United States Patent 9,328,346 (POLYCOMB-ASSOCIATED NON-CODING RNAS) - sequence listing, part 40

SEQ ID NO: 7052 - RNA, 29876 nt, Mus musculus
ugguagcaggccgcaugcgcagcuucuuaacggcgcgucuugccggaaagauggaguguccugcgcccgaugcuacggaugcugcggacccuggagaagccggaccguacaagggcuccgaggagccggagggucgggaaccggacggagugcgcuuugaccgcgagagggcgcgucgccugugggaagcuguguccggugcgcagccggcggggagggaggaaggugagucgggggcuccgggguuggcggcuggaccgaggcgggaugggauggcccugccuccugucacuccccuggcgcccgccagccucugcacgacguuccggagcugcgagcucgcucucgcgaagggugcuggaccuaguaacucguuacccugcggaauuuguccguccuccuuuccagggcguucacuugcgaacaguuuccccccauucuaggucuuguccucuuagacagcgacaggacuuucccagccugacucguaggcgagccagcccccgucccugucugucuuuaauuccacaacuccacauugcuucucuuuccucucaaagcccuaugguucugacagauccgaauagcuuuauuuaauuuacuucauuauuauuacauuuauuuugcgacgccucucacuguuccaacucgugguggaccuccugcccucauccuuccuagugagagggaggaccaacgugagcucuggaaggucuucuugaaucccagcuccugggcuugaugacugcguccugguuugccauguuucuuccuugguagacuuggcuggccuugaacuugcaugggucucccugccucagugugggcaucgcuggcuugcaccacuauguccuucaaaaccguauuucugugucuguugccaacagcuuuuuccacugaggaggcccaggaggcggggaagcuuagguauucaucuugccucugacugcuucaucucacacucgaugcagaguuguggagaacaguguauacucacucagggugcacuucugggcagaaccuuaccagauggcucuguuugaaccaaaacuggguggguaacaaggauacuagaggagugcagggcgagcuggccucuuucucuuuucagagucccuucccgagcuagcuacuuaauacuaacccaaauguacaagaacuguuaucuggguuucugugcuaaccuaucaggucccugcagagaagucuuucccugguuauuuugcuugcugagcagacuaaucuugggaaguuuaauguguuugugaacugcuugcccuggauaaaauugggauuuuuuuuuuuuuuuaccauauuaaagggagauauauuuaaauuuuuaauauguuuuuauuuuaugugaugaguguuuugcuugcauguauguguauaugaaugacagguacccaaagauauaagaagaagguaucauaucccccgaaacucgagguaccauuauaagcuaccauguggguguugagaacugaaccccugguucucuacaaaagcaguacauggccuuaaccacugaaccaucucucugaccccaagauacgucgaauuuaaguguaugcauccccaaucuaauacuguuaagucuggcuccuaauaaauguauaugccauuucugagucucuacuuuuguacuuuuaaacauuuuuuugagccaguugugguagcagauacaugucauuuucagcacucaagugguugagauaggaucaagaauucaagccagcuucagcuauauacugaguuugaaccaggcaguucuggcacaugcguuuaaucccagcacuugguugagucucuuaguucgagggcagccuggucuacagagacaguuccagaacagccagagcuacacaaagaaacugucucagggagggaaaaaaaguuugagagaagcaugggauaaauaagacucuugccucaaaaaaaauuguaguacaaaguugucuccuugacccagauuuccuuucaugaauuugacauucccagggccagcuggaccucagagccuuagggaugaagacgaugcuguucuuacucuggaguagcuugcaguccguccuggaggcaaacaccaaaacaguuguauaacuuucguuuuuuaaauuuuacuuuuaaugaugguucuuaaauguuuuaaccucccuuguaacccaccacccaccaaagguaguggaaaagaaaggauacaggggaaguggacggguuuagaaagguucuuuggaacaacgccugucuauguuaucuggaaaucagcaguucaguucacagguuagcagucgacagcagcucaguccacuugcaaacacgucauggauacaccagccuuccagucugguagagucggguuagcaacuguggugacacgaccuagcagagacagccaggccucagccucggcucgagucagcaggagggacagcagggacaccagaaguucucagcugugccucucucagggaaucgaagaucagugaagacaagagaccuacaaacauugcagcuuagcugugccagcaagccaagcucugucuccaucacuugauagaguccuauuuauagccucccaacaucauguguccuccacgugccuugccucagcacgugcauccaagcagccagagucugaggaguccugacagaugcagcucaacuacacaguguaaggccgaccaacacaugugagucauuagcaaagaaucuuucaucaugaguccuuucacgugcuugcuuuagcugaacauccucucuacugugucugcuucagcaaaauguuccuucacgagucugccuuagccuuucaccuguguccacuucaggaaaacacuccuucauguguuugccccagcaagacacuaugcgacacaacuaacuccaaagaacccuuaaauucccacuucacaguuauuguauaauguaaggggagaagggaagaggggugccucagaauaggagaugcagcaaagggcaguggccuuggggaagugugcccuggaccuuaaagcagagaacacagcagcugcuuacauacaugugagcauaauaauuagugcucaguucgugucccuguugaaaguucuccagucacacuuagauaccuccagcacuuacauucuaauuauaaaaugugugugcccaugucagaguacauacagauguguuagaucccuuggaacuggaauuauaggcaguugugaaccaacaugagagcugugaaccaaacucagguccucuagaagaaaaaaaagcacauguucuuauuggcuaaucaucucugcagccccaacucagugacuuuuuucuuuuuuuuuuuuagauuuauuuauuuuauguaugugagugcacacuguagcuguacagaugguugugguuguuggggauugaaucuuuaggaccucugcuugcuccgaucaacuccacucacucagucccuaugugcucaggcccaaagguucauuuauuauuauacauaaguacacuguagcugacuucuggcacaccagaagagggcgucagaccucauuacagguaguugugagccaccaugucuuugcugggauuugaacucaggaucuucagaagagcagucugugcucuuacccgcugagccaucucgccagccccugacuuuuuuucuuauguguauuuagagaguaugugguaccaugguguguauggaggucagagaacaacuugcaggaguugguuuucuccuuucccaauguggguccuugaagauguuacauuggcugacuuggaacacucuggguagaccaggcuguggccucaaacucacagaaugcugggauuaaagucaugcaccaccaugucuggcuaucuucuuuauuucuucuuacauuuauguauaagugugugggcauauggguguccuagcacuccuguggagauuagaagacagccugggguaaucagugcuuuccuucuacgguguggagcucaaggauugaacucagcaguucagaucagccuuggcggcagcacccagcccacugagccaugucaccagcucuuguguguguuuauaaacagugccuuuugaagcacaaucagcuucuagugcacgaaagagcguguggugcuuguuuucuuugccugucugcucucacuuaaaaucauacccugcaguuccauucauuuugcugcaaaugacauauuccaccguccuuuguggcuguauaguauucuacuggauauccguaccguguugucuauauucuuuuuauuuuguuuauuuguaagugcacacugaguguggacauggccuagcugcugaggcgguuugacacaggugcaggagcacucuccuuuggucaagugggcugcaggaaucaaacucggagucuugauaggcaacgggugccuuuguccccugagccaaaccaucagucucacgucugugcucauucuugugacugacuucauaguucagauggccaguugagcuacuucacacauggucaggcagaggucucaacaugcuaguuuaguucauuuuuuuaaaguuuauuuaauuguuuccaacaacucuuguuggcauuuuguaucagaauaguuguacuuggagcuggaaagauggcucaguagguaagagccugucuugcucuuccagagggaggcaaauguaguuaccaacaaccacaucaugugacucucaacacaauuaaaaauagcaaaaaccaaucuuaaaaagaaaacaggccgggcgugguggcgcacgccuuuagucccagcacuugggaggcagaggcaggcggauuucugaguucgaggccagccuggucuacaaagugagguccaggacagccagggcuauaaagagaaacccugucucgaaaaaccaaaaaaaaaaaaaaaaaaaaaaaaaaaaaaaagaaaacaguugcucugugagguucuaguucucuggccccaaagagaccagcagagagaaaaacacaagucaggauguccacucauaggcucaaaaccuuaccugucaguggcaauugagagaagcuauggaagaccagaguaugccagccaacagacuaaagaacucucauagccaguuaugguggccagaguaaaaucccucccaaaacaaaguuucaaaaucauguaaaaguuuaaagaauuaagguuuagagcuggagagauggcucagugguuaagagcacugacugcucuuccagagguccugaguucaauucccagcaaccacaugguggcucaccaccaucucuaaugggaucugaugcccucuucuggugugugucugaagacagcuuaaguguauuguauuguauauaaauacaauaaaaauuaaguuuuauauaugaaccaugcaagacuucuuagcacugaugcaaagcccagcaaugacacugcaguugcacaaaguggagggguggguuccaugcugcuaaaucaguggcagaaaggcucccacuccuucccccugcuuggucugucuguaugugugucuuucucucccucccuccaucugucuucgcccuccccaacugucucucuuucuccccacccccacccauguguaugucugucugucccagaaggagagcacuuagugccucggcauuaagggacacgugguccauuuugugagcagggaacaggguagagaugaguaaaguucugucuuggagcugggcugagugguaagaagcucaccugacauucacaggacccuagguguugggagguaggguaucagcuggucuaaccaucuugacuugguugcaucugaugaaaaaagagaaaaguaaagaugaaguuauucaaauacaccuaaaacugaaagccucacagcuggguaugguucuugguuuggucaguuuccuacacucuuccuguucaguaggacuccacagcacagugagguuuccuauagcaggagauuuccuaggcucuacuggcucucagcaaugcagacggaugcuuguggagagccagccguauacacuaaccugaaaguuaccauccaaaagugagggaucagauugccgcuuucccacuuugcaauuacuuggaaugguuguuauagccagauggugccccauaccuuuaaucccacacuaaggcauaagcaggcagaucucugugaguucaaggcuagccuggucuacauagcaaguuccagggcuacauaauaggcuagaaaauuggcucaacagucaaaagcauugguuucuuuugcaaaguacccagguuccauuuccagaacccacuuggcaguucacaacugucuguaacucuguuuccccgggauccaauaccuucuuuauaauggccuccaugguacacauacaugcaugcaagcaaaauauucauacacguauguaggcuuagauuuuuugaaaaccuacuuuaauaaagguucuuaaaugcuuaggccuucuuucuaacccagcaaccaaagguaagggagaaagagauuacuaggacaagggggauguggaccuguuuagaaguaguucuuuggggcgauuccaaucuucauugucaagauaucagcaguccaguccaaaacaucaaacacaaaucaauagcaguagcuaaaugaauuagaaaucacaagaguccucauaagugucaggaagcagccagaauaccacgagaaguucauuuuucucuacaaagucacgacaagggaauaucagugaagaccagcagagcauugcagugcaagucuaugcacaagcaccuuucacuaucugcuguguuauacuuacgcucucugcaaacaucacacauccuuucaagugucugccucagccaaacauccucucaauagaccucguccaggaaaacaccacaugacacaaccgagucuccaaagaaaccugaaauugccccuucacacaugaauaaguaauuuuuaacucaaguguucagcugucucauaaggaaugcaaacucaugccuuagguguguacuguccuuuuccaauaccuaucucuccucuaaugcuuaagucuauauuaaaacucuuguaacaaaagaaaaaaaaacaacaaaaaaaaaaaacaaagccaggcgugguggcacacgccuuuaaucccagcacuugagaggcagaggcaggcagauuucugaguucgaggccagccuggucuacagaguaaguuccaggacagccagagcuauacagagaaacccugucuugaagaaaaaaaaagacucuuguagaugucauuguuauuucagacaggaacucauuauauagcccuguacagccuugaacuuaacuacauagacuaggcuggccuugaacucagguuccccuggcucugccacuugaguguuguuauuuaaagugaacaucucuacauccugcuuuaacaccacuucauaguccccagauacaccagauacacuuuuuucuaaaaacugacggugcaugauguuaugggucuaucguuauaccuacgaaggcagaaggaucgcuugaggcaggaauucaugggcagcaugggacaaccucaucucacauaacaacaguaugacuagguaaagagcauuggccuguaucaaaugagcaauaaugcaggagguuuguaagcauagcaggagucauggcacaguggaacugaagggcagaucugcauacguguuaguaugguuuccauuacuuggugucuaugauagaucagagacagugcuauugcgaucacaucugucaaccuacaugauuucuuuucccucuguaguggaacacaugauccagaagaaccagugucucuucaccagcacccaguguaaggucugcugugccaugcugauuucugagucucagaagcuggcgcauuaccagguaggcaauuucuacugucuucgugcgcuuaccuuccaggcccagcacuaaggccucgcugcuucugccuuacacaguagaagcuccuugcacaguuaccagauguuuccuucauacguguuugcuagggcuugaaauugacuuaguuucugugacugucaucucgcccaugcaagacaguaucguuguaugcagaucuugccggacaacgugaugcaguaggaaguaugagcuuuggcuuuaccuagaccggaauuugaagccaaccccguuauucauuguaggcaagaaauuucaccauacuuggccuuagcuucaucuuguacacaauaacaguguuuucauagauuguuggaggcuaaauuuaauagcauguaaagggccuagcacaugguagggacucaauaaauaaaguuuucuucccccauuuucucuuccuuagaaguuuuugugaggaugaaucaguaagaaucugguauggccugauugucuucccuaugaaaugauguuuggcugucuuuuugcuggguucuugcagagcaaaaaacaugccaacaaagugaagagauaccuagcaauccauggaauggagacaauaaagggggacgugaagaggcuagacucagaucagguaacacagccgccuuguugacacugcuugcuucccgggcagguuuguguggugugagugugggcuuugauucagacugacuuggcugcaaaucccaguguugguaucuaacuugggcaagucuuauaacucuucagccuugauuucuuccucuguuaaaaaccaagcauacuucuaagcaugguggugugcacguguaaccaaagcacuuggaaguggaggcaggaggaucagcagugugagguuaucuuuggcugcauagcaaguuugaagccagccugggcuacaugacagacugucucaagacaaaaaacaaacaaacaagcaaaaaguauagcuaccuuucaggauuuuuccuaaguugagaaaagacuuauaaaacagugccagacucaaaauccgucauguagcaacaguucaguaaauggaccguuguuaggcuccgccccuaccacccagaggguuauccaaguggacagaguaaagggacacugcuguucuugaacuguggagaaaaacgaaguucagcauuuacuugacaaaugaggacaauaaaugccuucucugacacaacgcaguacacuuacuuuaucuuagaguugcuguaagaauuacagagaagccagccccaguuccuaagugugcugugccuuucagagugugggcauucugcacaacauggugagaaagucggugggcaaggcuccuuaacguauuagauaggaaaccuugagcaagucaccuuaucucucgggaagucacucauagcuugcucauguugugagguaaaacuucaguacccaggaaauggucaguaacuacgagauugcucuccagacugcugguuccuguuacaguggccagugguuuaaaggggccuugcgugccccuuucagaaaucaccuccuguuugcccuuaugguuuagauccacaggggcacggucauuucaccuuucugcuucaguuagaugacugaguagcuaaggugagaucacagcacccaccaccagcuaggaaucgccaagcccaaaccaucugcagugugaaggcagaaaaauguugaagagacaccuuguucagcggacauucuuuugaaauacacuuucuagcauaacuauaguaacaaguagaacacacugacguguuuuuucuaagagccuuggguaucuacugugugcuagacacagcaggguacaaggguaggaaacaaugagucaaguuauccacguccagcauugcacuuaagcucacauaaaaggcuccucagcuguaaugcuguccgucaggugacaaaggcuguaauaguagucugauacacucugggaacacaggugaggaacaaccuuaacucuuccuggauaagcacagcacaggccuugguaauuguguaccaauguuuuuaagguaaaagucacugaauggcugauagcagaccuaauuaaugccaggcaggaauaaggaggaacauucuagagaguaggaauaacccaagaaaauugaggaagugacagaauaaaaugggaaauuaugcauggagccugacgugaaauagcuggagaagacucuguaaagguauguuucaguuauguuguggguaacaugugaagguggucuuaaauguccaccagccaaugggcaguggggaaccauuggagguuuucuggaugggcacuggcaugaucagaccuguguucucucucccaaccagaagagcagcagaagcaaagacaagaaccacugcugccccaucuguaacaugaccuuuuccuccccugcuguggcacagucgcacuaccuggggaagacccacgcaaagagccuaaagcugaagcagcaguccacuaagggggcagguacugcgcuuccugaguagugcuuggggacccccucccauucucagggcaccauugccagcagucuacuaagggggcagguacugcgcuuccugaguagugcuuggggcccucccauccucagggcaccauugccaggugcuuccagaaugcucacuggagccucggaaugcagacugggacucaguuuucaggcuuuugagaguucugaaauauccaaguaugaguuggagauauaagucaguugguggaguacuucccuagugugcacagagaauacuucccuagcuuucauccccagccuugcauaagccagauguggugcacacuuucagucucagcacucacaccauggaggcagcuaccauauggaguuugagcaaccuggguuaugugagagccugucuaaaauacauacauaccauaauagacccugcuuuacugagauugggccucagaugugguucacuuuacuuccuuuugugugauucuaucagauguuauauagaagcuucuuagccuauaauuacuguccugagcaguaauuguaacucaggagggccaagggccugcugcauacugugagcauucugcugccugccucccucuacuuauucugucccaccacccaccuguucuuacugcuaagaguugccaguugauagcuaaaucauccucacagacucagguuaugcccugcucacuuugaccugcaaaggcugccuguucuaaaugcaggcuugccuucaaagcaggcuacucuagcaagcuguuugcagcugcugugaauccacuccccagcacugacuucacauucagccuucuuuguucucucgucguugguacagccgucacuuucauccuguuaacccugaauccugagguuuuuaaccuaggcuaacugcaguuagucaugagugggaggccacuggugugcaugcauguguguguguguguguguguguguguguguguguguguguguguguguguucguguguguauuauucuccaguuuggaccaagaccacgcuaguaauagaacuuuugauccuuuuguuuuauuucaucacugaagcaagacaacagugucuuagaagguuuuggagauaugauggaaaagucuacucauaguuauacccaaacguaguuauucauggucugaaacaguagaauauagauugagucagagcagcacagacuuaagucaggcgcuuuucuuuaccauuugugucuguacccucugcaccuguaaagugucagugccaccugcuuuggagcuugugaagaucauuacggcugcccugguacacaucgccauucccagcaugggaaagaggaggcaggaaggucaggaguucagugccacuuuggcugccagcuuugagaccagccuggccuauaugacacccaaaaagauaagaggcaaacaccccucacucaaaaaaugccuaggguacagcagauagucacugaacagcugucaucacuguuguuaccauuaaaaagccagugcauggagccucuuguaaaaugcagucauuaaucaggaagccacccuugcaaccuuccuaaugcugcggcccuuuaccgcaguuaauguauuaaacaggcccucgaguuguagugaccgcagcuaugaaauuaguuccguucauaacuguaauuuggcuacuguuaugaaugauaaugugaauaucuguguuuuccgaugcacuuagaugacccuugugaaaggggcauucagucccaaaggggucaugacccacaaauugagaaccccugaucuagagccugccauagaccuugaucaugguugaccuguugacuauggugaguauugauugauuuuugucuacgcugagaaccuguaaacagcacaugacaugugagcauuaggccaaggaaaaugaucuuagcugaguuucuaaugccacagacuuaccuucccauggugggaaaauuugguggaauaugacuucuccuaauacuucuguucuaaacaguaacuuaucuuccauauucacguccagccauugccacauguaacuuuguguugcaauuagugcaucaaccauguguauucugcuaucacuuuucauuuagccucauaguuuaaagauacauccauauuguucauggguuuacuauaacuccaauccugaaacugagcauuugugugcuaugcaagugagacaaacaugcuguagaaaauacagagaaagugccaggaauucccauaacuuugccauugcagacuaggugauguuaaccuagaguccuggguucuuacagccgugugcaccacguguguuuguguaccugcuuguauuauguuuguuuguuuucuguucauccaaguugacuccauauagaauauauaauuucuguuucuguaaaaacuaugcacauaugugaauaauuccaauucaacaugcaaaacauucaaagaagcagacaauauuccacccaagucuuacuucuagggagagcauugucagcaguggcuccugcuuauaggcauccuggcuacaagcaaguucaagaccaaccauauguuacacgacauacugucaugcauacguguacauaugcgugaaguguauauauguauguauaggugauauuuuuaaaugcuaguauacuuauauagguuauacaaaaaccuuuuaauacugauaugacuauauuauuauaauauauuaaaccuucuuauauauuucuucauuuaauauaacauuuccucauguuggggcuagagaaauggcucagcaguuagaaauguguucuauucuugcagaggucccaaguucaguucccagcaccaguguggggcaacucauaacccugguaacuacagcucuagagcaguccaucacucuggcuuccagggcacugcuccacaugugcacguauccauacaggcacaaaggucagagacaaucuuugauagcacacuuuguguaucucaaguauuucuuaagagaacgcucuagcucucgcuggcccugggugucuguuaacagcugcucuggcuuacagcucacugcguuccuccccuccaaugcggucuuuccuuaaacaauaguauuuauuuuuuauguauauggauguuuugucugcuuguaugucacuauguaugugcacugcccacagaggacaccaaaucucuaggacugagugaaguugcaggugguugugaagccaccauauuggugcuaggaauugaacccaaguccuuuggaagaucagucagugcuacuaagcacugagccaucucuucagccucacccucuagaauguuuuaaagaacaaccuugggcccacaagaugacucaguaaaucacaguguuugccacacaacccugggggccugcgucugacucucugaacccauguugaggggugaggagagaacuggaucacaaaguuguccucuaacuuccacacauguacucuggcaugcacacuaugugcacacaccuaugacugcacaaacacacacacacacguucaauaauaauaauagguuaaaaauguuuuaaaguggggacuggagagacagcucaaugguuaaaaacacuggcuccugguucaauucccagcacccacuuguguaacucuagccccaagguaucugaugccuucuucuggccucugugggcacuaauauacauucagguagacauacacauaauaaauagaugaauaaaauuuucaaaauaaucuaaaaagaguaaaaaaaaacaaaacaaacaaaaagccaggcagugguggcauacaccuugaauucuagcacucauggucuagaguucaaggccagcuuggccuauagaguaaguuccagaauagccagagcuacacagagaaacccugucucaaauaaauaaauagauaaguaaagaauuugaaggggcaggacgcgagcaaacagcucagcagguaaaggugccugcugacaaccugaguuaucccuggacucacgugguagaaucaccaugacgagacuaccugcaggucagccuuugaauuccacaugcacacauaaugaaucaauagaauauaauaaaaacuuaaaaagaaggaucuuagcuuuuauuagucccagcauucuuuaggcuaaagcaggaggaucuugcauuagauaugcuaucucaaaaucaucaucaucauaguuauuacaagccagacaucaugguucacuccuauaaucaauacguggaaggcuaaggccugaggauuacacuaaguuugagacuggccugucuccaaaaacccuugcuaucuaaaugacuuaguucuagauuucucucagaaaucuacaucaauuuguaagaauagagagugcugaagacacacuccucacucugugauuuugcaucucccacacaaucaugcgugguuuugguguuuuguuuuuuauguaagugaagcuaggcaugguaguacaugccuauaauuccaguauucagaggcaaagauugaggagugcugcagguucaaggccaacauggucuacauaucaaguucuaggucacuagggguauauagugagaauaaagaugaaucuuucuuuaaaacugaaaccaguuaaucagaguuaucccuggacucacgugguagaaucaccaugacaagacuaccugcauucaaaaggagaaagaaagagugcauaugguuaugcacuccuuuaaucccggcacucagaaggcagaggcagaugaagcucugaguucgaggccagccuggucugcaaagcuaauucaggggcagccagagcuacacaaagaaaccaugucucacaaaacugaaaaaaggaaaaaauguuuuauaaucuauuuuuuucaacucaauaccacaaacuaaacacucucgugaacuauuuuauaugugcuucacuuucugaaugacuugcugaaacaaagcccguggccagagaaaauguguugugaguguugucuggcuugcuacaaauccucagugguaagggaaaugguaagaggugggaaaggaccugaaagcccuuuaugagcucugcucaccugcauccuucucucccacggccaggaccaggggucugggcccuccacgucugcaguagugccuguaagguuaauaccauucaaacugaccacgcaaauuuguuagucauggcaucuacucuggaaagcagcuaucuggcccgcuuuaaacauuagcaccaacaucagcacucagaagacauacgcccauaccagacucugauuaacugguuucaguuuuaaagaaaagauucaucuuuauuuuuuuucauuuuauuuuuuuaauauuuuuauuacauauuuuccucaucaucuuuauuuuuaaaagugugugugugagccaggcgugguggcgcacaccuuuaaucccagcacucgggaggcagaggcagguggauuucugaguucgaggccagccuggucuacagagugaguuccaggacagccagggcugcacagagaaacccugucucaaaauaccaaaaaaaaaaaaaaaaaaaaaaaagugugugugugugagagagagagagagagagagagaguguguguguguguguguguguguguguguguguguguguguguguguguguacgcgcgcgugcgcuugccugcggaggccagagcaaucggaugccccugugcuggaggguuagaggcacugucaagccaccugacaagggugcuaugaauugaagucagauucucuggaagaacaguaggccuucuuaaccacugaaccaagucucuccaucccuugacuaagugacuucucugagcaggaucggaacguuuucugaaggcgaaauuggcagugguagcuggcagauccacuugcuucugucuugagccuuggggucccacggucuagaagucucucacuaacuuggugaucuugagcaaaucaguuuugcugucuaagcacuggucuucccugugauauggcaaaaugguaccuccuucauuggaguacuucugagaaccuaaagggaaacugugauuacaaaaugugucuugucccucacauuggcuagaauuuaguauggucuaacaggcaucuuggccagguguggugacacacacuuuaaucccagccugguuuauaucuugaauuuuagaccagccagggagcuacauagugagacccucagaaaaacuacaacuaaauaaauaauagaaggcauuccuaaucugcuugccugcuuuuguuuguacaggcucagagcgccaaugccuacuucagcucuauaauagguauuugaggauggagaugaaauauuuuuauccuucuuauccuaccugcuuugaauuccauggaauucugaggucuagagacugcaaguauacaaucagggaacugaguagcacaaugagagccucuucagggugugaaagccuuagggcucccgugccuagugcuggugaacaagucaguuguucauggagcucacugaggucuugccacuguugccaccuagagcauucauggugugacuauucacagcgugacuuugaggcagugucucaucccucugugguggguggcacugccuuccuuucucuugaaguguacucaaaaccuggacgccuucuggcuuguuguuucauuguuucuguuugaacucucuuaccacagcuuugucgaaacaccuuacaaauccuuuccuuguggccuccaccuuagccuugcagcagaauagagagaugcuagacccagacaaauucugcagccucugccauucaacauucaacgacccugccauggcucagcaacauuauaugggcaagagacacaggaagcaggagacuaagcucaaacucauggcacacuaugggcggcuggcggacccugcugucucugacuuaccaggugagaaggccccacucaugugcagaguuggaccaggaacugagcacuagauucccuggacgccccagagaaguacuguuuguugcauauucuaaagcaggguuugcaagcacagggagcagacaggcaagccagacaacauuugggagguugaagcgggaggaacaaggucaaggacagucuggaauacauaguaggaacaugucuugagaggaugcuggagaacaaacagaaaugggaugacaugguccagagacagcaugggcaguggaagaggguuaggcacuccuagccuacaccaguguugcuaccuuucagucuucaaaguucuguggaagccaggcaugguggcacaugauuagugucaguacucaggagauagagauagguagauuucagugaguguaaggcuagccuggucuacauaacacaauccaagacagccaguacuacauagaaggacccugucuccagaacaacaacaacaaaaaaaacaaaacaaaacaauagaaacccaaauuuguuugggaguuucuugugguuucauuaucauuagcuccauuucaaugcugggacgaaauauagggccuguacaugcugaucaaccauugccacugaacuacagucuccacuaagauuccucuuaguuuucaauaugugacuaaaguuuagaaauuuuaaacucugaguaaaacccucucuauaagucagauuuuggucaaaaguaccaguuuuuuguuuguuuguuuguuuguuuuuagauuuauuuauuuuaugaauacacugccauucuucagacacaccagaagggggcaucaaaucgcauuacagaugguugugagccaccaugugguugcuggaaauugaucucagguccucuggaagagcagugcucuuaaccacugagccaucucucugccccaagagcuaccaguuuuuaaucucugguuugaaggaguuuugguuuuacuuuuuugaaauuuauuuuuuggccaguuaguaugcacuuauauaucuuagcacucgggaaacagaggcagguggaucuuugaguucaaggacagccugaucuucauaccugguagggcuacacagaggagggcugggggagucaauuuuaauccuguaugucuguggguucguaagugcaggugcccauggaugagagaagaggguguucacucccuggagcuggaguuacaggugguugagccaucugacauaagugcuggaaucugaacucgaguccucuggaagaacagcaaguaaucuuaacugccuagcaucuccccaguccugacucugauccaaacuagguuacauccacauugcuagauugaaggccucaacagccuuaccagaguuugagcauguuuagggcaucucuuuccacagcauuugauaccuguaucccugggguaucacagugaaggagguggcuauccuaguuuccuuaaccucaaaaugucacuuggcggugcuggagaaauggcucagagguuaagagcacugacugcucuuccaaagguccugaguucaaaucccaguaaccacaucauggcucacaaccaucuguaaugagaucugacgcccucuucuggugugucuaaagacagcuacaguguaguuacauauaauaaauaaaauaaaucuuuaaaaaaaagucacuuggcaucacaagaguggacauucauaauuaaggaaccuucuuaguauguuuggaguuggaaaugucacuccauugcuggaguauuugucuaacaugcacacauagcaaugccuucacuggccagcagcacauacgcauggcacaauagcacauaccucuaaucccacguauguaagcaaucaaaucaauaaaaaugugaaagcaagcugggugugguggcgcaugucuuuagucccagcacuugggaggcagaggcaggcggauuucugaguucgaggacagccagggcuacacagagaaacccugucuaggcaaaaaacaaaaaaacaaagugagagcaaggaagacaaucauucuugugaugacuguagcacgccggucuguaagcucagagcagguagggcuguuuuaguuucuuugguuugggguugggauuuagggauuguuuaguuuuguuuucugaguuuuguuuucugauacagucucauagcucaugcuggccccaaauauuuuguguauccaaggauaaugaacuuuugaccuuccugcaucugcucuuuuuuuuuuuuuuuuuuuuaauuuauaugaguacacuguagcugucuucagacacaccaaaaguguacaucagaucccauuacagaugguugugagccaccaugugcuugcugggaauugaacucuggaagaguagucagugcuuuuaacugcugagccaucucuccagcucccccugcauccacucuuaacugcgcugauuacagggcugugccgccaugcuuggcauaaacucagccaaucagugggaaaagaaacaaaacagucuggacccaaagugacaucuccauucugccucuaucugugagcuccggaacauaggcucagccucgcaggucuucaggcuccugagcaagugccauuuccugcuuagucagcucacuuccccuuuguaucacuaaaugaguauuacuuaauguugaaugugaggguggccuuugguuuuccuccagugcucugucccugaaaguauacccagccuuucuuuauuucuuagcauuuaacuuuauauguuguaacugaucgggauauuuucgucaacuugacacaggaaaaaucuaagugcaggacuacuaacauuauaccaaggcaauuauaaggaaucuauaagaaaucugaacucagugaguguuagacugcuaguuaggugaagagcagacagucugccucaauaugguucucugucccuggcagaggucugucugcugugaaucagugaagacaguaugucccuucucucugcugugcauuccuauugaccccacaacacacaucaguagucagaucuagggagugguuaggugaggggacaccuaccugccaaguccuagcaugcacaggccuacagcaggaaaggccugggugaggugguaucugccuggacccagcaguuaggacauugaggcauggugguggugaguuccaggcaagccugugcugaggaaauaguucaaggccagucucuaaggcgcagucucagaaccuaacaaauucaguaaaguguugugauaccauaaacauuaaaaaaucuaguuuucgcuaagaaauacaucaagaaagcaaucuccuaauagcuauaaaaaugaaaauaaaauuaagaaagugaaagcuuucuuuaaugaaaaucauaagacugaucaaagagauugaaagggagcuagggagcuggcucaguugucucauugccugccccacaagcaggcagacucuagcacccacauggaugcucacugauggugcacaucuguaccacagugcucuggggcagacagcuggauccuggagcuuacuggccagccauuguugucaguugguaaucgcuagguucugugagagaaucuaucucagagaauagagagagcuacagaggaaaccaccugaugucagccucuggccuauacacacauuugugcacacagauacacacauauacauuguagaagaacugaacagggugacacacaacugagacugaggagaauugccucagcuucaaggccugucuggacugcagucuuguugaaugccagccugggcaagacccucucccaaaaaacaaacaaguacuaccaucccuaaaauggggauauuuccuguguugguaaaauuaguacuaaaauaccaauaguacagccgggcguggugacgcgcgccuuuaaucccagcacuugggaggcagaggcagguagauuucugaguuccaggauagccagggcuauacagagaaacccugucucaaaaaaccaaaaaaaaaaaaaaaaaaaaauacccauaguacuguaaagugguuuguguauuuagaauauuucauauccagaugccaguaacaguagagaaauguccuguaguguguauggcaucacaugugacuucuagcagcaaaggcagucuuggaaaaaaaaaaaagagcaaaacuugaagcauuguaaauacuacaaaguuguauugaaccaggcauuguagcacucaucuuaaucccaggacuugaaagaucagaggaggaagauugggagucaaaggucauccuuggcugcagagaggaucgagguccgcugaguuacauaagacccccaaacugcccaucaucuguaauccaguacuuaguggguauaggcaggaaaaucaggaguacagugccaguuuuacaaaauaguagauuucauucugacauuuuuaugcacaaaucauuauaauccuuuaauccuccuugcauguaccaaauacuuuuucauuuucuguuuuguuuugguuugguuuuugguuuugucuuuuuugagacaggguuucucuguauaguccuggcuguccuggaacucacuuuguagaccaggcuggccucgaacucagaaauccaccagccucugccucugccuccugagugcugggauuaaaggccuggcuauuuuguuguguuuuauggggcagagucuuauacagcucugucugucuuggaaccuacucuguagaugaggcugcccucaaacucacagagauccaccugccucuaccuuccaaaggcaugugccacuucaccuagcucaagugacuuuuuuuuuuguaauaauuuuagacuguugaaacacauaguaacaguaaugcauuuuacaucccuggaacucaaaucucagagacacuccauuuucacucacaagagaaaguaagcugugugcgcagggaucucaccacagagcugugagguugaaggugacagguggcucaaaggcaccagagccacaagaaccuucaagauaucugaauucugcuuauccuacacaggauaaauaaguccaaaauaaguccacccuucauauaauuggucagguuggcuacuuucuacccuguccuguuuuuuaucuacauauauauuuuuucuauuccauauauacauauauauaaugcagcugcuauucucauaggaugugaaauaagcuaaucaugauaguacaugcuagaagucuugacacuugggacguagaggcugggggaacagaaguugaagccuaaccugaacuauaugaaaugcuaucuguaacuuuauuuuuuuuuuuucaaaaauaacucuggaaaaguuuuauuaaaggaaaacauucuuguuuucuucucaccagucuguucuggcgugcuccuaauacugucagaaucaccugggucagugauagccagugugcguacgcuguaguguuuuccacacccugugcccaguucaguauuauugccacuguagugauggacaccaguuuuaguccacauggcauagaacucuauuucagauuuccucaaagcugggcagcuguuggugaggauaaccaacuuugcuuugcccugucugaucaucuucagagucuguuuguucccuggcacguacuuuccacuuuucauaacaaacuggagccuagaguugaccgacuccagagacuuuuucaucuucuuuguggccaccaucuuccugccuuaggugcggggcaacccccaaccaagaucagcugccaagacggcuggggagugagaaaggauuuuuuuuuaauuguauuuuuaaugaugguucuuaaacacuuuaaccucccuuguaacccaccacccaccacagguaguggaaaagaaaggauacaggggacguggaccuguuuagaaagguucuuuggagcaacucccaucaguguugucuggaaaucggcaguguaguucacauguuagcagcucaauccacuugcaaacaccucagggauacaccagcaguccaguucuguagagucagguuagcaaacaggaaucagcagcaguggugugaggcagcaggagggacagcaggaacacuagaaguuaagaugcgagacccacaagcauugcacagccugcucuauaagcaagccaagcucagccugucacugcuugucaaguccuauuuauacccuccaaauaucauguucgggucuugccucaggauaugagucugucucagcuggcaagaaacuacagcacacaaccagaaguuuuuugguguguuucucacuauggaguccugacaaauacagaucaacuacucaauguaagguggaccaauaacaugcaugccguuagcgaagaauccaucacauguccuuucaugugcuugcuuuagcagagcauccuuucuccuaugucugcuucggggaaauguuccuucaugaaucugccuuagccuuucaccuuuguccacuuuaggaaaacacuccuucauuugccccagcaaaacaccaucaaacacaacugaguuuccacuugaacuaucucaaaagaaauuguaagaaauacaugacagacauuugauacauaguaauugcuuuggccuggcgugguuaugcgggccuauaauccuggcacucaggagaccaagaaaacaaaaucaccauggcuuuacggccagccagagcuacauaauguagugagaucucauuucacaaauaagauaauaagagcccuagagagauagcucagcaguuaccaccacuugcuggcauuacagguggcuuauaaccaccucuaacuccaguuccagaguauaugacacucuucugacaucuugggcgcuuggacauauaugugcauacaagcagacaaacacauaugaaucaaaauuuuaaaucccagggcauaacuauuuuacccuaaguauucugaguauagagaguauaauaagugggacuggagagauagcucagcuguuaaaagcauugacuguucuuccagagguccugaguucaauuuccagcaucuacaugguggcuucuauaguuggaucugaugccaucuucaggugugucugaagacaacuaauuauaguauacucauauacauaaaucuuuuuauuuuuuuaagauauaauaggcuuaugguugugaaaagcuaagcacuggggagaaaaggauuuagucaaguuacaugaaacggccagggauccagucugaccuacuccugacacacuauuagagccauaugacaaaaguccaccaugucacuggaggaaacccaguauaaagagacagacugagucucauaauaguuuguacccuucgacugcuauuacugcaagcccaaggagaguggaccauccaagagaucucucggggcuggagagauggcucagugguuaagagcucugacugcucuuccagagguccugaguucaaaucccagcaaccacaugguggcucacaaccaucuguaauuaaaucagauacccucuucuggggcgucugaagacagcuacaguguacuuacauauaauaaauaaauaaauaaauuuuuaaaaauagagagagagagagaucucagugaaggagugcucuuaaugaggccgcuuagcaaaggaagaauugaagcaaccaucaucuuuguucugugguuguuacuauuauauuuauucguguuguugaggcagggcacacauugcggcgcacaugcgaaagucaaaggagucagcucuguccuuguaccgugcggguccaggcacugagcccaguucaucaggcuuggaugugcuucugcacccacugagguaccucaggagcuuacucuccgucauccuuucccucucucagucccaucgagugugguuguuugcuggauuacuugagaauaaggagcagucccagggauaguguuacacggccuugccuccagagcacccaggccucucaguuaguuccaagccauggguccucagaagggcuugugcaugcucugugcaaggcagcauuccucuggucccuuccugcugggugacuaacucucuucauuuugauguguguuucagcugggaagggcuaccccugcaagacguguaaaauagugcugaacuccauagagcaguaccaagcucacgucaguggcuucaaacacaaaaaccagugaguaaaguccuucggaaguucacuccagcaggagucuaggguuucugagucagauccuucccgccauagauggacggacuccgagagccuucucagucagucaccgcggugucucgugggucuccuccaucagcccuucagcuagcauuugcacugacugagagcugcgggagagaugcauaugcgauuuccuuuaugcuuucaaacagugccuggauuuccuggccugcagcaaccugaagagggaagcaugguuucccucacuggucuggggccaggcugagucacaugugagccugucuaaaaacaaaaauggaaaaaccuuugcauaaucaaaauuauuauaaagaaauagguggaccagguggcacaugccauaaucuaacgcuuggcaaguaaacucgagagagccagaaguucaaggccaaccuugacuauguggacaguuaguuagggaccaaaaugugguccaugagaaccugucccagaaaacagaauuuaaaaaaaaaaagaaaaaaaccugagcagugguggagcacauguuuaaucccaguacucuagaaacaagcuuccggacagccagggcuucauaagagaggagaggagagaaaagaagagaaaagguugaggcaggaggaucaggaauucaaggucaaccuggacucuacuugcaaaucugagugaaaaccgcaaacucgccaggcagugguggcgcacgccuuuagucccagcacucaggaggcagaggcaggcggauggauuucugaguucgaggccagccuggucuacaaagugaguuccaggacagccagggcuacacagagaaacccugucucgaaaaaccaaaggaaggaaggaagaaagaaagaaagaaaaagucgcaaacucagauguacugggcuaugcucagcauccccgcacuacgaaggcagagcuguagcucccugggcucacugggcagccagugcagccugcuuagcaagugcaagaccagugaggcagaccuugucucagaaggacauaagcaccuaagcaauaacaccuuagggccauccucagaccuacacacaugcgcgcgcgcgcgcacacacaagaaaucauguuugaugaagaguaaaugcaucucaagaucauguuaagcaagacaagccaaagucagagaaacgcauaaagucauggcuuucuccccuccuuugcagauccuaaaugucuuuucuuuucuuuuuuuuuuaagauuuauuuauuauauguaaguacgcuguagcugucuucagacaccccagaagagggcaucagaucucauuacagaugguugugagccaccauaugauugcugggauuugaacucaagaccuucggaagagcaguuggugcucuuaaccgcugagccaucucuccagcccagauccuaaacuucuaaauaaauauuuuaagcuagucgauuaagcuuucugaaguucagcuucauauggaaaaugagaguggucucaccaugcagaauugacuugaaguugaaaugagauacccuaguauccagggauccuccauaagagggaggccaccaugccauugucccagcacaugagggaagccauaccaccauuagaacaagcuacugaguguacccucauggccaugccacaugcucacccugugucuguguuuucaaauuacaggucacccaaaacauuggugacacucgggagccagacgccagugcaaacacaacccacuccaaaggacucaagcacagugcaagacuaaagcugucccugccuggucagccuggugggacagccauaagccaguuccuggugacugcuuagccguggcuccuuccuccuccucucuuauauccgaagaauguggaggcaugaggccaacuugggcugcagaucugcagauagccugacugcgcccagaugcagcuccuccugccccucuugagcauggcccuauaggccauggcaggagacagggcucugagaagaccugaggugaagguuuagagguuggccuuccccaccccucuggguguauguccuacagucccgaugucuguuuuuacucucaaggucaguugggagcaagguccugcagagaagggagagcacugucucugggcuccaggcagcuuuguguagaaauguggagcuaaugugucauuuccuaucccucaagugugcaggcuugcuagguauagauccugccaaccaugaagucucccagaaaacagagucuccggcagagcacugccaucuccgcugccugcugucucuccaguucccucguggugcuaggcagcugcagcagcucggcgucagaggagacuugagugcccacugggguccugauaggcaccuaagggggugcaccaacccagggccaugugagaaagucuccuaccugcuauguuccuugauucugugcccuuguagguaacugccuccugccagccuacuaaaaggucacuugguguuagcucuaugcccuuguguagugggcgauccuacccaguugcuguggugcuaucccucccuugaccuccucaagaagauucugggggaacuaaaaaggaauuuagaacuggugcagguucuacagagagcaauaggguccccagacccuaaccugagaaauuccuucuggguuuguguccugggauccacugcaguggguuuauacauaacuguggauggagcaggucuuccaggaaguauuccuaaagcuuguagagauaaaacagcuuccuuguuagugucauuggguaccaaguagagauggggcagggcuuaaacucuuguucuuuggucacucaaccaagaaaaaaaauuucuucugugagucaugcuguaaccccagggcugagguugauacugcuaugacauccccacacaguuggcccccaguguccuuaauaacaaucuuacccaggaaaggucucccugcugcccuaagcccaacccaguucaucccccagcuaagggauugauucuugagauagucacucuggcuacugagugggggacugcgaagaggccagugugaaaacuguguccauacugcugcuggucuccagggcacucccuucaggguagauguccaggauguugucuuaagugcaggaugugugagugacugggugguagugcugaagacagguguccuuucccacuccacuuaaagagcugucggaguuuuccuugaaguccuccuaggccgacugguccuugggagagccuuuuauuugacucauaaguaacaaggcaaagagcguuauagcuuagaaacucaugcagaugggccagaccaagcaccaccagccccagguccuuguagcacacugcucugggcaccagcggccccuagcuccugacuuaagcucuugacuccuggcauugguucucugcuuucagcuucccaacuguaggccuccucagcagucuuccuagaagucugugccagaacuggugucagaauuaguaaagagcaugaaguagggaaccaaaggguaaggcccugaaugggcugacugaccauuagcccuugucuuggaagaccucuguguuuaaauggauucaggagucccuaccagcuucauguccagcacugcgaguauggaaacccuagaaguagcucgcuguugcccuuuggaagcucacacacuuaaaaaucaugauuuggagagucucauggggcaagugggaguguccaggacacaagcaauaacagcguggaguagaaggcugagagaaauggcuggucucuguggcuuuguuucauguagcccaggcuagucucagauuugucaucugggaggcuagccuugagcugcuugcugacccucccaccucugccuuccugguucugggauggugggcacgugcccccaugucccacaucagcuuucauccauguuauuguggguugcuugguuugcuuugguuuuucaggauggggccucauuguguagcucugacuguccuggaacucacucuguaggccuugaacucagcuccaccugccucccucccaagugcugccauuaaaggcgugugccaccaugccugaaugagagguuuuuuaauacuaucuaguaguccuuuauuuggaucagucacaaccuagcuuuguacuguugaaaucguauuguuucccuuugagguuaucuugaauaaagcugcuguaaaaacugugucauccgaugugugcgcucuuccacucagagaaggggauggacaauggacacuucuuaccuuguuuuuuuuuuuuuuagccagugguucugguguuguucaguucguaagggccccaguuccuacuaaguauuuccagucuucaaaguuaguuguucugacggcaacccagaaguuguacccaggggcccagucuuuuaauaaagagcauucuuauuucagcauuaaaacaaacaaaaauagucugucuuuguauuguggcuguucuguaaccuguuaaaccugcagauauccaccugccucugcuuccugagggcugggauuaaaggcaugugcuagcuuu

SEQ ID NO: 7053 - RNA, 2760 nt, Mus musculus
cgucacgugaccgggcgucccgccucuuggcuuccagucccagaggugcuguuuggaguuagcuacgaggaccccagauucagucgguaaccccggcgcagcggagcuucgggcgcagcggcggucgcgcgggugagcaccgcagggcucugcggcgcgguggagggcgcuguccgcguccccgcgccgcggcucugcaaaggacggagcgccccgggccgaggcgccaggggccugcgaggugcgaggcccuugggguuggggucugaggcuugggcucugccugggccgcgcggacccugaagugggugaggcggcccagggagcaugagcgggcagcgcguggacguuaaggugguuaugcugggcaaggaauacgugggcaagacgagccugguggaacgauacgugcacgaccgcuucuugguggggcccuaucagaacgugagugcaccccugcggagcaggcaugggaggaagggguccggccaguauuccacacuuaucucuucccugguuguagaccaucggggcugcuuucguggccaaggugaugugcguuggagaccggacggugacucugggcauuuggguaagucccuugagaacagagucuugugcaaaccugucucccgaauuuaaugucuugccucuuaaaccagccaacuggagccucauagaggucguuuuuccuuccucacacccauuuacucgucuaaaaaaaggaggggggguugucuggaagauggggccuauuuuguagucuugugaaggagcuuauuaacuccuuucaccccucaggacacagcagguuccgagcgcuacgaagccaugagcagaaucuauuaccggggugcuaaagcugcaauugucuguuaugguaagggguugaauucuggcguguucaaguaguaaggguuagguuacaggccagcaucagagggaagccgcugaucuuuaugugucucuugccuuacccuuaccaagaccucacugacagcagcagcuuugagagagccaaguucuggguuaaggagcugcgcaguuuagaagagguagguggccagauaucacaagaguagggacagagacuguauuggucuguggagauaaucucagccuugucuucugcuacagggcugucaaaucuaccuguguggcacuaagagugaccugcuggaggaagacaggcggcgccgucguguagacuuccaugauguucaggacuaugccgauaguagcuguuuuuaagucucugaggaugggggcuugggggcggguacuaucugccugaguguauuucaaagaugggaaugacagucuugguugcuuucuggccuucuugaaccugugugguucaggagacugaacuguuagcuacauuuaggugugcuccccaagugugaagacagucacuucucuuugcagauaucaaagcccaacucuuugaaacauccagcaagacaggccaaagugugggugaguguugucuuggguccugucagcaggaacaggcaggacaguagagcagaaagguucagagggcugggccacugggauacccagggcugcuggucucaggcccucacugauucuuugcuugccagaugaacucuuccagaaaguggcugaggauuacgucaguguggcugcuuuccaggugaugacagguguguacuuccucaugguccccagccuucuuggugaccuacuugaugccccgacauaauaguagugcugagcagucaccucuccucucuuugacagaggacaaagguguggauuugagccagaaggcaaacccuuacuucuacagcuguugucaucacugagucaccacucaucuggcccaguggaauuagaugaauucccagaggggcuggaccugacucuugucugggcuggaauggucaagcgucugagcuauuccaggugccucucacagcagagguggcaccugccugugcuggcccauggaacggaggaaguauugggcugacugugggcaugaggaggaguaagggcugacuugaaucccaggcuucuguccagacuauuuaaguagcuucugaacuguaaauaaaauugaugcauuuccuugcugugugcacugggugucaaaacaccuaguuguuccuggggccacgugggccucacuuauaugaagacuuccaucuggaaccaaguaacaguuuccuaagacuaucacugaaaccauggauaaacaaugggcucuuuuucuuauggccuuuuuauuagugcuuacaugucugaguguagagcaaauaccagggcuucuaacauacuaggcaagaacuauaucacuuuuuuucuuuugugggggugaagauagguugaggcugggauggaaaaguacaaaguucaggagaagacgaaggaaagcaccucagcugugcccagagacaaaaggcuuggguacaucaaccucaagacgaguugguuaggccagcucuaccuguuguguuaugucugaaccugugcucaggggugugacucaguccuaagcuucccagugaaacccuauaauguacgcaacaagaggcaacuccaucuuucuauaacucaaaaaggucuuaugcauccaauuuaguugcuaacuuagaaaaaggccuugaagcuuccaaaccuuuacucacugcacucuagaggcagaggcagcagaucuccaaguuuaagaccagcauggucuacagacugauucccaguucagccaggacuacaccgugaaaacuauuguga

SEQ ID NO: 7054 - RNA, 19066 nt, Mus musculus
ugcauuucguuggccugcaagccuaacgugcugcuccaugauugguuggauccccuugucgcucaugagaacccucggccguggccggcugucaggcgaccaggaaccuccaaaguuauggagccgcgcucuacugggauaggaggcuggccagccaauaaggcugccaucccgcuggcggcgaggcuuuccuucuuaacucuccugugauccuaguuuggagggcuuccggccggagaccauuagaaaagacacccggaaggcggaagucuuagggcggaaguggccgagagaacaaggagaauggcggccgaggccuggcuuuggcgcuggggcuggggcuggggucagcggugcccagggaggccugggcuuccuggccccggcccgagccccacgacauuucuacauuugcuucuguugcuggggccgguggcugcggauaucaccgacggcaacagcgaacaccucaagcgggagcacucgcucaucaagcccuaccaaggugagggaggccuguagcugagggugaggacgcgggccgaagugggauggaggagggcauggcccguucugucgagcagagcagcgcagcgcaguagauuucuggcgcggcccucugagcaccuguccacguccgucucugcccacaggggucgguuccaguuccaugccgcucugggacuuccaaggcagcacgaugcugacgagccaguacgugcgccugaccccggacgagcgcagcaaagagggcucgaucuggaaccaccaggugaggcucucccaagaggcugaacaugaccguucacugacacaguagucccugccucgucagcaaccaagcuuaguagauacacgugcuccuuuuuuuucuuguccugccgauuuuucuguccuggucgcacagaucguucagagcgacuuguauaguuacuguaugucagaaagugugcgugacucuuaaaacacuuucaccucuuucuucagaaaucacacaagguaaguaaugaugucugcuuuuuugauggcuuacgaagcaagaagccaaggugcagaguugaacaucccugaagucauagaacaagaaaugaguggaguugucagacuaaaucgaacccacuuaaucgagggaagggcgaaacuuuauccuuacggccuauuuuacuguguguaggguacugaccuugccaaaccuuaccagauuuaguucucaaacaagguguuuggaaugaauagauuucgugacuuuaugcugagguaguauauagccaccgaauagaauaaacaguauuucaacugaucuuucugaucuccacucuuaucaauucccuugauacacccgaugccuccugguuagcaaugggagaaccccccuucaagauauuuaacaguccuaguuaccuuucucugugcuagguugagagucuuguuagcuauaucuacacugaacuuacuggcuguggccuuugccuuuagagagcagggagccagagauguuauugccuuggugugguaacaguguugugcaaugucuacaccaaggaguguagguuguccaaggggagaaaagaagugauuuagggauaggccauggcuugaaaagaaaccugcuucucucuagccugcuuggucuaacccucccuucucccucuacugucagcaguggccuaguuuucuccaucacuguauucucuuggcccuucugguugauuuugccauuaguucugggagacuacacuguccuuguguugccucacuuggcucguccccgcagcaccuccucucucccugccuccugccuccacagugcugcuaggggcgucugugguuacccucuuccuucagcuuuggcucugucccuuagagccugagcucucucaugaauggaaaacuacauucucucagcacagcgugucccuccaugacugacaucuccagucauucugucaguuuguuccagccugucugccugguugccuucuucccucaggggcuuuggucuugcucacucugucugggacagugccuccugguucuucgugacugcuccuugguuacuucucaucuguuacgucugcguucaaaugccacgcacaccaagugcucgauuaaaccucauguccccaagucgcagucugucacaucauucuggcuaggcuuuucagauacuuuuuuuguucuucccuuuuuauuuuauucuguggugcaauagauugaacccaggaccuaugcaugacaggcaaggcaagcguuucacuccugaacugcacggauaacuggagugcuacuuuuuuagguggugauguagccuuguguuuuucacauaaaugaguuaauagcauuacauuuuguuuuguaaaaagcaagauaaaaauauuggccgggugaugguggagugugccuuuaaucccagcacuugggaggcagaggcagguggauuucugaguuccaggccagccuggucuacaaagugaguuccagggcagccagggcuacacagagaaacucugucucgaacaccccccccccacccaaaaauaugauagaacuuuuaggaauuggguuuauccacauguaacagacacauccaagguaggaaucuaacuuagguuuguaaguagugggagguuagcauggugacuuggugaugucauggaccaagggcauucugcgcuugcuuuggcugcguuacacccauccuuucuucagcuccuggacuuuugcugcuggacccuaaugguuuguaaauaauggauguaaauguuuggguggaagccgggcgugguggcgcaugccuuuaaucccagcagaggcaggcggauuucugaguucaagaccagccuggucuacaaagugaguucuaggacagccugggcuacacagagaaacccugucucgaaaaaccaaaaaacaaaaccaaaacaaaauguuuggauggagagcauuuauaguucuugagagaaauugcuuggaacucuuagacguuucuauuuaauguuuucaaagaaauacauccuccugacagaacagccaaggugauuucuccaguuuuguuuuguuuguuugagucucccucauuuguauuccaucugggagaggcacuggcugagcaaacauuucaugaguaccccugccuucugagcuuccaagugccugacgucuggaacacagggcauggagggcugaagaggccucugcuugugucgggguguguuuugugucgggguggguuuugugucggguguguuugugcgaaaggcagcagcgggggucuuaagcuucugaauuuguuacugugccggcucaaaauuguguacccccucccucuuuuuaaaaguugaugcagaggcuggggaggcagcccagacuggggaggcagcugaguggguauauaguguuggcagcacaaguguggggaccugagcucaggucccuugaacuuaggugaagagccuggugccuggcuggcuguaaucccagcccugaagagacagagaccagaggcuccuggagcuugcuggccagccuguuaaggagcucaagguuuagagagagggggaaacuuucuuuaaaauaagguggggugcuggagagauggcuuagcaguguaagagcauuugcugcucuugcagagauaguuuuucugugugccugaguguguguuccuagcacccacauugagggccucauaacugccuaaaucacuaacucuaggguauucaacauccucugacauuuucuggcaucugcacauacauauaaauaaaaauuuaaaaaaaaaaagcacuccuuccccugaagaaauugucuugggcuuaaauauccgcagagggcugagagggauaguuaggugcuugucucggcccuggguucagcucccagcauuaaagaaaggcuuaaaggauguugucuccugcacgccagauagugcuguuuuauagcaagacugcuuagauggcacuugucucuacugucagcacucaggagacugggaaaaacugcugagaaucugauaaggacagccagagcuaucucugacaggggguggagggguggggagggggagaaaagaagaagaggagggaaggaggaaaaaaugaaccaagcaaauaaaaaauaugaauaaccuaaacugaacaucgggcucuguuuuguuuugagauggucucguggcucugguuggccucacacuuccuacacagcccgggaugguuccugauucuugaucuucugcucaguucucacuugccgacaguacaggcuguaccaccaugcaccagugcacauuggggggugggggguguuguugcagcuguguguauaugcauucggaggccagaggucagccucagaugguguucuucaggggccggcgaccuugguucuugagucuuacuguccuggaaccugcucucuggccgaugagugccggcaugccccugucuccccccccccccccccccccccagcacugggagcacaccuguguggcgccgggacaggcucucuuuacugcggggucugcagccaagcagguccucaugguuugcagggcaggcacuguacucagcuggcuaucucccuagcccacacuauguguuuugauuuuauuuuagaaauauagcuagcucuagcuggccugguacaauagcaagguagaccaggcuagccuggaacucagaucugccuucuucugacucuggagagcuggaauuaaagguaugugcugccgugcccugccuaccaccuuauuuuuugagacagggucucuaauugaaccuggaacuugccauuucaucuagacugucuagccagcaagaccucaggaucugccagcucggugccugcagcuuugggcgcccugugucugcuuguacgugggugcugggauccaagugugggagcuugugucugugcagcaggcacuguaugcccgagccacaucuuaccucagcaccacacacugugaacagcugcugugagauacacaucccugugugcagccucugagagagaaaguguuaacuuaauacacagaaggacuuguaguagagcagaguagccugccauaccuggcuuuugucuguuauuuugugagauaaaguccugauuggccuugaacugugaucccaagugauccuccugugccagccuucugaguggcugagacuacagaugcuaucccuguaccgaccucuucugauugacuuccgagaggcaggggguagcaaguuuaaggccaaucagagcaacuuaguaaacccuuauuucuaagauuaaaaaauaagaacuggcagccaggcagugguggugcacaccuuuaaucccagcacuugggagacaugcaggcagauuucugaguucaaggccagccaggucuauagagugaguuccaggauauccaggacuacauagagaaacccugucucgaaaaaccaaaaaccaaaaccaaaaaaaaaaacaaaaaaaacccauacauacauuaaaaaagaaaaaaaaggacuguggagaugguuuguaagguaggaguaccugcugcucaggccuggcaacuugccuuggauccacagaggaaggagcacacugacucccaguuuucucuacuacagucaaguguuucccacaaauaaugauagauagagguuagaggcuagaaagugaguuccagcaaguguugugcuccuccuuagggaagaaacgggcugucugacacugcauucaucccagcucagcagcagugaaugaauggauaaaugaauccagagccuagauuuggauuucaucucacucugacauaucagggucagccuucucucuuacugguuucucuccccccccuccccccuuggucuggacauuucuuacucauuuucccucuuuaaaauuuccuuuugauaauucccuuuuaguuugugugugugugugugugugugugugugugugugugugugugugugugugugugcauuaguguauuucuugcauguaugucugugugagggcguuggguccccuggaacuugauuggaggcaguuaugagcugccaugugggugcugggaauugaaccaggguccucuggaagagcagccagugcccuuaccucagagccaacccuccagugcucacuuugccucuuauuagucuggaaguuguuugcuuguuucucggggcuuuauuguuguuguuauuuauguuugugcuucugugugugugcaaacguguacaggugccccaucggauccccuggaacuagauagaguuaggggcaguuaagggugcugggugcugggaacugaacucagguccucuggaagagccacugcucuuuaccugcucagucauccauccagccucuuguuuuucaguuuguuacaguuaucuugggcaguaggugcccagaaggcaggugcuauaggugucaagcgcuuaggaggcagaagcaggaagucugcuugcucaagccuguccugagcuacaugccaagacccaagaaccuguuguaaagugacaaggcugggggugcccaaaaccugccuuggaccuacauacgacacugcaaaaauaacccucuccaaacacagcacgaacacgcacacgcacacucugccagagucuaaggauaaugugugccuuugcuuucucccgggacagugcugggccuuagaucucuugguucauccuguggccgaccuuuacuugagucuucuucugugaguggugcagaacugugcugccagcuauaggugcgaguucugaacugaugguuggcucuuccuucuuccugagccucugacuuuccgcguggaucggaucacuuuccuucuccaggaagauggagagacacugagagggcugcuggccguuugugcuucuccguguuuugcuuuccuugucugaaauugucugcugccgacucuuagcuccuugaaggggaucugguacugguuuaacuucugguugcauccuucuguaaucugguugcauccuucaccucaagacgacaggacauuaugaaguuggguaugcuggcuuaggacuugggaguuagagguagggagaucaggaguucaaggccagcccuuguuauagauagugaggucuagagcagcucggacucucugagacuuuguguugucucaggaccaacaaaaacaggcuggagagauggcucagugguuaagggcaugcuuugcuccugcaaaaggccugagcuugcuucccagcaacauuagacaggacacaacagccaguguaauccaagccgcugacugccaugacaauaaaguacaucuuuuaaaaaaacacaaauagcaucacauuggaaauacgugaaaaggagaaagcacagagagacuaggagugaccaguacccaccccuggguguccucggagaggucaucuuuuugagcagguucauaguguccggauggaaccuaggcaagcgcuacaaccacaguucucaguaugccacuguuaggauggggcguacgcucaguucgcauccagaauguagcaugucguuauucuccucuggcuguagaacuguugggguuuaacagaucucugcugcuuugguccagucuccugugucucaauuuggaauugaauuguuugugccuuuuacucugggaucuuacugucaauuuugaaucuuuucuccgcccccugcaccauucuugauauuugucugaguaaccuuggauauauuaucucuucaucuguugcuaaguuucucccuuauauuaucauauauuguccugaauguuguuucuuagugaguuuaagaauaccacuaaccugcugaauacucauaauuguccuuggacuccuuggcugugguuacugggagcucagucucugaagccccugugcuuucauggguuucagccccaccuugucccuuuggugucugguuacuugucaucucugcugaaauuggcagagucacuuaacccuaauuccuggaagaggacccaacauggagcugagucccucccuggguggaccccucuaguauccuuucuuuuagauuuuagacucagacaaggccuccgucucccucggcagaccuugggucagacucuuuguccugucuuuguggcuacuugucaucaucucuuagcugccucuucccaguccauggcugugcccagaccagugaaauuccagaacuggggaaguugucacacagguacuuacugauuccuguucuguggccagggugguuccccagugucugccaggucacaagcugaugaaucggucagugcaccagccacacugccuguggugggacagaguauauuuuaauuucuucauugaaaugcuccugguuacaagagaaauguuucauugugcugucaaguuccuguuugucuucucuucccaagccagggacuguuucccuuugggaacuguacagacagugacaggaccaccucuaauugaacaccuggggagaguguuguucauggcuaagaacacaagagggagagacacuggaaaauuggcaucucaaccuugaggaucaggaguuggagggugggcuugaaagugcagaaaugcuuuguggggaguggauauuuuccuggguguugggcacacagccuuuuucacuccuucuguggugccucggauguugccauggcugcugucagccaugcaggcccccagguugccgccugugaggaagggcuucugaugauguuagguugcuuguguuuguugcugugggcuagcucguucuagccagcccaucugcagugggcuuacagcauccucauagauagacaggcucggggugagggagagggagagcuagguuucugucuuagucaggguuacuauugcagugauaaacgccaugaccaaaagcugccuggggaggaaagggucugguuuucuuuacagcuuauaaguccgggguaccacaggucauucugaaggggucacccucagcccucagucuacacugcucuccuccuuugcccugccugcuugucuuucucccagcacccuggguuuugcauggcuaccaucucauccuuuauucuucucccaggcucuguggguccaaguccaggugcucuugagauuggcauuguuaaauagcugcaucagaccgagugggguguggcagcucaggccuguaaucccagcacucaggaggcugaggcuagcuauggguacaucccugucuucaucacucacacacacuuaaagaggaaggaagggagggagggagggagggagggagggagggagggagggagggagggagggagggaaggggaaggggaaggggaaggggaaggggaaggggaaaggaaaaaggaaaggaaagguaagguaagguaggggcuggagagauggcuuagcuguuaagagcacugauugcucucccagagguccugaguucaauucccagcauccacaugguggcucacaaccauccguaaugagaucugaugcccucuucuggugugucugaagucaguuacagugaacuuacauacauaacuuaaaaggggcuggugaaccucucuaauguucuaggacaggcacucagcugaggaugauaaaguuggguggagguuauaugcugaggaaaaaggccuggguuggcagaggcugagagccucagagagccuagagacagcaucuggggccgguaucacuuaaggucccguugccugaccccugaaccuugaagugauugccugguuuaggugggguggggaguaagguguggaacugaacaggccaggcccugcuccagcuugcuugaaagccuugguauucugagggccucucugcucccuuuucagccaugcuuccuuaaggacugggaaaugcacguccacuucaaaguccauggcacagggaagaagaaccuccacggagauggcauugccuugugguacacccgagaccgccucguaccaggugaggaggggcacggguguggcugcuggcccaccacagcggugaguggccccggcaagugccugcuaugguuacugugcgccucugcugggagacugcugcugaccagagucuugcucuggagggggugggagagccuuuggggcugucuagccccacccacucacuaccacacgguuuuaaccagucagccuguuuacuauuuuuagguuuuuagagacuuggacuauauaucccaggcuggguuuaaauucauuagcccaggcuaccuaaaacaggaaaauauuccuucugccugaaacuuauaccaccacaccuggccauuuuccuauagauuuuuagaaauauuugugugugugcacaugugcccaugcauaucauagcaccuguggagagcaaaggguagcuugguguagucgguucuguccuucuaccuucauguauuuucuggggauggaacucagucaucaggccugguggcaagggccuuuaccugcuggccguucauggguccauucugccuuauuuuuuuccuuaaagauuuauuuauuauauguaaguacauuguagcugacuucagacacaccagaagagggagucagaucucauuacaggugguugugagccaccaugugguugcugggauuugaacucaggaccuuuggaagagcagucagugcucuuaacuguugagccaucucgccagcucccauucugccauuuuuaaagagcaaacacaaagacugugcaaccagcaaaguguaaggcgccgccucuggggcccuugcagaaaauuuaccgcuuguaguuucagguggcuccauacacguguccuagauugggcacugccaguaccuaaugcuugccuucgugacuacccucauaguuaaggccucagucuucauugcuguucagugggacuuugcuauggcccuggcugaccugguaccaugaagcugaagcuguccuugaauucauggcacucguacugagccucagcuucgaguucucuguccugagaggccugggucccuccccaccugcuuuguccuucaaggguccuuccuuccugggugaugugccaaugguuggacuuucuuucuucugccuaggucaucucuauugauccuauucugaaauaucuccuaauuccagggccuguguuuggaagcaaagacaacuuccaugguuuggccaucuuccuggacacguaucccaaugaugaaaccacugagguaggaccccacucuuccucugcagggcaggcaggcgagcaagggcugggcugcuggcuugagaauggggacuagaacuuggcugugguuagccuaaagcguccuccaggggcagggugguggugcccacgggcuggcaggcacgaaguaaccagugugucgguuccagcguguguucccguacaucucggugauggugaacaauggcucucugucguacgaucauagcaaagauggacgauggagugaguuggcaggcugcacggcugacuuccgcaaccgggaccaugacaccuuccuagcuguacgcuauucccggggccgccucacggugagcaggccuaagggggaggccacugagccuaugcuggcuccacagaggcuccaggagguggugggcuggggccugggugugagcuugaccugcccacugacugcaggugaugacugaccuggaagacaagaacgaguggaagaacugcauugacaucacaggggugcgccugcccacuggcuacuacuuuggagccucugcuggcaccggcgaccugucuggugagugugugaaaggaugcucucagcaguuaacggccucccuucucugcaggccuuccucauuucccaucagcuguaacuauuggugugcccgagggcaggcccaagcagucagcuggccucuuuauccuguaucuuuaggugagaggagacuuugggucuagguauuguagcuugauggguuccuagugccaggucuauaggaacacagguguuuagucuccccucagccaccccuuugaacaucgcccuugcccaucaaggugaaggggugucccuaccuuucuaguugccugggauaacacaccuuggugucacccuggaccuugucucaugccacuacuuauucuuugacaagucccagugucugucuuucucccugcugcauucacacugccaccucucacuggcacccacauguugucccucccuccuuccauacuagcacccugacguucugucccuggugccuggagagucaucucugugcucagaacuguaauggccgccaucccaguuguuaugccaggccccuccccaugccuccucccugccuuggcuucucccugugcugaaggugacucagcugcccuguccuuucugcgugggaccuggucaugucuuuagugacuuccuuaagugugaaguugccugcuucccuccuuuaaaaucguucacuucuacaguccaugaugucuucccccaucccuuccccagcuuugguuucuauguagcuugucuuagcuaugucauuuccuaugcuuccugguugugguccugucccuccacuccccacauuacaaguggcugugacccagccuacuagugauguuuagaaaggccgcagcccuggacccagcuccagcugaccagaacuaggcugugaugugcaugagcucgcagggcuuauuuauccccaggauaaacucuuagggacugaacuguccccucuauccagaggccauguagucccagaaugucuguuguuguggugucucuuuaaaguuccuauaccccagggggcuggggagauggcucagugguuaagagcacugacugcucuuccgaagguccugaguucaaaucccagcaaccacaugguggcucacaaccaucuguaacaaaaucugaugcccucuucuggaguaucuaaggacagcuacaguguacuuacauauaauaaauaaauaaauaaaucuuuuuuuuuuuuuuuaaaguuccuauaccccacuucacuagucagcagacuugugucaguaauggacccagcaugcccuugcucuuuccuguccccuggcuuaccugggauuucaucugacagugcucccguaugucuucagggguuuuugauagaacagauggcugucuguggcagguaguuauuccauagugcuauuuggaguggccauuugaagagacaggcgggcaccaggguuuuuauugggggaaagggagggcagggucucuauguaacuucagcugacagucucuguguagaccaggcuagccucaguuuuuugagguccacuugccucugccuccuaaguacuggggucagaggcauacaccaccacaccagccacuaauuucuuuuuuuuuuuuuuuuaaagauuuauuuauuuauuuauuauauguaaguacacuguagcugucuucagacacuccagaagagggagucagaucucguuacagaugguugugagccaccaugugguugcugggauuugaacuccggaccuuuggaagagcagucgggugcucuuacccacugagccaucucaccagcccccagccacuaauuucuuagguguugauuucuuucaauuuucacauaacugaaaucaagggaaauuuccccaagauaagcagaaaacggcagagccugggugacaaccagagucugacucggaaguugggucucaaggcucgacccucuucuucaagggucugucaguuuuagacgccaggggccugcccacccuggccaccagcugcuuguguauggcuccuuccuccucacugcagcuccugucuccccaccccagagagccuugcuucacauacacauuagugggugugcgaguguacauguggaguugcuuggccgggagccacauccuggacucagugcgucaccucugggauauuuggaguaucuuuuaugucuauggugguggugaacauguccuuuccaggcguaguugcugacggcuccuuuguuaucugcagccuguguauggccugacaagaccauagcgcugcuccuucucuuggacguauugggauugugaggcagcccuagaaugguuacaguggcccucacauccucugcuuagcaacgugucccgcacugcauggcauuugugugcccuggccauugugguggcucaauguggacacugcuucgauuuuacaaagaaacuaagccuugaagccucuagaucaucuccaacaucauaguuaaugcuugccucucuguucuguccucucucucucucucgagcacugccaacuucuccacaccuaggcuugagccccggcuuucacacauacuaacuuagcauugagcugcacuccagcccgggaugcugccugcccaggagaggagacugcugggcagaaacccgcucucccugggcuggcccuugugaggcugaggaagcagcuuucccuggggagggcaguggccaugucaugaggugggacccucucugccucuagacaaccacgacaucaucuccaucaagcuguuccagcucacgguggagcggacgccugaggaggagagcaucgacuggaccaagauugagccuggcgucaauuuccucaagucccccaaaggugggugggugugugugugugugugugugugugugugagugugugagugugcgugcagccccucugcuccugucuuagcugggcucuggccucugagcucuguggcuggaggccaggagcuugggccagguuggcuuuggugaguguuugaguaaagaaugaguugcugucuuacuguguggauccugcugaggcucugacaccuuguugucaugugcgugagcgucucauguccacuuccugugcuaaagcgucagguccacgugaacauaacgugccgagucucccuaccacgccagcuucugugaacacuuaggagcugacugagguuugcucggccagaaagaaagguggcaguuggccuauaacccagccuugguucccuccacuagcacaguucugccucacauuugaccagcguucuagguagaagaaauaggcaccuggauuucuuuccaucccucagagccacagccugccaaccauggauccccugaaaguauaggccccuauccugucuuuccagcucucuaggaaaaaccagagcacacuguucuuuguaauuuuaucuguguagccugggcuggccuugaacucgcuguguaacugacugugauguuggccuuuugagucuccugucucuacccuggguguaggaauuacagguguagcuaccaggccugguguuugauaucucacgguuuuuaaacuuuacuguuacucuguuuaauucugugcagucagccuugugugugugccuguaguggcuggaggccuugggugcccuggagucgcaguuaugggcaguugugagccuccuaaccuguguguugggaagcgaacuuaaaucaguauggacucugaacuccugagcuauucuccagccguagauuuuagagcuaaguuaaugcugccauauagcaccguuuaucacucuggcuguugcucccagaaagccgauggcuucgccccaccugcaucccugggggccaaucgagauggcucauuuguccacucaguggguggcugcugucuccaaagggauugagcagugacaggccauagggacccauggaagcuacaaggcuaagcugcuuguaggggaaucaugcggccucugaaguacuagcucggagcuggguagauuucaucugaccccugcccuuugccugugcugugcuggguguaagcuggagugccugucuguccaguucuacagagcuacugugagguagccccuucaugcuuuguaugguaaucuuugucuuuuuccauagacaauguggacgaccccacuggaaacuuccgcaaugggccccugacaggauggaggguguuccugcugcugcugugcgcacuccugggcguugucgucugugcuguggugggcgcugugguguuucagaagcgccaggaacggaacaaacguuucuacugaggccggucuggcugggaagggccugaccuugggccagggcucuuaugugaacuuuuuucuacugggauuguaaaaaccaacgaaccuuauuucuuaacuguuucaaagaaauaauuaaaguauuuucauacauuuugcuucuugcccagcugagacagcgggcagggcuggggucaggguuuagcauccccacagcuggagguuuuugcuccaucccaaggcuagcucucaggagcaagcaagucuguauuuggggcccaggugaggcccuguguaugggauggcuacuuaggguuccaggcagugguuuuguucugaggccugcggcagcaaaugggauuugugguucuggaccucccaguagcuuuuuacaaagacagaccucagccaaggcuggaggaccguucaguagggccaaggugugacaguuuacuaaaaguagcccgucucagccucaugccuguccuaagggcuuuuuuccacaucuggugauucccggucccuucucugaccuagagcagagagaugguggcugucacauugccauuuggggaagcaugacucucaggucaagcaggacucaccccauucugccugguaugcaauguuuugggaauaggguauuguacacaggaugugaccucagcccagggcacaggcacuggggacagaggggcaaugacagaaaucuugagauugaggugaucuggaaggagcugcugagccaggaauggaagacagcuggauggcagugcugcucccuuugggcggcuugaggggacaaggcuggggggccgaguggaaagcaggcaauaccacagccagcuuccggucucuggcacccuccccaguccagcucuagggacucaccaagucugccuccuuccucgccauccccuccccacagucaaugcuuggucucuuaccucacaagcaaaggcugccauccaugcagugcggcguccucaguucgcuuuguugcugcaggaaaggagugguggaagcccauggagugaacacggcuguuuuguuaguaccaccgucuuuaccuucucucagcagagcuguucgcugagcugcuaggagccaucuguccuugucggaaacuguucauggucauguguccagagguagucacagcagcugccagcugcagcuugcucccaggcuuaugagccugucauggagccucaggaaccccgucuuuuugacacauugcucucuaagcaugcauugccuauuugcugugacaccaugugggccguguccaagcaguuacguucugcgugacagcaggccugggaccugaagcaucaggcuucugccgucgggaaggaccucaguuccuauucuaacuuggccuuccugauguccagaguuauuagcuacauuauaaucaagauuuaccuuuguguauuagagccuccuuagcagcugcuguagcauugggagauaacucaauaaaacacuugucugacaguacuggcggcugauggucucuggggcucacuagucuaguuggggacuuccaugccaaaggaggcacauggcauucccaaagaucacacccaaagcuguccucuggucuccacacacauggcauaaaacaaaacaaaacaaaccccugcuuucuccauauuuggccuaguaaaucuugugguguaggaccaggcagggucugcaaugaaccuuagaugccagcacuuagugaguuuguuuaaccuuccaggugggcucuccaucccucaucacauagccucacuguacuugugaagaacuguuucuaaguucaccccagaguugucugucugcacacaggaaugauuccacaauuaguuuuuuugucauauguuccuaaaaauggccuuccuaaucaacacugaagcacaaauguguaccccuccuuguaucuucucugcaguguuggagaugcaaaccugccgacucacguggccuccuuuguccccuccccacagagaugaugguuguuaaaguguuccuuaaauuguguauuuuaaaacuuuguuuugcuuuaaaaagcuuuuaaaugguguuuggauguauuccucagcucuucgagcagcauggccguguccuggacauguaacccaagaugucgcucaagaugucuucugugcacacuggugaccgcucuuagcaccguaccagacugucagauggccucuggcggugcuuauaccuggugcagccuccaauguucuugaauuguguucucacacgucaugagaaguuugggucugcagcuuguauccaguuccaguuuugcuagccagagcuacgaugcauucugaagagaauuuuucuccccuucccacccccacucccucagcagcucugcugugugcuuuucugcaccaggcuggcagucucugcucaccggucacgugcguccucugacgcuuuaguuccaacuccuguuacugauguuguggaauuguuauuuucagccuccugguuauaagcuuugcagagguuccuucccacaugcuuagcuuccugauuugcuaaugacgucauuugaugugccaucugcauuuaaauggcacuuauuaaucuuuuccaaagaugauuuuccugaagguuucuaacuuuggccuuuaaaaauuugcacuuuguugaggugggucuuauggagugcugaugucaucgccccugcugucuccacccaguuguggccaaguuuuccugacucugucaucuuccagcacccacuccugaccuugucccuuucucuucucaucagcugggaugcuucuccucccagcugcuuccauguggaccuguggcucaggagacccagaggacaugaggugcggaaggucuucccuuccugccuggaauaugguaggacccuggggguacagaagcaagcgccugugacagggcuggagagagcacauaccuguuagauagggggccuccaggucagcacugaagcccugccucaagccuuagauugucaacugcugggguuuugugugugugagugugugaaagaaauaaaucccuauuuguucagacuaguguga

SEQ ID NO: 7055 - RNA, 2382 nt, Mus musculus
aguuuacaaaaaguaguuuauucugugaaaaaaauuccagcauauuaaaaacuccaucauugguuauauuaauuacaaagacuaucacugagcagucuuacaaauuaaucucaaguuuuccuuuauaaauauuuucaauaaacaaaaugcuauugccuuauuaaaaaaagaaaaaagaaaaagaaagagagagagagagagaaagaaagaaagaaagaaagaaagaaagaaagagagagagagccucgagucccauccuggaucuacugaaccuggacaucaggagcauccuccuggucacucuaucaaagucugaugggcucugcucugugccacaaaaaccagcaucccaugcugugcccacgguagggugggaugagcaucccauggagaaacaguucaauaaggucacuagcuacagaaacaucucuccucccucaaacacaagauuggcauagcaagugagcugcuguguccaaauccuuacagaugguauccacuggaagacgcaggacugaaguccaagcauaccuggacuuaacuugcaggggcugaaagagaaagaagggaaccaggggccacuagaaagaaccccgaguaagucccagcacacagugauugccgcaugauggaaagggacuagggcagccugaacaaaacccuaggcaauaaugacuaucuggagccaguuagccauacucucuagggagaaaauacagucccagcucacuggagaucugcccaguguggcuccuucaaacucauuauaggagccgggcgugguggcccacaccuuuaaucccagcacucaggaggcagaggcgggcggauuucugaguuugaggccagccugaucuacaaagugaguuccaggacagccagggcuacacagagaaacccugccucagaaaacaaaacaaaacaaaacaaaacaaaacauaaaaaaaaaccaccaccaacaacaaaacaacucguuauagggcuuauagggcucuacucugauuuucuaccuugggucucuccuagguucuggcugucucagauggaggugagugacagauuuguggaugagggagcaagggagggagccacagggagguggaacuguguggacacucccauccacuuguugaucucucagguaaucauaccugcagagcagaugccugccugcaagggggauugggccccaggcugaggaagcaaaaggcucacccuaacuuauccaucucucugcagaacugaccagcacugcagguucccaggcccagggugagggcagaggcagcucucucagcauccacagccucccuaguggccccagcagccccuucuccaccgaggagcagccuguggccagcugggcccaguccuuugagcggcugcugcaagacccacggggucuggcuuacuucacuguaagcccugggguaggguggaaugggggagggcaggugccacugcagaaaggggguucagguuggccagagugcugcuucucucuguggucccugucuuuggcauccuuuccuucaucaccaagcugggaacucuccuuucuuguccucaucucuguuucuuauuuucuuccgguaccccagagcuggcaccaucugucugucuugucuggucucuuggccuccgugucugucccagucuuugaacgcgucccucaaccagucugugucugaaggccuuucuuccccuuuuccucaugccaggaguuccugaagaaggaauucagcgcagagaacguaacuuucuggaaagccugcgaacguuuccagcagaucccagccagcgacaccaagcaggugcagagaaagaugggacagauggguggggacuagggccuggggcauacccccugaccuuuucuggucccucaucccuagcuagcucaggaggcccacaacaucuaccacgaguuccuauccagccaggcgcugagcccagugaacaucgaccgacaggccuggcuuagugaggaggugcuggcccagccccggccagauauguuccgagcacagcagcuucaggugagggaaccagagggaacgaacacucaacaggcccagacacaggggcggaguccaagucggaagggaaggggcaauugccuugaagggcggggucaagaguaggggcgggucucagacgccagguaaaugacugguuugggggaggcagggcuugggguuucccugcuugaacuggcuagggcgggaccugggacuggagagaugcaggcagaacccaacauccagcccuccacuguccucuccugguaccaaucaccacucacacucgcuggccaagcagaucuucaauuugaugaaguucgacagcuaugcgcgcuucgucaaauccccgcuguaccaa

SEQ ID NO: 7056 - RNA, 14745 nt, Mus musculus
gaagggaucuggauuucuuuauuaacagacaugagcacgacccauuacauaaguuugugcuuagaaaaaaaaaaaaaguuaaugugaaaaagaacccaagcagagaggaaagaauuggggaggggccacccaaaccacugggucccaucaauaagcccugacuugagucaugccuaggaccuccagccugggaccugcccggcaggagagggcgggaagccaaggggccccaggugggucugauaauuccuucugaccaagcagcgaggguaaagagaaggggaagggucccagggagccagagcccacgagccauuuauugccauguuuuaaauuucgugcaaaauaucugaagcccuggauagagaauacaaagugauuuuuuuuccaagaaacauaaaacuaggaaaagugauggggggaacauuuucccaccagaacccccgacccccaccaggucccaaacaaggugaggccuccacccuggucagcugagcagaaagaacuaagcuacaaucuggucugggcaggaaggggguggaaucugcaacauuguuucaacuaccaacgggaggaaaaccagucaauuguacaagucuaucaacuuuuaaaaaaaagagaaaagcuguaaaagucaggcccuguggguaaggaagcagacagguccccggccagugccggaauccagagugggagccaggcggggcugcugcuaaugcuggcacugcaagccggcuggccagaggccacugcagguaggcagccuuggcgagggcagccagggggcagucgccgcuacuaaucaccacccucgaagcccucuuccucuucaggaacugggucugcaucccagcaggugaugucgauuucuaggauauauugagagaagagagaaggcuggguagauccaucaguggugccacccgccccccaaccucuaagagcugugccaaccgacucuagugacaccccuagcccuccagucccaucccagaauuccagaauucccaucauucacccggggauacuaccuggaggcuuguuguaaaauacaggaggcggaaccuuugcacauggcucuucugauugggcgaacucuuccuccugugacugacugaaguauccuucgcuggccugcugggguuuguuauuugguuuuguuuuguuuguuuauuuaguuaguuuaauaaaagcuuaggucaccaggacccaacugucaggacaacagcugaucuaucaggccugagccuguuuccccagcaaccacucuuggaauccuugguugcuggggaaacacagaugccugccagggaacgaauggcagagauggaaaggggcguggcauagagcugcuucucaauauggaucuacaagcaauccgcccucccccuccgcacugaauacugucccucccaccaggcucccccugucccaccuggguccccuccuuuugaguggucucuccauuggucagcaggugagguucuggcuccagcuccugcuccagcaccugaucuaccuccucuagagcugagggcauaguuaggaccugggaggcagccagcguuucuccuacuuccuccucugggucacagaagguggcuggagguucuggcagcucaucaaaauuaagaagguuagcacagccuucgccuaccggcggcagcggcuccugagcggccucauucagcaggggcaccucugccagggaggccucagcaccugaggguggugugggcacccuggguucagccugaaguguugaggccucuuccccguugccaggccauagaucaaugaggcuggcagcggcaggggugacguuguuggcaauaguggugucaguaguggcagugguggucucaauggugucagcugcauggacaucagcuacugaggugacagaggcagcaggcuccgcaggggcagccagggcagccugcucuggagauucugugcacaucgaguccuccagggggcugcuuugcaacaggggagguuccugugccugagggggcucugccgcacagccagcccagaccucaggagcugcuguuacuuuggccuccuugcugagcucuucauccaggcuugggguagucuccugggccucuguggcagugcacaugaaggacacaauacagucagcccccuuggggaaggauagaugcccugggccaguguaccauguccacccacugaagagugacgaguuugagacuucuggguaaauuugagauaccuucuacuacagcuguaccucccuauccuuucacccacucuuuucauuuuuauguuuugaaagauucauuuuuauuauguauacagcauccugccuacguguacgccuccaggucagaagagggugccagaucucauuauaggugguugugagccaccauguggaugcugggaauugaacucaggaccucagggagagcaaccagugcucuuaaccucggagccaucucuccagcccucaccaacuuuuuuuaaaccaccaggaggaaggccacauuccucagugaugagccacugaggguuagagaaggcauugucuaagagcaacaccagggcgcuccucugcuauagccacuuccuuagcaguguaguguuggugaggauugguccaaguucuuugaacuauguuacuguggcaaccuaggguucccuacccagagacugauggaaggauagguaccgguggggcccuucucuuaccuugaguugguggaggugguggagguggagguggaggcugcgaggaugugaccucauccagggcccucucgaucugcucagcgauggggguagaggcugugcuggaaucagaugggcuccgggugggaauaggagugggugccauccuccgguggcuguccagguggcugccugcggagcaaaugcccaggcuagugagugaggaagugggagccagguggaaucaggacuauccaccuugugucucaagugugggugggggcugugagcuccccaggccccccaggggccagauugcugcuccagacccugugaaccaggccgcugggggccagugcccuacagggccagggacaagaggcagguaguaccugcucuggggacaaacaccagcagucggcagucaggcugggggagaaagggcgagggggcugcugggaagcggggcccuccuuaccccacccugccgaggccuggggcugcuaccuacaugggagggaggaagagagguuuggggugcgguggcaggugauauagggaaagggaguccguggaggggaagaggaggaagaggaggaggaggaaggcccacuguccgaugccuuuaugaaagggcaguacggacgaccugccgagagagagacagacagagaaagagacagaggacaagagagggucagucucccccaccccugccccaaggccucacccacccccagggccagcccuagauguccaagccaccuucagccagggugcacauucagccaagcugggccacagccucaagccaucugaugccucccaccaaccagcaccagauacacacaugggcacacaacagccagccucuguguagcagcacgaaugagucuagucugccaugcuccuggaaccccggcaacaugaccaagcacacagaagaugcaaaugcucacaccggcagacaagaaaugaaagggugcuuccaaggggaggcagaagcuacacaaggagaagccaaacaagcgagccgagagaaccacugcuccaggaugcucacacugcaggacagagcaagaucccacccuccaugcauccaaagccuucgggccagaccuaguccaacccugcagggaaacucccaacaccagcagugugucugaagcuucaccaaaucuucccaacuggccuugaguaccagccauacucagccaaugccggacauugacagugccccccaacccagccccuccgggggugccaccaccuggaaagcuggggguggaagcacacugaagggggucuugccuucuccaaggaguccuuccuugggcaaggcuucuuuuccaagaagaagucccagagggaauuagggccauagucugaggaguacugauugggcaaggagggggccaaggacuaccuggucggugguugaagggugcaggcgcaggcgcgucacagcugccaccagaggccgaugccacucguuccugcugucugaagaacucccguggguuaucaggccgcugggcaaugauggcagccgccuccugagggcacaagggaagaguuagagagcugggcggggcuagcagucugagccagccccgcccauccgucucacuugccacuccccccgcucucaccuccaccucugacuccgacuucuucaucugggacucuuccucuucaucccgcuggucacccuggaaaaccaaagggacaauguccugagugguucuuuccaaccccgcagaaucucaaagguggcgcuuuguuccucucagaauucagguccacagccuccucuuucaaugucugcagccaccucauccccagaccggccagccaggccuugagccgcugauucaucuacgucccaucuaaccagguaucugggaucacucagaauauuccuggucccuuagcuagcuuaagucacaccaagcacggacugaauauggcccauggacuagguauuguuccaaugccauauuuuaaagccauuaaaaaaaagaaaacaaaaacaaaacacauuauuuuuauguguguggauguucugccugccuggaugucugcucaccaggugcaugcagugcccucagaggccaaaagagggcguuguaucccuagaauuggagacacagauggcuccggacaugugggcgcuggggauugaacccagaucuucuggaagagaaaccggugcucuucacugcugcugagcccucucuucaggccccaaauagcaagguuuuaaacccacauaaauuaagcugcuaucacuaagaaguucaguuucaugaugaacugaaaauagaaucugguuucuuauuuugucauccgaggcaucguacccagguccucaaagaagccaagcgaaugcuuuagcagugacuacaccuuuuaugguuuuauuuugagacagagucucauuaaacuguuagacuggccuugaacuuuugguuuuaccaccuccccuggcuuuuguuuugguuuuuuuuuuuucuuuuuuuuuuuuuuuuuugagacagaaucucucacagccccucagaguaucuaguuuguauucucucucugucucuccucucucucucucucucucucucuggcugugugacucugucccacccugggaguugggguggaggcuugcuggacagcgcucugccucugagcugcacacucaagccccuaguuucccuacacaguggugacagcccaguucacugcagucccccacucccuaauucccauuuggccauuucuuggcuuauguuuuaagacugaagcccaggacuguaggugggcaggccccuugcuuggcuccguuccccuuccucagucugaucuagucuucuucacgucuccaaccccaccaucuauccuggcuccaacucgcccacauccucugcuagauguggacauaauguccucuacaugcuccagucacagccuagagucgucaucccguuucccaaccccauccuuuggcaucggaggccagcucacgucacaccucuuccagucucuccaguuuuaaggccucugcuuggucacuaacuccagagcaagaagucccugguucauuuaggucauuuccuuuucuggguccccucagggagcucccagcagauaccacagacugcacagcauuguguuuccuguuucuggggucacuucccucacccucagugagcaacaccggaugaagccccaagucuaugugaacggccagcauggggcugguauguguuuguucaauggaacucucuauaucaaaagucucuuaguuggcaucuucugucauucauggggcaaacugggcagaaggggcaagagcuaggugaagaacagaaccuuuuucuuauauuucuuacuuuauauagcuggguggucuggagcucacagccuagaccaggcuggccucgaagucacagugaucugucugccucugcuuuccugguguugggauuacaggcuugugccaccacuccuggcucagaguuugaccuuugagcauauaaccuagaccuuauuuuucugccaucaaagaaaggggcagauauaggcuggagaguugucuccguggguaaagcauguacuucucaaguuuggauccucagcaagacacauacugagcugggcagagaacauagaucuauaucaccaacauuugagcagaggcagagagcccuggggcucacuagcugaacaguaagcagguucaaagagagagccugucucaaaaaaauacagugcguagcuacagagggagacaccagaagcggaccucuggucuuuacaagugcaugauggguaaaugcacuauccauaccacaaauacacacacacacacacacacacacacacacacacacacacacaccauaaaaggaagagauuaugcuuaucagagagguguuaacugugaauaaugucaacaucacugaaacaaguuagagcuguagguaggagggagaggaagacucaggggucaaagcauugcugugccuaaguguucugacacaugagaacccaaggccagaagggaacucaggggcuggagagauggcucugugguuaggaguccuugcugcucuuguagaggacccagguuugguucccagcacccacaugcuggcucacaaccaucuguaacuccaguucuaggagagccacuaucuucugaauucugcaggcgcugcagacacacagugcacaagcauacaggcaggcagaacacucauauaccugaguaaacaaguaaacucacugacaggagagagagcauacagcgccuacgcauuccuaauuuaaaucauuuuagcuagauagugguggcacccagcacuugggaugcagugucagguugauccuuaugaguucaaggacagccuggucuauagagcaaguuccagggcuacagagaaacccauuuuugggugguggugggggaucauuuuagagugcuaaauuucagcucccggugggaccuuucuuggagcacagcuggcuacaauguugcuacaucguuacuuuccuaugagauacuuugaagcaguggauuaacucuugaagaagagcaaaaccucugcagccauugcuuaagaugcuggugacugacaaagaugaagggcaaauucagaagucacuacacuaaucuacuucucugugugcacgcacaccuuggaaauuccuacaaaacguggcuuuuucaaaagaucuugcugugaauggcugugcacaauauagauugggacagcaacaguggaggaggaggcugccccagagccugucuauguguucagucccuaacaacacuggccuacauucaggcaggagcucugaguccuuucauuaugaagccuaccuaauucucaagccccccagccccaaaugcagagcccaagacuaauacaccccaaggaccccaggucucaaggcggaagcaguggaggagccaggucagcgagggucugagucaagguggauuuucuuuuccaauuuggagaaaaacgucgaaaaaaaauguuuuguuguugcugcugcuguuauuugucuguuuguuuuucacacaaacaccaggaacccacaagauagguguuggaccugacacacucaugauagggaugcccacgcaugcccucagagggcagaacacacagaccagccucacguuccuggccaggcacaagagcccuggaaaagaacuuacaaagauagacugcuccuuuaaccuccucuuggcuucuucagcuuccagacucugcuguuuccuccuggaaggagaagugcagggaagccccuucaggguggacugggggcaguaggcuggggcggugggcgggggcggugggcggggcggggcggggcgggguggcccuucgccuggggccugagcuuaccugugcuccucaaucugcugcucccgcucccgguagcgccgcucacguucuuccugcuccugccgcuccugcuccauccguuccuguucaaaccugagccuggcguccagagccuucuuccgcuccuccuccuuccgcagcucuuccuccuucugcaccccacacccaggaaggacaagcccugagcccaggccagccucggcccuuccaauucuacucccacccaggcuggggagguggccuucugggaauuagggggaugagcccugugugcaggagaccaaaaggguuugcucuuucagccgagagaggucagagcuaccccgcaggcucagguagggacaccugggccugaaggcuacagcauugcccaccuuggccugcucccaaaacugcucacgguuaauccgcuucaucuccacugcugcauccgucuucugguaggugguacccugcagagucaagugccugggcaugagcgcaagagcagacccaaggcacaguccaguacucacaugugcagaaugagggcuaagagggccuggggaggcccgacuggggaccaggucacacaggugacacgagaccagccugucccgggaauacacugaccaccgguucagcauuuucauccucccgaaggcgcaggcggugcaauacugggcuggagagccgugccaguccauuggagagccgcugcccaauggcaccagcaucgaugucuuccacacugcuggcauucacaaugacaucaacacccuuccauacaaaaagcaguguuuaggugguauccgaauucccaucaccaaccccagcauacaaaccuggcccuaggugaccaaccguacccacuucagaccuggucccaacauaccuggaagaauucagccaccuuggccacaugacuggcgcaagcacauuuucgggcaucaggcacauccucaccaaccugcaaugugcccagugaagaggggcucaggacgggaggagugggcaacagcccacuggcccaacagccugaaggcaaagcagccuaugggcccaggcuaucuucccaagaacuaguguaggcuuuuuccuccagcaguggcuauggguggaauguggccgcuccggggccuucagcucccagccccaucccacagccacauacccaguugaugagcacauauuuuggcagggcagcuugggaguccuugacgcugcagaaaccauacaucacuuucugguucucgaaguggccggaaagcuccugcaagcccccuucuggagaaaccagggagauguugggacuccccaucuccuacacccgucacccugcaagggccuagaaccccucccugccaggggauuucuauuccucagagcuagaggcccagaccucuguguaaugaggcgaagggguugguaggauuguaucuuugccucugaauccuccugggccugacuugagaugggacaaaagaggucuguuaacacaucuccauuucucggggaucacaccucucgugucuuuccaggugcuagugcccagcaagguacaggaagcuuugcuuaaggaaaucucacagcuccaagaauagcacugagcuggaccacccuacuaggccccuucccuagcuguaugaugccgggcaaguugcuuuuccucacugugccuucccagaagucaaacaggaagcaggaguccccccccgccccccuacacucugaggaaugcgggaaugaccaagaggaaggacaaccguggacaagcgugggucugcuggauggaggcaggaaagcgagaggggaacaaaacaagcagaguggguggugggaaggagagggaacggcuggaauucuuaccuccugacgcugcaagcuugaggucaucugagccauccucguauguguacagagcccugaggagagggaggauggcucagaacugucagggccuaggcagccaauuuuggguggggaaggcacuagggagggagagugaaaccagaggggacaggcagggcagaacaggacgaggagggggaaagcugugguugucgguuggucaugacaauaaagcuaggcauggcaucguuccgcugagccgggaguccugggucagauggcaaucagggaacggugggggagaaaucgcugccuagucagcucagcguccggcccuagcccuggcagcccacaacucaguggagcgggugugcgauggagacuccaaggcaacgguuccuugguuaccguucccuggcgaccaugauucucaucccucauuggccagagccaggaaucuaccuggugcgugccuugguacccgcugccccucccccuuuugggagggagaagaaucuggugcucaaugcugggcauccccugguaaccauggcaacccagcaauuggcacagaaaucagcccaccagagcugcauucuccucgaacacaaaggacccuggggacauccucagacucaaucucucccucucugagauggggaugagguugcugugaccacuccccgacucugacccuaagaucuggucuucuagcccugaggcagccucugcccucccugaagccuccuaggacuaccauauagacugaagccgaccagaaagcuaaacuaaugacuuccuuccucccuagccuuuucugcucuguauuuauucuuggcaggcauacuaacgcauccauuucauggaagguaauguaguuauucuucccuugagccaccccucaacccauccugaugcaggcaccacgcuggacacacaugaagaagagacucuuggucccugagauucagaagggcucagaaccuugcucaucucccauuucccaucuaagucaggaggcuggggugugcgagaagaugaaaaagcagagauggaggaaaggggggagcagggaggaggaagaaaagaagagggggaagagaacagacaagagacaggagggaaguggaaaaaauaaaaaauggaggaggagggaagaaaagaaaaggagcaaaaaaggagaaggaggaggaggagaaggaggagaggaaggaacgagggagggcuaaccccaugccccagggguuauugaccccuguuaaggcgaccaaauaagucccugcagccccuccccuuccugcaucccucccugcuuugcuccacaaagagacacaggugggcugcaugucuccgagcccuuggugcaacugcugccccagccaauccgacagcugcuuuccccgcacagcugccccaccaccugucaggcugcccuaaccccauggccaggaacaaagagcccucaaagaaauagggugucucccucuguagucacggaugaaacacugagccagcaccaagaauccuggcuccuuccaagacacugcucuggccaugacaucucucuggggcaagcugcucaucucaagacucugaagccccuuuuaucauuucuccaugcccacccaccuccaaaccgucccucuucccugcuagggccacaauccuuccucagcagagacugugucucauucaaacccucucagcucugccuagcccaccucuccaaaaugacuguguauucacacccacacuugggccacgcuggcucccagauucaguuuugaagaacacuuuguacccaagaguugcauugcauuuuccuguacaugaagaccacucgggauaccgcuaccaacuccaggggccagccucaggcugagcuucacgccccagagugcuauagcacucagcaggaaccgggaaagacaucuaucugcacuagccccagacccuacuggacaguguuucucuaacauaacacagguacucugagacuggcagguaggagcucggaaacacucagggcaaaguagaagagaacucuagaugugcacaccucaccugcagcaagcccuggagauagccacugccacaggcuguccugucagucuugggaaggcagggacucugacugugcuaacacacacugcugccucuauacaaaauagcaccacagggauuuguaauguugacaaaaacacuuaucuaccaccuaaggcagagauaccugacuagggcaaggcgagagucuggcuucagcagagauacuagcaguggaagguucaagaccggcaugcucucagggagcuggaacuggaaaggcccaggagaccccagauggacucugcccaucccccucuuccucagagcacuugagaagagcaggaacuucucacacaaugaaucacaucauaaccaggguggugcuggccuuucccaccacacaaucugacuuccccugugaccugcuuauagcacaaggacagagugcauuuaagagacccucugccuccuaggggccagcagccccaagcuccacuauacacacacacacacacacacacacacacacacacacagagucaagguacagggaagacauccaauacucaugacccaacguuugaacccagacaccccuccugcuggacuccuaaaugugggucuguccugagccuugagaucucagccagcugcugguuguaggauaagagcugagaagcaccacgccaucuucuucaggaugggacccucaccacccuuuuacaacaugccguuaaggcccuuggaaguaagcacacauauaagcgagggugcaucugugcaucugcacaugucccacacacaacccagauggggcuggcgcacagaccaaggaugaauaacuccuucccuuuggcuacauggaugcugcuggugauggaggcccgggccuguucugagcaggaugcggggcagaagucauuaguagccccagcacuggguugccaguguccagcuuucgagggguuaagagauagaagguguugucuacaccccauagacuggccaguguuucuccucaggcagggccacauccccaaacaggcuccuccaccaggccacuuguccagauugccucucaugaucucagccccccaggggcagggcugggacaauaagauggaaacugcccugcuugcccugugcuggccucuccuauaacugaccugcaagacacgagaacuugucuccugaguccaucccucugggccuggcuaccggccagugcugcaguaccauggccuggacgccugguuauuuuguuccaucuuccagccccccuacccgguugcccucccagggugagagugaggccagcccaacuggaggcucccucagaucagccccaacucggccucgguuuucucaacgauagccuacuuccagccuaaggagaggaaaagauucaaauacaauuuuuuuuuuugagaagaacacuugggggcugugcccugaauggggcaucggagcccccuugguuuuccugacacccugagacuucagaccaaggcagguggcucacacccuccuccagcucagggaggguaacagcuggggagggggagauaagccacucacucacucugccccagucggagguugauagcccccugcugcugaguggaggggcuagggucccagagaucuacucaucuggcaucccucuguggaggcucccuccacgcucccagcugccccccuagccaagcugcuccguccaucuccugagucucuuccugccuaucugccucguccuagcgaucugcuccuucagcaggggagagaagggcucagcccugccucuuccucugcgauccgugagggauaaagaagucacuucgugguugccauguggcaaucaaccuccuuguaucacacccuaaccuagauguggggggagacaaccccgagaagcccccggugggcggggcacgcuggcccccagcccucggcgcuccucccccgcccuagcuuuccuuugugcuguggccgggcaggcugcucuagcuccgcuagcuggguccccgccccguccccacccgguccucgcccgcucgaagguggcgaaggugcccuuggcuggcccgugcacaccugucccccgggcccguggagggaggcagggugagaagggggaugggcuccgacaggaccguaggaccccaggccccacgucugggcuccacacccgcguggcuggcguccggcucccgcgcccccagugagccuuagggcggccucagggcgccccggcccgcgcgcccagccuggcccgagcggccccucccccggcucgcacaaaggcagccccuccccggcucucccgagccguugcaccauuucggggucucccccucccuucccgguggcagagccucggggaaacaaaggcgcgcggcggccuggggacaaaggggccgggggcgggggcgggggcggggggcucaccagucggcugcgcucuccucccggaucaccuccucguacgccgccagcagcuccaggcgguggccgcugaagcugacgccggccaugcugcgggccggaccgaggccgaacggacagacgcacgcacaggcggaccgaccgacaccggagggaggggaugagggagucgccgccgccgccucagagccucugcagcgcugagagcgagcgagccagcggccgggggaggggagccggccggcggggggcggggggcgcuggcuccgcccggcucacucccucggcucgcucgguccuagcgccgccc

SEQ ID NO: 7057 - RNA, 6251 nt, Mus musculus
gaacugguccaagaaaagggauugugcuuuaaugcuggggaggagaacaaaaauaguaauucugagggcacuggggcugcccaggccagcugggccgggaggcuggcuucuugucuugagugcuggugugcacauggccaguguccuagcauuggacucuuggggagaagagagaagucagacggcucagaaguccauggagcugugggccagguaguccuugcggccaauguugcugaccugcuuggucugcauagcuucaaguuuggggcagucagugauccgauggccaaggccuccacagaaggcacagccccguucuccugugggugaagagaagggucagcaaggucacaggaccaaguuucagguccugggucuugaccagccaagacuggauuccugguauuucaaucuuuuugccuuacuagccccaaggaacccagcuguagacugaagacuagagccccugcucaacacucaccuccaauguccacuauggaccacagucaacacucaccuccaauguccagcacggaccacagucaacacucaccuccaauguccagcacggaccacagucaacacucaccuccaauguccagcacggaccacagucaacacucaccuccaauguccagcacggaccacagucaacacucaccuccaauguccaccauggaccacagucaacacucaccuccaauguccagcauggaccacagucaacacucaccuccaauguccaccauggaccacagucaacacucaccuccaauguccagcauggacucguccccacagugcagcacuugcagaacaggugguaccuucugcuuggccuccagcaacaaggcuuugagguccaugagcacugacucaucugagggagagacaaugagcaccauuagggucuauccuggcuucagaacccaagguagagccaggcagcuauguggagggccucaccgcaggccuuguugaugaaggugguagcgaugccuguguuuccugaacgcccagugcggccaauucugugcacugcaaggaaaggaacaggcucuggucgacuucccggaggccuggcccuccucuuguccagcccaccaauacccaugcgccuuaccauaguuuucuaucucuucaggcaugucauaguugaugacaugcuggauggcaggaaaguccaggccuuuagaggccacaucuguggccacuaagacguccuucuugccuucccggaaugccucaauggccuugguccgcucuuccuggucuggggugggucagguaggugucagaacuaaaguaggaguguuggaaguagcacaggcuagccaggcagggaaggggaaggggauagagaggaaggcaggaagcugucauggcagcagggcuaugccaauguguugaccauccugaccuuugcccccaugaauggcuacagccucaacacccuugagcaggagguauucgugaauggcauccacaucugcuuucuucucugcaaagaugagcaccugccccgaaaaggccgcuccaguuagaaaguaucacacugacucccaccuggcauacaucccucccaucccauuuuaucaugggaacucugggcccagcuauacucacaggugggggugucuucugcaggcacucaagcaaguacaccaucuuggcuuccuccuucacauacuccaccuccugccaccagaagggccaggucaggggaccccaagguucagcucaccagucauggccgacacuggagcugggcucgcagucugcacuaggugaccagaagccccuugcugugaggacuagacagccuaaggauggccuuggcuaaaggccacagguggacucuuugguuaacuucaagggagcaaggcagcuuuagccuauacuaguaagacucugucuauuaggagugugugccuaccuggaugacaucaaggcuggcugcuccagcacgacccacauugauggugacaggcuuuaccaaggcacucuuggcaaaguuuugaaucuucuucggcaugguggcacugaagagcagagucugccguuggcccugagaaaggcagugguucucaaccugagggucucaaccccuuuggggggucccauaucagagagccuucauaucagauguuuacaauucauaauaguaacaacauuacaguuaugaaguggugcuauaaauuaacuuuacgguuggggucaccgccucgcaaggagcuguuguggucucaucauuaggaagguuaagaaccacugagcuaugucgggcauggugguacacgccuuuaauuccagcacucgggaggcagaggcaggcggauuucugaguucgaggccagccuagucuacaaagugaauuccagggcagccaaagcuacacagagaaacccugucucaaaaaaaaaaaaaaaaaaaaaaaaaaaaaaaaaaaaaagaccacacaggggaugcugucaggggauaccgaacagcugagccacagagccugagaagcagagggcaugcagugcagggacccugcagcucagcaugcaguacaugaguguauuuacaugcaggggucgggcaccuugaaguaggagaagaugguacgaaugucacccucaaagcccaugucaaucaugcggucagcuucauccagggcuagguagcggcagaugucuaggcugaccauuuucuucugcagcaaauccaugaggcguccagguguggcuaccaucaugugcacaccacugagaacaaagaaacccuaaguuuuggguuccuggguaucucuaugagcuaccaagaggcuguacacugccuucugcuuucgcugucuccuccccugccucucagcacuuccccaggcuaucuucuguauaacaaaagcagcuuauuaguaagggcuagaccuuucuggcuagcacuuacuuugucaugccuuccccacaagagcuauccugagucucuagagguuuucuccugguuccugcaccccuuuacuggccuugcugggcucacauuucugaugagcuaucuguuauacaccugcauccucccugagccugggaauaccucagacauagggguggguucugguaugacuaucaucuuggggccugguccagagugcuagagaugucugcuaggauugcacuaccuggaaaggaccaagcagaggugcuacugggguccaguccacaucaguaccuuagucugguuaaccacaguaaauaguucugauuuuucuggauacccuagacuucaaucucugagcuuucuaccugaacugacccccaauuucaaauggcaccuucccugcaaugccuuuucugacuuccaauaucccagagaauggggcauuccaucuguucuauucccacaauauccagcuacaucuuuccauccuaccccaaaccauuuucccucaaggacuggacucccagaagaacugugugaggcccaugcaguagccaaucuaaaggcuucuucuaccucucuggacacucaggggaugccaccgagaccaucaguacguacugucggauggucuccaucugcuccuucaccgacaugcccccgaugcagagggcacagcgcaggaggggugagcuguccuccugcagcagacggcaguaauacuccaggaugccgugggucugccgagccagcucucgcuacaggcagagacaaggcugguaccggaagccagcacaguccuucucccgaccccaggauuagccuaucuuaccgaggggcagaugaugagcccauaaggccccucucgcuuggagaaaggcaaccgcuucuccuguuccaggcagaacaugaugacuggcagagugaauaccagugucuugccugaccccgugaaggcaaugccgaucaugucccgaccggacagacugucgggagaggacagcuucaggacuggcccagcaggagacagcuggauaagugggcauggcuucucuguugcagucaugcucacagcccacacuuacaugguagggaugcccuggaucugaauggguguuggguggaggaugcccuuuuuuuucaggccccgaaggauagcuguaguaaagaacaggaguuuaauuggcauccugaguccgguagaauuaguucuucccuguaaguuguaaaucgugaaacagaggcuggggugucaggaaacaguagguccaaggcucacuggcucacugggccuaaguucucauggaagcucuguugaagcagaagauagccgaggcaucugaaaauaaguccaaagaaacccuuccucgccgggcggugguggcgcacgccuuuaaucccagcacuugggaggcagagucaggcagauuucugaguucgaggucagccuggucuacagagugaguacuaggacagccagggcuacacagagaaacacugucucaaacaaaacaaaacaaaacaaaaaacccuuccucuagugaggaguggugggacaugccuauaagcccugaaccuaggaggcacagauaacuggaucuuugagugugaggaaagccuggacauauuauguucggggacaauugggccuccaaaacgacacgugguuucacaacugcccacaggguguggugguuaugccuccagugcuagcuagcacaagcguucaguagggaugcugcaggaggacuguuuuggauuugaggucagucugggcugccgaaagagauccugucucaaaagagcuccuccccccaaaaccaaguaccaccaacaaccacagagagacuuccuaucuccaacucuccauucccacggcugagcgcagugggugcugggauacacaaccucacaggggcaagaugauaaagcacggugucucccuucuccucggguaccugcaggaaacuucaucuccuugaagcucuugauggguggcgggauaccaucgcccuccaccaggaugugauacuucuuccgaacucgcucaugccgcuccucagacaugcucaggacauaacgcggggguguccaacuauggguagguggugggcaggagagggcaacacgguagaguaugguggggcagcucccuccccaguccgcacagcagggcgucaggguaccacugccagucccaaccucauauacuuacuggaaaggcauaccuaguuuugauuggaucgucauaggugaugccuuuggccauuuccuucacugacaucaaggcugaggagacagacauggcucaaugagcaagaccacccaagaggucucgccuuugaaaucgggaggagguggcucaguccaccucugcucugaaccaacuauaaugguaccucggccuucagccacacucuccagaaucuuuucuucuuccuucaguugcuuuuccuuggcggacuccuugcgugcugagaaaagaagccgaagaggucagagaagcaggagcacugcggccuaggcccguccucucuccuuccugcuaggcccaccuucagccuucucuuugaggugcuggugcugauccaggaggcugacauuggacugagggcccagcgggaugucguccucaucuccucggggcucacugccacuguccugcugcucuuccuccguagcgcccuugcgucuucgcugcagcagcuucuggagcugaggucccagcagugucccucagagccaagcccaggacccagcaggugagggggcacagcacccgggagggcuuuuuccgggaaggggaucgugugcacugaggcgcacgucuguccggaacucagguucacuagucccuggucuuccucagaaccacgacccaagguaggacuacagcuccccagauccccccucccgcugacggccggggacaugucgccguugcaccagggaugcggccccucaccaguagcugccggcgcugccgcaacggcacauaggguacguaguccucgucguccucauccucguccucggagcggcucccacccgcggucgccucguccgcgcgugcccgcugcggagacccgagucagccgcggccccucccccugcccgcacccccucgcguggaccaaaccucagucccaccuuccgcuccgguuccgaauccuccaucuuaggcugcacacaugcgcaaugccagggcaucugagcuccaaucagauaggaaaaacugcuguggucgccuagcaacggcgugagcgccggaucgcgaaccgggacaaucuucuuccagcgcguuuacggacgcgcagcggagccaauug

SEQ ID NO: 7058 - RNA, 26298 nt, Mus musculus
ccuaaaucacuuggaaacagguacgaauuauucccauuuugcaauggacaagcacuggcugcaaaaugccuaccauagauuccuagauaucaucccaccacaccuguggucagccugaggcgaaagaauaggcaggucuuuacuugucguuuacugggagccccacguucugugcucagaacugcaggacccagacucaggucguucuugaggcugauggggaagggggucacuuaaauagauaauaggaucggcgugacaaggaugaaaugauuaaagcacauacucuggcaauguuuuuuuuuuuuuuuaagugguaugugcgagagaggucuuuaacccacaaagcaaaauuagaaauguuuuaauagcucagcauuuuaguuguuaauaugucaucuccacccauuuucuucccacagggggagaaaaauucaggcacauggaacaaaaaaauauauguauuuuuuuuuuaaguuuccaaugcugucuuaugccuugucgagugaaacuggaacuuuuuaguaguuacacguggaauuuauauugauaacaucaaucagaacaaaaucugaaacuuugacuaccaagaaguaaaucaauuuuuaaaaauugcucuauuuaucuuauuguuuuaauagguauguguguguaugugugugugucggugggacuggguuaaacuucuuuggccuaacuugcuccaucuugaagucuguccuccguuuugcauggccccaauuccaagaaaaaccacaaauguucuagagucuaccacucagggaaggggaggaacaucuggccuuuucuccaagauccugaaacaguugccacccuucuuucccuggaauaccuaggggccaccacagaccaaucaggaaccaggaccucuggaaagcccccuaaccacaaccaaccaugguaaagguugccuagacccucacccuaaucuuccacuucauaccugguugugguuuucugcuuuaaaaggccugugagcccacuucuugggcucauugcuucagcucccgagccuaacugcaucucuaguccagcuagaucucuuggugagaguuucccuuggugaauaaaagcugcuuuuguuugacuuuggauuguggcggccugugccucauuauuugugugaccucaggcccaacauuucuguguguguguguguguguguguguguguguguguguguguguacgcgcgcgcgcgcauacguguacuugugugucaacuugacacaagcuggaguuaucacagagaaaggagcuucaggugaggaaaugccuccaugagauccagcuguaagacauuuucucaauuagugaucuagggugaaagggcccacuguggguggugccaugccaggccugguaguuuuggguucuauaaaagagcaagccaguaagcagcaccccuccauggccucugcaucaguuccugcuuccugaccugcuugaguuccaguccugacauccuuuggugaaaaacagcaauguggaaguauaaguugaauaaacccuuuccuccccaacuugcuucuuggucaugauguuuuguguagaaauagaaacccugacuuuaauuuauuuuuaggauuuauuuuauguauaugaguacauuguagcugucuucagacacaccagaagagggcaucggaucccauuacagaugguuaugagccaucaugugguugcugggaauugaacucaggacuucuggaagagcagucagugcucuuaacugcugagccaucucuccagccaaugauuaauuuuuauuuuuuggguuuuguuuuuguuuuuuuuuuuuugguuuuuuguuuugauuuuuuucaagacaggguuucucuguauaacccuagcuguccuggaacucacuuuguagaccaggcuggucuugaacucagaaaucugccugccucugccucccgagugcugggauuaaaggcgugugccaccacgcccagcacggcaauucuugaucaaagccagcuauggacccucagugucuggaaacaaugcuugugagagucuaaauaagacaaagcauuagaaacaguuagcaacaguaauuuuaccugauagcuuccauaacuguucuuauuauauauaccuuacuaaucuaagagaaaguccuuuucuagacuaaaaaggggcaauauugaggauguuuuugagcacuguguauuuaagugaugaauucuguacccagagauccaaauguaguccagaauugguauuggcauuauuaugaagcauuuccugauuugguauuuuguaaaacacugcccuccauuauuuucugauuggucauuaaagaacuggacagaagagaauaaggcgggacuuccguacccuaaaagagggaaggucucaguugaccacaugaggacucaacaugaggaaucagauggaggaggugucagagucagaccaacaugguagguaaugccauguaguggggaaguuguagggauaaggucauugugcacuguguauaaauauucaccugucaauagaaaagccuuuugccaguuagcugaggcagaauucaaagguaacacaccugcaugggagagaaagaauucuggaaaugaaucagguacaugagagauucacccaaauucugaggagacagacacauaaaucugagaagcagguaaacaaccauguggcucuagaauagaauaaacuggacuauugagauaugagcaagucagggaaccaagugaaaguuauugaucuauauaaaagaaguuucagagucaucguuucugggaacaaagcuugggaaaaaacaaaaacaaaaacucuuaaggguauauggcgcccaacauggggcauggaaugcaagcuuagaaaagucccaggugagaggcagugcaguuauauuuggcacuggaugucgggaaaguacuuacaaaaaaucugagacagaaauccaaacuuaaaguuuggaugagaagagaaacgagugugcucaggauacagagcaguuucuuaguucuguuccuuuaagagagaaaaaagucguaagagcagcugguaaaaaaaaaaaagaaagaaaaaaacaaccaaaaaaacgguugcuuagcaacacaguuucucaggaggucagguguggcuagcugcagagagaaaaaaaaaagacagcggaggaaaaaacacagagaggcucauuuaagaagccccacugggguuggagggaugacucagccaguaaaagcacagacugcucuuccagagguccugaguucaauucccagcaaccacauggcccacaaccaucuguaaugguauuugagucccuauaaagacagcuacaguguauauauauauauauauauauauauauauauaaucaauuaauuaaaugcuuggggggaaaaacaguucuucaacccacagauggagagugggguggucaaagggguugggagacagcaacagaguccugaaaugugagcaugugcuggcccuuuucaugcccaccugacauaugcugggcugaggagaugucaagaucaacuucccagagaggggagcaggggucaggaucuaagaagacucauauccugguuacacauggaagucauaaacgagacagagaccaagccaaugacagugcaaggucugagcuaaaagcggaagccauaacacagccacagaagacauaugaacacagccaaacuuugggucaaguaaaauugugauuaaaugcuaaaagcucagaauuacaggaggugauugagaaguccagggaagcauauuuggguuagaauaaaucaguaucugcccagcuauagugcucagaaguauauaauaaguauaccaggucucugugucauuguuuugggcaaaggagggcauagaaaagucccuaacccauuacacaguacuugccuauuauccuaugcaggaagcccuuugugcuuuguaccauggagggaagugacagagcuuuuugauaauuugguccugagaagaacuccaguuucguguuguugaaacagauuagcaggucuucuagaacagugugguccauguagacauccuuugcugucccaaauguuucugcucugcuggaagguaaaacacagagagcccaagaaccacauggcucugagaugggacagagucccaaaggaaagguaucaugagacacaggagcucaggaaccauacucugagaguaagccuccgcagcagaggcauugaagcucucaagagaggggauccccagcugagcucaggagccucagccauccuccuccucuuccuugcugcuugcuucuucucuucauugcuucuuggcuucuugcaauaagagagucacaccaggcagcaaaucucaugaaagagauuuguugggaggguccaagguauggagggucaaauccaagggugguugcccuuuguucccgggaacaaacagcagaaaauuaaacaaagggcggggcuuauauaguacuucuuagggggcagagcuacucagaguagagauuuccagguugaagauuggugggacuucaaguccugagcuugcgaagcucagggacuggugggaauuccuguucagggauugguggacucuccugcucaaggauugauggauuuuugugcaacgcucuguggggcugcuuggggagacuggagaggaggcgcugaugccauugaggacagcuccuauguuguagguugagacaggaaagaaggugucaccaccauggacagcuccucacgacuacaguaagcugaggagggaaggguucugcuaacauaaauagcucuugagggcagcuucagcugaagggagaaaggugaugaaccaccguggacagcucaaacaauggcuacagacuaagggucuguccuggugcugucauuuugacaagagccaccauauuuguuuguuuguuuguuuguuuguuuauuguuuuuuucgagacagggugucccuguauauaccgggcuguccuggaacucacucuguagaccaggcugguuucgaacucagaaauccaucugccccugccucccaaguucugggauuaaaggcaugugccaccacugccugacuagccuuuuuauuuuaauucugauagccuuuuauuuuccaucauagcaaaacugauaccaaccaaccaacaaagguuuauauaugcucagcccaagaaauggcacuauuagaaggugugauccuguucaaguagguguagccuuuuuggagugggugugccacuguggguaugggauuuaagacccugauucuagcugccuggaagccagucuucuucaagaagccuuuagaugaagauguagaacucucagcucccacuguaccauaccugcauggaugcugccauguucccaccuuggugauaauggacugaaccucugaaccuguaagccagccccaacuaaauauuguccuuuauaagaguuuccguggucaagccgggugugguggcacacgccuuuaaucccagcacucgggaggcagaggcaggcagauuucugaguucaaggccagccuggucuacaaagugaguucagaacagccagaguuauacagagaaacccugucucgaaaaaccaaaaaaaaaaaaaaaaaaaaaaaaaaaaaaaaaaguuuccguggucaugaugucuguucucagcaguaaaauccuaacuaagacagaaauccccuucucgucucuauaaauauuuaccugaaacugggcucgaggcccuuucccauucuccugugucagaaacaguagugugguccaagcuugagcuuggauauagagacccuaaugugauuguauuggaaugggcuccucaguggucucuuggggguucacaaauguuucauggcacaacacuucuuucuuucuccucuuucuccuucuccuuguggugccuagcugagaccccccuacucaaucucaaguccugccuuccucucuccugcccagagucuccagccuuuuauuauccaaucagagauuauuggggaacauucuuuauagcacacuggucaauacaaugccaauguucagacugcaaccugauuuuggggggugggagcagaacucagcaucugaauacguggcacacaagaccauuugcaacccacacaugcaucuuguagucucuguucuaccagaguuaacucugucucucugcuucagcuguuaaucaucuuggaaucucauuguaucguuugaaacaaauuacuuaauucuuugaguaguuaauucaaugguaagccauagccaauuaacuucuccccuuaauccuugagaaucauuaaaaguuugcaauugaucucuucuaaucuguaccuuuuguggcugauuucuuuuguuguuguuguugcucacuuauuguagaaccaaagaguuaauaaaaaucucuucccugaagauuuuucuuuucaggaacaacuuguaacccucaucaugacacaauucuuuguguuuccuuaaacauuuucucuaaaguaacugugucagaaucagucaacaaaauaucauccauguagugauaacuaacauauugaggaaauugcuuacaaaguauuucuaguaguuguugcagacugucacaugcagugugacuacuggucaagcuguuagugaucuuguaacccugagcugccccuucuuccacccuggugacacccuugguuugagauuaacccucaaaacaagcuguuucaucagaucauccucccagcucuucagcuuucucuggccucaccgcccucugguacaguucauuucccucuuccugcaucugagaaacucccugacucuuucucagucacuggggcugaguguuuuuguucucccuuuucuggugcuucuugccugccucccaagugcuuccacauguucccacaauuuuuccaguugcacaacuaauucugcaacccguucagaaauaagagcaaaguggucccuucuguuuucccauuucagccguuuuuguuuguuuguuuguuucucgggcuucuucauuuccaccugcaauuuuuuccauugugaaaccauucucccccaaaacaaaacaaaaacaaacaaacaaaaagaccaaaacagaauacagaaaaaaaaaucuggaaaugucaucugggggauaucccagcagcagcagccacagguauuuuuuggcugaugucuugaccagagcccuucauuccccaccauauucucuguggcgugccaaaucaaauuucccauguugccuagccccacaucugggugucacuuguagcuacucuguggguucguuuuucuucuacacuucuccacccuuucaaccucccuaacaccagauaagaggagaaaggauggagaggaaaggagagagcaugaggcaaaucagaguuaacugcuguggacaauguaccccauaacggguaacaccugggauuaaaacaaaaacauucaggguuuuuugcucuaaacucagagguuaagagcauugauugcucugcuaaauguccugagaucaauucccagcaaccgugugcuggcucacaacuaucuguaaugagaucuggugcccucuucuggcccccagucauauaugcaggcagaaugguguauauauaguaaauaaauaaaucuuacacacacacagagaguuucuguguguguauguguguguguguguguguguguguguguguguguguguguguguuuaaagaaacuaaaauuccaaacuugucaucacagguucucacuauauagcccuggcugaaccucacaaugagaccaugcuggccccagacacacagagaacugccugccucugccucuagugcucuggcauuacaggugugagccaccaugcccaacgcaaaagaaaccaugcccggcccuacagaguuccaggacagccagagcuacacagagaaacccugucucgaaaacaaacaaacaaacaaacaaacaaaaaaccaaaacaacaaaaaagaaacacuuaaaggacugguuggcaaccaggcaugguggugcacaccuuuaaucccagcacuugggaggcagaggcaggcggauuucugaguucgaggccagccugggcuacaaagugaguuucaggacagccagggcuauacagagaaacccugucucgaaaaaccaaaaggacugauuggcauaugacucuuuuuguagccauuaaacugucugacaccccaaacaccaaccauuucacugacacaacugccccagaaacaugggaugucucccaagcuaacuggucuacugcugcugagcacgauaugagucucuaggaaucaaccuaagccugugugaacuuuauuuugaggagaucagccaguuaacuucuuugcagggggggggggauaaugauaauugucuauguauuugucaguguuuguuaacugcuguaccaaauaggacucaaaugucaaagguuuagccccuuggauuuuuggucaugccacagucauugauugaaugagaguuuguucaugaggucauuuaagucucugccucuucuggguucucaaaguccuccucagucaacuauaagaugggaaggaagaauuggggaggguugcuaugaugguuuguacauauucggcccagggaggagcacuaguagaagguguggcccuguuggaguagguauggccuuguuggaagaauuggggaggguugcuaugaugguuuguacauauucugcccagggaggagcacuaguagaagguguggcccuguuggaguagguauggccuuguuggaaugagaguaucacuguggguguugccuuaagacccucauccuagcugccuggaagccaguauucuacuagcagcuuucagaugaagauguagaacucucagcucugccuaccuggacacugccauguuccuuucuugaugauagugacugaacaucugaaccuguaagccagccccaauuaaauguuguccuuuauaagacuugccuuggucauggugucuguucacugcagugaaaaccuaugacaguugcauaggucacugucgugaucuacacagaggaaugacuagauacuauuuuuaaucacaugcuauugaugagaauucagcuacaugaagccgccuacugaaaucccagucuccacugccuucuuucuucgaaggcaauggcucaucugcuuucagucucuacagaacauuuugugauuuguacacaauaugcaguauaguuaacacaguaccugguggcggcggcauaugccuuuaaucccagcauuuagaagacagaggcagguggaucucugaguucaaggccagucuguuucaagcugucuuggaacaaaguaaguuucaggaugucuaaaucuauaaagagaaacucuugaaaaaaauaaagagguccccauggauucguuuacacaguacauacucugcuuuaucuggcuuacuucccugggcacaauaauuuugaaaucauccugguuggcuuugguauuaauaguucauuauccaguagcacuccauugucuggaaguaccacaguguguuauguguuagcugugaacgagcagucaugacagacauuuccuccauauuauauuggcaucuuauaaugcucugagagcuuagaagaaaauauauuuaaugugugugcauauauauauauauauacacauauauaugcaaacauauaugacaauuacaucuuuuguaacuguuuaaagugauaugugugugugugcgcaagaauguguguguguguguauuuacauguuaaccuagaagugaaggugggaagacagccaaggcuguuacaccggaaaaacucugucucacaaacaacaacaauaaaacccaaaacaaacaaacaaacaaaacaaaaaagugaaggugugucugucuuagagcuucuuuuuuuguuguuguuggguuuuuugggggaguuuguuuguuuguuuguuuguuuguuuuuucaagacaggguuucucuguguagcccuggcucuccuagaacucacucuguagaccagacuggccucaaacuuagaaaucuaccugccucugccuuccaagugcugggauuaaaggcaugcaccaccacugccugguugucuuagaguuucauugcugugaauacacaucaugacaauggcaacucuucuaaggacaacauuuaauugaggcuggcuuacagguucagagguucaguccauuaucaucaaggugggagcauggcagcauccaggcaggcauguugcaggaggagcugagaguucuacaucuucaucugaaggcuguuaccagaagacugacuuccaggcagcuaggaugagggucuuaaagcccaugcagccaaucacuggacugaacucgggguccccaauggaggaguuagaaaaaggacugaaggagcugaagagguuugcaaccccauagaaagaacaacaauaauagccaaccagaacccccagagcuccuagagacuaagccaucaaccacggaguacacauggcuacagcugcauauggagcagaggauggccuugucaggcaucaauggaaggagagauccuugguccuaugaaggcucaauagaugccccaguguaaaggaauggagggugggaaggugggaguguggguggguggaggaacacccuuauagaagcagggguagggguagggaguuucuaggagggggggaaaacugggaaaggggauaacacuugaaaugcaaauaaagaaaauauccaauaaaaaaagcccaaaaccacagugacacaccacaaggccacaccuacuucaacaaggccacaccucuuaauaguuccacucccugggccaagcauauugaaaccaccacagugucauucccccuugcugccccagucucuaaauggugugaccaccuucaaucuccccaauggugugacaacccucaaucuuccuaauggugugaccacacucagucuccauaauggugugaucaucuguaaucacccauaggcagucagagagagaaagugaggcugggggauucugacaccucaggaguugagugagcugaagagaacagacucuugggaggcaggcuucauugagaagcucauuuaauugggggagaggggauaagggccauuuaaaccuuugugagguacauaagaucuauggggcuagggccagggugcuaaggaugccucauuugcaugaggaauucuaggugcuggcagaaaugacccuaugaggggaaagcaaauuuaaccuggccaauggcuacguguccuccucgggugaggcaaaggugggcaggggcacaggguuaugaguauccguggcaagaggggcaugguccuacuccugcugaucuugggaugagauuucuaggggauaugccuugaccccacucuagcuccagaccagcuucucccagucacaccacuccacagcucccccagccccacaaaagugggcacaauagcuuccauuuaguaucugguuaucggaguuuuuaaggcaaaagccuaaguucuaacucguugggcuuggccguuugucuccaauacaucaauugcagagguaauuaauauugaaaaugggggaaggaggauuuuuaucaaugugccuacauggagagcaggaguagaguaaaggguuguggugguuaauuuggaaccaacaaaaagacacacccaagaaagauugacugaaaggagaagacgcucccuggguggcuauaaccauacagucucuugcccaccagcugcucagguaauggcucagaugcuuucauuaguucugaaagcuuggccuuaguuuaggcuuguucucaacuagcccuuauacuuaaguugucccuuuauacuaaucuacauucugccauguggcucauuacuuccugaauuccugcaucugcuucuuccuccacaucugacuggugaagcucccaacucagacucuuucccagaauuccuaucuuuucccggaagucccaccuuuccuuuccugcuuugcuacaggccauucagcucuuuauaaaaccaaucagaaggugauggagaacauguuuacaaaacacugagucagggcuggacagauggcucagcugguaagagcacugacugcucuuccgaaggucuuguacucaaaucacugcagguccaggaaccaggauuugaauaauacacagacaaucuuuacacauuucacaaaagauuaccccaagaaguggcaguuuuaauucagggguucucaaccugugggucacaaccccuuugggguugccuaagccugucaggaaacagauauuuacauuacgauuuacaaccgcagcaaaaucauagccaugacgugaaguggaaacuuaaggguucuuuggaaaguccguuguguuggauggcguuuugcuaaggcagacuugugaaggaacguuuuuugcugaagcagacauaggggggaggauguucugcuaaagcaugcacgugaaaggacacgugaugaaggagucuucacuaacagcacacauguauugguuugccuuauguuguguuguugagaugcauuuguugggaccccguuagagaaaaaccacaccaaaaacugcuggcggcgugcugcaguuucuuacugcuuuaggggacucagacugauuggcagagugaugucagcugaggaggaugcacuugcugaggcaaggcauguggaagacacaugauguuuggagauuauaaauaggacucugagugucagaggcuuauagagcuagcugugcaaugccugugggucuggcaucuucgcugauuuuuacuuuacugagagaggccuagccaagaacuuuuccugguguuccuguuggucuuugucccuccugcugacuugagcugaggcuaaggccuggcugucucugcuagguagugccacagcugcugauucaugcuugcuaucccgacucuacugaacuggacugcugguguaucugugaaguauauaugagugcugcuguugaccugugugacuuuaauuuuuuuuuucaaaaccuauuuuuaacaaugguucuugccuggugugguggcguacgccuuuaaucccagcacucaggaggcagaggcagguggauuucugaguucgaggaggccagccuggucuacagagugaguuccaggacagccagggcuacacagagaaacccugucucgaaaaacaaaaaacaaaaacaaacaaacaagcaaacaaaaaacaaugguucuuaaaucaucucaccucucuuguagcccaccaccaaccaaggguagugggaaagaaaggaugauacagggaaaguggaccuguuuagaaacauucuuuggaacaacaccugucuguguugucuggaaauuggcaguucauucacagguuagcaauggcagcuugauccacucacaaacacaucacagacacaccagcaguccaggucagucagcagugugacugguuggcuuuucugcagcuccuauccuucuccccucaccacccaagucaugacaauucucucuccuuuuucucaguuccugcaaaucuaaagguaucgcccugucuuugcccagccauugaccgcuggcaucuuuauugauauaucaaaaaccaauuggggacaaggaccuucagcauuuggacacccagacuccugcauguccaaccaaucgccaacacacaaggaagguccuuuacugcaguuuguagaguaaggaucauuauucaggacuguggauagcaccccuaacuuacuucucaagccugucugucauugugugugucucugugacuagauccaggggagaacuucccuaggaacuucuacauuagaaacuccgagccccuggaugcucuucagcuuuugucuacacuacuuuaaagcgcaugcugaccucaaacucaaagcuucgugccucagugaucgagugccagaauuccaggaacacacuagggcuagcccuggucuaaaguucuuuuaacuuuuguuuaaaucuggauuuaucuuuuuuuuuuucuuaaaaaaaucauuuuucgggcuggugagauggcucaguggguaagagcacccgacugcucuuccaaagguccagaguucaaaucccagcaaccacaugguggcucacaaccaucuguaacaagaucugaugcccucuucuggagugucugaagacagcuacaguguacuuacauauaauaaauaaauaaaucuuaaaaaaaaaaucauuuucaguauaggaaucuaauaauguccccaacaauuaucaaaacuguacuacuggaauguaaggauuuaguagcugagugguuuuuuuguuugguuguuugguugguuuucuuuuauuguuguuguuuugagacaggguuucucugugucgcccuggcuguccuggaacucacucuguagaccagguuggccuccaccuugcagaaauccgccugccucugccucuugagugcugagauuaaaagcauucacaacaaugcccagcuuugcauucucagucuuagaacaccacacuaacauugcuugcuaucuucagcaaguaagauagauauuuuuaugauuuccuguguccaacauguacugacaucccugacucaggugcuguagagaugagcaguggcuaagaucacuugcugcucuugcagaagccacagcgucaguucuuaacacccacaugaagauucacaguuauugguaaccccaguuccagaagauccaaugcccucuuccggacuuuguggguaccagggacucaugugguguccagacauagaugcaggcaaaacacuuauacacagaaaaugaacaaaccuuuaaaaaaaagaccugauccagaguaagaaauuaaaugacucaggggaugaccuguggaaacaggaucuuacuaugcugcccgauuggccuugaacuccgaacucaaaucaucuuccugccucaaccucuugaguagcugggacuacaggugcuuaccaaacucuuugcagggaguuugacccugcuucccuagcuguaagaucggacuccuacugauguacuucauagcaguaugccuaggauugagucagauagcaaauuuaaacuggcaggauguuucagcaggugagggggcuugcucccaagacugacagccuuaguucaauccccagggcccacaugguaggaaaagagaaugacugcaaaaaguugcccucugacuuacacaugagcaguacagcaugugugcccuuucccccaaauaaauaagaaaaugucuuuuaaauaagagaagugcuaagaacacgcccaggggaguaaagucucaccaccaaguguagcuuaagaagcuuuaccaagggccuggagagauggcucagagguuaagagcacugacugcucuuccagagguccugaguucaauucccagcagccccaugguggcucacaaccaucuauaaugggauccgaugcccucuucuggugugucugaagaaacuuuaccgucacuuacacacgaggguguggacaucuuuauccccagcugucaggcuaugacuuucuguugacuuuugagucuauaaugugaauucaagucuauacugagagacugagucuauugcucuccucaaggcacugugagcuucaagguuuugagguugucuuuuucccaaguguucauucuguuguaauagccagccugccuguguuucuuuuuuucuuuuucccuuucuuccucuuuuuuuuuuuuauuuuuuuuuuauuuuuuuuaaagauuuauuuauuuauuauauguaaguacacuguagcugucuucagacacuccagaagagggcaucagaucucauuacgggugguugugagccaccaugugguugcugggauuugaacuuuggaccuuuggaagagcagucgggugcucuuacccacugagccaucucaccagcccccccuuucuuccucuuaaggcuuuuuaaaaaaugucugguaaaauagacaaaccauuugcuauguuaaucuuacagucaauaguucaguggugucggguagugguggugcacgccuuuaaucccagcacuugggaggcagaggcaggcggauuucugaguucgaggccagucuggucuacaaagugaguuccaagacagccagggcuacacagagaaacccugucucaaaaaaaaaccaaaaaaaaaaauaguucagugguauuaaaaacagccacaucugugcaacagaucuucagaacuuuuguuauuucacacuuaaacucugggaaacaucuucccacuucccccagcccugucagucacuauguuucuaucuuuuuugauaaacuugacugcuccagauauguugcauagaguauaagucuaugcauaugcacacaguauaugucuauguauuugcauacuauauauauaucuaugcauuugcauagucuaugucuaugcacauaguaugucuuuguccaugccuauccauaugguaugucugugcauaugcauauggaaugucuaugucaaugaaugugcauguaguaugucuauguauaugguaugucuaugucuaugcaucuaguaugucugagccuaugccuaugguaugccuaugcauaugaauaugguaugucuaugucuauguauguaguauguuuaugcauaugccuaugcauauacccaugcauaugaauauaguaugucuaugucuaugcauguaguaugucuaugcauacaguauauguccaugucuaugcaugugcauguaguauaugucuuuuuauauuguuuucuuuuacucaacauuguccucaagguucauccacacugcagcaugugccaaaaaucuuucuuccauuuaaaagcugaauacuauuucauuguauguagaacccaccuuauguuuagguauucacuuuaaaauuuuuuucuuugaggggcuggagagaugucucagauguuaagagcacuggcugcucuucuagagguccugaguucaauuccaaggaaccacaugguggcucacaaccaucugaaaugggaucuaaugcccuccucugguaugucugaagacagcuaugguguacucauauaaauaaaaauuuuuuaaaaauguucauuggacuuaucuucgguguuuagguauuuuucuugcauguguguaugugugccacauacaugccuggugacugaagaggucagaagaagacacuagaucuccuggaacugaauuuacaguugguugggaaccaccauguaguugcuuggaauugaacuuggguccucuguaagagcaacaaaugcucuuaaccacugagccaucucuucagccccuuuagccauuccuuugauggacgcuuaaugacuuuuacaucucuguggccaaaugccuaacaaauaccuaguaacuuaagggaagagagguuugcacuggaucacaguccauagaacaugguucaucaggacaaggacguuacagcaacuggggccgcuguaaguaaagacacaggaguaugagcagaucagggagcauggaaauugggcugugaccaagagcaaggacuacaagcaucaccaucaaggccugcccuugagauccacuucuguuaggccacugugcucaaagugcuacaacuuuuacagguugugccaccaaguggaggcuaaggguucaaacaaauaagcuuaugaacaacauuuccaaugucaacuacagggagcacuuagauugcuuaacuuuggggcgauuuuaaagcugcuaugacgaugguacacuuauuuuguuuaguuaguuuuguuguaacuaaaguuuuguguaguuuguucucugugucacccuaguuauccuggaacuuacucuguagacuaggcuagcuucaaacucagagacccacuugucucugccugcugagugcacuuccacuacuuagcauuaauuaauuauuaaugauuaauuaauaauauuuauaauauuaaugauuaacaauaauaaaauuuuuuugguuuuuugagacaggguuucucuguguaacccuggcuguccuagaacucacucuguagaccaggcuggcacaagccauugcuguucuauucaggauuuuuuccccugugcccauaucuucaagacuuuuccccacuuucuccucuacaaguuucagugucucugguuuuauguggaguuccuugauccacuuagauuugaccuuaguacaaggagauaggaauggauugauucacauucuuccacaugaaaaccaccaguugugccagcaccauuuguugaaaaugcugucuuucuuccacuggaugguuuuagcucccuugucgaagaucaagugaccacagguguguggguucauuuuugggucuucaauucuauuccauuggucuacuugucugucacuauaccaguaccaugcaguuuuuaaucacaauugcucuguaguaaagcuuuaggucaggcauggugauuccaccagagguucuuuuauccuugagaagaguuuuugcuauccuagguuuuuuguuauuccagaugaauuugcagauugcucuuucuaguucguugaagaauugaguuggaauuuugauggggauugcauugaaucuguagauugcuuuuggcaagauagccauuuuuacaauguugauccugccaauccaugagcaugggagaucuuuccaucuucugaggucuucuuuaauuucuuucuucagagacuugaaguucuuaucauacagaucuuucauuuccuuagagucacuccaaaauauuuuauauuauuugugacuauugagaaggguguuguuucccuaauuucuuucucagccuguuuaaucuuuguguagagauaggucauugacuuguuuguuacucugauaccuaaaccacagaaagauccaacaaagauagagaacuucagaccaauuucccuuaugaauauucaugcaaaaauacucaauaaaauucucacuaacugaauccaagaacacguuaaaacaaucauccauccugaccaaguagguuuuauuccagggaugcagggaugguuuaauauacagaaauccaucaacguaauccauuauauaaacaaacucaaagacaaaaaccacauaaucaucucgcuagaugcggaaaaagcauucgacaagauccaacacccauucaugauaaaagucuuggaaagaucaggaauucaaggcccauaccuaaacaugauaaaagcaaucuaccgcaaaccaguagccaacaucaaaguaaauggugagaagcuggaagcaauccuacuaaaaucagggacuagacaaggcugcccacuuucucccuaccuauucaacauuguacuugaaguccuugccagagcaauuugacaacaaaaggagaucaaggggauacaaauuggaaaagaugaagucaaaauaacacuuuuugcagaugauaugauaguauauauaagugacccuaaaaauuccaccagagaacgucuaaaccugauaaacagcuucggugaaguagcuggauauaaaauuaacuccuuucuuucuuucuuucuuucuuucuuucuuucuuucuuucuuucuuucuuucuuuuuuaaaugagugcucuaucugcaugcacaccugcgugccaaaagagggcaucccauuacagauggaugugagcuaccauguaguuucugggaauugaacucaggcccucuggaagagcagccagugcugacccaucucuccagcccuguuucuacaguucuuuagcacaagcccuuucccccacuccaaagcuagagcccuccauguucagaccacaaacuuguuccuguuccuaccauuuuaauuccuguuugggaguugccacacagacucuauaggacaacuucuucccugcugaagcauuuaccacauuagcaagaaaccugaacaacuuuugcuuuacucuguuuuugguugcuuguuuaguuuguuguuguuguuguuauauaaggugaggcugagaaagcaucucugaagugcaaugagaagcaguacuaacacugcugccccuaaagaggcagcugauauggaugggaccacagggcaggaagcauaggggaugacguuggcagaucagacuggccacuucugccacuguagcugcugguucucauggauuauagaggaaauuguuugagcucuacaaucuguacaagugcuucauugagaccuccuauaccccagaggccuggaagggagaugagaucuagcuauucugcaauuucuccucaucagcauuucugugcugcccucuggaucuccugaucucuggaaucucucugcacuaugagccuguucaguaaaaguuccaugcauucuugucucagcuacaaugugggacucccucuucuugccugugugggcuuuccuuaucucuaucaauccaaagccuagagaggaauguguauccuuuaucaacccuacaagcaugaagagauuaauuuaaucccagcacuagggaggcagagguagacagagcucuauaagaucaagaaggacagccuggucuguugugaucauaaaaagagagcgagcuauaagaauauguucuggcggggugugggggaagagguugccuuagugggcccaugccaaggcaucccuucccccugagggaccagaccacacugguauaguauagaauaguuuauuuagggcauggggaaggcaguuaagagaguagcagaggcagagagaaggagagaguaaagaaguaggggcuggccauggcgacgugaagagagaggggaagggaauaaagagcaaagggaaagaggcaagagaguaagagaguaagagagagaggaggggccaagcagccccuuuuauagagccaggacuaccugacuguugccagguaacuguggggcggagcauacuuggcuucugccaggaacuguggggguggaguuuagagagauaccaacauggucuaccuaucaaggucagagccaggcagggcuacauaguuagacugucucaagaaaaaaaaaaaaaaagaugccacaauguaucuacuuaguacagacaaagguauuggugaacaacaaacacaagacauacauaaacaacacaaugauaguuauaaaucuuauuaaugauuaaauuaaauguaaguggcauaaacccuacaauuaaaagguagaacuuggcaagauggcguucaaaaggcaugaucuaauugcauguugccccuaagagguucauuuuggaauauaaaguaaugauaugagugggaaagaauagacagugcaaauaguaaccgagaguaggauggcugaacauaguguugugugcaccuuauaucccaaccuuaagagucagaaagaucccuacaaauuucaggccggggggaguuugcauuguaaauuccagugaggcaaagcaacauagcaagacccugugucaaaucaaauaaaaguaaagagggauggggagaggaugggcaagagggagaguuguauuacuauugggugaaacagguucgaaccuugccuccgcuuauauguugcgcaggcugacaacuauuaucagucaucucgcuauuuggcuaaaccgaagaaaauccuuccauuuuggagaccccaguccucagcuugcagaaaccagccccaaucagguacugccgcgcggaggcgugguguaucuagggacuuguaguccaugcggcggaacucgcagucccggcaggcacugcgguggccuccgcugggcuacguggcucggcagucugcgccugcgcaggcagguggggcaagauggcugcggugcgaggcgugcggguugucggaagcucaccgggucucuugcuggggagagggaugcgggccuuccugcuacugcuguggcuugcagcccgcggaagcgcgcuguauuuccacaucggagaaacagaaaagaagugcuucauugaggagauuccggacgagaccauggucaucggugcgggggcgcagggaagcguuugggacaagucagugguccuggggcggagggggaugcgaccuguuccggguagcuagccuggccgcgaaccccgcaccucuucgagcuuauuucaucuuccuuuuuccgccugucuccaggaaauuaccggacgcagcuguaugacaaacagcgggaggaguaccagccagccaccccugggcuuggcauguucguagagguaaaagaccccgaggacaagguaagcuggcccuuacccgcuccgguacuucuuuguuaguuuccuuaucuguucgaucgagaauuuuaguugguguugugggaagauaccggaucuucucuaggaacuugggccgcgguuucuggacagguucaguucacaacuucucagugaccucugagugacucccccaauucggcugcuuucccuagccugugaaauggaagcucacuuacucuagcgauaaguguauuaauugcagucagugauggauaccaaaaaguugcuaaugcuaaaguuguuguuuaggccuuaauuucacaaaacagaacaccuuucaguuuugacaaauaauguuuuaaagacaaaaggcaaaauaguuuuguugucacuaaccaucagaauaguuguggaaguuauuuuugacaucaccauucauccaagcgccuggagagauggcugagcaucaaggaagagcauuugcagccaggcaaaugcucuuaaagcuggcccaugccuuuaaucccagcacuuggagggcagagacaguuggaucucucugaguuccaggccagccuggucaacagagugaguuucaggacacccaaugcuaacauucacacaaauaaagaaaaaaaaauacuuaaaaaaauuaacaggcauaaaaacaaacaaacagccgggcggugguggccuuuaaucccagcacuugggaggcagagacagguggauuucugaguucgaggccagccuggucuacaaagugaguuccaggacagccaggacuacacagagaaacccugucucgaaaaaccaaaaaaaaaccccaaaaacuaaaaacaaaacaaaacagcaacaugguggucaugcugccccuggaagguagaggcaggccagcuccgccuggggagcaguuacucgccagccugaugucagacccuucaacccugccccagauuguugcgaucauuuuaugccuguggcugaguacccuuggguccuuuagugcugugacgugcccaaggcucuccuugcagacucuugugguacucagagcuuuuauccccauuuuuuccuagucuccuggcagcaucacugacugaaauccucccuguuaucuauaggucauccuggcccggcaguauggcucugagggcagguucaccuucaccucccacaccccuggugagcaccagaucugucuucacucaaauuccaccaaguucucccucuuugccggagggaugcugguaaguagguccaugggugaccaaaggcuuucaggcaguauacccugcuuaggacugggcauuuguaccgugaguguggcagguacuggauuuugugccuuuuaaagcauuggauugccagagggcauacagggcauagugacugaucaguuuguauagccauuucuuacgaccguaauagugugcuuuuauuuuuauacaaggcauacauauccugcuguauacuuuaucaucucuagguuacguauaaccccuaaugcaguguuagugauauauguggcauaugaauugaucuaaagaaugaccaaaaaggcuucauucucaguacaaauauguuuuuugaaucugugucuuugcucuuugaaguuuuucuguucuugggaagccacagcuacaaagaacaaauggugugaacauggguauuaacaaacagugugaacauaggucagagugugagccccaagcuuauuauuuucacucguauacccggagccccauagcauugagggugucucagugugugaucugaauuuaacaaaaagaaagagaaaaaagggaagguagacagaucagcugccaguccggcagucagaggcagcaggcccgccucacucucuucucacucuucccuccccagaggguucaccuugacauccaagugggcgaacaugcaaacgacuaugcagaaauugcugccaaggacaagcugagcgagcugcagcugagggugcgacagcugguggagcaaguggagcagauccaaaaggagcagaacuaccagcgggugagugcugggugagugccggcucggccggccgcccgguggguggcaagcucugcugcuaggaguugcaggaaagacucuuuauggaagcccaggggacuuaccuaugccagagugcaggucuaaaaggugacuguguguuacagaguccauuuguaaucgagccgcagccucguaagagccuggcuucacaggaaaucacagugacaaacaggagaagagcaugauaauaccagcaccuuagcagccguuuuaaagguucuagguguccccagaaucuaaagccucugaauuuuuccugaccaggaaccaggcagguaucaugaaugaauuguaguugaugggcagugacccaucuaaacaggaaaaauuauacagugucugcuacggccucccaguaguaaagguaguucugagauuuuagcuucccacuuaccgccccccacccccuuuauuuuaauuauuuuuuauuuuuuugguuuuuggagacaggguuucucuguauagcccuggcuauccugggacucacuuuauggacuagacuggccucgaacucagaaaucuacgugccucugccucccgaaugcugggauuaaaggcaugcaccaccaggcccggcuauuuuaauuuuuaaauauuuauuuauuuauuuauuuuuguugagaggagguuucucuguguccuggaacuugcuuuguaggccaggcuggccuugaauucacagauauuuaccugccucugcccccauccccacccccccagugcuaggacuaaaggcguguaccaccacugccugacaggagacugaaucauaaagaaggaaaacaaaugcaaacagaaaaacugugaacuaaccauguccagcccaccaguuugcauucugaauguaugacacaugugaucuuuaaggagcagauugaaagacccgaacagaaguccacacuaagugcuccaggacaccucugucgcuugccaccaccuuuccucuccucucuagguaucaggaaggguuaagugaggacuguaucugacaaauggacagacagacuuaggagaaaugccuuagucugccagcagucauucgacugcuacugaugaagauaguccccacaggcaucuggccacacuuugggcagaguggguggcccuggggaucuuugcaagcugggaacacagcgguuccagcagucuuagacuacuaagccuugccgcuuauuucccaacaguggcgagaagagcgcuucagacaaaccagcgaaagcaccaaccagcgagugcuauggugguccauccugcagacucucauccucguggccauuggcgucuggcagaugcggcaccucaagagcuuuuuugaagccaagaaguugguguagcagcugucccaagccucacaggcgaucuuucuuccaggcugugggaaguaggaggaggacugguuuucagccgcagauguucuggaggagagagggacuguaagcguguccccguuccucaggcucagguggaggacagcagccuggcuggcuaaugcugagccaguagugggacaagcccucccaccuccacuccuggaccuuuugcaguaaucacucaggggcuggcgaugcccuuggugucucagaaucucaguguuacugaucagggauaugagguugcugucugggguagguuuugggagggaaguggguggggcagcaagcugauuuuccuucugucuuccuuuguuaaugugggauuuugagcaggucaggguguaucagugacuccuugcuauuccagaaacuuugcuuuucuugccuuuggcuuagaaccagccugcuuauauaggguguguuugcugcgugucaguuuaaggguguggagggguugcagugcacaaaaggggcccagagguugauuuuaguuuguuacaauuguccuuucuggggcuugaacaacugguaucaaaccaagcagagacuuuggugcugguuggaaacagagccuacagagucuuaguuacugaguuuauuuucaaugaauguggguuuguuacauugguuucccaauaaaaaagaaaaaagaaaaaaaggaagaaaaacuguuc

SEQ ID NO: 7059 - RNA, 2689 nt, Mus musculus
agaggccccugugguuguagcacuggcccugagaaggagaggaguccaaggcuacagugggagagagucccagggagccuggggcagugacugcugggaggugaguggagacagcaggaccugaggcagcgcuccuccagggacccugcaucauggcuucucaguguccuuaagcaacauuccacauccagugaucucucuaaagcagacuuuacaccacagcccaccccagagacuccugcuauacccagugagaguggccuaccuccucccaccauguggcccuugcucgaaguagccuaucacaggccugagcccugagcgagaggaacaggcacuggcagccaggggcgaggggagaggcacugggaagugagggguggcucgggagcugcuccucaccugaaaugguccaccugguugagcacauagauguggugcuggauccucuuccugcuuaggaagcggugcauguggggcacaaagaccagcagcuccucaaagcgcucacgaaagggcaccagcacugccaagcgguggggcccccaggacucaucuucuucccagugcucagggggcggcucuggagggcaagcccgggguggacccgaggucucuugcccuuguccccuggucaccugggccauaucuccagaacagcugagcugcagccagagcagggagaagaagaccaacaggagaaaggcaaugaagagguggaagauggagcauuuccggcggaggccuccaggaagcaaccuggcccugaggugagagcgggaaggaggucaggaggacagggcuggccgagauccucucaggacccucucuggccuccccgagggaggacgggggagucagugcagaagcaggggugaauguuuuugcucaugcugcuuccacacaggaucaguucauucgccugccuaggcccagccugggcuccccgcugggacccucccucucagacgguucagagcagucaggauugccucagucauucaaugacuucuugcaucgggauggagucugggucagagcacucugggucagagcacucggaggaaggagucagcucauuguuucaaaucuguuucucccuagaacagugucuggaaguccugagccagugggagggguuccagcuuagaaagggauaaguuacuuuguugugcugcugaggugcccagaaagcuccccaagaacgggugugugcugacauaagccccaggcuaaaugguugaaaccgccacuguaagguccacagggagagugggagaucacaggagagcccauagggcgggcgagcagaaggaaggugggaaggacagggaggguucagcaccauauucuaauguaagaaccuggacaaacacugaauaucugucacugggugucugggaaacugcccuuuaacaauuccaaaaauaaaagcccaggugaaaagccugacaagguggccaggauggauuuugaguucaaggccaaucuggguuagauagugagacuaucucaaaaacaaagaagcaaaaaagaaagaguggaauucaccuuugccuuucuggaaguuucugaggauacuaggaaugcuuguaagaaucuaaggaggcuuccucuccagcucccccugccucugcccaagugaccagcaaaggaaccuagacuauaaccuccaaggguugggaaccagcucucaggucuugcagacgcuaccuccugagaucgccugcaaugaucuugccugcuggucuucgagcuguccuucacuuucacuccuauggcuguucugacucugcucacaagguuaaugcccaaacccuuagucuaacagucagaacccucuguccaggcgcucugugauguuggagaaacucugcaguuucucacaaccguucccucucauccgggguaacaaaaggccuuucuacuggcuacacuucugcuccaacccacuccuaccccacccuccuuuucuccuaagugauauccucuuauuuuaucuacuuaggaguuuucucccaaucuuucaaggccaaaaacccacaucaugucacacccaucacugcccccaccaagcucccugcuguguucccaggguacccugcacuucgguccuuacaucgcucacuugagacggccugcaugauccuacuugcagaacaugucauauuuuuaucuguggccucaggcccagucaaacagcaaagaacuugucaaucguguuaggagaagggucaacgcaggccaagcaugcugcaagguacacacuggagccacauccaugccuaccuuucucuaaagacacagcugcaaaccuggaagccagcagcccugaagccaggcccaggucccucgugcagcugagagguugcccgguaggacuccccucacaggacuucugacuuaccccccauuguccuguggugaugguuuccacuguggagcaguagagcccagaccugcaaauggccugacaggccugggaccuuuauagauucuuucuugcacucugggcuccuucugggagcaggacugagauuuauaugaugagcaauggguaauagaccgccuuugggggaauaaacaaugaccauuauccaggagcaaggcauggaucggacaguccaugugcuuucucgugcuguuucuucaauucaaccuccccuuucuauaaagaacgugugcccaa

SEQ ID NO: 7060 - RNA, 9898 nt, Mus musculus
agaaggagagagagcucuuucugcagcuccauagagaaguggacggccugggacuggauaguggauugaggcuccuucguuuguuguccagacauuuucaguaaagaacuaggaucaccacagccaccaaaucccagggccacgcucccggagagcgucgcacccgcaauuacguauccaaggagcagagacgcguuggcugguaaaaagcucccgccgcugcaaccuccauuuugcuuccuggcagagaauaaaauggaccugcuccucacugucauuucacucaucaggagggcauccgucucuucaucuucgagagcagcugugagguaaccugguggcgagaaaccugagcacugcgagccaacuuaggaagagggaacccuugaacugggcuugcccucacugaacauggcggcagagccuggcgcagccgauuagcgcaugcucacgcuucaguucccgccccuuagagggcgggauuacagugggagugggagcgaacucugcggcccugccauaagucauccuugccuuuaccgucagccugaucuagaccguagagaaagcauggagccggugccugcggccacggacggcggggaaagacccgcgacgccgucgggccugucggcuucucagcggcgagcggagcugcggaggagaaagcugcucaugaacuccgagcaacgcaucaaccggaucaugggcuuucacaggcccgggagcggcucgggugagagcuucgguuucccgucucccgcccaccucuuugagucuucaagcuccuucugcccacuccagcucguaaacauuuuguccccaaaaugcauucugaccgaacucugucaccgcucccuaggugacgacccauauuauauugucgcuuaaccccaggacgcuccuuguugcuuccuauuuucuuggauccuugcccggaggucgucuccacccuggcuacaaagccuucguuccugagucucuguguacgguuaucugagacaaccccuauguuccugauuacucgccuuucuugaaggcugugcauuuuauccccagaccucccagggagauuuuccuauaagcuccagaugccuuuauucccaguuacuccccaugacauagcuuuugccuuuugcuucguaacucucguccaccacaucagucauuacucaacuguuggcugguccguccguuguggauuagagacccuauuucccuaucuugguggcuaugcucauugcuuucaaaauuaucaccugucacacagguccucccgaaagaugugaugucccugcagagauuuccuuucauuaccauacauacaucacguuucaauaacugcauuugcccuaagaaaauucaucuuucaugcaaccuuguguccaggacacuguuuucuuguggacacaauugaauucuacuaugcuuggccucucuaaguuucgauuuggguguuuccuuuaguaauuggcuuuuuaguugcucuuugugagcuugguagaacucaagaauuucucugaggcguuagagauauaguucugaacuucuagacaauauaaaugagagauauggcuaccacuuucaaaaucaucugaaacaguacagaaaauauuuuuuuuguagugaucauucugaagauauucuuaaaguguugguguuugucuuucucaagucccuuucuuauucuguucuuuugcuugaaaaauuuuaucauuuuuagaguucucucuuuaaaagcuagaacagcauccuaaaagugccugcucauagcugcccgggaacagcaacaguggguacaggcggcgccacacccugugcucacaguuagaaaugcaacuguaaaauagaaaccuugaaagacuucaaugauuuuguauuuuuaucaguauuagcuagugaaagaaacugaggcacaccucuugaguauuuugucugugaaagagcuauucuuuauuccuugggacaucccgugcuaacuuugguaguuucuguccucauuguuugaacuccccucugccagagugcuaguuuugcggcguuguauuuugaaggugaagacgaaggagcuggcuuuguuuucugcaucaguauuugucuggauucagagaccaaguucuagcagcagugggaguguuuaagguguuugugaauauguaauacacaaggcuuuauuuuuuccccccucagaagaagaaaaucaaacaaaaucaaagccacaggacagugacaaacugaacucccucagcaucccuucaguuucaaagaggguagugcuuggugauucagucgauggaggaggagcugaccagcucggugguguggcagaagucaggggaacccagcugggagacaaacuggacucauucauuaaagcaccagagugcaguaguaaggauggagcugagcuccggcagcggaccagaggugaccugacagcagacccggcccagagggcuucucaccacggccuagaacaguaccuuuccagauucgaagaagcgaugaaguugcgcaaacagcugaucagcgagaaacccagccaggaagauggaaguaccgcggaagaguuugacucuuuucgaauauuucgauugguggggugcgcucugcucgcucuuggcgucagagccuuuguuugcaaauauuugguaagacaagagcuuccaguuauuaacuagaagaaugcaaguugaguugucgugauagggauuucuugccagcauuaccagaucuaucaucaggcuguuugaaaguguaguauaaauucuguuauuaucccaguuagagaaugagagccuauuuaugguaauaacuaacaucugucuacaugccagguaccacuuuauaugcuugucuuuuauucauugauuuaaauuccaucuuuaugcacuauaugcugcuugaacccacaaggacucagaugaauucucuuacacagccgcugacagguggggugaaauacaggcaguuucaucccagaaccggaaguccagaugcuuauauauacucuguauuagcuaguaguuuuccaaguaguuugaggcauugaaauguacuccuugugguucaguguagauuggcauugucuauaguucagaaaggguuucugcaguauguaauguaguagccucauaacgacaguuccugaugggacguagaagagcgcagaaagacacaguuacaguucagugucuuggugagagcuuuuuucaaaagaucuauuauuaguuuauuuuuguguuuugccuacauguauguauguguaccaugugcaugccuggugccuccugagaucagaagagggugucaggccaggcggugguggcgcauuaaucccagcacuugggagacagaggcagguggauuucugaguucgaggccagccuggucuacagagugaguuccaguacagccagagauacacagagaaacccugucucgaaaaaaaaaacaaaaaacaaaaaaacaaaacaaccaaccaaacaaaaaggugucagauccucuggaacuggaaucgcaggcagcugugagcgaccaugggggugcugggaacugaacucaaacacuguuacccaaccagccacugcuccagccucccaaugucuugauuugaaguaggaccauucaauagucauuuuaagaaugcuuacuguauauuggguauguacaaaacaucguaaggcaaaacaaguuuuaaaaugugcuuuaugcagccaggcauaguagcucaugccuuuaaucacagcgcuugggaggcagaggcaagcagagcuccgaauucaaggccagccuggucuacagagcaaguuccaggacagccagggcuucacagagaaacccugucucaaagacaaagcaaaacaauauaacaacaauaacaaaaccucugauuuuaugcaaauauuuucuuaaauagaaucuguucaacagauuugauugucucucugaugauaaauucucaccauaacagaggccagaugauuuuagucugcgagccaagagcugcucuuauuuaagggcucugugcugucaugauucaaaagcuaugccugguuuuuguuuuguuuuguuuuguuuuguuuuuuguuuuuugagacaggguuucucuguguagcccuggcuguccuagaacucacucuguagagcaggcuggccuugaacucagaaauccgccugccuuugccucccgagugcugggaucaaaggcgugcgccaccacucucggcuuuguuuuuuuuuuuuuuaaaaacaaagauuuguuuauuguauuugugugauuguuuugcuuacauauauguauguauacucgugugugcagaguaccuucccggucagaagagggugacagagcucuguggaacuagaguuauaggugguugugagcugccaugugggcacugggaauugaacccgguucuuuugcaagagcaagaaguguucuuucccacugugccaucuauccaggcccagugccucauuucuacguaaggauuuuuguuguuuugguuuucggguuuuacucauaucagauauucaguuguuuguuucuugccucugccacaggacaauguuuguuccuuugccccuuugaugaccuuuuacaucuuaguaauaauuauguagaauaagugccauauugaucuuuuuccuuuuguugaaaaugagauaucaagcugccaagcuuuuuuuuuuuuuuuuuaauuuacauugguguucuuguaugucugugugaggguguaaaauccucuggaacuggaauuacagacaguugugaacugccaugugggugcugggauuugaaccuggguacuuugaaagagcagccagugcucuuacucgcugagucaucucucaggcccccacccuacucuguuucaagaaagccagguuguuguugucagagggaucuguggcuucccucggaagcuggguuuaugcagacuuuuagucauuugucagucuccuccaggggagagagauguuacuguaccacuuuuuuuuuuuuuuuuuuuuuuuugaauuuauuucuaaaugucacauaggucaaagaugucucaagagaaaccuggauauuuuuuuuuuaagauuuauuuauuuauuauauguaaguacacuguagcugucuucagacacuccagaagagggcgucagaucuuguuacagauggcugugagccaccaugugguugcugggauuugaacucuggaccuucggaagaacaguugggugcucuuacccacugagccaucucaccagcccguuacuguaccacuuaauguuaccaaagaagguaagcuuuggagccgggcuugguggcgcacaccuuuagucccagcacuugggaggcagaggcgggcggauuucugaguucgaggccagccugguauacagagcgaguuccaggacagccagggcuacacagagaaacccugucuugaaaaaccaaaaaaaaaagguaagcuuugggcugggcucuuuagggcacuucuaggacucugaagucugagguagcagaaucaugaguucaaggccagccucuauagucaugguucuccaccuuccugcuggacccuuuaauacaguuccucauguuguggugacccccaaccaugaaauuauuuucauugcuacuucauaacugcaguuuugaugcuguuaugaguuguaauguaaauauguuuccugaaggucuuaggugcccccuaugaaaggaucauuugaaccucaaagggcuugcagcccacauguugagaacugcugcucuacauaauaagauucugucucauaaaaaaaaaaaaaaaaaagaauagauuguuguguaagagaacacauuuggagagggagcacacugaaaaauuacguuugagcguguuuuaugguuagagacucagaccauguuauuagcuuuacucuucuacagaagucagauacccucgccugcugcacuagauguuuuucuguccuguuuugccuuuauagccgcuguuaaguugauuuaucaugauacgaguaauucuacuggaaauacuuaauuuuauuuuuuauuuuuacagucuauauucgcuccauuucucacuuugcagcuugcauacaugggacuauacaaauauuuuccuaagguaaauuuuaagucuuuucuuaauuaugauguauuuagauugacucgugacuccauaacaguuaacaauuuaauuuacuugugugugcaugcauuuguguguauguguaggauacgagaguguggaccugccuuuguggcagucagaggacaacuuuccggaugguuuucucaugccuuggcuuugagggaucaaacucaguugucaagcuuauaagcaggcucuugccugcugagccgccuugauggcggcugacucacuguaagaacuuaaaggcugggaaggugccucggugcuuaagaauacauucugcucuagaggacccaaguucgaugccuagcucccacgucaggggguuaacaguuaccuguaacuccagcuacagcuacagugggaccuaacuucuuuggccacuguggguaccugcacucauguaugcaugccuacacagauacacagaauuaaaaaauacaaauaaauaauuuuuaauugaaaaaaaacuaaaaaaaaaaaaaaaccaaacaaaccuuaagggaaacaguuacacugaucugaguuagugcuacaggagaauaaauacagacauacagacagacagacagacagacagacagacaaacaguaacaugcuguccagcccgggguuacagagauagcccaguguuuaugagccuuuacugcucuuguagaggaccugauucagucccaguaggcacacuggcggcuuacaaguaccuauaauccuagcuccagagagccugauguccucuccuggcacgaugacaguugcuugugcccagggcugaacauguacucagaaggagaggacacagagcauggugcuguguccaacccucagcacacacacaaaaaaggaaaaaaaacaaaacaaaagaaaucaaaaccuauuaaccucaucagccugugaaccuguauuuucuccccucgaagccccaagugaggaauaucuaacccaaagugagcuuucauaguccaagucucuuguuuuucuugaagaaacaucuacauaugguuucuucagcucucacucuaccauccacaacugcaguagaucuuccuucucucuuuuuuuuuuuuaaagauuuauuucauauauaugaguacaccguagcuguuuucagacacaccagaagagggcaucagaucccauuacagaugguugugagccaccaugugguugcugggaauugaacucaggaccucuggaagagcagucagugcucuuaaccacugagccaucucuccagcccucuucucuuuuuuuaaguuuauuuauuugccaggugguggugguccauguuuuaauccuaacaguugagagccacaagcagguggaucuuugaguuugaggccagccuggucuacagaaggaguuccauguuagccaggaacccuguugauagggaaucuuguuuauuugguuguuuugauacaguuucuuuguguaguccuaguuguccuagaacuuacucuacagaccaggcuagccuagaaccuagaaauuccccugccuuugccucccaagugcuguuauuaaaggaauaugccacccgcauccggcaagaauauccuaguaugagucuuuauguggacauaagcuuucauugcucuugguuaacuauauagcuuuuuauauauuuaaaguugcugaguuaccaguagcuauuuagugauacuaaauaaauaaauuuuagagaucaccuuugaauuccauuaaaaaacugaaucugggggcuggagagauagcucagcggguaagagcacugacuguucuuccgaagguccugaguucaaaucccagcaaccacaugguggcucacaaccaucuguauugagaucugacacccucuuuuggugugucugaagacaccuacaguguacuuauauauaauaauaauaaauaaaccuuaaaaaaacaaaacaaaacaaaaaaaaaaaaacugaaucugaggcuggagagacaacucagugguuaagcuucuaucacaccagugccagggcaucugauggccucuucugguucugcaggcaccaggcaugcaugugguaugugaacauacauguaggcuaacacccauacacauaaacuaaagauaauuuuacaaaaacaagacuaguggugguggcgcacaccuuuaaucccaguacuccaaggccgagaggcacgcagaucuuugaguuccaggacagccaggacuauacagagaaacccugucuugaaaacuuaaaagaaaaaaagccuagugucaggggauagcacucuagcaggagugaggcucugaaucugaaccuagcaucuuguggaucugagcaucgugcuuagagccuaugaauccagccauugggaaggggagguagaagggucaguaagucuucgacguguagcaaacuugaagccagugugggaucucauaugagauauaugugggauaucacauaugugggaucucauaugugagacucagcauaugauaucauucucugcugcucugacaggacgcuacucaucucugaaagcuucuuuucucucuccucugaaacccuucccuauauguuucuguauguggugauauacuggacaucagaacugccagaucccuucccugugcuuuguuuacauaagacaccagugcagucucugugccauuuggaucccuauguuacacacuaucauuucauucauagccucauauccaguuuuauuuuuucucauuuuuuuuacccuguugucauuguguaucucaaaaguuguuacuaugucuuguuuccaaaaugacacaguuaauuaauuagggacuuucuacagggcccuggcuguccuagaacucacuaugaucccagacuggcuuugaacucacagagaucugccuguuucuaccucccaagugcugggauuaaagaugugcugcaucuuggcuaggcaaaaugacauaguuauaaaacaauuuugcugggcauccugaugucuccuauugccuaauaauccucggauuuaccuauugugcccaguaaguguugucauguuauuguucugacaguucauuagcaguuuugacaacugaggagagacggcaucuguccugucuguagagcgcaggcguagucugcugagagcaaacgauuaacuucccuuucaucuguacagggcgagaagaaggugaagacgacggugcugacagcugcgcuguugcugucugggauucccgcugaggugaucaaccgguccauggacaccuacagcaagaugggcgaggucuucacggaccucugcgucuacuucuucaccuucauuuucugucaugaacugcuugauuacugggguccugaaguacccugaaacccgaggaacuuagaaguuuacaaaugacaacaacuucucuuuuacacugcagagucucuaaaaggggcaacuugguuuauaccuucaucaaaaucuuuggcuuuacagaaauccaauguaaucguuucccugauuuaaaaggguugacuuuguaucaguacuggucugaguaaccaacuagguuaacgaacagcacuaacgauuucucuuguuuaauuagaaguccaaucuuccacuuuuccucuaaugucugagauuuguaaucccucuuguaggcccaggcuaguccuuuuaggcgacuagauagacaggucucagccugccuaaaagacugcacuuuguauuucugucauuccuuccugagaaaugaaaccauccucaaaauaaaagcgaauggaauuagauugacuaauag

SEQ ID NO: 7061 - RNA, 11599 nt, Mus musculus
caagauggcggcccgcggccacgccugcgcucugggcucuccuccccguagucucccuggggcggggggugcgacuccgguugccggugcgccgauuuucuuccaccgcgguggcugucgccgcggcucccugucgcgcgccaugcaacuccucugcugguggcaaguccugcugugggugcugggccuuccggcccacggccuggagggugagugcggaucgggguccggcgaaggcggcugcguggggcgacgcgcugccacccgcgggcggugcgggacggugcguggcggugggggugcugggcggcggaggccgagccugcccaggccccucggcgggccuggcccgauacccucugcgaugcgcacuuuaugaucagccgucaaacgcagacaccugacuuuuguuguguccugauuagaaucccagagcucagaucuccuccaguccuuccagccgccgcgggagacugcuuccguuaauaccuucauuucacaggcuggagacgaggaggcucggagggaauaagcuauuugccuguucgcacuuaguaguaauaucagagccugaggucucuccgacuucaaaguucacgcuggaguucgcucuugcugggccacuguuugaaaguggccacucuagauuaguugggaucugucugaagaaaacaccaaaaaccaacaucagauuccuggggcccguguuuauguggggaccccuuuaaguggguaaaggagccacucugugcuagaguggggagcagagagaggccuucuuaguucauggcucuuuuauccacuccuauuaaaagaccauuucuuucuuucuuuucuuuuggauucauuuauuuauuuuuaguugauuaguuaguauuuuuuugagacaauguuucucucuggaaccuggcuguccuagaaauuacucuguaggccagagaucaagagaucugcuugucucugccucccgagugcugggauuaaauuccaccacugccugauuuacaucaaacauuuuuuguugcuauuguccuuuguuuugagacagcucagaccgacccccccuccccccaauccuccugccugccuagggcuguuuccauuuagggaugcccaaccuggaacugagacucaggaccuaaauccucuuucaauauuaugcagccauagaugagggccugagauggaagccagugucugucagaucucacagccaaaaauugaaauuuucaaucuauuuaaucacuagccuuuaaaaugaagauguaaguggggcagugguggugcacaccuuuaaucccagcauuugggaggcagaggcagucggauuucugaguucgaggccagccuggucuacaaagugaguuccaggacagccggggcuguacagagaaacccugucucgaaaaaccaaaaaaaaaaaaaaaaaaaaaaaaaagaugauauauggaauaguuggcucucuagacuucuuucucaaaaagaaggcacuggaacaagcagagaauggggucagaguguuguaauaagucucggcacccuccaucaguguuuauuacaggccugugguguuccugaccagaaagcagcaaggcugggaaacugcucccuuuggccugugcuagcugucugaagguucuagacggguucagcagcugccaccagaugugguggcacaggccugugaucuuaccccagcguagguggaggcagaaggcuggggaguucaaagccuguagcagacaaaagaaacagaacaauauuagguuuuuaguuucucuacauucagugcauacauuaauaguuccucacuaaauacucagauuucccagaguuaguagucauugugaacuccuugcaaaaugcacuauuccuucacacauucguacagacccugaagauaccacagacugacuaggguauuggucacgugguuaggcuauagccugggcauaaaggaaccuucacagcugguuccuccucagaguggcugaaaauacaaggcuucccccucccucacacccccagcuacuauugagggacuagcaucugguuuuaggggugcugcccagggaccuaggaaugagagugaacaacugcccuugaguuccaagauccuguagucaucuuuacuagggagucugucaguggauugcuauuuuguuacuuucuugggggcaugugucacaauguagcucauucuaguuugaagucacagaaaucccccuaccacagguucccuguaacugggauuuuaggagugaucuaccacgcucaguucacugagucuuuccaugaauucugugcauuggacugcugggccccaguaugcauaggaggguuagacaaaguggagggccugccuuccaauguggagagcaaggcagguaucaaauggauacaaauuauuaagugaauucuaaggggggauacaucaagggaagcccagagcauuguugggugccaucuggagacugcuuacccugcuguaaaggguaggauggauguccuuguggaagugaaaguuagugcuuccaucugaaggauccuggauuugccuggagauggagagguggugcagaggacuuucuuagcugagaaaccauucucaggaacgguccaaggcagaaugggggacagugggagugaucagggaccaggcaaucacacagggcaggggaugccgcucaaagaguuuuaaacuggggagaagcaagaucaggucugagcaggucugaagggagauggacuaagagcgggugcccaggagaaacuacggaucuggagugccagcuuaguuaggagaguagauuaggguuuaccccccacccccaguaauugucaaagccaaauaaaauaaccauagucagagucucauucauuugguagaccaggcuggccucgaacucagaaauccaccugccucugccucucaagugcugggauuaaaggugucugccaccacugcccggcuccuggcaucuuuuuuacagcaucuuugcuuguggucuccagaacuggagaugguaguggcucucuuauaguaaaauggaaaauuuucaccauccgggugagucucauuuuggaagacaauuguaaguuuuugggguucauuugcuuucaagucagaugugacaguaugcugcccugcuuuaguugcagaggacaguggucaccccuggcgggaggagcggccugucccugcucuccagguaggagcuguguaucugcaugaagaggagguugcucaggaccaucgggaccaggcaagagcggcggaacccauggaggccucucuggguccgcgcggagaucccaugguggugcugucaguggucccuggggcagcugaggaccaacggagccccgaggcccacgauggcaccugcagugcgcagggagaggaggacccgagcuguggccgagagaaccucuucgggcugcagggggcaggcggcuuccaggaucgggaagaggaguacuaugcugagccuggcgugacugaggccgagccuguagccaccgaggaugccaacagcacugacagccucaagucccccaaggugaauugugaggagaggaaugugacugggcuagaaaacuucacucugaagauuuuaaauaugucccagguaggaagcacguguuaaugucugucugucucugugucucuacaucugucucuaugucucugucuuucuuuuuaagcucaccuuauaaucuaauacucaucagcuuucggauggauguuguccagguuggucuccaaccccugggcgugaccagagcaugcugccucagcauccuuucugcucagccucuucccuguuacuccgugaggauggugucggaugacugccacagugcagccagcugccacucuguuuggacaggucuuagguauccuagguuggccuucaauugcuguguagcaaaagaugaccuauggcuuuauuuuuauuuuuuuuuauagauuuuuuauguauguauguauguauguauguauguauguauguauguauacuguagcugucuucagacacaccagaagaggcugucagaucccauuacagaugguugugagccaccaugugguugcugggauuugaacucaggaccucuggaagagcagccagugcucuuacccacugagcuaucucuccagcccaaccuaugacuuuagauguugauucuucugccucagccuguggagugcuggggucuuaggucugcacuaccacgcuuaauauuaugaggugcuggggauuuguauugcagcccugcugucuuaaaagaaaagaugauguuuaggugaccaaaagccagucauuccuagacuacucccacuaacaaggccauggaaaacguccuacuggacggacacccaggcacuugcgaucagaaucacagcaguuuccuuuucuggagcugagacuagcucggggauagagcacuugccucgcuuguguaaggcccuggguucaauccccagcaccaccaaaaaacccaaguuuuuaaagaagucugaacgaggggcuagagagcuggcuaaacagcuaagggagcucugcucguccagaggacccaaguucaauucccagcacccacuuuggauggugcacaaucacauggaauucuagcuccaggggauccaauguccucucuggccuccucuagugccuucgcucagguacacacacaugauuaaaaaaauaauaaaaauaaaugauuuuuuuuaaagaaaagaaaauccgaaugucugaaacugcaguuugauauuuacgcuggaauauuacaguguuacagugcuaaaguuucucuucucucucaagacugggagccuugugccugcuuugcaaaccuuagcucugagggcagugguggcucacugucauggagggcaugacauaguuaauucaugcagcuucuccagaucuggggucagaacacuguccucaggcccugaagggcuguuuuguugucacacggaugaccgagccagucuggguuacggcucggacaccuggggcaggagcagugcucccuugaccuggcuccaucgacuugcaccaaccuuugaccuuuggccuuacacauugaucuuagcucuggcaagaugacagucugaaaguguuugauauugucuuaguuagggucuuauugcugugaagggacaccaugaccaaggcaacucuuauuuaaauggcacugacuuacagguucagagguuuaguccauuaucaacauggcggguggugugcaagcagacauggcucuggaggaguugagaguucuugaucugaaggcagcagaagggcacuggaauuccauauggagcuugagcauaggaccuuaaaucccacccccacaguuucacaccuccucccgcaaggccacaacuccuaauaaugucacucccuuugggccaggcaucaaacacaugggucuucaggggccaaaccuguucaacccaccucagauguguuaucuuuuuauuacuguaacacacuucuaaaauaccugggguaaccaacuuaacaagaggaaaagcucguucuagcucacaguuuuggagccacugcucggcuccauuguuucugggccugugaugaggcagcacacccugguagaacucauauuggaaaaaucccucgccuccuggggacugggaagucaaaagaaaaugaagagaucaagguuuguacggcugcacacacagugcuaggcaggaagaggcaggcagaucuuugugaguuccaagucagcuggagcuacacagugagacccuuuaaaugaaacaaaacgagaucaaaguccaacagucccuucaugcuccggggacuggagagauggcucagaaguuaagagucuugccuucucuuacagaggaccuagguucaauuucuagcacccgucuguaacuguuguuccagggcaucugaugcccucuucuggcugccacaggcaccagguacacuuguggugcaugaacacgcagcagaagacucauagcaguuggucgugcuccagugaucuauaugaccuuccaggagagcuuacuuucuaaugcuggaacuacuuuucaguggcuccacagagugugggugagccuccagcaaacgucucuagcuaagcaguuaugaugcuugcugcucuuccaguggaccugaguucugcuccaaacaccaggguuggccaucucacaacugccuguaguuccuguuccaggggucugaugcucucugcuggcuuccaugggcaucugccugcacauauauaugugcaaacgugcaugcauacucacaaacacauaacaaaaauaaaucuuaaaagcuguaaaccagccgggugcgguggcgcacgccuuuaaucacagcacuugggaggcagaggcagguggauuucugaguucgaggccagccuggucuacagagugaguuccaggacagccaggucaauacagggaaacccugucuuggaaaaaaaaaaaauaaaaaaaaaaaaucuguaaaccauagcaucugagauguacaguucaaugccacgaugcacaggugcugugguggucugugugugcugugagugcuuaguguuugacuugaccgcuuaagaaaacaccgaaguaucagguauccaugggaaagcuuagagaugagcgugcccugucauucagagugcuuuccugcugacuuguggucuucaucagucucuguccucucugcccuccugcugaccacucccuagagcagcaguguguccucuuuaugggggagccuuucagaaacacacacaggugcuuuguuuuuguuuuguagcccuggcuguccuggaacuugcuauguagaccaggguggccuugaaccuagaguuucuucccaacucccugccuagccggcacauguguacuuaaugcugacuuuaacuauugugcuuuucuuuguaggaccucauggauuuccuaaacccaaaugguagugacuguacacugguccucuucuacaccccguggugccgguuuucugccagccuggcuccucauuuuaacucccugccccgggcguuuccaacacuuggcuucuuggcucuggaugcaucucagcacagcagguauccuuggcagacuguggcuugucuuugcagcugaugucgugguuagggggagcccugguuguuuaagcugcaaguagggacggccauggagcuuuguaacaggcuguuggucaucaggcuccugggagcugguggcguccaguucuguaucaguucugguggauggaagaguggcaggucacagggacagaggaccuuggauggucuagaccagacuaaacuaguacccgugguaccacaguagggcaucugucugugccauagccugcagugcaguugccagcccugugcugugcugugccuaugcauguuuuuuuuuuuaauugucaucuuuuaaaaguacuuuuauuuauuuuuaacguauguauguggguguucuggcugcauagauggcugcaugcuauaugaccaugaaggacagaaggaggugcuggaucccuuggaacuagaguuaugugagcuacugugugggaugcagagaaucaaacccaggacuucuggaggagcagucagugcuccuaacugcugagccauuucuccuacccagcucugcuucucuuaagagcagaaugcgugcuuaguuauugagcugucucuccagcuucucauuuucuucccugucuugucuugucuuuucuuucuuucucugucucuuucuuucuuucuuucuuucuuucuuucuuucuuucuuucuuucuuucuuucccuuccuuccuuccuuccuuccuuccuuccuuccuuccuucucucucucucucucucucuuucuuucuuucccucucucuuucuuucucuuucuuucuuuuguucauucguccauccauccaucugcucuuccuuccuuuuuugagacaggcucgcucugcaucccagacuggccuugaauucucagccguccccaugccucagccucucaagugcugagguuacaggcgugagccaccacgcguguauuuacucuugugugcauauuacagguuauguauuaguauaacacgcacuuaauauauuaauaaaugaauguaucccuuuguagugacauuauccuugcuuauacgucuauauaguucacagagcuuguuaaucucuucuuccuuaggcagaucagugaguuugcacuguuacccaggagacaagagaacagcuauaugcuguucaucaauaugccugccuugccuuuuaaccuuauuuuuuucauauuauuuauuuguguguuuuuauuguuuaugaagaaaucaauugucccucaaguaauuaucauuuuuuaaagauuuuuuuuucauuuaugguguauuaggguucucuagaggaacagagcugauuauauauaucacacacacacacacacacacacacacacacacacacacacacacucuccugauaggaaggccaagaauccguuaauuguuagucuccagggcuagaugucucagcugcucuccagccugcaugggaaucccaaagaaguccguucaaacgucagugaggggauggcucccaggcaggcaaacgucagugaagggauggcucccaggcaggcuggaaggacuuguuaguuagagcgagggcaagcaggcaaaaaagcaaagccuccuccuuccauguucuucauguaggcggccaccagaagguacgacccaguuuuagggugggucuucucucuucaaaugauccagacgggaaggcaccucacacagcugccuggguuuuaguugaugccacauguggucaaauugacaaccaagauuagccaucacacacggaaugugagugccugcauguauguugaggcagagauacucggagcugaggugacgggaagcggugaccugccccauacagguccuccaggagcgccaucugugugugcucugaacuccugagcagucucuuucguccugaguaacuccucugucugcuuccagaaagugugugcgugggccggccugaggaauggcacuguuugucaagcucagaagugagcccuccucugggacugggucgcccucuuccccacucucccuuccuaaagcuuuuggcauccucuucucgccuugaugauggaggacacugucauuacaggggguggaccacgugcuugcuuguauggcagcaucagaaugacauagugacauugcucauccaacacugcuuguuagugcugggagaaacugaggcguggcgggguuaagcaguguccccaaaggucauagcugcuucuguccucagaccacugccagaacccggacuggccaagugaaggcaaaagaagccugcaggccaccucugcuaaguccucccucccuaguuucgagccuuccgcuguguagauugagucagaauuucuuugcaccaaucugggaaagaauugcuuacuguaugcugaucuuuuuggaaggaagggauggccauucuaaaguuugaaguuuguuuuuuuuuuuuuccugucaagaaaauugacacacggugcuucauccaugaauuagaauuuucuggucuguguuguuuugacauuuggaauugcugggucauggcuggaauuaugugcuaauaccaacugacuuggauugcagaacaggacugccccagccccgaaccauaaggcuguggcaaggaacagagcaaaagucaaaaguuugacuuccaaaaccacaggucauaaggaacuuuucauugauaucuaccaauucucccagggaagccacgugaggacauucguuguagggcuuucuaacuuaacugccuucuuugucuuacagccuuucuaccagauuuggcacuguagcugucccuaacauuuuguuauuucaaggagcuaaaccaauggcaagguuuaaccauacagaucgcacccuggaaacacugaaaaucuucauuuucaaucagacggguauguagaaauaacauccgggggaggaaggcuuuuuuuuuuuuguuuuguuuuguuuugguuugguuuuuugagacaggguuucucuguguagcccuggcuggccuggaacucaugaggaucuuuguuaguugcagcacugcagcuagcuauugugauuauaaacuuuagcugaauuguugggcgugcuuaugacuuaguuauuuuuauuaugcugaguuccauuuuuuaauccauuugaagaaguugcuuuaauuccuuaguguuugccaaaacauauggcccuauuguuucuuccuuguaaaggcuugauuguggugaguggaagaacuguguuccugggaaacuccucuuucucacagcugucuagccgugacuuccagccucccucuucccccugaggggcacuuacuagaaaugagugcagauuggaacgcuccucagggcaugguguucucauuucuuucugacaccaaagagcaaagacucuccuuauuucagguuaucucagaguaacugagugccuuaggguugcugggaauucugagccucaugcugggcccugauucaccaguccacugggagagaaagccauuguguuuggugauugcagaggaguucuaggugccuggcaucuuugaucacuguccagugguggguaacugucuuccaugaacucauuuaaaggcaucuugauaaccugugggaacuucugagaguagcuuuauuuuguugaacuuuggucuuaagagaacagaaggugacucuuaagaguacauugaccagaaaagcuccaaggagucagaaauucuagaguuuuagcuuugaaaggcuggaaggauucccgauccuuugauguggugggaggaaagaaaaucacacugacacacaagugaaauccuuccaagauaugcuugagaugguguuuauuuuagggucgcuugucauuuugcaugccgugcaucauacuucagacaagccucagauguguuuucuuucugauuugaaacaauuaauuucucuuucagguauagaagccaagaaaaauguggugguaacgcaggcugaccagaugggcccucuccccagcacuuugauaaagacuguggauugguugcugguguuuuccuuguucuuuuuaauuaguuucauuauguaugcuaccauccgcacugagaguauucgguggcugauuccaggacaagaacaggaacacgcagaguaaagacagaacugaacuggaacaagaggggucucagccccuccuuuguggacuuagcauuacagucgcuaaauguguggacuugcaacggaaaucagauucaagaaucauguucuuguuggacuacugaaaagcugaaaagauuucauauaaauguguuuuuccuaugacaacuagcagguacaaaaauguccacuagaauugacuguuguugcuuuuuaauacuugaacauaaugaauuucuuuucuagugucgucaaacaggaaaguguugucucagaagaggagcuaagaugggaaguaugggcuaggacgggaagugcaggucuacuacaggaccaggugaaaaauaaagucacugaaacaauucaaag

SEQ ID NO: 7062 - RNA, 3557 nt, Mus musculus
ugucacacaacuuggauuuuuaaaaaaagauuguuuauuuauauauguguaucucucccuguguguaugugcacacacauggugauacccguggaggccagaagagggcaucagagccccuggagcuggagugacaggcaguuuugagcuaccugauuugggugccgggaaaugaacuuggguucucagcuagugcucuuaaccacugauccauuucacagugcuugggguccuuaccacaaagaauguuuuuuaaaaacugagugggggauuuaaauagugaaugguaaauaccaaauuagucuggggauacugggauagguuucuauuaugaagaacaaugucuuacugaacauaggaagauugacgagacuccucuguauuucaucugaccacaacagaagguaaagcugcaaagcaagagagccaaagccacggggguuaaacagcccacucgggaacagcgcaugggcccuggaagaaauugaggaggagaacagcauuccuacaaucuaguggaauuggaaacgcaacacagcaaaucuauggaacaagugaaagaaaguccugagagggaaaguuacagcugcaaguguuacaacauuagaugggccagcaggaugcccccagguacaggugcuugccccaugagcauggagaccaggcuucaaccccugggaccacaggaagguggaagggaagaagcagaugcagagaucugccuugacuccacaagccuccauagcugugacccccugcccaugcaaaucccuuuaaaauaaaaagagaacuuagguaaguggaggaaacaguuaugaucagggcagaaacuagugagagaaaaaugcaugagacaagcuaagguaucagacagagggagacaugaugggaaaggcuggagguucaaaccagacaaagauggccccacaucauaaaugagaggggaaagggauccaggagaguagaugcugauaaacuaggaaacagguuaggauagaccuuuaagaccuuauaucccacugaauuggaaaaucuaaaagaaaugaaugaauuucuagauccuacuaaaauuaaaugaaaauaaacaaccucuuugacaaugaaaaugaccuuucauucaacaucauagaccaguaagcacagauaaccagaacguuaugauaaauauuacaagcagaaggaacacaguggguccuucugacuugacuggcugguccucauaaggggaguacuguacauguauauuuaucauucagagaaaugaacacagauagugucguuucuaguuuugagacuagacuugaucuguuagugucccugucacaagccagcuuuccaagcugcagacaggcuaguuagauuuguugauucuuggagaaaucgagaaaggggggaaaaagacccuuuccuuuauuuaaauuaaaaaauauguuuucauacgaaggaauggauaugcaaguaguuaagagacaucucuaaagaucaaucuuuaaagaucuuuuaaaaauuaaaauauaauuacaccauuuuccuuagaguaauaauuuuaguggauccacaacaaacgagauuaaaacuguaauaagaauaucccgacugaaaacauccagauucaaaggauugauucucugaugaguccuaucaguccuuuaaagaagaauuagccucuccagccuccacacgcuaggggaggagagggcacuaauggcucuuuaugaagcucgggucacccagaugcacauacaagaaacaaagaacagaaaauagaugcagaacuauucccucuucccucugcucucugcaaaccagaucuaagaacacaccaagaagaugauggaccaugcuaaagcuggcuuuguuacacaggugugggggcggugggggguggggaggcucagcaugugcagacagacucaaggacagaaaucacgugaccucuuaacugaggcaaaaaaggcuuuugauaaaaccccaaaucccuuugugauaaaaccccugagaagaccagcaauaggggggacauauguugauguaucucaggcuauaggggacaaaucuucgacaguagacuaaacugggaaaaacugaaggaauucccacuaaaaccacauacucuucucuuuccggauguguuguuggacaucucagcuagaacagugagacaagagaggcaaauaaaggagaugcagagaaggaagguuggcgucucuaacugcagaggaggacucuucagaagagaucccaaaacacagccaggaaacucuuaauggcagcauacaaaagucagcaaagaagucagaagccuuccuagccaccaguaauaaaugcuccgaggaagacaaugggggacaaucccauucacaguugcaucaaagcaaaaauaaagcaaaccaccccacucccaaccaaaaccguguaggucugaagggcaaggcuuccgcugccauacgugaugacccgauucaaucuuccgugugggaugugugaacaggcucccacaaauuguccucugacuaccccagcuuacugugccuauacacacccacgugcaugcacacauggagaccgaugccaugcucaugcacuggagaaaggccaucaugugaaaauggauguuguauaaaucuaguguaauguccauuaaaaucccaacaucauucuucacaaaaauagggaaaaacucaccccuauaacccauaugaaagcacaaauaaccaaauaaccaagcacuuuugggcaaaaagaauaauguuggagccuuuuccccauaccugauuuugaguuguacuccagagccagaguaacaaaaacaguacagucugucacagagacagucacguaaaucaacaggacagaagaguagaggcagacacgaacacacauagcuauaaccaccugauuucuuacaaagacagcaaaacacuuggagaagagauagcaucuuuaacaaauggcaagggugggauagagagcccaguggguaaaacacuuaccaggcaagcaugugguuugcaucuccagcauccacaugagugcuggacagauggaguggcuugccuguagucccaguacuugggagguggagacagggaguguucagagcaagcuggcuaguuagacugacugaauaaggaagaaacucugccuuaauauauaauguagagagugacugaggaagacacuuauuaucuuucuuugucuccacacaaauacauacacaugugcauggacaucuguguguauacaugcauauauacacauaugaacauacaugcaugcauauauacacauauaaacauccauacauacauagauaauauaugaacacacauacauacauacauagguacacaugaacauauaugcauaguguauauacacacacauacacacauacaaacuagucauguugagaaaacuguauacccacauauaaaagaaugaaaugagaucuacaucucccacccugcacaaaaaaacaaaaacaaaaacaaaaaacaacaacaaaccacaaaaacaaaacccaaaaaaaaccucgacguaagaccuggaacugu

SEQ ID NO: 7063 - RNA, 11150 nt, Mus musculus
cuuccccacgggcgacgggcgacgggcggcggcgggaggagcggguugaacggaggcagccccgaccuugcgugcuaggauguaacgaaccgaaccggcggagacccacacugcgcgcagagcagagccaguggccaccugagcgggagucugcggcgggcgagcccggagccgacuagccucagacacagagcugccuccauacgguaagagacgccaggcuggggcgaggggucuccacagucuuaagcagggaagaggccaagaucaucgaggcagcaggagauacugguuccugcgggccggguggaucgugccaucaccggauugcuaacucaccuacgggugggcccacucugugccucggccccacacucccagagggcuacgguguccagggcacaggcucaggcacagcaaaggcgcagcccuggaagccccuggcagugcuucccgagggccugcgggagacaguggcccgugagcggacuggcagcugccgcauccaggaauggggccccaccgcaaauggaaacgcuggccccugggaauggcuaaggacuugggacauagcuucgcgucacaaggguauuuuucccaaacgaaacugcuucauucguuaguuaguucguuaggguagcaaugccgccaaaaaguaguagggaccggucaaagucccgacuucuucgcucuggaccacgauguccagcugucaccuucagaaaugucccagccuaugguggccugcucccugcugcaugguucgggcuuuuacuuccccuaagagaaaacccaaauacaccucguaaaguccaauaaaauugcucccgaagccucuccuggguuugguuguugauacagaaucucugagcacacaacgguuucucuagaaccgggucuucaauuucuaaaauuguccaguuucccacacugaggcugaauaacgcugaagcaaagccugggucggugggggggggggggugucgagguucaccucugaucgcuguagggaaaaucucaagcuaaaauucugggucccaagauuauuuucuaaucuaggaauucaacaaaaucuaauauauauaucccaaauuuaugagaaaugaagauuuagauauuaucuuagcaucucugcaacuggagaaaucccuagguuauuguccacuugugaaugauggaggacuaagggacuggccaggucuaggguaaagacauaaacuaccuguagcggggcacccugggagaagacucccaguuccugcccauucccuugugguuuugggccuuggugccuccaccagagagaaaaaguagggucugaggacgcuguggaaacacacaggcaauugauaacuuucagguuuccagcacccuucucccaagaaagcagcccugggagagugaaaaauaaaagcggguccuccucugcuccagagcagagugacaaacgcuaccauuuucuuagccgcccuauauucccuuagcucagccacucuucuggaaucagaaaacaugguggcagacuugggugaaaaacagcauggagagucacagaucauaucagccauggagagagacaagcccuauacauccauuguagcugguggcugauguccuauccagcagucaguauucccauacaaccccgucccucaaagaaaccucaauaggcugcaaccuucugggaaacugauaaaauccuccaaguuugauccaauuucuaccugggcacuaggugucuauaauugcuugaaaaaaauaaaaaccaagagcuuuuauuggggaggggguauuagauggggcagaaagagguaggugguccccgauacacuccaaaaacuggguuuucuaguuugaacuacucuacagccuaagaggcuuaggguuggaaugucccggggaaucacggauggcccugggggcaagccauagcacauuccuuccuuuuuccuaaaaucccuucauucuccaagaguacagauuuuagggcagcauacccagauagggaccuaaggguggcccccaugagaguccuccacucggccuucucaagaauuaaauuacuaaaccauucuuuugccagauucuauuugacuaagcccagaucagcacagguccuugggcugucucuccucuaacucccacaacaaugcaggcaucuccagaucaccgucucccgguuucuugaaggacagagaaauauuucggacucugcacaggugggaaggguaguggaauagaacucgaccugcuucagugaacccccuuucuuccaccccuccugccccaucuggagaccaacucucacacugaacaggagaacugagauucacuugaaggucaaaccucaaaccuccuccaagucacgcaucaaaaugaagggggcugugcaugagccucugccccagaaagauuguagcuuuccucccgguguguaucugcaugugcauaccggaagccccugcuuagaguaggacagugagugaggaggggagggggcuguggaagaacagagaauuuaugcuagucucauucuucaauaugcccagagucggggcacagccucuuguugguccucccacguccaccccaccccccacccccuugaucacuauaugugcuacugaaaagcacacuccucuggcaguccccauuagccucagugcuucuuuggggcucaggaucuaugaggauaguggaaggaguaucugaaagggucugaagaccacuccacccacacagcaaaccuugauaucuccaaauaaaaggacugcugugucuaacccagagcagugcuuaaggcuuaggcccagaagggcacacagcaauagcuuaauaacugcacugauacacugccaauguauuaacacaauggugaugugaacgacagaugcuucuccacacaguccauguaggaccuaacuucaccauuucccugucccugucugagacacacucccaggcguucccaccucgaucugacuugauggaccuccuauuucaugcuauccaauuggacauuaaacagcacauguguguguccacccguacacagccuccuggguccggacguacaggugugcacugccauccuuguaugauccaggcugcucucugacugagggagguaguguagccccguggaccaaccgaagcaccuagugggcuucacuugcaaggagaaaucaagauaccccagggccuuagucagcuccccggaaagcauccucccuccaucuuugcccaaauucugucucccucaauagaccuggcccuaaggagcugggcaccuugaagcaaggccaagggaguaugagacaguucuggccccacccugcaugucugcccuugcccccacaauucucacaaggcacccauccagggcccagcuacuucccucuggugguagagaagguaggagaaggaccaaaggcagagccuugcaguccccaccacuaacauaccuguagagccaacccaagaaaugacuacaggagaagaugauguccugggcucuggacacuggagaacagagaagugcuucuuuccuaagcccuagucuaccccaucaguggcugguucaggggagaggucugcaggugaggcccagagacagccuagggguccuccguggcuacagaggcaggucagggccaccucaguugugaccuguuuacucaagaagcugaagucccugggccaguuaacaauuguuggauaaaauccuuggacaaacuucauuggagcgugaggagcuaaggaggggaccacucuugugagccuagaggguaaagucuuugcuuggggaggggggagcucuggagcuacaguuuccuagcaguguaucgggagaaaacccaaaggcuuccuaagcucccagcccaggguugugagacaucagucaccuggccuaccaggccucugcugaagcccugagaauucagaaaguaggccccacacuggagcaaaguuacccuaaaggagggcagaggcuggcaaggccuaccugguggcugccaaagaccugaucauuguaggugcaaaacaaagggggauguggaaaggccacgggccugguggggcucuuggggucuccagucccacucgccauggccuagagccaacagaaacguuucgucugauuagaagccgucaucucuaccccaauuccggaaaauugacugcggugcagagaggaaggccaugagagcagccuuaggggagaggguccaaacuaauuagaagacagcauccggggcccauuagagcucgcaggcugcugucacucagccggccccgaguuccugggagaagcgacugagguaggaggggcccgucugccccucgaggacgacaccaccgcugggagcugcagcaaccgggaaccggccccccggcucugccacugacugcccuggcgcuggcucggaggcgccggcucagagcgauccugcucagcgaaccuucacucauucuaaguuguucucucccguggcuggggacuugagguggcccagacaggaguugacucucagcgaaacaagucacuuggggcccccaaggugugcaccagccgcccggggcuagcuggccagaugcguuucuuuugugcggccaagggagaaauucgugugucaccggggaaggagggagaggcgcggugaggccgcgggagagggggggaggugaggcggcgggaagguggcugcgacggggagggcgcgggcgaggccaggagggagggagggagagagggagggagggaggacggcggggagggcgcggcgcgggcggcucgaggcuggauuccgcccgcgcccgcucccucgcucgcuugcucacucgcucgcgcccucccuccuucucucccagcccccucccaccgaggcccaccccacccaccaccccuggcgcagggacugcuggaaccuggcugcgcgcacugucguuuucagacagacucugcgggcuccgacccgagccuuagaaaccggccucgaaucgggacuggggcccgggccggccgggcagcugaggccggagcagcaggagcgcguggcggagccccgagccccgaacccggucccgcagccuggagaggucgauggagcucgaacggcgucgcugugggcgcgggcagcccuggggggcagccgcuuaggcgccacucucuuguccccaacaggucgcagccugggcggccgggagcucccagccccggccccuggagcgcccguugcgguccccaccuccauggacgccuucaagggaggcaugagccuggagaggcuaccggaggggcugcggccaccgccaccaccaccgcacgacauggggcccagcuuccaccuggcccgcgccgccgacccccgggagccgcuggagaacuccgccagcgaaucguccgacgcugaucugccagguaaacgcggcucccccaacccgcggcgggcauccagccuccgcgcacaccgggcggcuuggcacgcagccggguccccucugcgucucugcagcgaggagcuuucuuuuuccucccuggucuuaaccugacgaugaacacggaaauuuacacgcgcguucgcacgcacacgcgaagucacuuccaaacagucccccacacgccaagcccugagugggacuggcagccccucuggagcaggagcagauagcacgcgggagaaaaaaguugaguuuucccuaacugguugcugaggagucgcuggggcucagggcgagaagcagaugugcagggaguagaagggguggccagacaaagugcccaaagagacaccuugacagauggaggaaagaauccuaaaagaagagguggggucacagagcaggcuagaagagagggguccguaaagccgagcucgagcucuggggacagcgagagccagccagcuaggaggcgcggccugacucccggcagagccggcagaacccugcugcagcggggauccuggcccacguggacaccucagcccagagccaccagggguccagccaggguggguucucgacuccacaaaucccccaguugucuuuuaaaaaacaaaacaaaacaaaacaaccccgaucucuugagcugggcccgagauuggguggcuucggccauguccguuuccaggccuguccugucuuggagcggcugugcacgggaggggggucccaaccccaaauagucacagaucuccaggcugccugggacagccaucccgggcccugggcaucucuuccacguuuauuuaaucgguauuuguuucuguuuugcaucucuaagugacuuuuuuccaaccucuguuugcuugguuagaaaacaaagcucugaguguacuuuuguuuuuagaaguuuuaagcgugguguuugcuuaaaaaaaaaaaaccuguagagauugauuuucaaaucaaaucuacagggauaaauuaacaauuuuaacuguaugcuuccuuugacacaauucacuaggaguauuucucugaaauuuaaaagaaccuacaugccacaaguuacuuggagagauuuuuuaaaagucaauucaaaauggcgcauuucuuugagauuccccccccccccaucaaaauccauucguagcaguuuuauuuugugaauuuaaaucaucucgcuguaauguauuuaucuaggguuuggaaaguaucucucccaguguuugugugagggaaucuaaaauuuaccugcagugaugcauagauucuuuuucccagagaaauggccaucugacuggaguuuauacacauuuggcuguguguuuaguuuagggguguguucacaggaacgguuuugacuucuugaucuacauuugcuccgguucugccucccuggcucugaggguuugugcaccuuucuguuucuagggagagagcucugagcuuuucuagggcuccguuuugguuuguaguuccuuugcguuauguuugaaugcuauugacuacugugugcaucuugaguagcuuuaaagagacagagaggcccgggucacuuagacagaauaugucugucuaggcugcaaauggaggguuuucuagaccucagaauccgaggccgguaaggcugggauccaagcuaaguugcggcucugacacagcccuggcaagaacaacauuccaggcgacuacauggcucuuaccccacagauaugcuagcuucagcuggaaaguuuugaugcccguucaggaaagcugagguguccgcucagauuuagaccuucaagagucucagcagggccgcagccagcgagcugcagaagcaggcccugccuagcugggaacccaggcccagauguggcucccgggcucuuugcuguggcacgccagaucuaggggugcuuacugagaaccggcacccggcccuuccuuuccagcggggaaacaguucccagggccccuggauggagggagggaagccaccgcugacggcaggcgcuucgguggagccgggaccgggcgcgauaguguuagcccgaggugacucgcgcccauuccuaccugcugcagacaaggagcgcgguggggaagccaaggggccagaggaugguggcgcgggcagugcuggcugcggcggcggugcagaggacccagcuaagaagaagaaacagcggcggcaacgcacucacuucacaagccagcaguugcaagagcuggaggccacguuccaaaggaaccgcuaccccgacaugagcaugagagaggagaucgcgguguggaccaaccucacugaaccgcgagugcgggugagcguggggcgcgugcagagggcuaccggcuggcacucaguagcuuagacuuacaacucugaccucgcggaccuugcuucguaggagaccccacuuuaggccccagccagccacccacgucagccaggucccugggcuacugcuuucuuagcccuuuuaccugucccacaggagcuacugcaagccccugucggaagacccugucccugcccugaacucugucagaauuacucagagccggagauugggcagaggauucucugccgcuaaggaccucgggagcuuuaagccuucauccccuggaaaacgaaagggaaagacaggucgugccuggcugccucagagaggccugaaaggugcuugaguugggguaucucaaacuucuuggaacugugaucucauucugaauuucccuucuccaaacuguuuuuggaauauucuccaucuuuucuggccagucagccagguacuagcuggaccuuugccuaaugcccuuucccacuguaggucuggggucauguggagcgggacgcugauagugaguggcccuuccacuacacuuuacagauguaaggucccagacccaaggccacacuguauucuggcaccuuccacaguucccagcaaaugcuacccgcuccuucaggagaaguaaggaaaucauuucuucccugggugggcaaauauuuaaucagacacugggagcacuucucaagccagaccaaagucccaccugccucguggagccccugccauaagcccaaccuucagcccuccccagugaggcugguccgacccagugggagccuggaugcagcagaccuucacccuguaauucggagcucacuaauccugcccagguuuaugggaguggggauggugugggguuggguagauagaaucagggccugggaaaggcugggguacagggauccuggccuggagaaugagcuaggaggucgggggccaauguugggaagauaggggaagucggggaagacguggucagggagagaaaagugguccuuaccaaaguuuuuaggagaaaacagagguggagauuagagggaaacuaauaaacuuacagaaauuaaauauuugcagagaaacauauuuggauuauauuuaggcagcaggaaagaaauuaaauauuuaagggaagcaaagagguuaggcauuuagaaaaagaaaggaucgacuauuuaagggaaacagugagggucagauaucuguaaagaagggauaaacuaaauauuuagaaaagaauaaaauggggacaagaaauaaagaaaaaaaccagacuggaguuuagauagucaagaaguggacaaaaauuuacauuuugggaggagaaaaauuauuaaauguaauaaaugccgaugaaaacaaaauaguugaacaacgaaacucgucugaaaaaucggagauggucaguuuugaggaagaaaaauacuuuuuguguuugaaggagacgaaaaagauugaacuacuaagaggguggugguaccccauuuggagagagauggcagaaagaagacagguugggagggagaaaagaaaacgaauauuuguucaaacaaaagagaauccgagucagaaaaagaaaauaaauuuaacuuggggaagaggauaaaaaaaagcaggggggggugugggggaagaggagagggcucguauuuucuggagacgcgaagggaaccauuacagaaaaucucggcagaggccgaagaaaauacgggguguuaggagaggaggcugcagaguugggggugaggacccuuccuggccaccgcggcccugacguuucucccgcuggcuucuccaggucugguucaagaaccggcgagccaaauggcgcaagcgggagcggaaccagcaguuggaccugugcaagggcggcuaugugccgcaguucagcggccuggugcagcccuacgaggacguguacgcugccggcuacuccuacaacaacugggcggccaagagccuggccccggcgccgcugucuaccaagagcuuuaccuucuucaacuccaugagcccgcucuccucucaauccauguucucggcccccagcuccaucucuuccaugaccaugccguccagcaugggcccgggcgccgugcccggcaugcccaacucgggccucaacaacaucaacaaccucaccggcuccucgcucaacucggccaugucgccgggcgccugccccuacggcaccccagccucgcccuacagcgucuaccgggacacgugcaacucgagccuugccagccugcggcucaaguccaagcagcacucgucguuuggcuauggcggucugcaggguccggcgucggggcucaacgcuugccaguacaacagcugaccgccccgccugguccccggggccgccggccagcaaggcucacagaagggagcgcgcgggagcacgcggggcgcucgcagcuccucggaccucaccucugcgcagccccuuccuccccaccccgccuccagguugguuuuguguuugcuuuuuccagacccccgcucugucccccaaugaaugaaaagaaaagaaagcaagccaagggagggggucggguggggaagaaagaaaaaaaaagaaaaaaaaaaaagacgucggagaaaaaugcuggagguggggguaaguugcaaugucccuggcgauggcgcagauggugcguucaaacccgggaucccagcuguccacuacaccaaugggacauggcggggagaagccaguguucggagaagaugccgcgcguccccgccggagcgccucaacccgugaacugaauguagggaaccuggaggcccugggaucguucacccggucaagaaccgaggcgcccucuccuagcccgacccguccgagugcacgcgggcgcggaucacugcuggaguuuacgccuggcugaggauggcugcgucgccgaggaucuggcguuugcgcuggauuagccuaaggucccgggaugccaggaagagcccagcagcacugagcucuggagccgcacacuugaggccacugagccgcagcuggccgaggccagccagcagcaggaggagaagggcucagcucugaguuccccagccccaagcuuagccgcuagcccggcccucugcuccacucuggguccaggagguggcccagcgaacagcccccuucuccacuguccgccugcccgugcaagagucgagccaggagagcgaggggccacagccccagggcccccgcccacuuugcacacccgcucuccggcccgcgcccguuuacagcgucccuguguaugucggacugacuguauagaauuauaaaucugucuauaucaacuuguccauguacgucuauuaaaaccauagucggagcgugcuaagcaccacuga

SEQ ID NO: 7064 - RNA, 1794 nt, Mus musculus
uuuuuucccuuauuuuuuuuuauuuacacgaagcaucugcaguacaaaaauguaaacuuugauagcucauaauaauagaauaaauucuuuauguacaaaaauacauuuucauaugaaugaagcauccugaauaaauuaaaguacccuccaguccagugccugaauagcuaugcuagcacucagguucuuccuggagcaagcccacaguggcgggggucgggauccauaaugcaugaagcccacuccuuguggcuccuuuuuaagccuugccauuguauugucagccggcucaaaccgaauuuucaugcucguuuuucuucauuagaguucuacaaauuguaaaauugacuuuucaccucgucuucaggggcucaucugucccuuuuccaaaccacacugaagugguggcuggggucaguucugagccagucacaaagaagguuuugugaaguucagaaagugcaacaaaaacgaaaggccgucugggggcgggcggggggggggggaggccgugcuggggguggagaaauagaccgagggcagcuucagcgagggugcagcaaccuaacaaguggucagguauucccccuccccccuuuaaagcucccagaauucacuuggggguaaguguggcccccggaggcuucagccaguuccccaucuauuauugcucuuagacugggggaggaagaaaguauugauguugccuuacaaaggccuagugguaugggaugaaacagggcgucguguggagcaggucuuugggcaggccaggaaaggagaaaaggggaucgcccgggccauaggugaagucuucugaagccgagggacuacuggggucagagaguggugaugccacaguggcgcagggggaggcagcggccccggaaccccaggacucagugucgcuggccgggcucgggggcccgggcagacaggggacacacugcggaggcaggaggcgcucccgggcacugcccccggggagcccuugaucugccaggcgcagugucucagccagggcccagauguaguuguaggcgaagcgcagcgucucaaucuuggugagcuuggugucgucggggaacgagggcagcacgcugcgcaaggcguccagcgcagcguugagguugugcaugcgguugcgcucgcgaucguuggcuuugacgcgacgacuccuccgcagggagugcagcagagccucggaccgcacccgagcgcgaccucgccgccuccgccguuccugcucuucguccugggcaccgggaacauucgaugccccggagagggcgggagcgcuccuccgggcuggcacggacagccccgagguggaggcuaggggcuguagccuggcacaguccuccucgucggugaggaagcuggacaggucgcugcugcuguugcugcuggagcagucgagaucagagaugcaggucuccaaaggggcaggcaucuugcagugugcaggaccgacagacggacaggagguuuggaggucggccuucgaagcgcacuuacuguccguacgacccggggcuagccugugccugcugcaggcgcgagggccgggaagaucgcaggggcucagggagugaaugggcuuggcccuccucgccucgccugcaggggccacgcgccgggcuggucuccugagugaugucgccggcgaucagaucagcuccugugagcaccaaguguggcacacgaccggccucaggaccccuuaaguacggcgcgcaacaaugggcgcccccucccuggccaccuccgcccccgaggcggcgcgggugaaug

SEQ ID NO: 7065 - RNA, 7630 nt, Mus musculus
gcaaugacuaaagggccagccacuuuaugucagagggaguccuaaucauggcagagcuaaggagguccccaggcgccuuucccagagucccacagaauccuggcuucuuuucagccuccaggcuuuugugcugaucacuagaccccuucccccaccaacagaaagacauuugacugaugccugugacaggccccacaugugcuuugggccuguauuguucuugugcaggcugugggagguaacuggagggagaaaagggccacacugacuucagguuugcucugugagcuugucauugggaacaggguuccuuccgcaaagacaguucccugggcucugcccagagaaugcucagaugauuuucagucugucguccacccggugagacuucgggagcugcgugauagcauguggcuggggagugaggguggauuggccguuugaggacucuggcugccaggucgcugcaccaggguugagaggcugcugcagcugguggcugguggugucgcucuuuauaaguaagguagguguggugccuucuuaggcagugucugaacaaucaaacuguagaucucagggaagccagcuguccugacaagaugcgccaggagggggcgcugcugcacagcacucggggccuccaggacagcgagguugccagaauggagggguuuccugccacgggcugguaaggagcuggggucugcauuaaaaagguccagcaagaagucugaggaugccagcgaggcugcgggggccagggaggacucucugagagugccagaggagccacugagagucuucuugggaguuguagacuggaggaaaaacaaaaaacaaaaacaaacaacaaaccuuacuucaggaucacuugcagcuuguaaguaaccaggcucccaucuugcgggugggcagucagcucugccaggcuacaccaggcuuucaggcgggaggucaaauaaauucgcuaaugucacucaguggugaugauugugagacucgugggcggcuccacuccaagccccaaaugcuccuucaggccaggacucaagaagggaagugacuuuccugaaggcccacaauccccaccccgcugcauaaaugcccggguuucucugccucagcuucuuuaucaucgauaaaacagaauuagcaugccaacugcgucacacccaaaacgccagugcacggugcuggagcuccuguguuuucuucuguaccagguucugagggccaaggacugccugacuccucuccgacuuucuccucaguugauggacacaagugggaacaagcugggagaucugaaagugaaggguaccuguguaaaaggcugacaagggccaccgcugcuggaaaccucacugggaagccaagagaaguauguaggggcauaaacgggagguagcugggucacauggcuguccuccaugugcuggagaccuagcugcaggcucgcccauggaaauccgaagagcagaggcuagcaguguucagaaaggaaaucuaagggcagaugggcaagcuguggggagaggccauagcaagugggaagauggcgcggagccacgguacgccugcgcaguggccugggagcggggggggggggggggggggugaucagcaguccuuugcucccugguggggcaggauacugaugggcuggagcccugacuccggaggaccuuggguugcagagccaggaacugagauggucacguggaagguggcauuuacaggucgguggcaucuauaggccaguggcagucuucagggaggaugguugcugcugggaguggacaauuacaucacccacacaagaauacaggcuccucugaaaacaguguuugcguucaggagaccugguagaucuaccaccucaguugacccucaccccagggcauacauaugugucagccaauaauccccaaccccaacuauccucugagggaagccuggggucauagggcaagauacagagaacucacauuguuucagaucaaugccugggucugcccacuugccacaagacuuggaugugucugguacuucuguauccauuuacacaccuacuaacaaggcccagaacuugauccuagaguuuauccuacacccccagacauuuuaccucucucucucucucucucucucucucucucucucucucucucuuugagcuagagucuagcuaaguuguaaagaauaaggugcacgccuuuaaucccagcaccugggaggcagaggcaggcggauuucugaguucgaggccagccuggucuacaaagugaguuccaggacagccagaguuauacagagaaacccugucuugaaaaacaaaaacaaacaaacaaaaaaguaacaauguaacaaugaccugcuuuuucuggcuggccuucuaaauagcugagaguaaaggccugugccaccaguccuacaggauccaauguccucagagucaagucugaggucacucuuggcuucggagcacaccuacuacccacugauuucugccccagagucaguauaaucaccacacaaaugucccauguugaagaagaacaaauuucaagaacuccaaaaugucuucugaucccauaacaagugaggugggggaggguggggguaaagaauaaaauccuagggcuggugaaaauggcucagcgguuaagagcacugacugcuccuccagaggucaugaguucaaauuccagcaaccacaucguggcuuacaaccacucacaaugagaaacaaauaaaauccuuaagcaacauggauuuuuuuuuuccccuacaaaaugcaccucgguuuuccuaagcagcaaaauggguccagggagaagaauugggagaaccagacucagaaggggcucaggugcacacagggugggaagaggcagguggagaguaaaugggucacaccagagccuugcuggaucuccuggcugugcagucaggcuccagcucagcuccuccuggcccaucaaucccgccaucccuguagccccaaccaugggccucugcuaaggccaguguucagaaucaggagccugucugcacaccccucugaaccuguuucuuagucuuagaaugacauuuccucuaaaagccuggcaaggcaggcuccuggcuccuaaugacugcucaguagaagggaggugggccugguucugaagcaccacacuccaggugggaaggcacuccagccucaugaugacacuaucuacaaagccaguguguacuguguaccuucaggccguccaggaagcccuggcucccugugcccagguuugcagcaagcuacagaagcaacgaugggauccaaauggggacacaguaggaaucccccugcagccacuuuagugauuacccugccaucuccccacccccacacccagcuucaugaugcauauuucccaaccuagaagaacaaggugggguagaugguguaggauggugaauuuauggguguggcacuggguggcugaauguggcacaggccucucccuucugcuucuuaaugagaaaggcaagcccagacaugaggagggagauaccaggguagaagacugcaucaucaccaggcacuggugaagguguggagagaaggggagagaugguucuuucugugggccucugugggaaaaggaggacccucccccccauugguggucucucucuccacccccaggaaggaggaacaaugaaggucugagggcuaggcacucacuaggccagcuggggucccagggcagguggccugagcuguggggggccucuguuccaguuccccuugucccucgaugaucaggaggcacuggaguaugacuccccagaaguccccacugccuucacuccugcgccuucccaggcuggcagcaccagguugggggggucacucccaugaacuccccagcacagaggaggaaaccacagggcuggcccguagccucucuucggggcuccuguaguaugguacaaauccugaggccucaugagcauggugcccucgcaagcagcagcagcagacuggugaggguggaaacccagagauuaggucuggcccugccaagagagacugggugaggagaaauaggaaauaagcaagauucaggcccagaugcaagauagaaucugggcuacaacucuacaggggugaucaaggaaggggacaggaccuaggccaaguucugucaaguggggaaccuuugguaauguugcuuccucauccagaggccgcuaugggaacgucugauccuggccuuugaaugcaguacuuaucucugcagucccuagaccccaugccuaguggaaugguuguucacaagauuagagggcacaggacuaggucagaacccaggcuuggcaucugccagcugggugaccuaggcuaaccuaagccuuguuccuuugauuuagaaggagaugugucucacuagcccugucucauggucacgaggauuaaaugaaaugucacccauccagugucugggugugaaauuugucuaaccaauuucaagaaguaaccagguguuucuagggccucggcucuggcuucagggcuuuccuugaauucuugugggucauuuuucaucuacagagccacuuuccugcaaaggggggggguggaggcugguguacaauuggacggucccuccuagucucugugccucuagcuacugagucaucagggaccuggccagggucucacugggcaaggagagguagguaucuggagcauuucagaguuuugguguugccagcccuccuguggccucuucaaacucacaaggcauccaucucuggcugugacuuuguggcagccaucuugugucucacuucccggaaaggggucucuggagcccagacaccagcugcagccuugagggguggugguggcacuggcgaggugcucuuccugggaacgguaguacgggaagaagccacuggguggcgcugaguccucgaggaacaggcucccuuggcugcuccagccagcuucgugcccugggccgguuucagccagcugggccagcuccuccacagccaggggcugcucauaugugcagaagggcagguacucugagcccaccuuggagaggccgggagagccaaguggcucccugucccguagacugguagcccgcaguugcugggacagguguucuggguccucccccaacaggaggcucagagagaucaaggugccggacucggcuucuuggcucuucugcauugucuaagaagagaagacucuaucggccagugcugccugcccccuuccuaguccugucuauauuugagaggcuuagagagcucacaccugaccaggguuccccucugggagaagucuagcagugcuccuaacgauacuacuaaacccaggcucucuaaccucaucauacucuuuacccugcuggcucuucagcagauccugggcccacccucagucacaccucucuugacccuaccugagcaucucuggcccuugccccacaaguguuccuaguuucccugacugcaaccgauauuccuucuuucucucagaaaugcuuuucuucgccugccugcuuucucugccuauucugcaccugggguggucaugccccugacacucuuccaagaaaaacauaaaacaaagaacaaaagaacccaagaaauuguuccuuauucuaaccuccugaucucugacuccccuaacucacuguguugggugcacacaggccuucacuuggccuuuccugagcaggucccggucacuccccguugugcuuaccggaacccuccccuuuccugggugauagcugcauaugguuccuggucauaguggcuuuauucccgagcuagucacaucaccuuauucgcugaccccuuccaacugagaacacucguucuuugaugcacccucugccaugaagcacuuguuuugguuugguuaucuuguaucccgcuaacuauaaauuucaucuaucuaguugacuucuguuuccaugggaucuagaaaagcccuggugcccaagcagucaacaaagaguggaaggaggagggagggcagaaaguauggaaggaggaagauguaagagacaaagauggggcuguagacauggcucaggggguuaggaagagcacuggcugcucuucuggaggauccagagucaagucccagcacccacaugguggcucacggcaauuuguaacuccauuucuggaaggaucugaugccuucuucugaccucaaacaucaggcaagcauguuagugguguagacacacacaugcagacaaaacacccauacacaugagagggggagggaggaagggagggagggaaggaaggaagaaggggagggcgagaaugagagaguaagagaaugaggaugcccacagacuugcccaggcuugguugggcgaacaagccaugucugacgaagaggcagagaagagaaaugggggauuccuucuuggccagagggaaauagagacuacgagucuccauuuccaucacuaccuauuuggaccauauccaaaggccucaagcugcuccagccuagagaccaugggcuucaggaaagauuauuauagccugucaucuggauuuccugacucgucuagggggucucagcucuugaaucagugacagccccuaagucucugaaugucaccuaacuccuggagaaguccuggucauggacugauagugccaggaagggagggagggaccagagcauacaggugacacugaagaauggccccugcucuuaauccucagaaaguccacgaggauggacucgucucuccugcugcccgguaauggggaagcaggcugggcgacuguaccagggcugagccccaucugucccucugaagccugagcucuuugcuguacauaugugaaguacauguucccugugagagacaucccaguccuaagcccuggcauggugacuacgcccuuauuuguaugaucuuggcagaugcaaccaugucuagauaaguuuuacuggguuagggcaugccuuagaucuaugacugagaaacuuggacacagacacccagggagcaugccauggugaugaucuccuguggcggaaaauggagugacaacuuuuccccuggagucccaagaaagaacuaacucuguugacaccuugacaucaggcaucaggccuccaacacuguguggaaaugaaccauuuaaacccaccaagauugcaaguugguuauggcaacccuaggauccuaacagauaucagagggcuggauggcucacuguugaguuagaaggccuugcugguacuuccuauggaagcccccuauggcgacucacccuaugccuuauccuuccugccauugaagggggugccaaccaggacugacuguucuagagggaagggcaguccaugcuuuugucuugccuccuggggcccugacuccucuuuaccugcuaggccuggguugaaagggaccaggugugacggcuccaacuccccagagggcuucagaggagaugccccgcaggcucggcuguucccacucaccugcacuugccccuuagaaucccagcuggagcuagcuggagccccaagugcugacacuaaaccuaaaacucagccuagagcuagaaggucaac

SEQ ID NO: 7066 - RNA, 1108 nt, Mus musculus
gcgagccugcagcuaggucuccagcacauggaggacagccaugugacccagcuaccucccguuuaugccccuacauacuucucuuggcuucccagugagguuuccagcagcgguggcccuugucagccuuuuacacagguacccuucacuuucagaucucccagcuuguucccacuuguguccaucaacugaggagaaagucggagaggagucaggcaguccuuggcccucagaaccugguacagaagaaaacacaggagcuccagcaccgugcacuggcguuuugggugugacgcaguuggcaugcuaauucuguuuuaucgaugauaaagaagcugaggcagagaaacccgggcauuuaugcagcgggguggggauugugggccuucaggaaagucacuucccuucuugaguccuggccugaaggagcauuuggggcuuggaguggagccgcccacgagucucacaaucaucaccacugagugacauuagcgaauuuauuugaccucccgccugaaagccugguguagccuggcagagcugacugcccacccgcaagaugggagccugguuacuuacaagcugcaagugauccugaaguaagguuuguuguuuguuuuuguuuuuuguuuuuccuccagucuacaacucccaagaagacucucaguggcuccucuggcacucucagagaguccucccuggcccccgcagccucgcuggcauccucagacuucuugcuggaccuuuuuaaugcagaccccagcuccuuaccagcccguggcaggaaaccccuccauucuggcaaccucgcuguccuggaggccccgagugcugugcagcagcgcccccuccuggcgcaucuugucaggacagcuggcuucccugagaucuacaguuugauuguucagacacugccuaagaaggcaccacaccuaccuuacuuauaaagagcgacaccaccagccaccagcugcagcagccucucaacccuggugcagcgaccuggcagccagaguccucaaacggccaauccacccucacuccccagccacaugcuaucacgcagcucccgaagucucaccggguggacgacagacugaaaaucauc

SEQ ID NO: 7067 - RNA, 1108 nt, Mus musculus
aagguagaugucgugcugugaagaagucccgugggggcucuuaaaaagcuagcaaguuuggccaagauggagaagauggaggaucaagggugggcugugagaacuggagguaugagucacucagccggguuggaaaguggugguaugucugagggaaucuagggugaggagagcaaaggccacgauggggaagucuugccaugggugggaaagggcuagaggccaccuggugcaggugugugugugugugugugugugugugugugugugugugugugguguggcugccuaggcgcguccgugcuucucagccuggcugcccacuagaaucaccugagaauucccaaaccaaacaaaccccacaggcagacaaaugcugcacucucucagcuguauauggaagcuaaaauguggaucucaugggaauagagaguagaacuguaguuacuagaagccaggagguccaugaaaggucugagagaggaaggcuaauagguccagagauggagucgggugggagaggugacuucuacuguucuaugacacagcaggguaacuguggucaacaguuaaggauagucucagaguagcuagcuagcagauuuccuuuagugcuaccaacugggcuagucagauuuucaguguugugauggaaugaccugguauaaacaagggauggaggauuuauuugggcuccuguuuuuaagggucucaguccagagcccuugacuggugauucugagcucacaauaaggcagaaccuacuguguggcagcaacggacuggagcacgugacagaggccacgccccaccucaggcagacaagauacaggagugggaaaggggcuggauuccagguauaacuuuaaaaguuugccucuuggggccuacuuccuccagcuugacccccaccuccuaaguuuccaccaccaacuggagaucaacuguuccaugcauaagccuuuuggagacgggguccauauucaacccaggacaucaacaccaagaaaugagucauguuccaguuuauagauaagguagccagccuugucugauaccaugcuguguacguguccugaaauaucacgcugcauccaguaagugugca

SEQ ID NO: 7068 - RNA, 2734 nt, Mus musculus
uaacauucugccuaugugcuccuuuugguauugucugaguugagccacguuggcccagaaauuaaucaguacuguggauucuugaugccugugauuucaacgaaagaggucugguauguugucucuucacccucguggaccgauauauccugggagaagggggaugaaguugggagaugcucugugguugugcugcugugagcaccagucucugcuccauguacuucugugacaguuuguuacagagcgugaaugcccaugacaguaugaauuaaccuucacccggggcugcugugcuccaggccccaagccaagcguuucacacacugucaccuuguucuguccccacacacucucccaagugccccuuugucagacagggaggccagaaccuggcaagguuaacuacguggcagguuuauccaucuagagcauggaaagccaggauuugaacucacaggguuugacgccagaaccucuguuagucccucugcccugcagauccuaaguggcacaggacaggggauuaugccugccuuguuaacuucuaggcaauguccccaacagaaggugggcauguaguggguggucuugaagaguuuaagugaauguguuagggguuggacuugugcacugcauauucaaaugcugguuucugugcccagagaucaggauacagucccggaugccagcacugucaugauuauugaaccaucuucuguaucgguguuguauaaggagugcuucccaauuaucucugauuaauuaagaaagagcugaugagccuauggcugggcagaggagauaggaagguuggacuucagagcccaggggaaggucccagagaaagaagguagaaggaccaugaggagagaagagguaaccaugaggcagaggguccaggaggaguugugaugagcagauugccaaggccaucuccaugaugacauacauggacuagagagaaccagggcaaggccagauuggaaagcagcauggcauuugucugggcauuagcccucuuggagggcugggauagcucagauccugcccagccuagacuuguggcuuguuaauaaacuuaauaggucucugugccaauucuuugggagcuagaacaggagcagauaaagcugucaugcuugaaccacaaucuccaugagcgaaugaaacuaaaccccagucuuacaugguugugagagcagggagucccccuggacgguguucaccgucucucgccccccuuuucugugcugugcaguggggaggcgugguaugcacuuggggcugggggcaugccgccgaggcuggacauauugcagugucugccacagaugguuccggcggucaagaggagccugguagugagcaccaagaaacuguaggcacugaaguuaaaaaacacugccucuuuuucuuaucucccccagucuucagcuuucacauguguuuagccugguucccaauugcuagguaaccaaaacaagagagccuagacacacggcuccccuuccagaaaucacugcagaaccuguuuuccaugugagugggugugugaguaugccuggguguguucaugggggguuguggggagagggucuccaccccugaguccagcaugcuggcugcuugcuccucauuuucaccauggaaagcggcuccauuuugaaauuuuuauuuuauguaagcaaacuagaaaggagugaaagcuaagguaaacccugucuaagaagccauccaucgcuaacagguagguaaguugguggacauucuucaaguguuuguacgugcguguguacaguuucccagugaggaaagcccugugaauguuccuuuugcaguaucacugccucuucccgucuugacacaccguggagauccuuuccgugucaaugaauauggugcuucaucacucuuuuuaauggcuauauagaacucuauuguaugcuguuccaugauuaauuuagccugucccuuauaauucacauuuauccguauccacucagcagcauaauuauccauuuaaucaccugucucucccucuaggcugugagcucauugaaugcagggacauaucuaaagcucacaagcaaacaauaggcacccaauaaauguuuacauggauagauggauaaguuaggaggggaggaagggguuuugcuuugucagugcuguggaugguuucuggcuauaccuacguuuugaaugacaguccauuaacccggggcuggugagggcauuguggcgauuauacagcugacaguggcuguguucuuagugcucuaacuuuaaaucucagugcuacaaagaagaauuaauucauggucuuccugaaggaaaguccuugguuucuugagccugugcgcugcugcucgugcgguuucagcuugccugcuugucuuuuccaaagauacaaaggugccagagagaggccuuuuuacaguuaggaaaauggggguagauuucuugggggggcauuuguggggggacaccagggauaaugaccucugccucuaucucucagggaucuaggaggaugcuuuaguccuuuagcaacugugaagagaaugagccaaagagaagauguaagcaaaacucaacagccuuuuggaucacuaagugagaagaaauuaaauacugggcagcugccugggugagaaggagagauuugucaggcuucugugcccagccuucagcguguccuugcccauugucaaccucugugcuggcuagu

SEQ ID NO: 7069 - RNA, 7047 nt, Mus musculus
uaugaaaacgaagucguuuaugguggggcaagccuucaauccagcccuggagaggcagaaagaggcaacugucugaguuggaggccaccuguaacaacaacccacuaauaacaaugacaauaaaugagauuauagauagcaaaugacagaagauggagccuaugauuuucuaugcuaacgugaaauauuuaaaaguaguugccacuguacugggcguguggcaugcagugggcggcuugguucuguugggguuucuauugcugaaaccaguuuccgagauagcaaauuucauucuuuuguacagauacaggcacaagcuauuguucuuucgcaagguaguaauuucuagcacugauuacaggauuuccucuggccaucagguuucauuguaugucaauuuaaacuucagucuuuaacuuuaaaaaaaaaaaaaaaagauuuaucacaucacgaguaaacuguagcucucagacacaccaaaagagaucauccgaucccuuuacagaugguugugagacaccacguggcugcugggauuugaacucaggaccucuggaagagcagucaguguucuuaaccacugagccaucucucaagugcauuuuuaacuuuuaacacccucccccuguccucucacagcugcacacugccaaccaugccacaaacuccuaacacagucaaacaacggcuucugccuccaagcacugcgguuuuuccccaauuaagaauuuacaguacagcccgaugguggugguguacgccuuuaaucccugcccucgggguggcagaggcaggcagaucucugcauuccagaccacccuggucaacagagaaacacugccucuaaaaauaaagaauucagaagacaccacgggcgaggagcuugggagcagaguguacucugcuaugaacgaguucuucacuugagggcuuccauaacggcagcggugaucuccgggagacuuuuguccacgcugacuuggaugaaguuuucgggagcugaugggggcuccagaauacuaaacugggacugcaguaacucgggcggcauaaaauguccuuuucuuuggagcaagcguccauaaaugaugucaaacgagccgcagagguagaccaccaggagcuucccaccagccagcgguuccuuugcugagucaucacuuuucaggggcgcaucacuuccuccucggaucaagaugucucuguacguuuucuucagagcugaacaggcuagaacaacaggcugucccaaagccacaucucuguuuucaaaauauaagaaaacacauaccccaccccaccccaaaaaaaggaugagggcugaagaaugaaacaaugcaaaggaggcagaggcagguggauuucugaguucgaggccagccuggucuacaaagugaguuccaggacagccagggcuacacagagaaacccugucucaaaaaacaaaacaaaacaaaacaaaaaaaaaaaaaaaaaaaaacaaagguuucaaucguaggugauggggcagucucugccaaugucaagugcuacuugaaaauggaguuaagcagugggcuaagcaaucuuaaauugagggucuuuugucugugaacugagcagucuuaggcucaaguguucuauucccggacaucaguuccucacccguaaaaugggcccauccagagcugucccgaggacggagguuggcuggguaccugguauaugcaagcacuaaguguuuguccccaccccguuggaugcaucuaguugugguuuccgaagugauuuuuaaauuuacuggauuauaccacgggcggguaugacgucauaccuuaguaaaaugucgugcaaggugcaaagccauggaauccuguccugaaauuagaacagacucaaaguagcuuccccaguacugccugugcggaaacggccguaccauagucccaacagucagcuucaaagagaucucaguggcuaugagaacugggcauggacaggcuggggggccaagccacaggccuaccaccacagaaacauuuccuugguucugguuucgauggcucauuucauaaaacuauaaauucccuuaaguuacaauacuucauacccccuccaauuccccacuggugcagacguccucccugucuuccaugcacacaccucugacuugacuauggcugauagauucuuucaaugcgucucaucagaaccuacagcuaugcacuugaucugcaguugaguucuaccccagccuuggauuaaugucuuuuaaaagauuuguuuauagccaggcagugguggcccacgccuuuaaucccagcacucgggaggcagaggcaggcggauuucugaguuugaggccagccugguuuacagagugaguuccaggacagccagggcuauacagagaaacccugucucaaaaccaccccuccccccaaaaaaaaaccugauuuguuuaugugaguacacugucacugucuucagacacaccagaagagggcaucagaucucauuacagauggcugugagccaccaugugguugcugggaauugaacucaggaccucugcaagagcaaucagugcucuuaaccgcugagccaucucuccagcccuugaacuaaugucuuaacacaccauuugaguuugccucccaaaaugacucugguuagccaagguuuccuacacauucaagcaugaaaggacauuagaaagaugaugcuauuauucuaaaccuuuuaacuuccuggauauaucuuuuuucuuuuuaaguuuuguuuuauuuuacgggaguguuuugccugcguggcgucuacucacacugagagcuucugguucucaguggggccagaaaagggcuggggaagccccugcaacuggaguccuagcagcugugagugccccgugggugcugggaacaggaccccaggccucugcaaaugcagccagagcucuuaagcacggagccaccucuccagccucucggguguauucccuaaagcagcuccugccgcuguguagcagaaggggacucgagcuugaaguccccaugucagccaagaaaguucuacuuccuuucccgggauucuguaggaguguugccaccccacaaccccgcaccccucuccuuucuuuugcaucuaucuuggcuaggguuuuccucgcugagaacagacaccaugaccaaagcaacucuucuaaggacaacauuuaauuggggcuggcuuacagguucaguucaguaucauuaaggcgagugagcacagcagugcccaggcaggcaccauggaggagccuagaguucuacaucuaguuccgaaggcaaauaggaaaagacuggcuuccagggcacuaggaugagggucuuaaagcccaugccugaaaggccacauccaguucaacagggccacaccuccuaauaguaccacucacugggccaagcguauucaaaccacuacagcaucuaaacagcucaaauucacuucucacgcaagccuuauuuuugguggauuauaaaacuuucaacucaacaggaaguaccaccucugaguaggcucccccaaggaguggccuaggaucugagacuuuacgaugaacaugggccagucagucaugaaggaggaaacacagagagcaagcaguaggacaguggacacaaaaaucccacgaggaggaacacggucacgggagagaccaagaggcugagugguucugaugaagauggaggugggcguggcuaaggagcugaguggcuccgauuggagauguaccugacauuucuaaaagagaucggcaacacgcugggagagucucagacgugguggcaugguguggugguuugaguaagaauggcccgcgaagacucgggcguuugacuacccgcuuccccgacugaugaaaguuuugaggaaggauuaagaagaauccucaccuuuuuggaggaaguuugcccuugggcggaggaguugagcuuuuagaagaugugagcauucccagcuugcucucugccucaugccucagaucgauauguaaaguuucagcucucucugcugccgcaacauguaccaccgucauggauuccaacccucagacaucauaagcccaauuaacgcuuuuuaugagaugccguggucaugcuuuacagcauagcaacagaaaaguaacuaagacgcauggccacauuggaguuugcgugauugcugugguccuggaguggaauucaccagaacuuggugguggaggggaagugaaaggacccgggaggcgcugacuucccuguacgagcacaaaggagccucugcccacucgaggacuacagauuaaaaguccugcaaaaaagcuguggcaggcugcauccagggagggcagaggugggucauuccuggggcugaauucacggaggagguucagauucuaggcuaacggauguggaggcgucuuacagcaauacuggacacccguggccgauguuaccuggucgcucagugguaccccuuucgccaucuuuauccgauucuccucggagugguaaucaucggcaucauagaauuuccaucccagcuuuaggaacaaaaggaaagauagacguagcgucagcaugauggccccugugacagccaccaggagcuuccuggcaggcagguguagacaccacuggucuggggcugccccucucucacugauagcucugauuuaccacuaccaggaagaaaccuggaugaccauguugagguaucugcacaaacauaggccagaagaaagggaggaagccguggacaagaacacagugggcaaggagaguuaccuuggaggccagcagcgcacccacaguggaucuguggagagaauacagacauuguuauuucugccuaacacauaugagugccagcuguucugaaagagugccugagagaugcacagcugagauucaggcuccuucauggucgcaaagcagacaugcccuuagccauggagucuagagacggucuucacuguccuuaggaauacuggugaagguguauuagccagaaagcaauguaucauaucuaacuaaaacucugagcuaggggugguagcacauaccugagaucccaacacuuggaggcaaaggcaggaggaucucucuaaggagaucucuagcccacacaggcugucuuauguagacacugucuuaaaaaauaauuccacacacacacacacaaacaccagguaaagguuuuuuucucaauaauguuuuguagcucugugguagauauaagaaguggaggcagggaaauggacaguugguucuagacuauuggauagcacacggagaugcuaacucaaaaacccaaaacuagccagguaugguggugcacgccuuuaaucccagcacuagaaaucagaggcaaguggaucucugaguucaaggccaacuuugucuacaauaugaguccaggacagccaggguucuguuacucagagaaacccugucuugaaaaaccaaaccaaaccaaccaaccaaccaaccaaaaauaaugagagaauguuuuagucccuacugcauaaauguuuauauuuuaagagagaacacugaaugaaugaagaaaauugugcuuuuaucaaagauucaagagagaguuuuuuuuuccuuuaaauacuacugaguuuauuuuuuuguuggccaacuacuccccaggaugggaccugcccugaagugugguugauacauccaaugagagggguuuaauaaaaaguuuaaaugccagcacacuguaaaguucggaggcccguaaaaucucaaagcacugcuagcuuaccagauacacacaaugcugguaagguagcacagcaguuagaccacuggcugcucuuccggggccucuggauuugguucccagaauccagauggcagcuugcaaccaucuguauggaacucccauugcagguacucuggugcccucuucugaccaccgugugcacugcacccuugugguacucagaccaaaaccccauagacacaagacacaccaacaggagcagagauggaucccgugccaucaacacccuccuccaucucuccuguagaguuccccuuaguuuuucacccugcaguaccugucacucaacugaguucucauucagcgccucuaucgacuccccagccccugaacuguuuccaaaucagcccaguccagccacuccaucagaaaacaaacaccggugaugcucucaggcuuaucccccagucucuaccacaaagacaaucugagcucguacuaugggcuuugugugguucuggacagaagugaaaggguuucuggguagagucguacaacagcgggguuuucgccucugggguuuguuuguucacucuguggugcugggaaugaacacacacacacacacacacacacacacacacacccggcacgacaaucaaacacuccaccaccgaguuacucuguuccguuucacuuucaguuuaaagaaccuugcaguuagauggcgucuaucaaaccaaaugccuaccgcuugcuugcuuacuucugaaccuuccaacacugggcugagaagaaaaugcacauuuugcagaguuuuagcagcacuuucauauuaacauuccagccugagcaggcacacgaucaagcuuguuucucacuuuucaaaaucuauuuggaagaauccagacacucaccuacuagggagaccaugcacccaggcaaagcuuuguacaaagacccagggcgacguuugccuccugguuugggguucucacccucccacacuguucugcgaggugccaccaggcccagguuuguaaggcugagaagggucgcuagccacgguccgcggugacccuggggagcagcugccagcggggcaggacagcagggguccucagcaggggccgcaaaggcauggcucccagggcucagggcccacacagccucccagcucccauccgcccgucccccaguccccccaacgaccuacuuuccggagccgcucacacccaucaccagcagcaccccgggugccuccaugaccgugcucccagguccucagcgcccgcuuccggggca

SEQ ID NO: 7070 - RNA, 39500 nt, Mus musculus
cagagugcccugcgcggcgccggcgacgagcgugggggaggugcgggaggaggaagcggcggcgacgcggagaguccccgcguccacacggcagccgaucgcccacccggggccugcacccgcagcccgcguccacgcacccucggcggccccgcagccugucacgccucgcggacccggccgcagcccgcagugucgcgcucgccugagucaccgccauggccgagagcgcagagagcggcggcccaccgggcgcgcaggacagugcggccgacggcggccccgcagagcccaagaucaugaaggucacggugaagacgccuaaagagaaggaggaguuugccgugcccgagaacagcucgguccagcaggugagggcgccggccgggcagccgccgcgucgcugacggggcgggaagggcggccuggccgggcggcggccccgggcagcuccggucggaccccgcuggguuccgcugcgugagcugugcggggccgggccgggcgagccgcgcggccugggcugggcugcgccgcggccgccgagcuccgggccccgggcccccacuucucacaaagggccgggcgcugcggggcggcugggcgcgggcggcgcucguccuuuggccaggcuggguggggggucauuguuucaccugccugcuaauuggggagauuuaggagugagaagcacguggaggguugguucucgguuuugaaugcugaacuccuucccaucuucgagccuccuauauaaaaauuaugacguggaacuuguuuucagucgcauugugauagcucacgccugaaaggagaaaaguaaaugacuuugauucauuggcgacuugcuguuucuguuacaauacuuccgucaucgcuuagcugccagucaucggauagguuauuguuugaucuuuagggagacgagacagacaccuagcugggucuuagcaguugguugcaaggaaccugcaagaaagcacaguaggugauaaggggaauucuuaucaaguaauugcuuuaaagucuauucaggcaaacaagccuugcaguuaauuaagagccuugggagaaccaaucauguauguuucaacacagucuagggcacuugaauuguugacaguaucaaacauuguaaacagucuuaugcgaggaagcaaaguaucaaccacuggaauguacuuuuaaguucucucaagguuuaucuaguuccaaaggugaggucggguuuuucugaagcaggaggguguguggcaccauugagagaaacucuuguugauuggaucauuaccauuguuuguuaacgcugcuauaaaaaauuuuaccuucuuuauauucccagcaggucuguaugucacccacaauugacauuuuccagccuuuucugcaucaugcaucucuuauuucuaaaaauacacuuuaaaguuguaaauaucaguauuacccuuauaaggucggcaagcagcauggguguuaguggcuugagaacaacuuuuuuugaaaaaugguauuccacuuauguuugaggugcgaugaugggacaugguugccuuugcugguuuuugcagacccgucuacaccugugucagccaagcacgugacagcugaagucuguuacaguugacggcacacuuuucgucuuccguuuucucuucagucgagcuuuugucaccucugaagauuuuuauuuucccaacagaguuugaguuugcauaaacagaguccucucuaauguggucuuuuggauaaggcuuuuuuucuucuuucucucacucagcauauuuuuuugagauucauccuugagaaggucuguaccccucccaccacagagaucugcauacuaggcacagccuccagucuaccacugaaccaaguccucagcucaguacuuaacugcucagugccuuuccaugaaugugccauaaucugccaggguuuuuucagcugguuguaguucuugagaacagcagccucauauaaauccuuuagagaccauaugcuuuuuaucuguauuagaagagcucugguuacacuuuagaucuuugggguuuuuuguuuguuuguuuuugguuuuguuuaaaagacagguuuccacucuguaacuccggcuguccuggaacucucaguguguagaccaggcugguuucaaacucaucugccucccaagugcugguauugaagguauucaccaccauggccugccaguucuguuuaguuuuauaagaaaccugaaaaguguacuauuuugcaguucagucaacaucauaugggugugugcuccugucccucugucuccuuguuaauauuugguaugagcaggguuucuuguuuuuguuguuuucauuuuuuugagacaggguuucucuguauagcccuggcuguccuggaacucacuuuguagaccagguuggccucgaacuuagaaauccgccugccucuaccucccgagugcugagauuaaaggcgugugccaccacgcccggccguuuuugguuuuuuuaauuguaacuauuuagugaauguguggacauauuaaauuaggaagcucuugagucuuccugagagucccaguuuaguuuuccaucuuccuggcagcuuccacauuuuauuuuuggacauuagaaauaaugcuuuauaaauagaaaaauuauuuaggugggcaucuauagguuuguggguucuuuguuuuuguaauagugacacuagaauuaugaauucuguggaagcuuauuauguuuuacuaugcuguaacuaaaaaugacuuuaauggauaaaaguaaggcuuuccuaagguaacuuauucuaauguugguuaauguuuaaaauuuuaucuguuguuuucugugggugcagaaaaugugauaaaaguugaaagcauagccugcaccaccaacugaaagcacaucaaaugcuggcugagucuggggagugcacucagaaacacgugccagaguuggauaaagcagaccucagguacucauuuguaaagcucuauucuuagcacaagaaaaggucugccauucuuaaguuagauuuuccuuauagaacuuacuagguuuggaauuugcuauaaaguuugucgcugaguaauauuugaaggcuguaagacauccuugcaaaugguuaauagcaauugugauuggggcugaagucagcgauggagcaugugguucaggagacccuggguugaauccucagugcaccccacauccucuuuaaugguaggcugauguugucaaauguuugauucugaaaauucuuaaucugggagggggaaaggaggaaaaagauaauauugaaggcuuaugcuguuagguaaaucacauuuuaaaauguuacuuaaguuggcacacaaaggaaugaguucaucauggcgagaaauccucucuuuuuaagagucugugugugagagagagagacagagacagugagugagcgagcaagugagugagcagaccccagagccucaggaaggaguggggacaucucaggugccaaccccugccuuccacccuguucugugaucaggucuccuugcugcuucaguagucaugggcagcuguacucccucuccugggauuuuuuguugguagcccacuugugagcacuuugauuauaggcugggcaauacauggucuggggcuuugaaauucuguccuccuuacauuuguuuggcaagugcuuuacccacugagccaucucuacagguugaauccuccauuuuccauuuaaaaucucaaugugucugaguaauguaggcuauuuaucaaugcuauuuaugugaguguguuauuaacuaggugaaauuaucuucagccucccugguaauuuguaaauuaaguugguaauuucuauuuauuuaauuuugggaaagggugucccucuguagagcagacuggucuggaguuccuuuuccaguaugucuacuugacuguuggaauaguuucuguggcuucuguuguauuuuucuggauagcaucuuacccagaaggcuggcuugaagcagugauacaggcuauacuaaggaucaaacacguccccgagauuaguguuuugcauccucuaacaaauuugccaaggaacugauuuagugauucuuuuuuuuuuuuuaagauuuauuuuauuauuauaucuaaguacacuguagcugucuucagacacaccagaagaaggcaucagaucuuauuaaggaugguugugagccaccaugugguugcugggauuugaacucaugaccuuuggaagagcagucagugcucuuacccucugagccaucucuccagccccugauuuagugauucuaauuaaagauauugcuuaauuuuccuuuaaaacuuaaagagaccauacaguugacuuuuuuuaagccauaaauuaugucauuuuaagaaaaacauuccuaggcuuguauaacuaucaccuccaaaagaaacucuguucuucacugucugggcuuuugaaaccaguucucccugcagagcccaggcuggccuucaguuugcugucucugccccugccuucccaggguaggauuaugguuuugucuugaguccaccuuacaguguuuuuauagaucauccaaauuguagucuagaaggacuuuccuuagaacaagacaaaauauuuauuuauugcucauauguauguauuuguguguguagcugucagaagauaauuuugaguccucaggauuaaacucacggugcccugugugacgucaaacaccuuuacccacugagccaucucgcuugccccaaguauuuccuguguugugccuagugauaugccacuauauggaugugaaccaccuuuuauuucuucccuaccugcuggacaugugaguguauuuuuguuacgaauaaugucuccaugagcacucaugauucaugugcuuuucuguggacauaugguuucauuuuucuuggguguagaccuagaaguagcauuucugggucacauaguaacugcguguuuaauucugggggaauugccaaaguaucuucugaacaggcugcucacuccuuccucccugacaccugcuguggacggucugauuauaauuguccuagugacugcugagugucaucacuaaggugcuguucaguaucuccaauagccuugugacgugcccacagacgugccacagucauccugagauaauguguuuuuguuuaaagugucacaaauuauuuuuggcagagauuuuugagauuaugagauauuugcaacacacaggaaaacucggcuguccucuauuagauuaaggcgauucugcaaauugggcuagcuagcuagauggaugguaaaggggcuugucaguccugacaccagaucauuuucuuucuuucuuucuuucuuucuuccuuucuuucuuucuuucuuucuuucuuucuucuuuuuuuuuuuuuuuuuuccgagacaggguuucucuguguagcccuggcugucuuggaacucacuuuguagaccagguugaucucgaacucagaaauccaucugccucugccuccccggugcugggacuaaaggcgugugccaccacgcccggcugaaauggugucuugagacacagauugcuguagugauguaauuaagagaaagguaguugcugaaaacguuugaggacuggccucaccaaguugcuauugcuucuugacugaaaauuacauucuagcuugcugguagucuccgacuucuauauuucuccuauuucuccccucccauuuauccccaguguaguaccugaaaauuguuaaucagaugguggacacuaaagguccauuuaucucaaaaucugaguuaguggcagggccugaugaugguuuccugcuucuucguuguuguugauggcauccuucuccuugaucuuuuuaguuagccacacugucuguaauuccuugaccuguuacuacauuuacccucuaccuuaggacuuuuguacagcuuguucuggccugccuccuacucuuuguuggcuucuaccaaucguuuacauuguagaacagaggucgguuucucaaagaaguaugccugacugcccaggcguuacuggggucagcuguggcauuuucucacaaugccauuaguacauauauguguaugccauauguaugugccauuuauucuaguucaaaaauuacauaguuaggaucauuuaaugcuucugugcuaggaagggacuaugaugucauuguauuguuucuagaacuuggugcaugguauagacucccuaaacaguguguuugugaaugaauuuggaacauuuuguacaaugauauguauuuaauauuaaauaucuauuguggaaccuuacugagugaagcauauacaaauggauacaguccucuggaaaccucaucucaaccuucucuccccgaaaucuccuaacucagaacucuuucuuugagacagggucuuuauguagcccuggcuauccuguaacuuucuauguagaccaggcuggccucaaacucaaagaaauccuugugucucugcuucauaaggucugggauuaaaaauaugcaccagcauacccagcccagcuucacucuuuuaaagauguuuaagugugugugugugugugugugugugugugugugugucaucagggaguugguuuuucggcugaggaaccagggucuucaggcuugggcagcaagugguuuuucaccaucccucucaauguccuuaguuuuuaagcuagagaguuccucugacucagaaaaugauuuaguacuagccauuuuguaucaaagauggcuugugacugauagcaguuauuuuauuauauuugucucuguuauguguacacauguaugccagggcauagauguggaagucagagaacaucuugugggaauuguucucaccuccuucuaccaggucaggccgguugagcaaacucagcucuucaggccuagcugcaagcacuugauaaaucaucucacugaccccugacagauuuucagauguguagagaacuuaguuuuuuugcagaguccauguuaaacuagucagcgauugccaaccaguucuucaggaaaaacagcacugauuuguaguguuuacuuguuuguguguaguaaguagucucacagugguagauucaagcaaccaguauuaaacugcuucaaaaauuacuaaaaauugacaagcuauugcuuaacguggguuucuuagacagcgagcaacuauggcugcgcaauuccugccugccuuuuagagccauggagacugcccucuagaagcaagguaggcuuuaugucgcccuuuacugaaacugcaagcuucugcagcuuguuacagugcucacuggaaaucuuuuacuauguuuccugguagaauggugugagggggcugaaaagcagacuaagccauuaagagggcuguggguugcucuugcagaggaccuggauuagaucacuagcacccacauaguggcucucagccuuccagaacuagucucaaaggauccaacacccuuuucuggccucuaugggcaccaugcacauacaauaaaaauaaaaguucuuuaaaaaaaaaaagcauaauugaaucauuggggcuggagagauggcucaguggguaagagcacugacugcucucccagagguccugaguucaauucccagcaaccacaugguggcucacaaccaucaguaaugggaucugaugcccucuucugguguguuagaagacagugacaguguacucauauaaauaaaauaauuaaaaaaaaacagcauaaaaacauaauuuucugggcaagcaauaaagcugaacuuuaaauuuguuaagguaaaagaaaaacuuauuuuuuuaaacaguuuuuuguuguuguuguuuugguuugguuuuuuuguuuuguucuucgagacaggguuucucuguguagcccuggcuguccuggaacucacucuguagaccaggcuggccucgaacucagaaauccgccugccucugccucccgagugcugggaucaaaggcgugcgccaccacgcccggcuuuuaacaguuuuuuuaguuaaauugugugaguguauauacgugugaagguauauacaccauggugccaccaaaucuuuggucuaggucuuuccaccuuaauuagccagucuaaaagaccuucagaguugugcagggguuugucuccuagucuguuguuauccugucagggugaccguauugaccaccaugaccuuuucaaaaagugaaggcacagguugcaaauuccuuauugggaaugguuaagaucagaaguacuucagguuuugcuuuuuuuuuuuccuucagaggaguaugugcaugcagcguccacgaacacacacacaucaugcaugcaacagggcuucuauauauagcccugguuaacuuuaaacuugcucuguagagcaggcucgccuuggaacucagagaaauccaccuggcucugccuccugagugugguaauuaaagacauucuccuccaccacccagcuaugagauuuuuucuuuuucucuuuuucuuauuuugguuuuucgagauaggguuucucuguguagccuuggcucuccuggaacucacucuguagaccaugcuggccucaaacucagaaaucugccugccucugucuuccaagugcugggauuaaaggcgugcaucaccacugcugggccuuaugagauuugugugcgugugaacaugggaggugcccccagaagccccaagaugucugauuucccugcaacuggagcugcuugaucagggugcugaggacuggacucagcuccugcacugcuccuacaagagcaacaagagcucuuaacugcccuguggugucuucagccccacaucuaaguucuuucugagagguaacucaugagucagccaaggcagcuucccuuugaggaggauguaagcaagggcucuuagccgcugcacccaucacugucuucugucaguaugaagagccaugaacuaacaucgcaaaucugaggugagguuggauggagucuguugucugugacaguaauugcuaacagcacuuuacuucuuugagagaaggugacuucacaugucuagcaagaaaauuuuagaaauuuucuaauaagcaucaaacgaggugauauaccaaaaaauuauauaccugugcaauaaagugaugauuaacaaagaauuguguguuuguguaggcacauccacaugucucuccuuuguugcccucugucuuguuuaggguacgaggucucuuauggaaccaggagcucacgguuugucgagacugucuagcuccaaacucaagguagccaaggaugaccuuaacuucuaguccuccuguuugaucucucaaguacugagauugcaaguagugugcccaguuuaugcaguguuaagauucaguguagggccuguugcuuacagauaagaggcaagcacuccacugaaccacaguucccaaucccacaccucucuuuagaaaacagauauugcccucugcccucucuucaccuguaaaugauuuucuuugguuugaguugucuacgaucacaggaggcuauuauucauuuguucuugaauacuggauuagacuaaauaaauguacaauugaugcacauuuugguuguuuucauuauuugguuaaacccaccaacauguccagccuguuagauaaauaguggaacuguaaggucuugguaaucagguccagugaauaugaugaaauguguuuauaaauuugacuggcuuucacuucagccugcaguuuaugcggcagccagugagucucuguugugauuuagucuguggacaaggaagagcaccuuuuccugaugugaggauccugcaucuggauuguguuucucacuaauuucuaggaaaucuuuguguuguuugugcuauugguuuuauaaaagauguauuuauuguuauuauguguauguguguacaccaagugcaugcugacacagauagaugccaggacagagugcuggauccucuagaaccagaguugagauggcugugagccaccauauugguuaugaggaaccagauuuauucucuacaagaacaucucagugcucuccagcccucugcuguuuugucucuggcuucuucacacuuuagugugugugugugugugugugugugugugaaguaaaauauuuuuuguucacuugauuccaauuuuugaagugugucaaugaauuuugaccgggugucagccuguuuuguuaaaugugcuucaaaagaugcuuauugaggaaguggaucggccacuugcuuuguuuugaguuguuuuuuuuaaauaacuguguguguuugugcaggcacauguacagguagaccaggguuacucuguagaccuccaucuuaaagaggaugucugcugagcucacagggucaccacaucugccugagaugcccacguucuuccucuuuucccuccaaccccugcugggcaugcugaggauuuaacccagcuuuaccugugggcuaggcaagcacuggcccagcgaucagccacagccuuagcgcuaguuccucucuuuuuggcaguaugaagaagucguguuuaaauccagcaguaugguccuggggacauugguuucuguuuauccugccuguugugcacaucucuccuguugcucucagaucaaguuguuugccugauuccagaugccucuuuuauuagguugauagguguauacuauuuuuauguccuuuggagauucuccaaggauuuuauaaauuguccccaucaggaaguacuugcuacuuggagaauaauacauagauccuagagcucuuaacucugcaugcccaggauuacacaccuuucucuuucuugguuggucucugucaaaugacacaagauauauaaggacuucauaaaauuggcauugaugaagaauuggcuguacaguuuuucacuuuuauuucuucauccaggaugguuuucuugucccugagggacgcuguuacaguuccuaaacugccugccuacuaggugucacagucucuguuuaugaguaagaaaaagauccugugagaugcuauguuugucuuuauauuucaguuuaauucugagggacuuuuauuggauauaaaacccuaggucacuaauucucccuuuggaaaaacuuuuauaauuguaaguacaaacugguggggccugggagaugaugcuacucagugguggagaacucgccuagccugcagaagggccuaggcuuggucaguggguuggagucacauaguagguccuucuuuguuuguuagcuuuugcuugguaauauacaucugaagucccuccacauccuuucaugacuuuagagugcacuucuuuucagugcucaucugagcgcacuacacauuaucuacugaggaauugacaacugugagcgaaaccuuuguagauauacaugaagguuuuaaagugaauagcuuguaaauauaaaggagugguugcugaaucucauucugagaguguguuguuuaucucuuugcuuuagucuuacaucucucuggagugauaggggagcaucuuucauguuaauuuguugucuguauaucucuggugaagugccugcuuugacccauuuuaaaacuggauugugauugucaaguuuuaugauuacuuucuuugugucuuuggacaauagcugguuaucaaauaugccuuuugcaaauauuuuuugccucaucuguucaucuucuaauuucuugaaagauguuuuaaguggcacacaguaggacacuucaauggcuagagacugaugagagcagguucccagccccucuuuuucuuuuccuuuuccuugcauugaccaggcuuugaagaccagggguccccagugcacagcucugcucugugacugauuuuagagggaacccucuacuggcucuuaguuuaaggaugugcuugacguacaguuuguagucacacuucuguuuacagaugaaggggcuuguuuuguuuucuuugcugacuuuugccauggagggaugcuguuaacaugucuuccuggcguuuccuguggccguucccagucaguuaaccuaggagauacuugacuuacccacaugcucauucagccucccauuuacagaugcugcuuucuaaagucauauuuuguauucuuugaaaauguguguuuguuucuauauguauuuagaucaugcccaucuagccuugccucccuccacgcccccuagagcccacgugggacacugacuagaucugaugcuguuccucuguugaggagcaauccuguuuuuugguuuuuuuuuucuucgcuuccuuuacuagauuuggucucggagggcugugugaaaugaggugagaaauggcucuauaagagauuggguguuuugcuaguuuucagcuuucaagaaaauggggaaucuugggcaaagcuuacuugcaagugugaggaccugaguuuaguccaugugugcagccaccacauucacacacacaaggaagguggguggugagcaugcagaaaggugcacaguaccguuguguugucaggagaauacaggucaaagcuguguuggugaggcucuggcagccuucccucugguacagcuaggaggaaaguaagaugaauggaugccagcagucaccagggaugcuguagagaugagggagcuauagaaagaaauggugaugcagaacacagaccaaauauaacuugacuauggcccaggaacaugugcugaggguaucuugaaaggcaaggucugcuguggagguaguuacaagaugugucaguauaaaauaaaguaguucugucaguuacauuggucgagaucacagauagguggguacagugaagagaggaaauugcuguaucagauguuuuuuuagauauaaugguuucuuuuuggauuuguuuguuucuuuuuggauuucaagacaggguuucucagccgggugugggggcacacaccuuuaaucccagcacuugggaggcagaggcagguggauuucugaguucgaggccagccuggucuacagagugaguuccagaacagccagggcuacacagagaaauucugucucaaaaaacaaaacaaaacaaaaaacaaaaacaaacccaggguuucucuguauaguccuggaacucgaguuccucaguagacuggucuggccucaaacccaacugcugggauuaaagauggacaccaccaccgcccggcagcuucuuaggguuugggcuggaggagaacaguaaccuaaugcagucccagaguuuccauucagugagacuggguuagacacagaagugagacgugagugaugacacucaaagagacuaagacuuuaagacaguuugucucuggucugcaguggucuuaguuuccauagucauuaaguacagguacacuguuugguuuuguuguuguuguucugggaacuucagugugcaguacccugaaaauacacuaucaagucaguaccaaggaccacccuagacggcugaguagguuaaggcuaugaaugagugguaccaaauaagcaaauuuauaggcauaaauguaaauuaguggggcuuuuugggaaauggggauggaauuaaugagcgcacaggaaagugagagcgguuacugguuucucuuugagaaugaggauguucucugaaauugacucuuagcaaugcagccuauuucuaaauacacugaagacuuuugaauuacacacuucaaguggccauauuauauggcaugugagcuauauauauuugaagacacagagucuuacuguguagcuuuggguguuuuggaauuuccuggguagaccaggguggccucaaacucacagagagcuucaugccccugcuucccuugaggugagauuaaagguuugugucacaaugccuggugaagcuuaaaaacauccuuuuguauuggaauuuggaggcaaaaguaggagcgugccuuaggucuagcaucuuaccuucaaaucuucaaacuauaaagugcuauagaacuguacuuguuuauuuguguguguguuugugcgcgcccaugcaugaaccacaauacacguguggaagucaaaggcuaguucucuccugcuaccaugaaguuuccagggauagaucucagguugcugggcuuggcagcaagcccauuuaugcacugagcuaucucaauggcccagccaugguggccaguuauuuacuucagaaugugagggagaucagggccuuucugaguuuaagauuaaaacaguugauauagaucaacuuucucauuuuacguauuaaaugcauuuuauuuauuuuauuuuauuuguuuugguuuuuuugagacgugguuucucuguguagcccuggcuguccuggaaaucacucuauagaccaggcugaccucgaacucagagauccgccuaccucugccucccaagugcugggauaaaaggcuugugccaccacugcccagcauguauuuuauugauuauaauaaaccuauaauaaaaguuucacauuuaguuaauauaucuugauuuauuuuguguaugaucuguaucgguuuggccuugaaaucagaccuaugcuggaaacccaguucagcaauuuauuauuaacaccauuuggggccaaguguucaauuccuuuucucuguguuugaaaaaaagauucauccuuauagaguuccuguggauagagagagcagcaagaguggccaccacuacugugcuugaugcuuguauuuuaugcauuguaauuuaagucuuauaaaaauauuuucuuauauuaggaacuaccuaacagaugguugaguuaugcucuuugcauagagaaugcuauagaauauaaaugguguuuugugaagauuguuuuuuuuuuaagucaccuggaaauaucuagguaaaaagauuauauaucacauagccaagucuguuggcacacuuguuuaauuaccugcagaagcugguggauuucugugagauugaguccagccuggucuacauaaugagaucuaggauagccagggcuauguagagaccuuucucaaaaaaaucaccaucaacaaaaagauuauauaacauauaguuucaaaugggaggguggggcucaaaugugaaaguuccagaauauuuacuuuaguacauuuuacauguauaugcuuuuuggccuuuucaaaaguuuguuugugugcaugaguugagaagguagguuguaaaauccauguuguugggugaugugcucaaaccugugaugccaggacuggggaggcuccacugggaguuugaggucacucucugcuacagagugacauccugucucagaacccaaccaaccacacagaaugauagguguauacgcaguguugagacuuaccuugaggguuucguucauauauaaauguacagaaugcuuugguuauaacaugcagcaguguuuucucugacuggccucuuccugaugguccugugacaguuuccucccgagacaggguuucucuguguagcccuggcuguccuggaacucauuuuguagaccaggcuggccucgaacucagaaauccgccugccucugccucccgagugcugggaguaaaggcgugcgccaccacgucaggcuccugugagaguuuugagccuuagaugugcagaugcugaguuucccucucccacgugaucugagucugagaccuuugcgugacaaugugacacguuuuagauuugggauauuuuuaaauuagggucacuuacugauguuaaagacaacuuagcggcuuccagaaguauuuccagucuggaacacugagccuuuuucauuggauucaugucuguguaacauguuucauuguggcaguggguagguagacuuguaaugaagagacucuagguuucaacuguggugcucugguguagucuguuacuguggguucccaggccacucugagguaauuugaaugaagccuggauacguggcuaguuaguagagacuuaagggaugguaagcgugucugcagugucuuguucuuccucugcauucgcaggccguucugcuccccugcaggcaguucuccagguucuccugauaucuuccuaguauuucuucuuuugguuuucaguucuggaaagccuucuuuaacugucuuugugcuuucucuguuuauaauuuauuugagucucuggaaaagauuucccuguuuccuucuugcuuuucggugguacugcuuggcaauaggcauugaaugaaagaagugauaaggauaguaaaaauggcugcgaaugugagcuugccaguguguguguacuggaauucaaaagagagggggcuaacgauggagauuggggggacaguuacaauaagcuuagcaaagccccuuugugaccccuacuccauuggguccuguuggcaaaagaaggaaacaaacaccgcgucgucuccaucugugcaggagccacagcccugacauguggagugaguccuuccuguuagagacgggaugguugguugcacgcugagggggagaugcagcaugcuuaguagggccucuggaagaacuucuacaaaucagucugggugguacuguacaaacuucgauguuauuaaaaacauauguaauuuauucuuuuauuuaguucaaagaggaaaucucuaaacguuucaaaucucauauugaccaacuuguguugauauuugcuggaaaaauuuuaaaagaucaagauacucugagucagcaugggauucaugauggacuuacgguucaccuugucaucaaaacacagaacagguaugucuguuuacauaaccaguucaggcucuaaggagcguuccuuguuaguauuuaaagcaccuuucuuuguaucucuugguuguuuggugaaaaacaacauugugacuccaugccuuccuaguaucugaaugguucuguggggaggguugaggugcagauccugggcccacccccauuuaauacuuugcaaaauucagcugguuauuauguagaacauuuugaguuagguaacaacuugguuuuuuagcuguuuucuuuagggaaaguuuuagacaugguuucuguaacauguuagcagaguauaaaucauuaaugugugauaaauuuuugaaagaaacuuauuauuguucuggauaccaucuaaauuuuuguuucaucauuaguaaagaaacuuggucagacuuacuugaauuuggaauuuucuuaaucucauuccccuauacaaaucaucuaagaugacguaauggaguaaaugacaggagccuccuaaacuuagcauuuuauuaguauuaccuuuguggcuagccuugacuugccaugcugccuagcagggguuagccugagucugugacuguauugccacacuggguuucuuuuagagacagaaggucagucuaguccaggccagggaugaauuugcuccuccugccuuggccuccugagcacuggggucacaggugcacucacucagaaccgccggucuuacguucugccaacgcuuccuuugcuauauauagacugcaguugaaagcauugcaguggaguaucuuacaagagcuugcuguagcaucugcucuaggagcagcuucucggucaugcauacccuagcaggcuuugugcuguuccccuaagaccugaugaggaagcguguucuuccugugcuccuguguacuugauagcuucuugcaugagagugguauagcacagagcacacauaugcggacguggugguucaugcugggaugugaagcacguguaagguagauuaugauuucugagauguugaagugaaaaccagaccuuugaaucaguaaaugaugugguaagauucauaaucaaauuggugucagaugagagagacuucucuaauaaagccugcugcucuaaagaacuuuaaagauggcacccaguaguuagugucagagcccuggccaacugaacaagcuggcuccacuccuuguccuuauugaaacagacaacuaaugcugaugaugagaagaaaaauccacugaaugucacacugagaagaacaagauagagaccagugacagccuugccacccccaaucuucugagucaugacauaagguuagacuuaaauagagggugagaggcauacauaacuaaguaauccugggaaaagaaaggcccugccuagugacccaccuuugucuuggcuucagucucuucuacaagguggccuaccuacacaguugucaaaggcugugaugaaaucacuuuccagcuggcaggcucgcccugugguuggcaccaggucucugucuccagccuuuccuucucccagcauggaguugcagagaaaguucagcuccuuggaucauuaugucaguagccuggcagccaaagggggagacacgugagacucuugccuaguuacagagugauagcagaaccagcccacucagcaacucuccccuuugucacagccgaugccuugacauugugucuguguguguggguaugugcacaugagagccuuugaaggcaucugauucuccugaagcuguaguaguuacaagugguugugagccaccugaugugggugcuggaaacucaacacucaggaugagcagcaagugaucuuaacugcugagccaucucuccagccccuuugcuguauuaaguuuuuuaccuuuaacacuuucaagaauguaaguuaaacaacucccaacacuguggaacuagaaaauaauuuguuugagcucuguggaugguggccuucugugaggugauaacuauuuggccuuccuguauaaucacugugauugaaaacagugacacauuucauguauauuguauucagagaagagaggcaguaguaguuucuuaaaguguuacuguauucucaauauuuguuugugaugcucagucauuucaggcaaaguauugauggcauucuguuuacaagagcuuacucuucguuuuuucugguuauugacauuuuaauucuuuuuaaaauaaugaguucugaauccugcauuguuauuuaauuauuuacacuaggccgcaagauaauucagcucagcaaacaaaugccccuggaagcacugugaccagcucaccagcucccgauagcaaccccacgucugguucugcugcuaacagcuccuuuggcguagguaaguugugcgugcaugugugcgugcauacacggaguaaaauguucucuuccuccaagagcaguuuaacuaaagugacauaaguguucgacaaacaaucuuacaaacuuuaugugguuugcuucuuuaaucauguuuuaaaagugguuugggauacaaguguguuuguuuagcuuguauuuaucuuuaguaaguggcgagccuccucuuuauaauaaacgugauguagccuauguauauguauaauaugacuaccacauaauugcaucagaggcuauaguuaauugaugcugagcugugaugaguucaguaauaauguuuuucaguuauacaagaaagguacccggugacuauccuaguuguuuguucuuguuuucucuuguguuuuguuugaagaaaaucuugcaaauguggcugagcucccuugaacuccucccacacuggcucuccugguguggagguuguagguguguggcaucaucacucuggaugggacugaccuaggggcuggagagacagcucauugguuaagagauggcucccuguuugcucuugcagaggaccucagucaguagccagcacccauucugaggcucagaaccaucuguaacucacguuccaagggaucuggcacugucuugugaucccgggggcacugggaaugcaugugguacccacaacaaacaugcaggcaaaacacucagucauaaaauaaaaaauaauuaaaucuaguacuuaaaaaaaaucuuggacuggagcacugaccacucuucaauagagguccugaguucaauucccagcaaccacaugguggcucacaaccaucugcaauagggucugauacacucuucuggugugucugaaaagagcaaugguauacucauauacauaaaacaaaucaaucauuaaaaaaaaaaaucuugaaaguauccugcacacaugaaagaacuguuuccugagugucagcagugaagcaucguuucucucagcccaagccacuuuggucuccucccugccgacccuuccuccuccccugcgugucguauaagcacuucucucacggagccucuuccccuacacugcucuccuuucuucaguugcaaagauugagauuuuggugaggaaaaauguugugaaggugacaaagguugggcugaagacuagcuuaaauaucuuuaccagcccuuaaggcuguagcuaguaguuuuccuuaggucucacuuucacauauugggaaccacaccuucugcucuuuccaugaaaacuuuggggugacucaauuacuguaugccaauauacagaacacacgcuuuagagcauggcugcugugcagcgagugcacaguacacacauagaugagccucuggcugcugcucuucucuccuuccaugacuggaggauggggcugaaagucucaccuuuaguccacuaggccguuugguaaucagcuccaucuugcaucauucccagggugcuuucagucuuaccccuccucaguguaguggccuguggggccugcuguguauaacaaaaaggcacucaaagugacugccuaagcuuuuaggaacccugugaaaggucaagaaggaaugaauguguuuuauuaugcuagagagauuuuuaaaauaugucugguugguuuuguuaaauauuaaagugagaauuuggcuaauuuugauuguagaauguguuugggguugggggcuguccccugugacaaacacugggaagaagcaguugaagugagguaguuuguuuugucacaugguuuccagcugguggacuacuacuggguaaaggccugugguguggcagggagggugcagcagagagcugguccucauggauagcugcugucucacuucugccugccaccccaaaggcaaaugagaacagggaguuugagcuauaaauuguuuuuuauuucagaacugguaaucuggggcuacaucuaaucuucagccagcaaauuauaugggguuggagagaacagaaacaaggugguugagacuaggccggggccuagcaaacacagaaguggaugcucacagucagcuauuggauggaucacagggaccccaauggaggagcuagagaaaguauccaaggagcuaaagagaucugcaacccuaucgguggaacaacauuaugaacuaaccaguaccccggagcucuugacucuagcugcauauguaucaaaagauggccuagucggccaucacuggaaagagaggcccauuggucaggcaaacuuuauaugccccaguacaggggaacgccagggccaaaaagggggaguggguggguaggggagugggggguggugugggggacuuuugggauagcauuggaaauguaacugaagaaaauacguaauaaaaaaaaaaaaagaagaaagaaacaaggugguugauccuuucagagcucagauuugccucuggucagauagucagcaauugagagugggccaaaugacuaugucuuguuauuccuuucauucaucuccuaguccugguuucaaacaguucuugaaacagaauaauuagugucugcugguaucaggguuauauuaacaagagcucuggucuucugugguugagguuaacucugaacaaacaaucaguagugugugcuguaggcuauuaguaggguguacaugcagauuucuuuguccaguaugagaguacaaguaugucuucuuaauacacauauaaaaguccccuaucuuagcaucaggaagucucuucaaauguacugcaccgaauagcccauugagcuacuggcucauuagcaccaugauaaccuucaucagugucaccagcugaugaaggcuuuuggguacacuucauaccuaagccguagcauaggaauuaaagcugaauaguauaauaaauaaugaauaacuuauaaugaauaaguauaacuuuauaaaugaauaauaggaauuguuuuguuuuuaaugguuuuuaaaauauagaguuaaugacuucauauuuuagcacugacuucugauuuucauuuuuuguuuuuuccucuucuaaggcggacuuggaggacuugcaggucuuagcagcuuggguuuaaacaccaccaacuucucugaacuccagagccaaaugcagcggcaacuuuugucuaacccugaaaugaugguccagaucauggaaaaucccuuuguccagagcaugcucucaaauccugaccugaugcggcaauugauuauggccaauccacagaugcaacaguugauacagagaaauccagagauuagucauaugcuuaauaauccagauauaaugagacaaguauguagaaaaguaguucuuuuuuuacuuaaacuaaaggguguuuauguguguguguguguguguguguauguauguaaauauaaaauguuauugccagagauugccuuguguauuuuuuauaaaguuagagagaaucccaaccauuauuuagggaaacucagcaaaacaauauuaauuuuguuuguuugagcucugaguuuucugcuaugcaugaaaauucuuuacaaacucuccuuagagacaggcuuuuugugccgguuucuccuuuggugguggaggugguggggguccuggaaugcaggguggagaggugaugucagcaccuugcuccuuacacguuucaaauaaaacagaaaaccauuuuuaggcgggaaaaacccaucgaaauauauuguaugaaaaaaaauuucagugaaaacauuagauuggguugguggcacacagcuuuaugguacacagcuuugaucccaguaccuggcaggcagaggcaggagaucucuugggcuugauuaaggucagccuggucuacauugugaguucuagaacagcaaggacuauguaagagaaauccugccucaaaaauugugaggggagguggggauggggggugggcaguguagguuuaaguccauuuuuggagauggccuguuugugauagccuaugaauauauuuuguguuuagagaugaaauacaccaggaaucuuaaguacuuuacuaauuuaaauauagcagaauagguuuaaaacucuuaauuagccuuuuuggcucuagaauuggaugauaccucacccuuuaaaauagaacuaguguuucccagaacugagcagaugagaucaggccaaggcaggcagcacugcgcagucggaguccugauuaaaaaaaacagcuguuuaaaguucagugugucugccuggaacuuagcacacgugccucccacaggcauuagcugaaugcagaaggaguuccuugaauaguucagugcuuucuuuuaaacuggagauuucuuucuuagacacuggaacuugcgagaaauccagcgaugaugcaggaaaugaugagaaaccaggaccgagccuugagcaaccuagaaaguauuccugggggcuauaaugccuuacggcgcauguacaccgauauccaggagccuaugcugaaugcugcucaagaacaggugagcacucgugcccaggcucagucugugacuaaggguacugcuaugugcagaauguggcuguacugaaaaaaaucauucuguaauugauuuuuuuucuuuuuauuacaguuuggugguaauccauuugcguccuuagugagcaguucguccucagcagaagggacucagccuucucgaacagaaaauagggauccgcuccccaacccgugggcuccgcagacuucccagagcucaccagccuccgguaccacuggcagcaccacuaacaccaugagcaccucugguggcacugccaccaguaccccugcuggacagagcaccucgggcccaagcuuggugccuggcgcaggagguaugugugccucgcauugauuacaagacuggugcugaaacuauuuauguaucugugugcaucccuuuaaugaagacucuuuguugcagacuuuuaggauuguuugagggguaggauuaauauuuauuuauuuauuuaacucugugugugugugugugugugugugugugugugcgcgcgcgcgcgccauauguguacaggagcccccuggaaaucagaaagaggugucagaugccuuagaacugaaguuguacauguuaugagccaucacucgggugauagggguugaaccagguucucugugagagcaguaagcgcucucucucucucucucucucucucucucucucucucucucucaacugcuacugucucuacacccacaacaugccuugaucuguguauucauugugacaugaucaaauguaguugccaugcuauacagaacaucuccagagcucauuccugggaaaaugugaaaaggggaaauaacauauuuuaagaugacaaaaugguugcuauucaaagaacauauacuggguauuuugguuuggaaugaagugccccuuccagauuuauguguuaaagccucaacuguugucaccuugaaggaagguuuugaaaacuuaggagguaggcaggucacuagacagguggguggguccuugcauguaucucugcccuugcuccuuucuugguugccauaaugugaacugucauucuuugccaagauuucccugcuguuguggacugauuucucuagaaucaugagccguaauaaauuccucuuagaaaucccagcucgggaggcagagguagaaggaucucugaguucaaggccagccuggucuacagagugaguucaagaccaaccaaagcuacacacggaaaaacccagucucaaaaaagguuggggagggguguggccuggagagauggcucagcaguuaagaacacugacuguucuucuagagguccugaguucaauucccagcaaccacaagguggcucacaaccaacuguaauggaaucuggugcccucuucuggugugucugaagacagcuauaguguacuuauauacaugaaauacauaauucuuuuagaaaaagaaaaaucauaucuacuguuuugucacaguuacauaaaaguaacuaguauauugggggagucaaaauuaaugacccaggauguaugaaaugauggcagagugccugaaaauaggcagauaagccauguguccacuuagugaugaaguaaaagguccucauuaguaccaugguuauacugccauuguuagacacgcacaggagaacaugaagacguucauauuuagauaucuaacaccugaguugcugacauacgaauucaaacauguaucucuugcuucguuuguucuuugucucagucaauaaacgaucuuuagcucuagaaauuuguagaaauagauuacaugguguaauuuugugucugucugcacuaguuuugaaauuaauuuauucuguguauaucucugaguugcugaaaaguauuucuuucuacuuauguguggcuuuuuuuuuuaaaucuagucucuguacuuuguagauguagagccauagaaacugguaauaaaguguggauaacaaaauugagauucuuuucagauaagaugaaagcgcuauguuggguuuuagcagaggccagaauggacuuggaauugugcugucugcugagguggaaugggggugcuugugaugugugugaacgaaggcauagucagagauaugggcauguccauguuuuucagaaggauuggucuugaugucacccuuagguaauugcuguuggugggauccugguuguugcugaauaugauuuauuuuguucucuugaguuuugcucuggcuuuuugaaccaaaucuuaggccuguuugugaauugcugucuuuaugcaggugagggcaggcauaagauaaggaaagaaccugugauugggcaauggauaaagaaggcaggcugagaguucugugucagccugucugcugggggauguguagccuggcuccagagccuggcuguugugaaagcacgacagcauuacuuacccaggagugggcggcuggaucaugugaccguuuuauguucauuucuuuauguuucaggugcucccuacugguuuccauaguagccacacaagucuaugcucccucgugcagugacuaaguacaguucuugcauauguccucgccaguguuuuucucaagcauucuagcugcagcaagcuguaaucucaaagcagucuuaguuugcauuucucugauaccaaaggaugcugaccuuuuuuuucuuaaagguuuauuuauuuauuuuauguauaugagugcacuguagcuguacagaugguugugagccgucauguggcugcuggaaauugaacucaggaccucugcuuguucuggcuccacuuacucuggcccaaagauuuauuuauuauuauaucuaaguacacuguaguugucuucagccauaccagaagagggugucacaucccauugcagaugguugugagccaccaugugguugcuggaauuugaauucaggaccucuggaagaguagucagugcucuuaaccgcugagccaucucuccagcccaaugcugaacauuuucaaguacuuguaugucauuugaggauugucuacccaguuuauuauuggacagaccgaguggaugauuugagguuuguuguuuaauuuugcauuucuuuucacacacacacugucugugguguuuccuuugcugagcagaauugucuuaaaucucauguuguuuccuugccagcgcuugugauuauucccugugcugcugaaauccugcuaagaaauccaugccugugcgugccuaugucuuaaagugguuuucuuagcaacuuaaagguaucggguuaaacauaaaggucucgaucauuuugaauuaauuuuuguucagguugcagacaccaaauucugcaggcucauguuugccuuugagggguggauugugacauaaucacuuggcuucuuugcuucugugagcucugccaccugcagcauacauacauacauaacucucucagaucaguuccugucuucacagcgcccccuggugggcagccugguaucugaggucuccucaccaauuuggcuucaccuugaccccucaaggugcucucucaaagccuccucucaggggcuagccuuggcucccuccccuccucuuuucuccucuccuuuccucuccucuuuucucuucucuccccccgcccccucucaaaccuugauccaguuucaugccuucaaaccgguaccaugaggaggaaaaugccaaauucugcugacaugauauguagccugguuuucuuggacauggcuacagugagcuucaugugagggucugugauguaguuagccuucuguuuuuaaauacauuuggauuuugcuauggugaccuuuagauguguggggucuucccucagggccccacauuacaaagcccuaaucugauuucuuuaacaauggcaauugcuucuuuguaacugugaacuucacuauuuucuggccaaggcugaaucucaagauaucaauucacucaauucuccaggacaaggcagagugcagccagauccuuugccaugaaggaaaggccugcagccugguuucccuuguguccguguucuccugaaaccucaugcgcaagucuccuccuguguacauuucuuggagcauuauugaccugagcaccaagaugcccauuaaucagcucacgucagcucaaagccuccagggcuucuccagccccuggcugugaccucugcugccuuccucuggcugacaaggacacuuucaccucugggaguuucugaugcuucccccuuuuaucauucuuuagcauaaaaucuagcauuucuuuuuaacacaugucucacugguucauacagagccugguagcauguaguauaccauucucucucucucucucucucucucucucucuaguaagucucagugggcuucaaggucuguguaugugaagccccugggguuuguguuauuacugggaacguuaccccugccccccugacuuccuguccuugguuuccauagaaugaauucagacagugguauagaagaugaaacauccuuaagagaugacuguaaacaguggcuaagggaccauuuuuguugaacuauauguuuguggagaugguguuauuucuaaagccucuaggauauaagucuuugcuggugguggguauucuguuguucauguuacuggcagaaucacuugauuaacuuuuuuuuaaauuauuuuuauuuauuuagauauaugagggcucuaucugcauguauaccuccaugacagaagagggcaucagaucacaaguagaugguggugaaccaccaugugccaggaguggaacuaaggaccucugaaaaagcagacaaugcucuuaaccacugagcuaucucuccagccccucacuugaauuaacucuuaagauaauauauuuauuauauauaaugcauacuuguuauauauaaauauguaauaauucuacaucuagaagguuacugcuacauggugauugauauccuguuuccucccagggcuggaaguacaacucagauucuauuccuuuaaccaaauaucaugugacaguagauuucaaagaguuaaagaaggccagguuuggugaaggccagcauuugagagucaagggguagagcaaggguggccugaucuacagaguuucaggacagccaggacuaaacagagagacuucggugaggugggaaaugaaagaagaacagacauguuuuacacauaaaagggacaacuucaccuuaaugaaccucaaaagagccuugcuaccuaucucaccaucuucucaugggguguuucuagaauucucuucuacaauuacugcauaucuagagacacaggagguaaggcccaagcugguucuaaggugacuuaaaagccugcuaauuucuuauagcagacuggguauggagguuacuuuuauuagacuagucacuauagcuaccuuuuaaaaauaccuuuaaaauuuaucucucuauccaugaguauucacagaugugugcuguguggccauguggccacagagcccguuagaucgucuggagcugcaggcugcccgacuuaggugcugagaaccaaacuguuccugaaagcacagaagcgcucugacuguugagcugugucuccagcccccgcagacaccuuuucuuagcuauugagaggacugauaguucggugccugugcuuucuccuggggccuggugacgacuuaauucuccuuuugugaagcuccaucuguuugauggucccaacacuuuucaaagggcugugugccagggaccaagcaccucucucgcucauguaugugggcuucuaggggugccuacauacccuaccaacugccagcacuuggcauauaaauaaggaggaauugaaucaugaaggaaaaguccuuuauuacgaagggaaaaccuguaguaaagaaaggauucuuguauuuuggcagaggaguauaaugauaugaaaugauauccuggaugcagaaucuaguuccagacagugucaugagguuucugaagacaagacgggucuguaaacauuggagucacaucaucuuuaaaugaagaaacugcucugugcucuuacuugcuucuuaccuuuggaggaagaugaaguguucucacuuuaauggcucagggcaacagcuuuaaucagauggccucacuaggaggcuguuggcuuuguuuuuguaauaguguguuaucuacagugacaacuuugcaacuuuuaaguugggucuuuaauguaccaucuugaugcuuuuaacaccuaauguugagaauguccaucaaaagaaguuaaauagcaaaaagacuuauuuuuccagugcaagcaugcacgccauaauacuugggccugcacacauuggcucuggaaacggagggaucuuaaagccggauuggcagaucucguguaaacaguacaguacuguuuuaggguuuugcacaggagucaagacgcacugcagcuccaacugggucaacacuagauccucagcagccuuccuugaaaauagucuugccagcugguggugccacauacccuuaauccagcccucaggagaacucuagaguuugaagucagucugucuuacaucguggguuccaugacagccaagacugcacagagaccuugacucaaaauagagugguucugugaaaaacugagaugguuuuuguuuuuaagauuuuacuuuauguguacacauauauguauacuguguguaccuguguguguggaugcccugggaugguugugagccuccaugggaguguuagggauggaaucugggauaucugcaggagcaauagcaaguacucuuaacccugagcagucuccagcccagaaguuacauuuguuuguccguucaaacuuugugauucccuuacaaucuagaacaggacucugucagcaacaucuuuuaacauuuaagaaucaagaaguagagcuggagagauggcucggcgguuaagaauacugauugaucuuccaaagguucuuaguucaaaucucagcaaccaucugacgcccucuucuugugugugucugaaaacagcuacaguguacuuaagauaugauaauaaauaaaucuuugggccagagugaguggggcuggaguaagcagagguccugaguucaauuuccagcaaccacaugauggguacaguguacucauguaaauaaaauaaauuaaaaaaaaaaaaaagaaaucaagaaguaacuagucagaaucaaguguuuagauuguuuuuuaguuuuauuauuggugcuaugcccacuguuuuuuguuuguuuuuuuuuguuuguuuguuuguuuguuuguuugguuuuuucgagacaggguuucucuguauagcccuggcuguccuggagcucacuuuguagaccaggcuggccucgaacucagaaauccgccugccucugccucccgagugcugggauuaaaggcgugcgccaccacgcccggccccacuguucuuaauucuaagaaaaacaucuguucuccacauaugccucuucaauauccguguggguauuugccugccaugugugucugaacugugugcauugcagugccugaggaggccugaaaagggauuugcaucuagcacuggcguuaauaggugguugugaguugucauguggguccugggacuugaaccugaguccucuggaauagcaaccaacuacugugagccaucaucuugguccugcuccauuuuuuuugagacaggguuucauuuugaaccccagacuagcuugcaacuuggcauucugccucagccuucugagugcugugugccugguuggauguuguaaugaauguccagucagcaguguuuaugcgucuuguagucuuugauauguaccaggguuuggcauuucauuugguaagguaauucacggucugcugugccuugaccccacaguauuaacaguuugcuucucuuauuuuacuucuuacaugauuaauuugcacuuguaauuaaaaaaaccaagaugcuggagugacagcaaagccguaugaaggaagcaggguggcucccuuggugcuggguucagagcuccugugccuaucugauaggaaagcgcccagcagugggaucagcaaagcaauacucaugucccugggcauuggguuucaguagucuccaguuacuauaaauauuuauuuguagagaguuuucucuuaacuguaaaaacaauauucacuuuugggcuauauaaaaacaaauugugagagccagauugcuuuuguaggcugaagcuugccaaauugucuuaagauauuuuuaaacuuuagaguguggaaaagcuaacuugaaacuucaaaauauaggaacaucacaaacacgggacucacagcaaauuagaaagaugaauggagacgcuuaagugauaaaggggcacuaguucagaauccagaaugaaaugaagaauuaaauaguugguuaacauuacacuggcauuucccccccaguacugugucagaacucuucucucuuuauugaaguaagccaacuugcucuuuuugggccucugaagugucacugucagaauucuugugccuuggagccauaaccaaguacaguaaagguugaucugaaaauagagcuuaguaacuaguacugguuagcaacuuuauuuagcuaugaacacuaaguguggagaaggggauguaaagucacaauauauacugugucuuaaaacauaaaugugugucuuaaucuguuuguuuguuuguuuuuuuuguuuuguuuuuaaauaaauuuuuagcuaguauguucaacacccccggaaugcagagccugcugcagcagauaacugagaacccacagcucaugcagaacaugcuguccgccccauacaugaggagcaugcugcagucccugagccagaaccccgaccuugcugcgcaggugagcuuguggcugugcugagaguguucugaacuaaacaggccugugguauccucuccgcacguuggcuugugcucucucagaacacuagagauguggacacugcaccuccagcuuugggggcaguuuuaguucagauauacuugaaacaaucucaugucugccauuuguugaugagauguacuuuuaaaaacaaaaccaggcauuuuuagggaaccugcucugaucacugcugcuccccagugugguguuuggugcuagcucucgggguggugguuguggauggagauggagcagcagcacccuuccugugccugaacagcuggagggaguacagugagcacccacguggucacugcuggaggaauguagcuuacagugugcucugggugcuuacagcacucuguuaaguuuaaaagcuucucuucuuucauuaugaaaugguuuuuauuuucaaaauccugcagccacacugcuacaaggguauagcagaugucguugagguagggucgguccuuggugaugacuuauguaacaacaaauacuuaaaggacaaugcaucuggauaauguuaaucucaaaacgugcaugguauggguuguugugugguuuugugaauuuauuaauuaagugcuugauguuaaugcgugcuaagcauuuuugucacuugggucccugagauguggaggugugugaagugaccuauauuuucaaguauguauucaguuaacccugagugugugccuuauccuugguuccucguuagugagcacacucuugucuguaggggaccugggugcuucgcagcuguugucugcuagcaguaaagcaaaacccuggcagucaaggugaugcccuuaugauagaguccuucccagcuuacagugugcucugaugccgcugcucacguucauaguggguauucuuuucaacuuaaauauuuaauuauguuaaauguagaaacugaauuguggaauggagguucagguaagugaggaaaauauaauaaguaugauaaauaaaaagguguguaugugugagugugugugugagacaagcuuuuucuauacuaguugaguaauuuaagaugaaaguaaaugugguaacugauuaacagccucguaacaaacgagcauuugcccggaagacuuaaaaagaggcgucccuggccuggagcagguucugguaauuugcugcuuacucuaaaguacacucuguauccauaagacaccaacuguuuccugcuuugaaauuaaauaauccacuuugaaggagggaugggagaaguuguuuuuuuuuuaagacaggauuuacauacaguuguuauuuaguaugguugccuaauugagggcaaagaucauuuccuccccagacuuuggacagguaaaggggccaucaguaaucuuugggaagcaauaugcaauuugucuuuuuugaaccuuguaguuucugguuugcuuauugugcaugacggucucaccccaggcagucacaucauguuaauacuggucauacguugacggcuaggugucccccguuuuuacuguggugcuagugaaguggaagccagacguuaguuaaucucgguguucuuucucauuuaccucucugcggcuuagguaucuaagcacuucccugaggauggcuggugcuaguuuggacugguuuucaccuagcagcuccauuucucugacaaguugauugcugcuuugugguuauucuggaccuaacagcaacuguuaguggugggcaggcagauccaauggucuuagaccuggguguucucucugcuugcuguuuguguguugaaguuucuaagcaagccauguuuaagcuguuacauauugauguuucuuuuacucuguaguguagcagaaagcauaucuuccugagagccuggcacucccagguuuuuucuuuucaaaggcagaaauucacaccuuuguucaaggaaaaggagacaaaacaauugcuuuuauuuuuuuagggcacugcaugucauccaucacccaccauucucguugaaagagaagaugccugccugccugccuucuuuccuuccuuccuuccucucuucuuccuuccuuccuuccuuccuucccuucauuucuuccccugagcuccuuguggauagaacuucccugccuuuuuuuuauuucuguucucccucccuuuaagugccaauuuaggcacuuggaggaagguagaaauuaaaccagguaccuuacuuguuucagauauuuccaguuaaaauuguuugaauacuugccccauagaugaugcugaauaauccccuauuugcuggaaauccucagcuucaagaacaaaugagacaacagcucccaacuuuccuccaacaagugaguaagagaagacgcugcuguccuuguaaugcucugcuugaaagguuugguggugagcgagaguguccuucuccguggcugacagauagcacagugcacaggagcgugugguuccacccucuaguaggcacugagccugacccucccggaccaugucacuccuccuaugaguugagaacuguguugcuuuugcgcaugaggauuuaggguucugaacgccuuguugauaucauaggccauuucccuucacugugcuaaccuugaagugcaucuuuacacacacuguacaguucggacuaguuuugagugauaggaaggugcugcccucagguuggcuuuuguuguaaugucucauuuucuuccaaauuaguagaaugcuuguucucuaggaguagaccucauuuucucacaaucagaauuagugaguugguguugucaccuaaggaagguuuaaaaaaacacuucccaagauugucacagugcuauuuagaaacauaaaagugguguugguguuucugaaacugauaguugucgggguucuuaccugguugaaaccacuguuaggcagcaggucauuacccaugguuagcgguuguucuuggucuauuaaugcagugguagacgcucccugccagcaagucaucaccacgguuagugacuguccuuggucuacugcacaguagaaacuccuugucugucagguauggggauuugaaagccaagaagcuaaacuaggagcgaugcauugauuucagguuugcaaugguuguuucagauggcgacuccuaagauuguuagaauagcaguagacaagacaaggucaucagguuaccaccaucuaauaaauuugcauuuggaauugcguagaaaauguuuuucuucuguuggagaaaggggcuauguggcuucugggauagcuccuccuugucuucacucuggaaacagcuuuuauggcaggcuugcuaguaagucgaguaaugguuuguguauggaauuugcugucagagaggaggaggguuucuucuugggaagaaauauggugucuggguguaaaagguuuuagauuuucuucgaaauguugcagaguuggaaauaugugccugccuugcuuucuguucuuugguaaccgcugggcuuccuuccuccucagaugcagaaccccgacacgcucucagcgaugucgaauccuagagccaugcaggcgcugcugcagauccagcagggcuugcagacgcuggccacagaagcuccuggccucaucccaggguaggcgcauuucucugagaauaucauucugccuuuuauuuugguuauugaguuguuuuuagucacuuuucaaaguuacaucugcuuguuuuuaagaaaauaagcuaacuacuauuauguuaaggugugaccugaugggguugccugugcuuucccuagguuuacuccuggcuuggcagcaggcaauucuggaggcucuuccggaaccaaugcaccuagcacugcaccuagugaagauacgaacccccaagggggcacugcugagccaggccaccagcaguuuauccagcagaugcugcaggcccuugcgggggugaauccucaggugacgaugcguuucucuacccaccuugcucuccuuuucaaauuuucagaugaaaagcacauucaaggauaauaaaucuaaaaacaaauuuuguugcuauagcacauaacaaaggaaagaauucuucaaucuaaugguauaguauuuagaaguagccuuauaaaauaugaguuuugaaguaauuucuucaaagccauuugaaauaaguuuuauaagaguuuaucagggagaaucuaaaaauauugucaguguuucagaacagcucuaucuaggcuuccuauuggagccuauccacugcuccagcacuuccuguguguuguggacccuuuagugauaguuuuacaccugugaacauuuguugucuuuccuaagaauuuaccauuaaaggggccuggagagaaggcuggcuugagagggagcacuggccaugcuugcagagcgcccagaugcuauacccaguguguacguggaggcucagagccaucuguaauauaguucgucaucuccucuaacuucuguggacagcaggcaugcuaucaggcgagcugguguuguaauugaaguacacuuaguauuaauacaaaggaaaguaucucauucuaaacugucugcaugguuccugcuacuucacaaggcucugaagcagugaaauguaucaagcuugcuuuaccuuuugugggaaaagaaagaagggguuucagggaaucaaauccaaagcccuuguguguucacuacagccuguaggguuuuuuaaaaauuuguuaugguuuaggaauaaacuauucuaaaguaaacugcuaaucagcuuuuaaauaugauagauauuuauaaauuauuuuaaaucauauuuugcucauuugaaguaaauaugcacuacaaauguaggguuaaauuauaggcuaacgccuggaaguuaauuuuuuuaaauaauugcagaugguuguguauuuuagauaaauaacuaauaaauaaccaaauacaaaaaaaaaauaaccaaauacaguggcugugucucaaggcacaguagcaauuuaaagaaagcucagcagcccagccagcauuauuuagaaagcaguugaugcuugcaaaggugaccuggguauagcuuagauuggcucuccuuaaauuguuuucaaggugaccuggguauaguuuagaccggcucuccuuagauugugcuucauuguucuuuucaacagcugcagaguccagaagucagauuucagcaacaacuggaacaacucagugccaugggauucuugaaccgugaagcaaaccugcaagcucugauagccacagggggcgacaucaaugcagcaaucgaaagguugcugggcucccagccgucauagcagcaucucucuauccugagaaaauguaauuuauuuuugauaacggcucuuaaaucuuuaaaauaacaugcuuuauuucauugggauucugugcuguuauaaaggaaaccaauaggaaguaucuggaggcagagugcaguacgacgggcggguuucugugucuuuuuggaacagugggaaucaauguuucuucugguuaaggcugcugcaugcaucaaacacuuggcauuuauuguaauuuuuaaaaaaauaucaccuuuucuaauugggugaacaaauuuuuguccugcaucuguccaacuaacuugcuuuuuaaacauaacccuaugguaguaauuuauguagaauaaaggcauuaaaaagcagaucauuugcgcgccccaugauuucugguacaauagugcuuguugugacuuuggcaugcacuuugcaaaugaugcuguaagauuuauacuccugacaauuuuguuuauuuguauacaauacaaauuauugcacauuucuaggccaucuaagcaaaauuucuguaacuaaaaaaguacaauaaggauuccuaauuguguagaaucuuacagcaucuuugauaaacaucucagcagaagugccauuuagucuguguggaaaauaaagaaaaacuaacucugguuaucucuuuagggacauuuaauuguacagacaacauaauguaacaauaucucagcauuauauaauggcuguaaauuaccuuuccuugugccgacuggaggagcacuguaucaugcucugauguguuugcuggggcguccugcuccccguaggugucgucuacgcagcauugaguuuauugaaaugucgcuuucacuggaagugcggauguuucgguucuaauugccauauaaaaguagagcugucucuuggguuuaucagcuuucucauucauaggcaauaccucgauuuuaaaugauuagugagccacuuguuucucaaguguuuggcuaguucuauuaagaaauaguugaaugucgugcuguucggagccucagaagggggugggggaggggugaaacagaaucuauucuggauugggccagccugaacuagguaauacuggcaauuaagauucugugaagauucuaugcauauaguagugucauuugggugaaaaagagccguuuuaacaauuuugaguacguuuggcuauucuauagccucuuucuuccuuccccaaagacguucuacuugccuaacucucaaacuguuggggugauacauuccuuugggaccaguuaaaauacagcguuagggucggugacauaugugacuggcucugguucaguauucucuuaucuuaggucacuguagucucucuuguaugguugcccaaaauuauaauguuaaauaaucuaaagugaguucagacaaguaaaaucaagggaaauagaaggugaauucuauaacuucuguaaguugcuugauauuaaaagguugagaggcagguuggccccagacuguauacuuuucugacacuuuaccugggaagaaaacauguacaaaggucaggguggaggcaugacugaggaggucggcacagccugcaugugugugcucucucugccuuacgccucagucugugguuggaagacuuuguacuggugaauggcaauaugcagguggggcagugucaaaagcaguuugauuuauuaaucuccaaauaacaauaaaucuccagcuuuuacacuugg

SEQ ID NO: 7071 - RNA, 622 nt, Mus musculus
aagcggccagaggucaccugccaagaugguucacuacucucuugacccagaaaaccccacaaaaucaugcaaaucaagagggucaaaccuucuuguucacuuuaagaacacccgggaaacugcccaggccaucaaggguaugcauauccgaaaagccaccaaguaucugaaggaugucacuuuaaagaagcaaugugugccauuccggcgguauaaugauggagucgguaggugcgcccaggccaaacaguggggcuggacacagggucaguggccaaaaaaagagugcugaauuuuugcugcacaugcuuaaaaaugcagagagaguaacgcugaacuuaaagguuuagacguagauucucuagucauugaacgcauccaggugaacaaagcaaccuaagaugcgccgacgaaccuacagagcucauggccggauuaacccauacuugagcuccccugccacacugagaugauccucacugagaaggaacagaucguuccaaagccagaagaggaggcugcacagaaggaaaagauaucccagaagaaacugaagaaacaaaaacucauggcccaggaauaaauucagcauaaaauaaaugcagauaaaguuuuuaaaaaa

SEQ ID NO: 7072 - RNA, 4610 nt, Mus musculus
cuccuggucuagugcacaccagcagagucucaugggaaucaugggaagagcaucugaugcuggcaguugucggguuuuaccacaguggagauguucagaauuaauguacuuuccaaaaaagacaaaaagguuguucuuacugauuauuugguuguaggugucuucacuucaugccgcacuggaacaagaaagaucuaaagugaaaguauuacaggcagaauuagccaaauaccagguauguuuuuauaauuuugacguuuucuuuauauauucagaguagauacaguaaaagaaugaacgugcuauuuuauuuuuaggccauaaauuauucacuagauaauauugaugauuuuuguaaaaaggggggaaaaagaaaaaauuagcuguguguguacuggggguggggggugggguggggggugcugugccuguggaggccgagaggaugcugaauccccugaagcugggguuggaaacacuugugaacuucacagccugggcugggaacugaacucagggccuccugaggaucaacaagucuugcugaucacugaaccaucucucuagcuccuugucauugccuuuguuauuggccagauaauguacauuuucaaaaauacaaaaguaauuccagauauugguauauacaacaauaaccaaagugauucaggaaaugcauuagagcuauguggacagugugcgucgcuaaucauauaacaggaaggcacaggugacacacagcauuugggugcugguuaucccacuguagauguccacccuuuuaacugacacgugauauggaguggagccuugcgagugggugaccuuucacccaucgguacuaucugcacccacuguuauuuugauauuuuagauucuacuaggcuuaagauauuucagcucuucucucccugcaugaaacaacugaaagcaaucgucacuguuucccauuaauaaaugugucagaugugucuuuacauauuuacacauauauguaaaucaucaaugugaaaucuuggacaaaaaggcuuaaaagccacugguagcauaaagaauauaaaaaguauuuaacccagccuagcaugguggcacacaccauuaaucccagcacuugggaggcagaauuuucugugaguucaaggacagccugaucauaaggagaugcugaaagcaguccuguaugucucuuaguugaauugguugugaggguuugguuugguuugguuugguuugguuugguuugguuugguuugguuugguuugguuugguuugguuugguuugguuugguuugguuugaauuggagugguuuugauuuuuugagacaggguuugucuguguaacaacucuagccaucuuggaacucacucuguagucuaggcuggccuugaacucacaggagaucugccugccuaaccaugcuggaaaucaaggcggcccagcuuguuuugucuuuuaaucucauugaguuuuucacacuggcaguaucguagucagugauguuacccaguguguuacuggugauucucaccgcugagaagcacgguaagaacuguaaggugcacacuggucguccucagcacaagggaguaaaggaguguucucuaaacuuuguuuuccuacuaacaagaaaucaauuccuuuuuuuuuuuuuuuuuuuuuuuugguuuuucgagacaggguuucgaggcuguccuggagcuuacuuuguagaccaggcuggccucgaacucagaaauccgccugccucugccucccgagugcugggauuaaaggcaugcgccaccaugcccggcuuauaaauuccuuuuuaaaauguuauuuacacauuuaacuaucuacaaaucagaacaaaguuuucccuaaaugaauaaaucuuuuuggcccucugcguggucaggaguaaauaacagcauucaucuauuugaagagguguugguuuuucuuuaacuuagaagccugguguauuugacuccaaaaggaaagcuguagugugggaagggagaaagaaguuaaagcagucgcuguggucucaggugagccugggcccgccacuccccuaguaggacuuagaaacacguuuaguauuugcuuucauuucgugugugugaguauuuugcccuuacucccagccugaacaccaaaguucuguugcuagggcucaagagguggcucagcaguuaagagcacugauuauucuuccagaggaccuggguucaauuccuggcacccacauggcagcucacaacuuucuauaacuuuagcuccaggagaucugacaaucuccugggguaucccuggaagccaggcaugaaaguaguacacaugcauacaugcaggcaaaacaccuauauguagaaaacaaaauuaauguuuucaaaauucuaauacuguuuaaaaauaaaacuagggguuggagagauggcucagccguuaaaagcacugacugcucucuuccagagguccugaguucaauucccaacaaccacaugguggcucacaaccauuuguaaugggaucugaugccuucuggugugucugaagacuguuacaguguacucauauaaauaaaaauaaauaaaucuuuagaagaacaaaacaauacagaacuugaauuauaaauuaucaaaaaacuaaacaacugaauuacuaaauuuguugacuauaugaaaagaacuacuuuguuuauuuuguacuuugugugugugugugugugugguuuuuuaagacaggguaucucuguauagcucuggcuguccuggaacucacuuuguagaucaggcuggccuggaacgcagaaaucccccugccucugccucccgagugcugggauuaaaggcgugagccaccacugcccgacuguuuuguacuuuuuaagguauuuaggauaaaaugggcucugaagaacugagauauuugugaccguauugauucagccuaaacagcucuguacuguugcuuucugucucguuuguuaaguaacugugagagcugggcguaaggaaauagcuaugcuuugauuuugugugcucauaaacugaccgcccagagacgugcaucuucaguaacuaacgugcuguuucuccuuaacagggaggcaggaaggggaaaaggaacuucgaaccugaccauugcaggugaucguggccucggaggccagcacagaauucuuucacacuuuugcagaaauguguauauuuaaugcugugcgacugcuaaacugcagguuuuuguugaaggaacuaaaagcaacuaguucacucauagucuacaguuuuauguucuuuuggcuuaaaguuaaaagaaaauacagaauaccagcagaacuugauuauuguuuucuguccaaacuucuuaugacuuuaguuuuucaucagucaauaaaauuaauuuacucuuccaagaaucugugugaucuucacugucuccugagcaauguggcaccuuugugugcuaaccccuaccccugaaggacagcagcaugaggacagagaaugugggcagaguaagaacaagcacugguuacaugagccuccaagaguaaucacagggcucgcgugcuccucggcacaguaaggaagguucuaugaggugauguuuacagaguaguuuuccugaauauuuguugaaaagcauucccaacagaaggaauacaaucuggacuagaaaauuugcuuaaacaguaggcugucacagcaacagugaggaggcugggagaggggagagcaacaaaugacccuugauugcuguggauuguaggauaguuagcugcuuuagucuauucaguaggacacaacuauaauuuaguaaaguucuaucuuugaccuuugagaagaucgcugaguggcaggggcacugugugguagcagaagugagcaugugagcacugaccgcucuugccugugccuggugcccauggaggccagaagagggcaucagauccccugaaacgaguuaggaaugguugugagccgccccguggcuucuggaaacacacuugagacaggcccucugcaagaacaagugcucuugccuacugggccaucucuccagccccaggaucccauuucuugacaggcuuuccuuuuuggugguguuuuaauuuacugagaugguacaugucacagcaugggugcaaaggucagagagcacccugagccacccuucuccccuuccacccuuuggauacuggguaucagacucggguccucaagcucaauggcaagugcccuuacccacugaagcuucucacuccguuucuugacaguuuuugagaaauaaacaaaacagugauagaaaugugcugaaccaccgucguaauugcuuaccucucucugccuccucccaugagguuccaugagccuugcaaagagcuaggauucaucauccccuggauucccagccagcacuggucugucguacagcauagcauagagcaggcacuacagcaguguuuaaucaauaaagagggcauucagggaaaggaaaaaacaaaugauaaaguauggcgaaagaguagaagccuuggaagguauuuuaugccaggccucuaaccauggacacacacgcacgcgugccagugagcaggaagcacacugcugagucacaug

SEQ ID NO: 7073 - RNA, 42356 nt, Mus musculus
auucuuggaagaguaaauuaauuuuauugacugaugaaaaacuaaagucauaagaaguuuggacagaaaacaauaaucaaguucugcugguauucuguauuuucuuuuaacuuuaagccaaaagaacauaaaacuguagacuaugagugaacuaguugcuuuuaguuccuucaacaaaaaccugcaguuuagcagucgcacagcauuaaauauacacauuucugcaaaagugugaaagaauucugugcuggccuccgaggccacgaucaccugcaauggucagguucgaaguuccuuuuccccuuccugccucccuguuaaggagaaacagcacguuaguuacugaagaugcacgucucugggcggucaguuuaugagcacacaaaaucaaagcauagcuauuuccuuacgcccagcucucacaguuacuuaacaaacgagacagaaagcaacaguacagagcuguuuaggcugaaucaauacggucacaaauaucucaguucuucagagcccauuuuauccuaaauaccuuaaaaaguacaaaacagucgggcagugguggcucacgccuuuaaucccagcacucgggaggcagaggcagggggauuucugcguuccaggccagccugaucuacaaagugaguuccaggacagccagagcuauacagagauacccugucuuaaaaaaccacacacacacacacacacaaaguacaaaauaaacaaaguaguucuuuucauauagucaacaaauuuaguaauucaguuguuuaguuuuuugauaauuuauaauucaaguucuguauuguuuuguucuucuaaagauuuauuuauuuuuauuuauaugaguacacuguaacagucuucagacacaccagaaggcaucagaucccauuacaaaugguugugagccaccaugugguuguugggaauugaacucaggaccucuggaagagagcagucagugcuuuuaacggcugagccaucucuccaaccccuaguuuuauuuuuaaacaguauuagaauuuugaaaacauuaauuuuguuuucuacauauagguguuuugccugcauguaugcauguguacuacuuucaugccuggcuuccagggauaccccaggagauugucagaucuccuggagcuaaaguuauagaaaguugugagcugccaugugggugccaggaauugaacccagguccucuggaagaauaaucagugcucuuaacugcugagccaccucuugagcccuagcaacagaacuuugguguucaggcugggaguaagggcaaaauacucacacacacgaaaugaaagcaaauacuaaacguguuucuaaguccuacuaggggaguggcgggcccaggcucaccugagaccacagcgacugcuuuaacuucuuucucccuucccacacuacagcuuuccuuuuggagucaaauacaccaggcuucuaaguuaaagaaaaaccaacaccucuucaaauagaugaaugcuguuauuuacuccugaccacgcagagggccaaaaagauuuauucauuuagggaaaacuuuguucugauuuguagauaguuaaauguguaaauaacauuuuaaaaaggaauuuauaagccgggcaugguggcgcaugccuuuaaucccagcacucgggaggcagaggcaggcggauuucugaguucgaggccagccuggucuacaaaguaagcuccaggacagccucgaaacccugucucgaaaaaccaaaaaaaaaaaaaaaaaaaaaaaaggaauugauuucuuguuaguaggaaaacaaaguuuagagaacacuccuuuacucccuugugcugaggacgaccagugugcaccuuacaguucuuaccgugcuucucagcggugagaaucaccaguaacacacuggguaacaucacugacuacgauacugccagugugaaaaacucaaugagauuaaaagacaaaacaagcugggccgccuugauuuccagcaugguuaggcaggcagaucuccugugaguucaaggccagccuagacuacagagugaguuccaagauggcuagaguuguuacacagacaaacccugucucaaaaaaucaaaaccacuccaauucaaaccaaaccaaaccaaaccaaaccaaaccaaaccaaaccaaaccaaaccaaaccaaaccaaaccaaaccaaaccaaaccaaaccaaacccucacaaccaauucaacuaagagacauacaggacugcuuucagcaucuccuuaugaucaggcuguccuugaacucacagaaaauucugccucccaagugcugggauuaauggugugugccaccaugcuaggcuggguuaaauacuuuuuauauucuuuaugcuaccaguggcuuuuaagccuuuuuguccaagauuucacauugaugauuuacauauauguguaaauauguaaagacacaucugacacauuuauuaaugggaaacagugacgauugcuuucaguuguuucaugcagggagagaagagcugaaauaucuuaagccuaguagaaucuaaaauaucaaaauaacagugggugcagauaguaccgaugggugaaaggucacccacucgcaaggcuccacuccauaucacgugucaguuaaaaggguggacaucuacagugggauaaccagcacccaaaugcugugugucaccugugccuuccuguuauaugauuagcgacgcacacuguccacauagcucuaaugcauuuccugaaucacuuugguuauuguuguauauaccaauaucuggaauuacuuuuguauuuuugaaaauguacauuaucuggccaauaacaaaggcaaugacaaggagcuagagagaugguucagugaucagcaagacuuguugauccucaggaggcccugaguucaguucccagcccaggcugugaaguucacaaguguuuccaaccccagcuucaggggauucagcauccucucggccuccacaggcacagcaccccccaccccaccccccacccccaguacacacacagcuaauuuuuucuuuuuccccccuuuuuacaaaaaucaucaauauuaucuagugaauaauuuauggccuaaaaauaaaauagcacguucauucuuuuacuguaucuacucugaauauauaaagaaaacgucaaaauuauaaaaacauaccugguauuuggcuaauucugccuguaauacuuucacuuuagaucuuucuuguuccagugcggcaugaagugaagacaccuacaaccaaauaaucaguaagaacaaccuuuuugucuuuuuuggaaaguacauuaauucugaacaucuccacugugguaaaacccgacaacugccagcaucagaugcucuucccaugauucccaugagacucugcuggugugcacuagaccaggaggacacgcucgcuugcucgcucgcugugaaggagaacagggaagcucgccugcugcuuaccuuucacacuccuuaggacacaccuaccauguuuaauaaaacaagcacaagcuuugcuaguacauaaugaguccuuucuugccugcuuuaagagcaguauuccuguuuaguuggacauaacaaucaagaccucagaagagccuaaggaagcagccagcagaccccacagcgcucaccuggaccgucagcucguucuugaugcucugagacucauccacuugcagaaguaucucggccuuaucuuucacugugggaaaggagaacggcagcguuacugccucagcacugcagggcugagcagacacagaccagcacagagcaucagaacaauggcuucuuccucuuugccuaauucuuguucuccugaagccugacugcucuuaucucucaccaucaaauucuggucaguauuacaguuaaaguuuuuaaaaaguaauuuaaauuuuucugugguguugaaauguuaauugcauagauaugauuaauauuucaauuuaccauaacuaggggcauauauauaagaaaaauuuaaaaauuacauagaaaaauaugaaauauuuauuaggucauguuacuacuuauuuacuguaugugugcgcauguuacaugccacaguccacaugugucaggauagcuuguggcagucaguaucauguaaguuccagggaucaaacucaaauuuccuguguuugauagaacaguucagcuuccccuguucggcugucacucuauucugcagcccagguuggccccuggacaucugauccucuuuucucagucuccaaagugcuaggauugcagaaacaaaccauuacacuuggcuucuuggcuaaucuuaaaaguaagauuguuuuuccuuuuauuuuuuuagacaguggucucauuaugcagccuuggcuggccagaaacuaagagauccacccaccucugccuccagagugcuggauuaaaguuauguaucuucauggcccagcugggcgcaguaauguguaagaacuugaaccucaaccuucuacaugaauaguggcaaaugugcuuuuaaaggccuuauagagauaauauuacaacaaacuauccaacucauaucacacuggggaacuuuuuauuauguugguugauaaaacauggaacuugacgauuugucuuuggauauuaguauuagcuuuaauucuaaaaacauacacaaaggcugagcauggcaguucgugccucuaaccaugcccuggagaggcagaggagcccaccaccugucuggucuacaccacagguuucaggacagccagagcuacauagugagaccccaucucaaagaaauacagcgagggagcuggagagguggcuuggcagauaagagcacuggcugcccuuacuaagaacccggguucaauuucuagccauacaguagcugacaacuguuguaauuccaguucaaggagaucuguccuccucuucuggugucuuuggcagcaggcauauucacaguacacauucguguauauauguauguguguguguguauguauauuuauauauguauacacacauaugcauuguauauguauacacauauucauauguauuauauaugcauaaacacauauacacaugcauuacauacacacaaguacacauuuuuguuuguuuguuuuuuguuuuucgagacaggguuucucuguauagcccuggcuguccuggaacucacuuuguagaccaggcugaccuugaacucagaaaucugccugccucugccucuugagugcugggauaaggccugcaccaucacacccaacuacaagcacacauuuuauauauauaugugugucacaagugucacuuacucucucccuccugaagcauuuucaguaauuguccauuucuugcuuuuacuucuuuauacuuugccuaauagucaaaggaaagaaauuuuaauuuuuaaaguaaaugauaaaucauggucuauuuuaaauuuauugggcugugcaugcuugcuuaaaaacauaaaccauuuaugaaauaaucagaguauaggauguaaacagacuacuuaauuaagccucugaaaagcaagaugacuuagaacguauagccugaggaugucuuugaccccuggaacacaacaguacaaggacaaauuuaaauguaaaagauuucagaacagaaaggcuaaaaguaaagucaggaaaaauuaaaauuuccugaaggauccuuuuuucuuucuucccuaaauaaaaacuucaaauaauuccaacuaauuucaauaaaaguaaaaagaaaauggccacagcuuuuggcaguucuggccugcagucugaucaggaccccgguguugcucuacagccaccacugucaagucuuuuauuuauuuuuuuuauucuuuguuuuuuuuucgagauaggguuucucuguguagcccugacuguccuggaacucagaaauaugccuuccucugccucccaagugcugggauuaaaggugugcaccaccacugcccagccgcugucaagucuugacagagcucguggcugcuggacaccucagcuccucucuccacauggcuggcuucuucuaauccucauaaaugauauaucauacacucagaacaaaaggaacugcgcucccacacgcaucaucugaauguuugguaguuaucuccccagucuucacugaacuuuccuuuaguagucugaaacacuuucaaauacuaauaagcaauaauuagugaaaacaauaucuuaaauuauaaaaagauaaaaaccuaagaauaucaauguaaaaacuuguucuuuuacucucccccaucuacuagguaugugcaaaauuuccuaguuucaucuuuguuuccacagugcugggguucaacuuaaggucucaccaaauacaaaaagguaagcagauaccauugaaugaugcccggacccaguagauucaaauauauuaaauauauauuaaauauacuaucuaucuaucuaucuaucuaucuaucuaucuaucuaucuaucuucaucaucaucaucaucgucauuauuauuauuauauuuugagagaggguuucucuguguagcccuggcucuccuagaucuugcucuguagaccaggacagccuugaacucagaucuccuugucucugccuccaaaguguugggaucaaaggcaugcaccaccaccugguuuuaaauauaucuuaaauucuaugaaggugacuuuuacuaaacaguacucuauucaauuaaauugcugauaauuauuuauuguguaguacuuaagaaacagaugaaguagagcugccacacauacucacgcacgcaugaacgaaugcaccaaccccagaagccugacacagcacagugaggaaucagugugcuaacauuagguaggagacaaacgaugcuuggggaauagcaagagaaugcuucauaaguuugugguuagagucaacuguaaggucuggagagcuagcucacaucaagaacacuugcugcucuuucagaggacccuauuuuggauccagcaccccuaugagguaguucacaaaaacuuguaacuuucucuccaggggaucuggaaacccauucugaauuccauggcaacugaacacauggcguauauacaagcacacauaugcacaaauaagaauuuuaaaucagucuuuaaaaaacacaauuguauauaaaggauuaacaaggauauggagaaauuagaauccuuaugcauuucugguaaaauaacauuugcuuuagaaaagcuuggaagucacagaaaaagccaaaacaauuauauaaucagcaaaucuacucuuaaguuauucaaaauacucaaagaccuaaaagcaugaccgcagauaccuguauacccauacacaaaauguagccucucucugcauguaagagaauguaggacaauggaucaaauucuguaaaucuuguaacagggaggaaccuugaaaacauuauguuaaaagaaauaaacuaggcuggagagauggcucagagguuaagagcacugacugcucuuccagagguccugaguucaauucucagcaaccacaugguggcucacaaccaucuguaacaggcucugaugcacucuucuagugugugucugaagauagcugcaguauauucauaaauaaagaauaaauaaaucuuaaaaagaaaacaaagaaacaagacagaaaaggacaaaaacugugugacucacuaaaugagagaucaggaacaggcaauucacagaggugaauuguugucagggaaugggcuaggaauugugagcaguucaauuacuacaguuuuugcauggaaacagcaggaauggucacacaguaaugggaaauaacaucacugaaccuuuaaucccagcacugggaggcagaaggaggcugaucucugugauuuugaggucagccugguuuacauugugagauccugacucaaaacaaaaaaaaauuaacuaaauacugcuacugaaccacaugcuuaaaauauauaccuaaauacauauaauaaauuauuuauucuacaauauuuauuuuauaacaaaauuuaugccaucauucagacucuaagugaguaaccuguuaggaaaccugauagaagacuguuucuaauaacugaauaauaaauauauagauacccagaaaauauaaauucauaauucuuuucuuuugguuuuucaagacaggguuucucuguguagcccuggcuguccuggaacucacucugaagaccaggcuggccucgaacucagaaauccaccugccucugccucccaagugcugggauuaaaggcgugcgccaccacugcccagccauaauucuuuucuuuuacaaaauaaguggauacacaccucccacugagugaucacagcuuugagcuucugaauuucugcgucuuuccuuucaaguucuaacuuuagucuuucaauucuuccaucuuuuagaccuacuuccugaaaaaagaaaaacacugcuuuugaccaagauugcuccacccagcauaguuuacaacagcccuuugcaaaaagauuaagaaaaauaaagacuuaauuuuaaauuacuacaucucuacuuucacucaauuauaugauccuaguuacauacagagaaagcaagugaggcuuuucuuuuuuuuuuuuuuuuuuuuuuugguuuuugagacaguguuucccuguguagccuuggcugucugagaacucacuguucugcggcucacucuauauaccagguugaucuuggauuuaagagacccuccugugucuggcuuccaaauacugggaugaaaggugugugccaucaagccuggcuguuuugauaaauguaaacugguuccauuuucguaaaggggaaugcacacagaugcucaaugaguagucucuaggugccaggggaagggacugaaacacuuuugucauaugaaacaugucuagugcaauacuucacaucaacaagcucauauaagccaagguucaaacuuuagacaaacugcugggcagugccuacaaggcuaaaaccagaggacuauuugagccuacaaguuaaacccaagcaggacagaggucaccucauuucucugaaaacguuugaaacccaaagcaaacaaacaaugcccccacacacauacaaaucaacaaaacccaccacaacaaccagguguagaauuacuacaguguaagccauaucuaucucucugguuuuucaagacagcauuuccucuguguauuucaagauagcauuuccuagcuauccuggaacucucauuuagaccaggcuugccuugaacucacagagauccaugugccucugcuucccaagugcugggauuaaaggugugugccaccagucuggcuuugcacuguuuucagaugguuauagcaaucugcacucugccuaguacacuaugcuguccugucugcuuacaacugaucauuaucuagccguaugcauacucaaaaucuuuaauuuuuccuagacucagcaauaaaauuauuacuaaauacaaguuuacuaugcucaaaaauuuccaaaaauucuuuccugucuacagacuaaaacauaaguuaggcuuuaaguauuguacaagccuucccaaucuaccucccugucugcacacagcacucuuugaauuaaauugcucuuuauuucacugugucuguagguuacugaagacauccucauuucuccuuccucauguucagauccuguccugcuaaccuucaguucaagccuuaguuucucugcagaaauccaucuugcuguuccauccuaguacacuaaugugccgauuuuuguacucacaacucucucuauaaaacaaugauuaaauguauaccauguacaauacacuguuaagcauuuuaaauuauaauuucuuuuuuuuuaaagauuuauuuauuauuauauguaaguacacuguagcuguccucagacacuccagaagagggagucagaucuccuuacggaugguugugagucaccaugugguugcugggauuugaacucuggaccuucggaagagcagucgggugcucuuacccacugagccaucucaccagcccccuaaauuauaauuucuaacucuccuaaaaaucauguaaaaagaaaacaauuauauuccuagugcaagaccauagaugaguuacaacacuaauauuuuuauuauauuuauuugauuucaacauccauucucuuuuauuacaccuugcugcuguccggccuuauaguagucaucuaguaacacuuacagacucaacucaguucuacccagacagugggcaccugagugaguacuuacugcucugugccugagacaggagcucccuucuuuccgguaccaguucuuaacuauacauacaguacaugugugcuccauauuuguuggugaauuaacugcauauucacauuauucuuuacagaauaaagacuaacauaauauccuaaaacuguuacuuuagauaauuagaguuacugugacuuuaagagaauguuauuguccaugccugguugugcucuggagcgggagaguuaucuguuccguugugcucugugaguuguucucuccuuuuuucucuaaucagaaucuuaugaacaucaucuuccagucuauugaagaaucccccaucgugugauaaagucugagcagaauucgauuccugucaaaauaaauccugaauuacuaucauucaacacaaacauauacacauucacuaaaccucgagagucacuaggaggauaaagaaaagaaaggcugcuaggagacaacgcaucacucuaaccugccuccagaagacaagcaggaggggcauguuugacaagugucucuuucuuacuucuuccuauuuugguguuuccuaugacugacaucuuuuagaggcaggguggucuggaacuugugauuuucgugcugaacuucucauacacugaaacuaaggcucuggaacaacaugcccagacaccguuggcuuuucaacuuuguuauacaugcaccacacaguucacuccguuaccacugaaaaguuccagagauguacaacuaccaccaccaaaagcuuuacacucuccucgccugcacucaucagcagucacucuuucucaaacguucuucucggcccuaggcagcacuaauuuugucuuuauaaacguaucuacucugcacauuucauauaaacagaauauuguguuuucugcuccaaacuucuuuaucuaccaauauguuugcaagccucgaccaugugacagcauggauuaguacuucauuuucuccccugcaguaccccauuuuacauugucauuuuuuugucacuggcagauggacagcucucuuuggucugcugugaauagugcugcuaugaacacuuauauacaagaugauuauggguaugguuccaguucuguggggcacauaccuaggagcaagguuacugggugcucucaaagucuacauuuaaccuucugagagauuccagcuaguccuccaagcagcucauuauuuuacaaaccugucagcaacaugggacagcucuaacgucuauauucucagcacuauguugucauguuucuauugcagacacccucauggaugugaacacuuacuucaucagggcuuugcacugaguuaguucccuauggcugauggaguaggccauuaguuuuaugauuuacuggauacuguagacucuuuuuugagaaauguuuacuuagaaccuuugcucaguuuuuaacugaguuacuugccuacuuacuuuuagcuagagagauggccccaugguuaaggugugugcugcucuugcagaggcccugaguucaguucccagcauccauuuggguggcucagaauagccuguaacucuagcuccagggcaucugacagcaucuccuggccuuauguacuaucugucccccaggcauauauguauauuuucaagaaacauagauguagggcuggagagauggcuuaagagcacugacuauucuuccgaggguccugaguucaaaucccagcaaccacaugguggcuuacaaccaucaguaaugagaucugaugcucucuucuggggugucucaagacagcaacaguauacucacauauaauaaauaaauaaauaaauaaauaaauaaauaaauaaauaaauaaauaauuuuccaaaaagaaaagaaauauagauguaaagggaaauaauuuauguauuguaaaaaacugaggagaaugacaaccggcuaucaucccaguuaaggcagagaggccagacaaauaugugcugcaaagacaucagauuccauggaucucuuccaugccuuccacuuucaagucuaugaauaaagugguuuaccaucacaucccccccaauauaguaagaagaugaggagcaauuaaggaagacacuggacauugaccuuuggcccccacaaacacacacacacacacacacacacacacacacacacacacacacgcgcacgaacauguacacauacaaaaaucauuugaauauacaucucauuaaauauuauaaauauuuucucuuauuauaagaguugucucagcacagaagauggccuagucggccaucauugggaagagaggccccuggucuagcaaacuuuauaugccccaguauaggggaacaccagggccaagaagugugaguggguggguaggggagcagggcagggguaggguauaggagacuuuuaggauagcauuugaaauguaaaugaagaaaauaucuaauaaaaaauuaaaaaaaaaagaguugucuuagcaaaguuuucaugauguccucuagacaacacaaaagcuuuaauuuucuuuaaacuagggauugauuugggauggcaugugugcugggugagcacuucaccacuuacuucucucuccuaagaugcagaguuuuagcuccuacagcgagcaaaccugcgacuuagagcugccuuugugguguuggggcucaaaccuaugcaugaccucacuggcaucuguggcugggugcuggcuuggcuuuagggucacauacaccccugugacccacgcuguuggucucucuguagaugcagaaggcauccucugcacagagacauuuauucaaggagaagacuauuuucucauacugaaucgucuuggcucucaaagucauaaaucaagcaaauacaaauaucaaauuuuauuucuggacucuaugucuacucucaauacugucaauucucaguuucaaauggauuccacuacuacagcuuuauauucacauuguuuuaugcugcauuuaaaagccauuuugacauaaacuguguauauaaauaaaggcaguauuaaagagaugugauuuuacacauucucuagugaaguaggauuuccccucuucuuguuaucaagcagagaccaaaggaaaugcuuuuccugucuucauuggucuucugguuacaggacugaguuuuaucaaguccacugucuguauaaacagucauacacaauucaauccauggcugcuuaguguuuaccugcacaucacccagaaagggaaaugucugaaugaacauuuguguaucaguacaaagcguucguuuccuguagagaacuucaugcucuauagagcauguggacacuguuuuacucgagucucauaaacaccagcacagagcaugugucccacugauaaucaaggccuguaugaccaggagccacugccaaguggcacaaaccuaacuccaaguauugcuucguaagacuaucauauucugucaacucuaaagcauaaaacagugcucgguguccaugacaggagcagugugcugcugacacuaacagcgucuggguuuacacuguucaguggccuugcuugcgugacugaggccuugagaucuuacucuucacccuucacuuuggcuggccuugggcucacagagaccuacaccucuaugcugggagcaagggcaugcaugcccacugucuuaguuaggguuuuacagcugucaacagacaccaugauuuuuuuuuuuauaaagacaacauuuaauuggggcuggcuuacagguucagaggaucaguccauuaucaucaaggugggagcaugguagcauccagguaggcauggugcaggaggagcugagaguucuaugucuucauccaaaggcugcuaguggaagacugacuuccaggcaacuagggugaggaucuuaugcccacacccacagugacacacccauuccaaccaggucacaccuauuccaacaaggccacaccuccacauggugcucucccugguccaagaauauacaaaccaucacaccccccaugccaaccaucuuuugacugcuacuccucucuucaguguuccuaucccccuaaaaucuuagccccccaguauuucugaacgacauacacacaaaacauacuucaacuuuggcaaaagauuugagaagacuguucaaagauuauugacaagcccaugaaaacauacuuaucaguuaucaggaaaaucuguuuaaaauucagugagacccacuacaucucuacucgguguuggcaaggguauguagaaacuacaaauucuuacacaccacuggcaagacuaguaaauaccacauccacucucuaaaacaaucugacaggcucuuaaacaguuagacauuucaaccaggucucccguuguaggccuauaaucccagcuaguuggaaggcugaggcaggaggaucaccaguucaaggcuugccuagauaacuuagugacaucauguuuaaaaaagguaaaaugucuucagauauaauucaguaguaaaugcuuaaggcccuggguuugaucucuaggacaugacaaacagguaaacaauuucaacccuaccucugaaaaaagaaaguaaagaucacuauacaaucuacaaacuuuaauccaagauggccaccugagagaaaauaaaaacacagaaccacacaaacaccaaacuaccugaauaaaaguauuaucacaauggaauaaauucagcaauaaagcuaaaugaacuauuauuugcuuguuugagacagggucucacucuguagugcaggcugguccggaacuauauagaccaggauggccuugccuccucuguguugggauacagugugcaacuacaucuaacugaaugagcuacugacacauaauacaacuuggaucaaccuaacaacacuaugccaagugaaaauaaucagucauaaaagagcacacugggguauucagagguuaccagaaagugcaaaucuauagagaucaaaaccagaauagucacugccagggacucaagaggggaguacaggggaauucugggauuauagacaauucuacaucuagacuaugaucacacccauccaacgccuucauuauauaaaugggucugggagucuagcucaguggcagagcaauuguuuaauauaccuaagacauuagauuugauucucugucugucuucaugccuuaguuauagacaugcaaugguaaauuuauuacaaauuauauaacucaauaaaacugcuauuuuaaauuguguuuuguuuacugaaggggauggaggccagagaauuuguuuucugcaagggcuagcacucuucuucugucaugugggucccagggaauuaaacuugggucaccaggcuuggcagcagguguuuuccuacugagccacauuacuagcuaguaaaacugcuugcaaagaagccacccacaagcucauuccucccgaagacucgagcauggccuaccugugcccugcacucugcauucucccauacucaucuugccuccacaaaguacuccggacccugaguuuacuguuuaucaccuccaguuuuauuaugcaagcagcacuaaagccuaacuucauucugugugucucaugucacccagaugcuugcuugucuuagggauuucgcaacagggugaacucuggagucucuucuagucuagaaaacaccgcuuuccacaacccacuuuuccuccucacauguucuuguuagagagaccaggugagcugucagacagaaccucuagucccuagauuuuccugggaaucagccccaagccuacucacagaaggcaaaugcucuacuaucagcaacauucagcugcccaaccgcuucuuagcauccuuucacuuacagggcugagcccugaaccucguguagcacagauacccucuugaggguugacuuauguguagguuaagcacugguuuugagcacacuuuguaaguuuugcuauccuugaguaucuucacuacuucacaaaccauuauuaaagauaagcaucuggauuggucccaagucuuuucuuggguaagauguaaagguaggccuggccaucacacacacaaauaucaacacauauguacauguuccuagguauauguaaguuucucuagagcaguguaucaguggcagcuugccaucugaucuuguaugugucuguguauaguugagugcuucugcacaugugugcagaggccagaacuggacaucagauagccucuuucugaaccuggugcuuguaccagcucagcugggcuguaagccaacuguccagcaguucuccuguuucugccauuucagagcugguacaugcaggaugcucuuuuacagcugaguuuggccuucaugccugcacugcagcacucggcuccgcuaagccaucucuccugccuaacacuuucucacugcuaccucauuucucuuucuuucuuucuuucuuucuuucuuucuuucuuucuuucuuucuuuuuuuuuuuuuuuuuuuuuuuuugguuuuucgagacaggcuuucucuguguagcccuggcuguccuggaccucacuuuguagaccaggcuggccucaaacucagaaauccaccugccucugccucccgagugcugggauuaaaagcaugugccaccacgcccggugcuaccccauuucuaagggugccauauaaccucuuaugagacagcauccagcuuuacaauguaaagaucucuuaauacaucacaauacacaaucuucacaauaguccaucuacgcaugcuuuccccuuaccccaaauucagguauuuguaacaggggauauuagucagcucucuccugccaccagcuaggucucauggacccaauucagguugucaggcuuggcgccucuauguauggagccaucuugucagccuuuuggggguuuguuuuuguuuuuuauucuggauuuuuuauuuuaguucuuuguuacagggacuugcuauguagcucaggcuagccuuaaaauauagacucccaggguugaaaucuguaacuaugugucaccacaucuagaaggauaagccacggguaggguggcaugugucccaugauacacguagaggucagaggacaacucguaagaguccauucucuucuugcucugugugggcccacaaaggugaggaacaccucagcaacaucaucuccacucgcacccuggccuccacacagccauuuacaaacacacaucagcagcuucgcacauacacuugugaacacacaugcuuuccucaauauaaaagaauaaacacacauauaaaugcaaaauugaaauacagauuuggagauuaagucacuuuuuugaauuuuaagauaguauauucauacagauuaggauaguaaugccaaaugaaacuguaguuuaugcaaauaaucacuuuuuuucuacuguauuuauauccuuauaauagcagaaauauagugaguuuagugaagacaaaccuuuaaguggccaugucucuauaaaaagacuuacugcuauucauuaaaguacuauucuucaguguuuucuagacuacaggacaaucauaguaaaacuuaccucugccuuuuuacuaauaugaucuguaaaugaaaaaaaagaaaaguuuuacaggaaagaauuaacaaauacaaauauuucaacaagaaaaaaaaguugcugaauuauaaaguauuacacacagaguuuucuaagauucauaucugacuuacuauuaggcuuaggauguuaaaaccuagcacagccuugcugguugugcucaguuucaggacuacauuuuauauccuaguagaugccucugcaccaagggaugguacuaaauuuuaagcaugugaguuuuauauauagcucaguuaccugguuauauguauuuuucagaggacagaaaauggaggagauaaaucuaugucuaaaaucagauggcuauuaacugaaaauguucagauuacugucuuuguugaaugaaauaaaaacuaugauaguaauuuauggccuuaaaagcuauuagcuguauuauuuuuaagaugaaaaaagugaugauuguacuguaauaaaauuccuaacauauuuacagauguguguuuauagacuucaacaacagaacacuaacaguuacagaugaagcaaaccauagacacagaaacucuacaaagcucuuccaggcaggaacagcagagcaggagggagagaacggcucagccuaaagcacuaggcaaggccacagccuguaauuuaagggugaucaggauaauagguacucgcauuaaguuaggugaucaggauaucuacuuaacaauguucuugccuacaagcaauuaucaccucucaaagaagaaccugacagaauaccuuucuuaugaccaacaauuagaaagacugccucauuuucuacaucauuuguccaucaguacaguacaaaacgcagucaacgucaaaaucauuaauugacaucaaacuaauuuuucugguauguucuacuuagcaauagaaugccauaauccaagggaagaucacaacugugaccaacacaaauugcaaacagcuauguagcuucucuuugcuauacucucaauguagcuaagaaguuugcucacaacuuaagaaaucacauggaaauaaauuaggaguuuuaaaguauuuuugauauguuuugucucaugugucccgggcugacuuuugaggaugaagcugagcuucugaugccccugccuccaucucuucagugcuggcucacaggcacaauaugaagcgagguggugugagcauccugcaauggcaggcagacaagcccaccacaaaaagagcuguacuccagcccuaauacauauucuuuucauaccucugccuaaauguuaaagaaguuucuuucuuuuuaaaaaaguuaaggcugaagagauggcuuagugucuaagaacacugguugugcuugcagaggaccuggguuugaucccagcacaaacaguggcuuacagcugccuuuaccuccuguucuaggagguauccgaugcccuguucugaccgccacagguaccaggcacacauguggugacagauacauacucagacaaaacauucauacaauaaaaauaauagaacuuaaaaauguacagaguuaaaaaccuacccauuugcuuuauguguguaguuuuggccagcauguuugccaaguagugcuuacggaggucagaauauggaggucagaggagggcacugcccccccggaacucuacuucagacacuuguggugcuggagauugaaaaggggucuccuggaacagaagccuuaacuccuaacggccaagccaucuccacagaccccaaauguaucguguaaaacaaauuccucuugguaaacuuagauguuuuacuuuagcacgucuuuuaucccuaaaccaaaguaaguuauuuagccuauaggaaaacuuuccuuuuuuuuuaaaggauuuagugugugugugugaguguguguguguguguguguguaugugaguguacagaugcaacuagagaccaaagcuccuggaaguggaguuagagguaguugugagcugucuggcauggaugcugggacuggaacacggcuccucuguaaaagacacaagcauuuaacuucugagccaucucucuaaccccaggaagaacuuucuugauccucaaaugaaagcaaaaccucuaaguuuacucuuaguuucacagaaaagcuaguuucugaaaacuguauuuagauuuuucauacuuaguuucugaaauuauugcuaggacagcauuuauccuuuuuuuuuuuugcacuugauuuauuuauuauuuugcuuuauccuuuuaagcaguuuuuuuuuaagguuuauuuauuauguauauagcauucugccugcauguaucccugcaggccagaagagggcaccagaucucauuauaguuaggaugagcuaucguguuguugcugggaauugaacucaggaccucuggaaauccagaacuacaacaagguaaauucuuacugagcuuuacagaguccuacugacugauuuaaauucuuacugagcuuugcagaguccuacugacugauuuaaaguuuaaaccucaaauaguuauuucuaagcagauguuuuaaauuuugucccuauaaaauucauguucaaauauaacuaucauuggaaaaauuacuaagcaagagacccuugaucccagccucuguuccuugggaaacaaacaacccaccaugaacaguccaaguuuuggaaacacugcauuuguguucuaagaaauguucaccacacaaaucaggaagauggugagugagugucuaugagagcaggagucugggcacaaacaauuaugauuuuuaaaaaaagugccgagagaaauaaaggagcuauagaaaauagaaaugaggcaaguaugacuucuuuucccaaaagaaagccugcugggacaacccagcaucccauguggagauagcuccugccggagggcacugggaaggacaccuacuccaguaagagccucaaaaggaaugugcgcacugcaggaacccaaaggaggcugaacccggcugccaaggaagaaugacaucacaggagaccucacacaagugccaaccuggggacagggaucugagacagaggauuggacagaguacacaacuccccuucccuugcuacugccgaguagcaggagaucuggccaagagccagagcuaugggcacuggaacucgggccugccuuaguccaccaggaaaggggugcagcucugcaccacgcaugcccagaggaagcacaagggaggaggucaggagagccacaccauucccuuucccccgaucauaaagccaagagaagacucacaugaaauacauguaaaacaacagacagggucauauacacuccagaaggggcacaacacaacauagacacucaaaaccaugacagaagaguccucuuggaaaccgccacaugcugacagugucucaguaccagagaccaaggaugcccagauuccugaacugccaaaaauaccucagagccacacuuuaaaaauuaaccaccaccaaaaauccaaacaaauggauuuaagaccuauacaagaaaauuauuagauagccgggugaugguggcacaugccuuuaaucccagcacucgggaggcagaggcaggcggauuucugaguuugaggccagccuggucuacagagugaguuccaggacagccagggcuacacagagaaacccugucucaaaaaaccaaaaaaaaaaaaaaaaaaaaaaaccaaaaaaaaaagaaaauuauaaaaugaauucaagagcuagacaggaagguuaugagaaugaaaugauaaguaaccuagagauaaagcucccuagagggaagaggagacaccuacaguucugccagccccacacggccuauaccugagcuuacaugagcagcagagaucccuuacacacagcugccugagcuugugcaagguccagggugcuguguuugagccuagcuguuacccaagcugagguaauuaggcuguccuacaggugaccucuaacccauguuucuggaggaaaagccuggaaacucacgggcucagcaagcuaaacuuggaggcaacuguuuuucuggucuguucuuggugccuucuccugcgugaauaaacacuuguucucaucucccaagaagucacacaggaccuuuugucucucucucacuccucugagcagcaagcaucccucugacagauucuggcaucuugacacugcacuuccuugccucuaaaacuaugagccaaugugcuucuguuuguuggaaacucucugccauuaguuagccuaccgcagcuguacccaauaaacuaaagcacaggguuccaucuuuauacucuaaaugguacacaaacaaaaacaaaauuagaagaguacucgaaacauauacagcuauaaaaugacucaagauggggugggggcuaccucaggugggagacugggccagcaucagcaagcgucugggucugacccaggaccacauaaacuagacaugggauuccugugacuccaaggcagaggccggagggcccucgcuacacacugaguuugaagucagccugaguaacaagaguccagauuuaggaaaaagacaaagccaccagucgaaaguggcuguggcacggcaggacgcgcaugcguuaccuucacacuggaagucuuugagugacaccgugacagguuuguccuugcccuggugguucuuccuuuuaucuuuuuuauuuauaccuuuugucugaguugaagcagucucagcauuuucauaauccuagaaagaauuaccaacagcaauuaaguuugguuuauaaagcacaacaucaacucuucaaugauucugacagcacaggcaaauaaaaaacaaaaagcuuaggcuuuuugaaauuguuuuucaugcaauuucagccaaauuguauggaaguuccugcuaaguuauguucauccucucaacugaaagcauuaaaguaaaagcauagauugguuuauaaaucccaccucugccaacguauucuuuccuucaggagcacauuuaagagaauaauuucuaauuucuaauuucauaccccugaaauggagauucuguuguuuucuaccacuaaaauuuagaacaguuuucucuuaaaacuauauucuuuuaaaaaauaaacucuaguuuuuaaaaagauguuuuuauuuucuguggauagguguuuugccugaauguaugucugagcccaaaugggucauaagaugacacuggguucugggcacuagaguuacaagugguucugagccgccugugaguccugggaaccaacacuggcugcugaagagcagcccccgacuccaugacacucguauauggcuuucuucacccaucucuaauacacuuaagucuccacuguggcuucuuuucccagcccucucccccuggucuucuaugcucuucggugucaaagucugcgcuucacaccccugaucucucucuauguucagcuaucagcugcagggcucagcacacuccgccauguuauguuucuuccccaccuucucacaggccccuuuauguguucggcaaugucacccuccaacaccugucaauuaugagucucauuuuuuuuuucuugucuacucucacuucacaucauauaugcuaaugaaccauucuguuaguuacuaggucuccucucuugcuuggacacugcuaauuuagucccucaauucacuuucuauacuuauagcauggguuucuaaaauaaaaaccugaaaucaaucuaaaaguuaaaaguauccaguaucuucuaagagaaggcaagcccaccacgugugucugacaccgucuuuuagcccacugaggcuuucccaggccacucagcuuuuccuaugcaguguuucgcacauuagcuacugucauguugacacaccuucccugagagugccuacuuccuucuggucugcuuuaugaacagcuaacaaguccagaaagauuuuaagacaauuguuuuugaaaagucccauccccaccaaaggcacuaagaagcuguuuauugugagucuucccagggcaccauuugccugucuccuucgcugagcucaagggcugagauagucuuuauccucacauccuaugccagcaccuggccagugaggaacaaaagaggcagaaaacaacaucccugauuuuuuuuuucuuuucuuuucuguuuuugagacaggaguucgcucugugguccaaacuggccuaggacacacuauauagcccaagcugcuggccuaaagcuguagccauccuccugucuuugccucagcagugcugggauuauaggcgugcgucaguggauggcccaaacuuacauuauuuguuacauaaauccacaggcuagaauaaucauagaagggaagaagagaaauggacuaguugguaugguauuugucuucgcagcaugaggaccagaguucaauccuuagucucauguaaaaauaaacacuugaauagugcugagcgccugugaccucagagugggggagguagaaaggaggagcucggggcuuguuggccagccagucuaguugagucugugagccucagcuuuaucugagauccuguuuccaaaagaagauggagagagacugaugcugauuucuggccuuccuacacacuuguacaugagcgugcacacacacuaaacuauuauaguuauuugcuugaaauacugacuuguaaacuccaugaacacauuaacauaauuacauaaguagccuucacauacaaaagcagcacuuccauucucucagagucauuacugucugacaaaaagcaaugguuuggaguacuaggccuaugaauuuagcaagaaaacggucugggagcaugacauuuuaccaacaucauuugcuccacuccuaaaacgccuaauuguugcagguccagaacaaagacauccauccuacaauagcucauuauuaaaaugaaaaucauaugcacgaauucagaaauaaaggcgcaccuugccaagccuaaccuccaaguucauuuaaucacaguaaagcaguguauucacuuuuacagcaguuugaucuuuaucucagcaaacaccuaaccguucaggcuauaaagacucuucucccaccccuucuccuaaaaggaaaucacuuauuuuucugcauacggguguucuggcugcauguguauguagaguuguagguuguucuaaggggccauacugaugaucagaacugaacgcaggucaucuggaagaguggucggugcucuuaagcacugagccaucucuccagucuugauuuugguaauaaucacuucaguuacguagcauacagugaagaagaacaugaaaaacaaagcacaugggacauaguagaccaccugacuggcaaggguuuuugguaguaaaaucauuugcagugugcuuuaacuucucucucuuugugcugggguggggacacuaguggacuuuguccuggggucgggacacuaguggacuguagcacagccagaaaggccucaaucauggggggugggggggggcgcguguuauucuugaucaacuugaaugaaucuaggaaacaacaaaauccuagcaaauguuaagaaguauaaugucacauaagucaaauuucacacaauuuagauacaggaacuggacacuaacacuacaucucacuuuauagcccucuagucagagcagcaagauccuggaaaucagugcucacaacauucgcugagcuuaaagcucagucuaggggugagcucuaugcucuggacugcucuuccuccugguagggagccuuuuaauggauuccuguauacugcagcacuuagauugauuuaaauuuuugaaucuacuuuuggggagggagcagagcuaauggccgaaccagggacuguuauauacauacauacauacauacauacauacauacauacccuaaauguacuuacuauguucauuuaggaugaagguaagucauguggccuucccauuuuuuuguuuccuucaucuugguuggagaaacucaccuuucuaagucaucggauaaagcaugguucucuugcuucuguucccucaaaucugaggaggagggacccugcuauagaccucaucacagacccugucauggacccuguuguagauucucucauggauuuugggggcaaacauuauuauuuuuuuuuuuguaguuuuagaggauaaauccagagccaacaccaaauuacaccccagcccuaaagaagaaacuuugugaguucaggcaggccggccugagcucugacgaugcagacauggugaauccuucggcuaguaacugugucaguagcaaccgucaugucaguaccuguuugugcucuucauacuccagcuuacucaacagcaacgccuucucaaggucagcuucaaacauuucagaggucagcuaaaaaaaaauguuuuacaauaaccauacauuuauagcauacacuuaaaauaaccaugauauaugauaauacagacagcaaaagaaaaugaauguacuuuaaaugaacacuugucaguuuuccuaaguuauuuaaccaugcuacccuagggaccuuguacuguauaaaggcauaaacuccauuuugaaauuucuguuuccucauucauuguuaguuugagcacauauccgugucuacauaugcuauagacaucucauauuuuucucuccaaaauccuuuauuacugugaauaaaauauucugauaucugugauucaacaggacagcuaagcaccccaaccauucuaacacgaugccauaugaacagccaggcugagugaccagcagugacaggcagggagcguggugagccaggucuuuuccagucuucuaggcacugucuucagauaggaagguacccacccgacagucaccccacaugugcugucugcuagccucgccuuggagugucccagaacuugcuaguuuccaucuuuccuacggccuaagucuucagguuuuaauuacuccucaauacauuuuugcccaaguuauuaagaauuguuaugcuguuuaauguuuuaaaauauucagacuaagauagaaaccaaugugaaagggaauggguaaaggcuaucuuaaaacuuagaaaacuguuaacaucaaacucuacaaauuaaacuuucuaaguggagcgaccccuuuaaaaagcaucucacuuaauccuuugccaagacuagaaacaguagaacaaguuagcuuuacacagaaaagcaagaacugaaauucaaugagaauuaaacugguaaaggaaacugcgugcaacaacaaucuaaggaagcccacaauaaacuacaauccauacaauaagccuaggggacugagaaguauuaacuacuagcaggaaaggcacuuuacaauuuaauccuaggagccugggagguggcucaguggugaugagcccuggcugcucuugcagaaaacccauuaccagcacacacaugauggcucauuccaguuccagaggauaaaauacccucuucuggcuucaguaagcacagguacacaugugauacacuauguacauacaggcuaaauccccauacauacuuuaaccccccaagucauuauauggauaauaaaaaauaauaaacuaaaauuaaaauuuauguauauuugccacauuaaaaaaagaaaguauaaaucaauuucucccagcacuugggaggcagaggcauuggauuucugaguucaaggccagccuggucuacagagugaauuccaggacagcaagggcuauacagagaaacccugucuugaaaaaccaaaccaaacaaaaaaaucaaugucuauaucuaaacuaaguacaaaauauuuguucauaaguuaaaauaugaugauggucuuuaaaaaaguaacaaaucuaaguuuauucugaacaaagcugguuaauuugcuacuguaauccuauuuuuaacauuuaauugugggaagaaacguggugauuauuucuuauguagcauacauacauuuggcugaaguuucaaugagucagagagcaugucagauuaggaagucuugcaauauacuaugaucuuucaguaacucacagaauuaaaauuguuaaggcagaucauucugauaaaacaauaaaaaauaaaguguguguguguuuucuuuucuuguuuuuuuuuuuuuuuuuuuuuuuuuuuuuuuaagagagaaggucuuacuauauauccuuagcuguccuggaacucaguacauagacuacguaggucaaaaauucauagauccacuaggccuagaaaugaaauuugaaguagaaaaaauaaaaaaccaaccaaccaaccaaacaccaguggcuuucccuggaaucugugucuaacuguaauaguuuaaaguguggcuaccuuaccugccugccugcuugcacugugugcugacaauuggccuaaaucauaauaagcaagcaaagauaaaguauaugauagcaucaagcaaaacuccaaccuaucccuuaaguuugcuuuuucuuauuaacauaaacuaguauacaaguaagaaaaaaugagugaaacuuaaaauuucaaaccaaaaaagaaccuuaauuaugauauacuaaguauucucugaaacuaaauuuuauguugcuauuuaaaggacagaaauagggcuggagagagagcucagaggcugagagcacugacuguucuccugaacuaugugaucugucuucuuuuccgagccaccugaucacugugacagcaaauauggagaaggaaaggugcuggaggcuguguucaaggucacacacugcuuuuguguaaaucugagucauuuuccuacaucaguuucccuuuagcuauugagagaaauucucucugaugacgacaauggugacuccuguuacugccuaccagcgugucacuauggggaaaugucagcagcauggcuccucuguaaugacugguacucacaauacugagucucagacagugugcgggccuaaagagaacauauugaacacaguuuauaugaggaguguauucacucuucucacuugcugucugccucugggaguuuucauugcuuuagagacaggcucuugcccuguuucccaggcugggcuggaacucaggagccucuugccucaguucccuaagugguuagauguuuggauuacauaugugcaccaccacacccagcucugucuaguucuuuuaaaaugcuaacacaagaaugauaggaaaauccacuaaaggacaaaauaucugucugaaaauaaugccuauuuccuauggaucaaauuauaguuuacuaaauaugcaaauaaacaauguucauuuccuaugaauguacaugcacacacacacaugcauucucacacacauucugugucuuccuccucucauguguacucucuuaaugaccacuuaagagauauagaauaagaugcauguaauaggucaacagaagcaacaugccaucagcagguucacacaguuacaaaggaagugucaccccaaagucucgguuuaaucaccacuguuacuaaauauuuuuaacaggagauuuguaacccuauaaaucugaguuuuaaaaaaugugaacaagccgggcgugguggcgcacucgggaggcagaggcaggcggauuucugaguucgaggcuagccuggucuacaaagugaguuccaggacagccagggcuauacauagaaacccugucucgaaaaacaaaacaaaacaaaacaaaaaauguaaacaaguguuuuauaaccacucucuccagcccuuugaaaguugaaauaaguuauuucucuacguuccuagcaugcuuuccuuuacaaacaguagaugaacugaaaacaaacaaaccaacccgagccagggcuguaggucaagagcagagcaugugccuagcgccaaaggccccaggucugacucccaaaacccacagagaaaaccugcaacugcuuugcucugagcaaucuaacauccuuaauacacacacgggccacagguuucaucaaggcugcgcauaggaaccacccagcacuguugcgcaagcacucaagugugcugccaucucaacccuccgucagguugagaaccagcacgggagccuuguguccuccgcaguaccuguucaucuuucugucuccacucuugccaguuuucuucccgugacuccuucugugcuggguuuggcgaugaaagcucauguugaacauugcaaauggaaugggaggauuucuggggaauuuucuugaaagcaagauuccugagcuaagaaauaagcacaaaauauauuaaauucaguguaucaguacuaguaguuuuaauuuuaaaauauuuuuagucuaaauacuccuuauauuaacauacacaacugaaaguuacuuguggauuuuauuuaucuuuacuuuaaaauuuauuauauauuuuuuuuaaucacacaaagucucacuauccuguccaggguuguucaagcaacccugucaucuuagucuccugagaagcuggggccacaggcaugggcucuccucuuuaagacuucucuuucuuaauuuuauagcaugaacacacaagcugcuccagucaggaaauccaucugugaguguuggcugcaugugaguucagguagguguauguucaccaggaagcuguguccugugacaggcacagugccugcacaguagaggugaugcaagcgcucucagccccgggacacaaaaccacauggcuaccucugucaugcgcucucagccccgggacacagaaccacauggcuaccucugucaugagcucucagccccaggacacagaacgggcauggcuaccucugucaugcacucucagccccgggacacagaaccgcauggcuaccucguuugcuucacucugcugcuguuccuucuuuuuucuucucuucucccguuucuucucauuugagguugcuuuguuucccagaguuugagacuucccauuacuccggccuuugccuuucccaggcucggaaucagagccacugccgcuguccacuuguagcagggcaaagcgagaggcaguugugagcacagagcugaggacugcagaggccauggcucagaacugggggcuuaaacgcuugcucaauaguaacuccuaaggggugggggguuggaggacagaggaggaggaagaagagggagaggaagaggaggagaaaacacauugaagaaaauuauucuauuuucuccaauagcuaaacauauaaaauacaucaggagugacaucagauuugguaguauuuggauuuguacccacaaucccauuggcauuaacauuuuuaaaacuaaacuaaacaaaauaaaguuauucaaaagaauauguagguuuuauuuauuucacagguaacaauucaggacuauaaucaauacacaaugcucauuuccacaucugguuuuaaaaguccuuaacuuuucuugaaacacuucugagguguauacacacucaugggacagaugcuacaucacaaugcccagcccugagaggagggccagcauccguaaucauacacaaaggccguucuugcagcugcacgaucaccuccaacuucaagaaaacaagacaagaacagaaaagaacacucuaacaucaaaaugcugaauuugauuauaaagacugaugcuuacaacuuaaaaaaaaaaaaaagaaaagaaaagaaaaaagaaaggacuuaaauuuccucaaccaggaaauucaugcccguuacugucaaagcuguccgucaaaagccuaaggcugacucggucacuggccccagcagguauagacuacugguguuuuauugaaaaggcaagccaaccacuggaucaauguugcucuuagccuuggugagacucucaguagucaguauguguaaacuguauacgguagcagcauaagcucuuaagugucgggagucacugguauuauuugacugcaaugccuugugugaguuaaauguucauaaauauucuaaaauaacucuugaagaggacuuaggauguggcacaauuauuuaaaaugugacuaagugagccuggcgugguggcucacgccuuuaaucccagcacucgggaggcagaggcaggcaaauuucugaguucgaggccaguguggucuacaaagugaguuccaggacagccagggcuaugcagagaaacccugucucaaaaaaaaaaaaaaaaaaaaaaaaaaaugugacuaagcacaaugacuccacuguaaaauacguucugaaauucacaccaacauuugccccaucuagaaaugaaagaaaaaagcuugcaggcaggcaggaggaacugagucagcaaaauccaucagggggccugaggagcccagaggccuaggcucccccagacccacaacuacagcagggacugacugacacacuggacacagagaaguuuucccacaaugagugaaauuacaaaaggcaaaccacaaggaaacagaauaaaucuuucaacugagaaaagaacucaauaaucauucauaagacaaaguacacuggcuacgaagguuacacccccucagcagcucaaaaugcuaaacuauuaaaaauguuucaaagggagaacaaaggaguacaaggaguacaggggaguucauaagcaacgaugacuccuuuuucucaggguuuacaugugugugugugugugugugugcgcgcgcgcgggggggggggggccagggccaggauaguacaauauaauaaauuacugucagcauguuaaauauuuaacauaguaaauauaucaacgacaaaacauuauucuacucauucuuccaaagcuaaaauaacagggguucacgcguccguguuccuuuuuaagaccaggauucaugccaggugguggugauggugaacaucuuuaaucuucguccuuggaggcaaaggcgguugaaucucugugaguuugaggccugccuggccugcagagugaguuccaggacagccaaagcuacacagagaaacccugucucugcucaggucuuguuucaauacagacacagcauuguaaugcuuauaccaagaauugaaagagaugcagaucaacccaaggaggauggaggauucaaagccauaaggaaggggucuggagagagaucauggaaacauacccgaagcccaaaaagccacaucaguaauaauaugcauguaucaugggaugggguugggagguagccagauuagcauaaaaguaaaaacugaucauuugacugcucagcuacugaaaacuaguuuuaaaucaauauuguuacucugugugguuacuggggacuggcauaaagcaaagaaauacagcugcuggauuaauuuacugcuacauuucuauuaaaguuaguucauuuacagaugguggccaaccgaaaggcauguuaucccuacucuuaaaauucauauucaggucuuaaagcaaaaaguucuggagggaaaguacaaacuaacaaggacagguuagcaagggcaaguucucugagacguuccccaaaggacuggcugagccugccaccuggcaggggucagggaucugguaaugaacuugggccugagaaagcagagggaguaggaucgaucuuaggccggagccaugaugcccagaaaacuucaagguaccugccuguggccauggagggaggagucaaacacuccugggacagcagaggaaaccggggcuacacacagaggccuggccuacauaggauagccugggcauaaagccucgggaaaccggcugagcugcucucucagaagcuaaagucuaccuaagggggcagagccagcuuagaccugaccauaggggcuccuccuggucagauacugccgaccuaagaggccaguacuuuucaucuuacaaccucccagagcgugugaggaacugggaucagguaaggcauuucaaguuacagguggaagguggaagcaugccucuucccugggagcugcugauagcauggaagcagaagccaagcucagacaaagaacagaccucccggucagauaaaaaugguuuaaagauuauaguuuugugcuaaaaacagaaggaaacaaauauaaaacaucacaguuagauaugcauacacugaaauugaugauuuuaaagaaauaaaacacugaguuggaaaacacaauaaagaccuuuugggcacucuaaaauccuauucaagggagauggaagguauggaggaaauuaagacaugguccuuuaaaguuacugcacuacugaguuucauucuuaucuuuuuuuuguuuuguuuuguuuuuuugagacaguguuucuuuguguagcucuggcuguccuggaacucacucuguagaccaggcuggccucgaacucagaaaucuaccugucucugccucccgagugcugggauuaaaggcaugcaccaccacgccuggcucauucuucucuuaauaagcauguugcuaugccuuuuuaacgcacggccuuaauaaaaaaaucaggaggcuuagaagacucuuugcuaaaguuaagaaaucagaauaaagaaaauauuaaaauguuagagguacaaaauaaaaaaucaaauaugaaaacaaaaaauagaauaacagauacaaagguuuuuuuuuuuuuuaaagauuuauuuauuuauuuauauguaaguacacuguagcuauccucagauaccccagaagagggcaucagauuucguuacggaugguugugaaccaccaugugguugcugggauuugaacucgggaccuucagaagagcagucggcacucuuaaccacugagccaucucaccagccccagauacaaaguuuuaucgaccaguuuaaagaaaagacuaagauaauagacacaagaaaaaaaaaaaugaaacccagauacaggccuuaaaagaaaaauuaauguaauuaaagaugaggaaaauacuaagauaauagagauaaaagaaaaggaaaaaauaugaaaaagccaaaacaaacccaaaacagauacaggucuuacaggcuuuagaggaggaauuagaaaagauugcaagccaagcagugguggugcaugccuuuaaucccagcacucgggaggcagagacagguagauuucugaguucgaggccagccuggucuacagagugaguuccaggacagccagggcuacacagaaaaauccugucucaaaaaacaaaaacaaaaaaaauaaauaaauaaaauugagaaauauagaguaagguuaaagccuguguaccaccaucugaugaagaucagggaggacgaccaacgguguuagaaaaccaaccuuagcuuaucccguugcuauacaacaaaugacagcagacaauguccacucacagaaagaauucagauggcauccaacagaaagacagaauuguaaaaauuauaagggugcaacuuuaauaggaaaaaauagucccuacaggcuuuaagaaaagccacauugucacauguuuuaacuguggcaaacaagaucauuugaaaagagacuauagacaaggcacuucuagaaauuaugcuuuuuuuuuuccccuagaaaaaagucaaaaaagaaggcuccaaccuacugaacuauguagauguggcaaaggccagcccuggacacgcaaauguagacggacaaaagacaacaugguaaccccuggucaaaaaauaccccaagcggccccaacaucaaguucaaaucagucaucucacaucaacaguggagaaacucaucugcagaacaaugaacacugcucuggauauaaacauuaauaacccagauaucgaaaccaaagcagcuucaauagaugacacagaaaacccaagagaaaucgaaggcuugauggauacagggacaaauguaagaaagggaugcuuaauaaacaaaaagggauuaaaaaaaucucccagagacagauaaaaaauguuuugcugggggagagaauaugcucuuguuuccauaggaaaagaaaaacuauggauuccuuccagacugauuugauagaggaagacccccuaaagaucuuggcugcagaugggaagaaagagaugaagagcaaacaggacagguagcacaauuuguugaucccucugcauggcuguaacccugaaaaugacugagacauaaaagcaucucuagacagaacuucagcuauacauagccaauggaucuuguuggcuacagaguccucaaaauucaucaugccauccuuucauauggcaugaaugaaauuuauauuacaguuugguuauaugaucaaauuaacuuguaaaggaagaaaguuggcuuucaccuacucaaacaaggaacaaaaaaaucaccuuuaacugaucugugcacauugcauauuccauacauuauguuaauauagaaauauauauuaccucuaaaagcuuuacguuugcagagggggaaaaaaaagcaaccaagacuaacccugacaggauuaggauucacccucggggauguuaagaugcugagacuguuguccuaacccugccucaacugcaucaaaacuguuuccgcuaaagacuugcuucgaggacaacccacaacagcuagcuccucaguccagccuuuccgacuguugcagguggagcuucagugaagccugcauuuucucagcaaagacuggacaacaaaugcuagcuuucuuaagacuaacaauuuuuucuaaauuucccugaaaaggauucuuugccccaauucagcagaaagaaauaauaagagacuguuguuccauuccuuuaaauugggguggaugguuuuggcuauuugaugguaauauacacauugucauguuaggaaaugauuuacaaguauuuauggucuuagagaggaagggaaacagggagcugagucagacucagggguuucuaccuuucuucuucucuauccuuucuuagauaaaagguaggaggcugaaaagaaaagggggauauagaaauauuauaagauguuagaugaauggggugggcuauugaaucuacucauaaaccaaaaccugugauagccaucaugcaacucaauggucauauuagauacuaguuacguuacaauaaaauguuuucaagguuauucagauaguaaauagcuaagaauaagcaauguuugacaauucagauauauuauaauugguuuucaaaaccuuaagagaucaacauaaaauggcauuuaaaauuauuuuauuacuaaaagaucuuuugacuaugagacaggucugcuccugacaguacccccauuucacuucaaagaagaugagcaucuuaaccugauguggaauugcuucaauggaggcaagcuaacuacugggcgaagaaaauguccauguuucaccuacagacaaaucuguucagaaaggacaaauggaugcaaggaagcagacugccaggcucugcaaagacagggggagcaaguccuucacaacuccugacaagaagucugucagcuauagugagccacagaugacaugggggaucuguccaggcaggcugcugucggccauuucuuuuaucuuuggaagcugcaucccagcauugccugcacacucggguaacauucauuccuucucaggucucugauggggcugaaggcuagauagucacagccuuacuauaugcauaaauuguuuaggauuuaagaugauguuccaggucuacaagauguuuuuaggaugguaguacaaguuaagauagaaagugauuuagauauagaacuugaacucaccagacaggaugguagaauacuuuaucuaaguugccaaaaauaaauggacuggauauuaugaauguaacucuuaucgaauaguuuucauaauucuuccuaaugcaugcuguuuauuauuauuuaaaaagccuuuuauucgacaaaaaggggaauguaggcaucguguuuuuguacacugugcaguuuacccugcguuauuuaaaugaaaugcugauuucucugcccucaugucuuguuucaaucaagacacagcauugcaauacuuauuccaagaauuccugucuaaaguuuguguaaacagcuuuuaccauugucaauaaauacugaccacccaauggcuggacagaguagacaacaggguaggaaguacaucaaccagaggaaggagaggggauaaagagaugcagaucagcccaaggaggauggaggauucaaagccauaaggaaggggucuggagagagaucauggaaacauacccgaagcccaaaaagccacaucaguaauauuaugcauguaucaugggaugggguugggagguagccagauuagcauaaaaguaaaaacugaucauuugacugcucagcuacugaaaacuaguuuuaaaucaauauuguuacucugugugguuauuggggacuggaauaaagcaaagaaauacagcugcuggauuaauuuauggcuauauuuuuauuaaaaaaguaauucacuuacauucuacagugauuucucccacuuucccuguucugcgagaaaacagacugcucaguguucacuuguuccuggagucuggaaugucugucuccuccacuuaaaacuucuccguucuucaaauuuagccccauugcaauucugaucugccuucucguuaauguuccugcacuuacacuuaauucuguucuucauggacucuuucaacagcuaccacuguaucuagcucccuacuguccugauuuacaaaaugcugaacaacacaggucucuucuuuguauucccaaauauauauauauauaucaaucaaggacuuggcacagauaucagccaguuguaaugggcacaucugcagucucaguacuggaagggauaaggcaggaaggucauagguucaaggcuaaacugggcuacacaguaaaaaacagucucagcaaaaaaaaaaaaaaaaaaagaagaagaaacauuaauuaacauuauuaacauuaaauaaguuaaucaugaccucaagcuuacugacugaggcuuaauuacauucuccaaucacacagugccauaccuaagugugcacuggaaucugugcucugaacuugaacacugaggguggagagcacacaccaucuaacuaacagcaccgucacaacgaaguguuuccacaacucaucuuuuucccccuaggaaucuuguuuuuguaggaagcuuuggauuuugugucaaacugcugauuuuuaaaaggugagggugugagauaaacuguugcuacuaaggaacaggccaagcuacgccuagcaagauuuauaaaugaaugaccuguuuucuugaggccuuggucucuaugaagggccacugccaucaugagcaccuucuucuaugacaucagugucgggaaagaauugagccugggggaacuuaaguacauaauuucagcccuuuaaaaaaugaacaguagugacugugucgaucaacacuaucaaccaccuagcuugauccaaaacggaacuaugcaaugucaaugucaucaguuaauauggccauaugcuuugagagggcagcucucucaccauguagccugcacuggaaccaaacucucaauccuccugucccaggcuccugagucuugggaauacagguguacaccaguucgugcagcuagagaggccuugguggacucuaacagaucaaacacaacagacugaggacuugcgacuccaagaggcccuggguuugaugccaagcacugucccuacgaauuacaaaaugagaggaaaaggaauggccuggucucccucaucuucuuggcugcuugacugucauuuugacuucuuagaacuuaagguuacagggaucgaggaccaacgguccugaaacuuuugcuuccaacacacuuaucgaaaaugacauaaacuuaaaggcauacccggagcuccaccacccccccccaccccccccccccccgcaacacacacacugguuaggugcagccuuccuuuucuaauccgaagcucucaacuucuguggguugugaacucuuagaaacaaaaacaaaaagcaaacugcagacauguacuaaggaauucagucaugaagugcaaaggugauuuucacuugcacacaacgucccucugauccacguguagguucucgcucuagagugauugcuagaagccccuaggguuaauauuaaacagguguauuucgaucuuuagugaaaaaucacauuaaagaggcuuagacuaaccgauuuuaguggcauaagcuaguguagggaaaccccaggcuuucuaggaagauucucaauacagcauuaccaucuuucggcaguuucuccaguauuucuggagcuacagcuuaacuucauucccgugacaggcgggcgcaagcgccuucacauaaacagacgaggcugaagaacaaugcuuguguuuuuccagcgccucugccucucgcuagaacucuccaccgacaucccuugagaaaugucgccaguggagggagcggggcagacaaugggauaaacuuuugccccgacugcuccgcguuuacagacaccccgaggcuggcacccuaccgcugccaccgccgccgccgcgcauagcugcuggaagccccgacagcaggggcuugugcgagagccugcgcaucuaccucgggcugcugggagggagggagggaaggcgagcggcgagcagccccucucuccuccuucgggaaccgaagccaaaucucacgcacgagcaguuccgggugcuccaaaacuuguucgcgaaguacccggagaaagagcgcggcgggcugggcgagccccagccgcugccgagacgcgguguccaagccugcaagcgacaccggcgucgggugggcgccccggggagccccgaacgggcggccgcaccugcugucacucccgcggccggccgcggcggaccaggccugcggcccgcacucccccgcagccuccgcggcccucccgccgcccggccccgcucggcucagccccgcucggcuccgcuccgcuccgcuccccgccucaggccgcacucggccgcguccccucagccacgagcugcgaggcuccguagacucaccgggccucccucgccgcggugcggccgcucccgucuccccgccgcucccgcgcuacccccgggcguugggcgcgggccgcggggcguccgcaguaacgggcccgcggagggcggcggcgcgcggagggcggggcggggcggggcggggcggacccgcaagccuggcgcccgccguggccggccggcgcgcgggacuucuuugccgagggucgcagcgcggcggacgcugacgccgaggagagguccgcgggggacggacugcggaggaccagaaccaccugcuggaggagccgcgcuacgggggccgcgcaggguccaaacggcucgcguaggcggcggcuccgcgguccucggggucgcggagccgggaaggugggaggccuuccgggaggaggcuuaggccgccgcgggcggcgcgcggcgggaucgccaggcuguggggaggcccgggggcggaggcggaccuccagucggcgagggagggcggugcugcacgagaugcaaacagccggacggccuuggguucccgcgggagcaccuccggggccgcuuuaguuuugcaaaguuaagcggcuuaccggcaaacccguccgcuaccgcccagccgugcgggcugcccggcgaugucccgcgcgagucaccgccgcggguguagacgugggggacacaguggggagcgaagcaaagaaucgcagaagacgccagaucacccuagggcccgguggaaaaagagaauguuacucgggauccgaggacugcgagcaucuuuggggcagcgcgagggaggaggcuuuuggauuuggccugggaagaggugggguuuugcggggagaccucggggccuuggauggaggccauuggacgcugcguuccacaaugagauuggagguguugacaaguggcagagacgacugaaaaaugagggaggggggcggcgguggugagggauggcugaguuccaagaguaaggauugauguuuaaggcaauauuugauguuuuaggauuuagaaguuugaaggaagaaaugaaggcuuuuuuugcuuuguaacuccugcagauguuagagauugaaaacuggcaguccuguguagaccaggcagacgguaauaacagaugagcuaugggggggcggggggggcggugaggacacacggcuaugagcccccaacacuuggcaagcugaucagaaagugaguccaaggccgguggcuacacagaaagauugauccgggggucggggccaagaggauggggcaagacaagauaaaggaaggcaggaagaauuuuaaaugauugagaagugauguggaggugcauucuacaggauuugaacaucugauugggaagggagaaaugaggucuugagacccgguugcuuguaagagggagcgugaacacuuggaagaggaggaugcagcuacuuaccgguuuucauaggacugggguugaaggcagcuaaauagguggccauaagcaguugaagcaguucuaaaacagcugaaagaacugcaccuggacaguacacugggugcuggggaauaguucagucgauagcuugaguucuagccccagaauaaauguaaaagcucccagcgugguauaucaagcucuggucccaaagauuag

SEQ ID NO: 7074 - RNA, 6050 nt, Mus musculus
gcugaccuuugggcuccuugaauacaguuggguaauuacccacgggacucuucaucaagaucagauucuaguuaaaccuggaaccgccucagcaagaguacaagauggagggacuuuugcacugucuugcugugacacaccuugaccgucagaacgacuggcguuugugucugguucagacaguucccuugauuuagucugacagacaaacacaggcauacauuucaaucuaggccauugcuuggugguggggaaccuccuccuggaaucauuucccuuuccuugcaaaccugggaucaccaucacuccuguuggaugcaagggcgucagaugcaagguuuaacuguacuguucccucaugcagucaauguuccagugacuccuaaaccuucauucggccucugaaguguggggugugcugagcggcccuccgaggcaccuagccucgggguggcgccgggcagcaaccagaguccccacgccccgcgcgaucccaagccuuccucaaagacgggagugcgacggggacgcgacaagaaacacgacggccgaacacaaggagucccagaggccggccggaagcuucccgcagggcaacuuccggaccucagacccggaagugggcgcaagugcuuggcccuggcggaggccgaggcuccggguucgaaacagcauggggccaccgcuuucgccgcgcgagucggcgagguucguggccgagaacagucgcgacgugcucguggaccacgagggcgugcgcagggcggccgagcugcugcugcccgcggccgcggcguggcgcguggagcaguggaagucccugcacgagcucaacccgcgcggggcggacgaggcugcgcucggcuggguguuccugguggacucgcucaacuucuccuucugggccgagcgggaggacagcaagugugcggugcgcuacggcgggacgcccuacacuggcuacugggcccugugcgccgccgucaaccgcgcgcucgaccaaggugggugccagccuuaaaccugggugggugcugcgaggcgcgggaggugaccucugcccaaagcagaaguccggacauacagaagcaauguaugccaaucagcacaggaggcaaagccgguuuucuuaaaaaaaaaaaaaaaaaaaaaaaaaucauuaaaaaaaaaaaaaagauuuauuugccgggcggugguggcgcacgccuuuaaucccagcacucuggaagcagaggcaggcagaguaguccuguucaguguagaauucagacuacacuagccucgaacccacagggaucccauccagcugauuaggccagcgccacaacacucugccuucuuuaacaugaauuugauuucauauuuuuugcuaauugcaaaaaauuaaauaaaaaaucuguggauuguucucuuuaaagggauaccgauaaccagcgccuccuacuacgccacagugagccucgagcaggugcgggauauauuucguucagacacagcugugcccaugccuuuaauggaagagagacaucggauucucaaugaaacugggaaaauccuacuggagaaguuuggaggcucuuuucuuaacuguguccaaaaaaguggcagaagugcgcagaaguuaaugcagcugauuguugagaacuucccuucuuacagggacgaggcagaguuugaggugaguuuguugcugagggagggguuuagcagguaugaucauucugaguuaaugcuuuuccuuccaaagccagguuuaaggccagcaacuuaaaauuugaaguuuguucacuguggacaagaagcaauaacaaaaugugcuuaaaaucuaucccuuuuuauuuuuucuaaucggagauuuccuuuauuuuugccuuuuauucuguuaaauguuucagccauccauauaaggcuugucacucaaagauggggaagcacaaaaaguugauaaaguuggaugaaaaucagaauguaaaauguauacuaguuuucucuaggaaaaaaguauuucuugaaaagcuugggcugguucugguggcgcaggccaguaggauuugcugaaagaggcaggaggaucuggaguucgaggcuagccuaggacacacaucuuuagccgggcgugguggcagaugccuuuaaucccagcacucucgaggcagaagcaggcagauuucugaguucaagggcagccuggucugcaaagugaguuccaggacagccagagcuauacagagaaacccugucucaaaaaaaaaaacaaacaaacaaaaaaagaagaaaagcuugguauguguuuucuuucuuauauacuguuuuuuuauaaugauuuguuuuaugguacaaaaaauuuuaauguauguacuuuuuaaacagugagcuugguuuugauuuauuuauuuuaugugugugagcugugagcucucaucuuccuguacuguaccuuuggccgugcuugcuguguguugccacucccuuccccuggaacuguaaacccagguaaacucuuccuuuucuaaguugcuccuguucaugauguuuuaucacagcacacacaaaaacagagcaacacucccccacccagguucauuucuuuuucagauauguuuauuuuuuguaugaauguuugauugucuguguauaugugugcuaugugcaugccuagaacccaaggaguucagaagaggguauuggauacccaggaacaggagguaggaaugauuuccccaaauuccuuaguaguggguuuauguuaugugcacugagguuuaacuugcaugugugagugugaggguaucacaucaccugggacugagugccagauacuugugaggugccaugugggggcugggaauugaacuuggguccccugaaagagcagccagugcucuuaaguagauuuagaaaagguaauuuugaggcuggagagauggcucagaggguaagagcacuggacugcuuuacugaagauccugaguucaaaucccagcaaccacaugguggcucacaaccaccuguaaugagaccugauguccucuucuggugugucugaagacagcuacaguguacuuaguuauaauaauaaauaaaucuauaaagagagaaaaaaauaaaagguaauuuccuagaaguaggucuggauugaugguaauggguuuuuuauaugauaucauuuucugggagcuuaaaauguacuuaaaccacaguaacguguuuucucuaaucaccaggggaaaaggaucgccuuuuacaaacgagcacagauccucguggcggacacguggagugugcuggagggcaagggagauggcugcuucgaggacaucuccagcaucaccauguuugcugacuacaggcugccucagauucucguguaccuuggagcccugaaguacucagaugagcuacuaaagaagcuccucaaagguuugcagccucauguccccguuugcugccguguucuguggguuguuuggguugaucuacagacagcucucuucugcuuagaaagcagagcacaagcauggggggaaugugugcugggugcagugguagcuuccagcuuugaggagacgaagcaggaggguggugaguucgagagcagcuuggacuagagggagaucuuguuaaauuuagggcuagugcagguuuauucgaggaauuaggaaaugcagacguaguaaaugcagagugcaguacuacgcccugugaguacugacacaggcaagccagacagccuccguugcugaauuuaacuuguaauuguaugugaguggcuagguuucuaaaugauuuuuuuuuucuuucccucguaauucucacaggagagaugcucuugaauggagauaaacaggaaguggaaauuagagguugcuccauuuggugugucgagcugauccgggaccgucuucuggagcuucuugaaaagggugaaaacucuccuguugagaucaacucuguucuucuggacuaucaccugugggacuaugcccgagagcacagggaagacaugaagggagucccuuuucaucgcacacgcugcaucuacuacugacccugagcauaguggcuccaguugaaacccuugcaacuuuagauccuacagucacuucacaguuucugauuugcuauaaagauaaaaauuacgcugccugaugguggugcacgccuuuagucccagcacucgggaggcagaggcugguggaccucugugaguucagggagagccuggucuacagagugagggcagccagggcuacacagaggggaaaaggaaaaagauagguagaagauagaaauuacaggaaugggcaauugucuguccaguugccauucauuuuuuccccuuggcauagaaaugugcguuccuauaaucauacugcguauccuucagcgaucauguccaugucuucaguugguaguuuuucuccacugguaaucuuaguugcucucuuccuucuuuuccuuuuuuuuuuuagugguccugaggauuaagccuaugaccuuguguauguuaggcaagugcucuaccacugggucacacucccagcucagugauuuucuauaugcuacaauaauuuaauaugaaauagagguaguccuugauguauggacgguugccaacugugaacacuuggcaugguggcgcauaccacgugccuauggaggcuauguaaucuggguacucagaagauggaagcuggacagucaugaguucuaggccguccugacgacucggaaagcagaaauaacgagaccuucaccaguacagagcauuugcugcucucugguggagggcaugaguuugguucccagcacgcacguucacugucgcuaccgucuccaaccagcagaaaagaagcgaugaaaccgauguccuucucaaggcaguuuauucaggaacuuaacaaugugcaggaaaaagaaugcuccgaccucucucggccaucccccuuuauccccucuuguccacuccccaucaccccaguccauguaggcacaguucauuggcucaggacuacauucgucacaucauccaaucuuaugucauggugcaucugugcaaugcaccucaagguacguggcuaucuugagggauaugaggaagucaggugccagucauaagacuuggcagcagucccaggugccaucuuggggccacggccacaccugcuccuuacaucucccccuuauucuuuaaauuggcagagagaaugccugucuuagguugcccccugcaacaaugcuccuuacccaucacugggagacagacagcaguggucugaucccugucuuagguugguaacauguccagggagucuuaccugucauugacuacuucucuagcaugccaagccacacuugaggagauugucacaucuccacagcugcaaaggcuuguaucaacagagcuugagcccugcaauggcgauguugcaugcggcagaugcaccaaaagaccaggacacugaugagcacguagcacagugccaauuuacaauacuggcccauuccuuuaggugugacauagcaguggcaauccaauuugcaaguccuucagccauggauacauccaccaaaguggaauuaauauggacuaucccaaaaucucuuuugggucuaaacaaggucauaaccgaaggggucugcacaggccaugguaacaaucuagguguucugguuacaauagcuaaagaaaacauagaagcauuccaaccaacagauacuauaaaaacagcuauccuccuuauauucuacaacaucaucaaaauaacuaccauuauaaacuaaaaauacaaaaagaggccaaaugcauacaggcguggcuuuaaagaauacauucuucccauaagcaaauugaauaacagaagacucaaauaauacagauucaucccaauaaaagcuagcauuuccccacgcccugccccccccaucaacauacucaaaggagaaagaucuguacaacucccaauuuaucccacacaacagccaaacauuaaagagauugcuugccccucucugggcuagauuuugauacguccaauuaaacccugaaa

SEQ ID NO: 7075 - RNA, 12214 nt, Mus musculus
acaaaaccccauaauuuaagauuacuguauuuccuuacaagaggaacacuucaacaaacuuuacauguauuaaucaaccccuuuucaaauugggcacacgucauaacuaacaucauggaaguuuuauuuagauguggauuuugaacuaucaauacagaugccaaguuacuacacaaaacauccacaggaacuuuuuccauuuuuuucgaaucguucacaaacauuuccuacauaauucaacacacaacagagaaaugguacaucuuuuuucuuucauugugcauacaauggaaaaacaaguauauauauauauuuuuacaaaguucaacuaacaagacacuagcagguugacagcuuuaagucuauaggugagaaauuaucuaacaaaaauaaccaggauuuauucagcaucagccacuuccauaaccaaguuuacucugguuaauaaagcucauugcccaucaggcuucuggcauauacuuaagaugcguaacucuuguaguauugcuccccaccgcaguucuccacaacuaacagaaaacuguugaaaaguaguggcaaacauuugcaaaaacaaacaaaaucccaagcuuauuauaagcaugaauaugugauggaaauuuaucaagccaagucuuuccaaccauuaagaagucacccaaacugaguuugccaauguauuuugucuauguccaagaggugcacuuauauccaacagaggagcugcugaaaaucaaacuuaguguuuaguuuaggggugggcuggaaaauucaaccaccauuugaaauugucuuaaaaaaaaaaaagaccaccaaaaauagauucacuaaauuuauuuuaaaaaucauaaaacguuucuuacaaaagagcauuacauucugcacacugcucugaacaaaugccagggacauguggacuauuacuuuccucccugucccaccccccaauguuacagugaccacaaaguaagguguucacaauaauuacauggggggaauuuuuuuuaaaaccaccaacaaugaacaaaaaauaaaagucacucacucugcugcuguuucaaaauuucaauguuaguuuuugcaugcccuccccccaacccuguuuguaaggaacuaaaacauuacaucuggugaacagcaaagauuucacuacaccucaaaugcagaacaccuaugaagcagaggaauguuggcuuuuuaaacagaagcagauaaaaaaaaaaagaugcaggacuccuucaguucuucacuagucuuagaaaaacuuuccagaauacugcuucacacuauaaaaaagaaaaaauaucuugcauuagaauccuucaacaucugcauacugcuucacacuauaaaagaaaagaaaaaaaaaguacgaauuagaauuuuuguucaaaacaucuuaaucaacauuaagacaauuucaaugauaaauuaaaaugauaaacauguccauuacaauuagaagaacuuuuaaagagcaauagcaacuauaaauuaaagcaauguaaaacucaagaaaauguuaauagacaguaguagugcaggguuaagaaaaugaaacuggaagcuguuaauacuugguaggaaagacaaaggaacaugaggaaggugugaaaugcugcguuugacagcaccaucauuaucuguccuguagagguggccugugccauauggcagacugugauuuguugucguuuuaguuaucuaaaaacaacaaaaucacuagucuuccacacagaacuaggccaacauccaaugucucuucuacauuuucuacaggcucuguauaaauuauuacaaguggugguuuuggcagcaguuuucaccagagaaaugagaaguuugcuugguuaaggcuucuuccagcaagauuaguauugaaugucuucauuuuaguaagaaaacagaagaaaauuaaggcagagcuauuaauuagaauauuuagaaguuagauuccccaagugacggaaacaccaugguuucuaaaagaagaaucaauugggaagaaaagcuuuuuaaagguuuuaguauguguacacuaacauaaagcuaagggucaacugaccuguucugcagcaaauacugugcguucuguaucugguccuguguuccuguaaugguaaugauccgaucuucagauccuucuaaagguucaucaauuuugauugaugcuccagauucaugacgaauuuguuuaauccgcugaccaccuuugccaauaauagauccagccaacugaaaagauuguaaguguuuaugaugacuugaaagaaauuuuacucccuuuuaucaaugacaaaauguaauaacuuuauaguaauuuauuuagaacgucagucuuaaauuccugaaauaaauuuuacauauguguauuuuaagaaccccaaacugucuucuuuuugucacuaaguaucauuugaucuaagguucaaaauacccccuccauuaaguucuuaaacauuaucucaauccuaaacuggaagucuuuguccaagaagcagcaaccaauacaaguaaguaaauuccccgaauuaaaaauacucuaaauuaaaaauacuuacaucuuugggaauaguuacuuguguagugauaauagguccgccaagaucaccauaugagccacggcccccugcauaagaauagucugauuuaaauaaugagcagcaaguucacauaaaaauaagauugaaauaauguuugauuucaaaaagaagaaacuuaccauauccagaaccacccuaaaaacaaaagaaaaaaaauuacuuaauauuucuaaaauaucacagagcuuagaaaagcaaaguccucccauaccacccauacccaguuuauccaggaaauaaacugaaucaagaaauuacagggguagggaggggagaccaauuauuauggacagucaagguaaauuaccaauauguacauuauuaacauuauugauacucaaccugugguucauaagccauuugccauucugaugggcuccaugugucaauugcagaaucccaaguuucaucagcacugaacccaaccuguauuacauacauaaauaccaaacuuuuagagggcugugaaaauaauuucaauuuuaaaaaagcucuuaguacuacagucucacacaaauguuugguuauaaggucucugaaaacacacaugccgcccuuauaaaucaaaauucuuaccaugccaucauagcggucuccaggccuuccucuucugucauaagccauuagaucucugcaagcacauguugcaauguuuacauggucacauuaaaaucacccccccacacacacacacugcuaagugcagccucuuuuauuaauguuaauguuuggauaaaaacuuaccccccucuggguggugguggaggaggaagaggcagauuccgggcucugcugccaccccggccaccucgaccaggugguggugguggagguccucgacgagggcucauaucaucauaaucucuucuagaaggaggcaugggacgcccaccccgaccaggaggcauucugucaaaaccaccucuuccccucauggggaaucccacaggucguccucggcggucaucaaacaucauuguaaaaccaccauaaucauaggucucaucauaaaaguugggaucauaagguugugcacguccuuugaugggagacuaaaaacagaaacacagcaccuuaaagccugaagaaaaauagcucugguccuaucaauuaacccaucucaaccauuauuaacucaaaagguaacagaggcagggacacaaugaagcaaugauggaaaggauuucuaacauacugaccggggggcggggagguggaugugggucagagacagaaggaucauuaccccagauaucucuguaagaaguggguaacauggcacuacagggaccuuugaguaaggaccaaaggcacuauauuaaaggaggcaauaaaaaacuugcagggagaugucaaaauuaauggugugaauacugucuuauuucugguaguuagaugaaacugaaugaaauaaaaauaucccaaagauaccucagauauaaggucaaggaugaucuugaugcauucuacaacccuaucagguuuuccuccaauaagaacaacucugucaguagagugagggcagcacuccuggaaaagcuugauuguugucugaguguucuauaacauuuacaaaagagaaaacccauuagaaguuguuagcacaucaaauaaaaucaaggcucccuaaguucagauauuugaacccaauuacucucaauacagaauguggucaacuacacaggaccuagaaauggugagaauuuaacaaaacuuagauuuguuacuuuaagacccaacuaaauagugaugagggaucugaggaaguaacccacaaaaccaacuccaugaaaaacuauugaauccagaaggaacaaaacagaacaaaauaaucucuuacuucucgaaguucuuugauuuuagcaccuuuaacaccaauuauuccuccugccagacucugaugaaucaacagucucaacucgcaaucaaagucacuuccuuuauaauguugguacuguagagggggaaauacacaauuuuacucucuugcaaguauuuucccagcacuguaucagcuuaugcuuaagcacaacauaaugcacuguugcaguaagcaaccugaauuauuaucucaauaacuuuaccaguuaugugcuuauuauccucaauagccaggcccaaaaaggacaaucugcaccaccuuaaaaaacuauuuuauuuucagguccugcaacaccauacccacacugcagccauuuagcaugucgcuguuaccacaaaauuauuaacauucaaauaacacuauaauaaaaaugacugcaaagcacuuugcaaauguaguuaauucccacugcagcauggagcagggucaacagugaguuguaagaccauccauauaucauauuuuuaagccuuuuucuauugagaugggaaaagcacacuauguuaaaaagaaaaucgauccuaugggccaggcuccauacuucagugggguucaauggcacuaugacauacauuuaagcauuccacagcaucagauucgagcgggagcuggcugguugcagugggugauggcaacugcaggcccugaaaguagaaaaauaagaauaauagguuaagugucuagcgugaucaggcuauugucgcauauauugguaaagcuacuacaacauauuuuaaaaucuauguuaacacaaaacagcuaguuuaacaguaaaauccuuucuccauauacccaguaaaugauuagacucuuaauguuaauaaagaaaauaagccuaacagcagaacucauaggcccagugcuuccuccuugucuauacaaacacuaugacaagcuccuguagcugcaacugccuaagauggaaguaaccuggaacugaacuauaaauaaacuuccuauuaaaaaaguuaagaccuuaaucuucccuaauuagaucuaaauuucccuuucuuccucaaacauaagaaaacucucuuauguaggauaaaguaguuccuaucuacuacucuaggaauggccagccuaaauuuuaaagacaaauauacauuauguugccacauauacauuauuuuucuccccucccccagccccccccauaaaacuuuaaacacugucccucaucuuuccaaaaguuuuaagaagaaaccuaccucuuccaagguagggaugauuuucuucagaauuucuccaaucgucucaauaucagcacugauacucaguaugcugccaaauaucaaauaccacagaauacaaaaaaaaguggaaaagaaaaaugaguuuugucaucaguaaucauauaaacuuuuagagaaguaacaucauaauuacuuaauaguccccauuuaagguagccuauuuaugaauuuuacacaugcauuuuauuuuuugcccaauacagacauaacauuauuaggagacuuugagagagacagagagaaugggcugcuggaagggcucagauuaaguggcaauaaucgaccagaauugaagcagaguugaauucucauguuccccgccaccaaguuaaggacacccucgcuguuaugguaauacuggcacaccuucucuuggguaauuugggggaauaugcaaguggugaacacuguaucuggaguaagguuaugaauaccaguuagaaauuagacuacuuaaugggcucugcaagaaaacaaauacaaaugcaagacaaaacaaagacaguacaaaugagaagugaaagaaagugaaccaguuagcguuucaucagaaaaaauuaugaacagacaauguugggaagcaaggugggccacaaagacagagcgagagacuauuuggguaacaguuugauuuacaaugcagcaaauaugcaacacuugaagcugugcuccuuccaucgaaauaaaauuaguggaucguuugggugggcaacucacgguaaaaguucagugacaaaaggacuuaauggggaaaauaagacagaaacuugaaaaacaauacaccgucuaaggggauacuauuuaauuauauaaaaggcagguaauaaaauacauuucucucuuucuaaucaggcagugaggcauaaacuguugggacauaccgcucggggccacugcugucugggacugaaacacuggcauuguacugcauuggucauuggcguucguggauguuggcauugggcaugggcauucaaucagaaguugucaaguauuguacccguuuggcaacgagcacauuuuugggcauagccaaccaggguuuucacaugggcguucaggggcggaugggccaacgucauggugggcaacgcagggguaagucgauccaguacaugggcaacggagauauauggccaaaaaaacaaggagagggaaaagggggaaaagcaauaaauuuuaauuuaauacaaacuauacucauacucucaaugaaacaagcuuaaguuguucugaagacuaacacaauaauggacuucucuauaccugaccguggcuucuuaacauuuaaggaccuuaaaugaugguucuagguuuuguuuuguuuuuuaauguuucaguagcaggcuggcucgugaggguagacacaaaaccugucaugacucaaaaguuuacugaaauugaggaaaauggggaaauaacccagauaauuauacagaacaucuggauuaagaggaaagagguucaaagacaaaacaaaaauucccacaccaaacccccaaauauuaagacugauuugguuucauaagguauaaaacacaucuuauaagcagauuuauaaaaauuacaacgaaaucuaaaguuuauuaagagaaacacaaagaucuguuaccaagagaaaugaaauacuguuagguacucaaaguuauuugccucaauuuuaccaagauaaacauuaagaaauguagauaguaugagggaaaaaaauaaauuuugguguaaucaguucuagaaauacacacacacuucuggugcugccaacauuuaaugugucuaaucacaagagucaacccacuauaaauuaugaagacucaaauccuaggcaaacaguucugauugccaagauuaaucuauucauuacccauauuuagaaaucagucagcaugagcuccauguugcaaacuguggaacagaugauuuaaaagaaaaaaaaaggaaauaaaguuuuuaucagccauauucaauggcuuucagaaaugacuaaaucccucuuacacauacaagaggaauuauacaauuaaggguuuuuacacuuugucuccauuccuaauuaagauguuuuaaucuuauuugaaaugaauuaauuugaaggguuuuauuaaaauaugaaaagauuuaauuauguuccaccuuaaucaggguuuuaaaaaaaaagaagucauuuacauaaccauuaauuauuacaaaugguuuguagcuagucagugauuucuaagaugugaaccuuuaaaauucuagaaacauacaaugaaugugcuugcuuguucaguaguuuaauacuuacgucuguacggagagccuuaauauucuugccuccuuuuccaaucacugcuccagcauucuggaauagacaaaaaaaaaauuuugcauuuagaaaauuaguauuuuuaagcuauauuuuuaacuucuaauguuugcacagcacugaaaaucuugagaaagaaaaaaaucaagaugaauaguuuuauggucuuuggaguauucagaacaccaggcaugaauauaaaauuccuagaaagcacagauuacaagugcccucuuguaaaaaaacaaacagaaucuaaacaguaccuacuuuuauauugugacuugaaauaagugaugggguagacuuaaguaaacuaguuuccuggggaaauaagaugcaaccaacacuuaaaaccugugucuacaguuacuccacucaucucucuagcugaucugugguggacccugguaauagggcuuucaccauuaaaauuucagcacuaccggcaguucugaaaucugcuuaucauuaagaaccacaacuaaaugugauagcgcacacucggaaucccaguaaucaaagacagaggaucaagagcucaaggcccgccucaccugugaggggucucaaaacaaaugaacccuuuaaaaaccuuuuauucaacguguuauaaaauucugaaagguuuccagagccaaagcagaguucaaagugaaaaagcauccauuuauauuuaacuacuaaccaaccuccaaauuuuaaagagcuuauaccuugcucugaagcaaaaugcgcaauucaaccaucucaucaguauuucuagaucuuuuaaaggcuugcuccucuuccauaucuucugcagggcguuuaccuagaaauuaaaguuuaaauuuucaauuagaaacaucccccaagaaaggguaauugaagccacuuuuuaagucccugccuuugucucccuaauaucccuaauaucaaaggccuuauuuuaauaaguauuucaaaggauuaaaauguugguuggaaaaacuguacugcuuuuuaaccugugcaagaaaagguuacuucuuuucauaaaaaccaacagacaaacucaagacuacaaaaaaaugaaacuauauaagagguaaacagaacauaucaaaaacauuuaugguaauuaaaguaacagaacagaaaauacuaauugguuauaauuaaaguaucuucucaccaaauucaccauugguuucgguguuggggaagguuucuucuggcuguucggucuccauuuucuugaauuaaauggauccaccaaucuguugaaaaauaaagaagcuagcuaguacauuggcuuaucagaaagcaaacacucuuuugcuuaaaaucuuccaaaaaaaaaaaaaaaaaaaaaggauucugcuuccagcacacacaagugacauccuagugcuacaguaguauauaaaaacaaggucugauucgaggaaacuaaaauauuccuaaaagugaacuguuuuuaaaaacuauaauugaggagagacaggcauaauggacuucuuuuagacuagauugucucaaugaagcacacccuaaccaccuccaccaccagagccuugcgccccccccccccgcaaggggugugggggaccaguaauuccguccucagcaacuugcuucauuucauuacaacggaaaaacuagucgacauauaauuuuguucacgagacuaauucuugaaaagaccacgucuuaucacaaaacuaguguuauaguagggcuaguaguaauuuuuuccccgccuuuggucgugacugacaacacuaaucaaugaaaucugccaacuuuaaaaaacuuagcggcaaauacaagguacauugaacuuucagacacagaaaucuaaagaaccagauggaaacgaccaccauuauucagcaaagccacggaaucuuuaaucaccaacaccauuauuuuaggcaacguaaaaaaggcuauuucccaacaauuuuaccucuaacccaacucuccaagacugcaaccaaaccaucacaacugguccaguuaacucguaguccuaccaaagccaaggaccaacacaggaucuuaaagucgaggcaucacccucaugccuucuccuauuccaaaacgccggcagcaaaugacgaucccucuggggaccacuuuaaaugcagagaucggccggccacuccgcuaaacccccggccgcggggguaaauggauucaggcaaaucagccgggucuacgcacacaaacaggcccagccagcccucucgucccgcggccgcuguucccacagcgcgcugguguuaacagguccgccgagcgagaccgaccgcgcgcgcucgccucccgcccacgggccgggccuggaagcagcggccagcgaccgucgccgagcggcgagccucuccucacccggauccgacaggaaauggcggcccgcguaauggcgacuacgugcgacuaggcggagucgcgcgagaccccccucccccacccagcacgcgggcucgcgagcgcccgucccccgcaccucccccaccacccgagacaaagccgccgcggccgccccaucggccccgccgcgcagcaccccccaccccggagguggggugaggagggaggcccacgccguggagggacaaagggcggccggggcgcacacacacacaccacacccgcgaguccaccggacggcccggcgcucccuccacacggggcgcccgcgucgcaaacccacaggccucuccuucccgggucccucaagccaccuagcgccggcacgccaaccgcaggggcacgcucggggaaauggcggcgguggggggaggggaacccgggcaacguuccccggcgggccacggccgccccgaacgccaccccggacagccgacuacggcguccgaccccgcuccagccagcgcgacccgcccgucccgcucaccgcgcgaguccgccguugccucccggccgcgccgccuccgacggucggucacugcuagacagagaacgaggacaaacccccucccacuucagcgucgcgccccauuggcugcccaggcuucggcgguggugcgagcgcgaagcgauuggcccguggccgcgucaauuacggcgccgagaaccccgccuuccgccggcgacucccuuugggcuggaaggccgcgggccugagaaaacucgggcauggggauagcccaagccgccaucccggggcgccaacccgcuccggggacucgcuaccccgaagcccuagcccacccagauaccuacaggccgcaaucgagugggagacgagcacgacggcgacguccgugcagcggagaagcagaggauaauggcgucugcagcgcugucgccuguagcgcccuccuccuuucucguucgcgcacucuguggugagggggaggggaguagugacagaccucucgcgagacuucagcggcgcugcucacgugugccgggaggggcgacugcggggggauuuucgagccccgagggaguuuggcgcgauuggaggagggacggucgccccgugagcgcccgauugggcgggaagaagugaaagagggaaaagagaacccagcugggaacgggagagggagagcggcgcgcggcccugggaucacgcugcggugcgaggcgaggcgaggcgaggcgggaaggccaggucggucggugcuccgcccggguuccgcagcuacccguugucgcgucucgcucgcccccucccuccccggcgcugcgggcucugcgcccccuccgcggcgcccgggaaacccgcugugcuaacggcucccccggcggggagggcgggggagggcuggaagcggcgcccgcucccagggagcccggggcuuacuuccguguugggccggugcgaugcagaccccccgggaacgccgcguagggaaugcccgcgcguccgugcugcagcgcucccugggacccucccugagaaagcucgcaggcacacugccccgccauggcugccccaccaggggaagggagggucacugcgggugcucgccucgcuccucauccucacagcagagcuccacgguccccagacucuggcugauguccggaugucagccuguaggggugaccuccaguuagcgaggcgugugugcgagcgcacccuguccuaccuuucccucgaauaaucccaaaaugugcacaccggccagcacccuguaaaucgcuccguuacagagcggucgag

SEQ ID NO: 7076 - RNA, 8903 nt, Mus musculus
cgccuuccgccggcgacucccuuugggcuggaaggccgcgggccugagaaaacucgggcauggggauagcccaagccgccaucccggggcgccaacccgcuccggggacucgcuaccccgaagcccuagcccacccagauaccuacaggccgcaaucgagugggagacgagcacgacggcgacguccgugcagcggagaagcagaggauaauggcgucugcagcgcugucgccuguagcgcccuccuccuuucucguucgcgcacucuguggugagggggaggggaguagugacagaccucucgcgagacuucagcggcgcugcucacgugugccgggaggggcgacugcggggggauuuucgagccccgagggaguuuggcgcgauuggaggagggacggucgccccgugagcgcccgauugggcgggaagaagugaaagagggaaaagagaacccagcugggaacgggagagggagagcggcgcgcggcccugggaucacgcugcggugcgaggcgaggcgaggcgaggcgggaaggccaggucggucggugcuccgcccggguuccgcagcuacccguugucgcgucucgcucgcccccucccuccccggcgcugcgggcucugcgcccccuccgcggcgcccgggaaacccgcugugcuaacggcucccccggcggggagggcgggggagggcuggaagcggcgcccgcucccagggagcccggggcuuacuuccguguugggccggugcgaugcagaccccccgggaacgccgcguagggaaugcccgcgcguccgugcugcagcgcucccugggacccucccugagaaagcucgcaggcacacugccccgccauggcugccccaccaggggaagggagggucacugcgggugcucgccucgcuccucauccucacagcagagcuccacgguccccagacucuggcugauguccggaugucagccuguaggggugaccuccaguuagcgaggcgugugugcgagcgcacccuguccuaccuuucccucgaauaaucccaaaaugugcacaccggccagcacccuguaaaucgcuccguuacagagcggucgagccauccuuuaccuaacugacagaagagacuggggcuugaggaucuggugagggggcucucguucugagacagccuaguguagcccuggcugucgugggauccuguagaucuccugccgcugccucucaaacgcuggcauuaaaagcgugugcccccacuccuggcucaagauuuuucauauggugguuuuugacccggagggucucucaagagauccaccugccucguccucccaaagcagggauuaaaggcaagcguaaccauggccagcuaaaguuaguauuucuuuuuuucuuuuucuuuuuuuuuuuuuuuuuuccgagacaggguuucucuguguagucuuggcuguccuggaacucuguagaccaggcuggccucgaacucagaaauccaaugccucugccucccaagugcugggaguaaaagcgugugccaccacugcccggcaaguuaguauuucuaguacaacauuuuuuuuuuccgaggcaagguuucuccguguaacccuggcuggucuggaacucagagaucccccugucucugccucccgagugcugagauuauugccugcauagccgccuccaccaccccgcuaacaacuuuuuuuguaaaugagaagugggaaucuaaaggaaacuacagaaauugucuugacuagucucuagugagaaguugcuuccucaagauuucauggcaggauuguucuugcgcccacccccaccccccaguuauaccuguuuguuuucuucucucacuuuuuuagguuuucucuuugaguaaucaaagugucuuuuguccguccuucauuuucuauuuagaguuggagguuuucaauuccuuauuaaaaccucagacuguagcucagugguguagcacacugagugcggaggcccuggauuugggugucacaacaaagcccaugccacuuuguuuccuuuaguggcuccuggguaaccauuaaccuaaugcuuuaguaucaauuuggauucaguaugacuuagcugugagauuuaauauaauuucaacaguucaguagcuggcugagaaaauauuugaaauacuguaggcaccauaccccgaguucuguccuguuugccacuuugugcugacaauucaaugcuuauuacaguacuuugaauacauuguggguuuuguuuuaugugugagggaguuuuuugaaaaguagaauaaacuaugaugguucaugccuuugaucauagcagcugggaagcagagaugugaaucugugaguucuaggucagccagagcuacauagucaaacugucucaagaaacaaacaaaacuaagguaagagggcagacaggugagauggagcagugggugaagguguuggcugccaagguaaauuucaucuccaggaugggggaagaccagaccuuacucucuugaccucuaaccuccacacauguguauauaaugaaaaaaaguuuuaaaaaguauugaggauagaaaccauauucaagaugacagaacagagcuggguuagagacuccuaagugggauuuucucucuaguuuuauuuuuauuuauuuuuuccucaagauaaggguuucucaguguaccccuggcuggaacuucuucuguagacccaggcaguccucaaacccugagauuugcuugccucugccuucugagugcugggaauaaaggcaugugccaccagccaagcuuuguggcuacuucuuaugucaacaguaauauaacgguuuuaucccuauaaaagguaaggucuauuaccuucccagaacucuaaagucaucuuagugucuuuaacaaguuaaaaugguguuagaaguaagugcuuauuuauuuauuuauuuauuuaaacauuuuguagugugacuaagugggagccaggggauaacccugugggacaacccugugcagaguucucuucuacccuauuggaccauaggaguagacucaucguuacauuuaguggcagguaccuuuaccugcuaagccaucuuucuuagcccaacuuauuuuuuaaaggaaaauaauagaaacauaaaauggauauaaaucuuuguuacugauuuaagaucucagcuauugauugaaugccacauacaauaucuaggaaugguguucuauuaaaaaaaucugaaucugauuaaaaauuaaucauugagccaaguaugccuaaaccuuagugguaauuagcagaauuuuccuacuugguucuguuuaagucuuaguaguuuuuagaauguaaauauguauuaguagccaaauaucagguacaaagguuaauaaaaguauuuuuucuuacuauaaaaguggugaggauuaaguuuuguaacuuuauauguugcuauuaugcuaaggaaauacgaauauauuuuucacgucauuaaauagucccuaaaaaauguuagagcugggugugaugguauauuccuuuaaucccagaacuugggaggcagguucgaauagaucucaguggagaccagucuggucugcauagagagguccaaagucgcauaaaaggagaggcccugucucaacaaaacaaaacaaaacaaaacuugaaggucuagagggaugguuccuggucuaagaacuuaacugcucuuccagaggauuggaguaacucccagcaguguguaauauccaacuccaagggaccugacccccaccuccuugagcaucugcacuugugcacaugccuccaccuccccacauauaccuuauaccaccccacacacuuaaacauguuuaaaaaucugaagacuacacagccuucuauuucauagacauaauguauguuuuugcuugauaacauucaaacccccucaaauauauaaauauugauaagcuuugucagauaagcauuccagugucuuuuguuccucuucccucaucccucuccucuuuccuccuaaauccuagagauugagcccaaggcugcagauacaccuguucuugucuuuauuucugaucuuuuaauauugguucuggaaaguaaaagguguguguuacaggauauaaacuuaauguucaauuuaaaagaccucuuuuuccaaguuguuuuucuuguacugaggggacuguuguuugucuaucagcaaaugggaaauuguguguccuagcugacccuuugcugucugccaugacugugguaagacacuuuuacaagggagaggguauuaugccuaaccaagagcaagugggucccaggcugcccuaucuccuaugcuugccuuccucagcagcuaaaggcacuugccaccaagucugacaccauaguuuugaucccuagaacccaccugguggaaagagaaccaaguccugcaaguugugccaugguauauaucacugcuucaaaaaaaaaaaaaaaguccuccgguaccugaguuuccucugaacugcuuggucacacacuguguuaauuaccuuaguuaucuucugguuuaacuguaacccuggaaacaggcugccucugccuccccagugcuagguguaugccaccaccacccggcuacauuuccauuuuuagccuguauuguuuuuauuuuacuuaacuguccccagaaccacaccauccuacuuuugcacucaugggaauaagcuagugacuuucuguggcgcaauucuagaaucuucacugccccuuaucuuauguuucagggucauuucucugcagaggaggcucugaguacuguacugaccaucuagcuugaaaucccucguuagcucacaggcuggccugcuaaguggugaguuuucuuauggacaugcuaagcauagauauauauuuaaauugauuugucuuuaguauuuugcuauugguuuguuauacugagagaaucagauuuaagcauaccugacagcacaguugagaauauuuagguaaacaaguaagacuucucucaucccagaguaagguggccgacuauagucauauaaauuuuaauagaguuaaaauauaaaguuaauuauagaugucagaagaaacuagugaacauuaaguaaaauuuaaaucacagaaucugauuauuauuuuauuaaaauaauaagauauaguaauagcccagugucuuucagaggucuggcauuacacuuuaucaugcauaucaauuuuucugcagcccuguaaggcagaugguggugcugaugaaaauacugaguuagagaaguuaaagaauugacauuaggccaugaagcuugcacccuaacuuaaacauuugucuuucucauuauacugucugagcuaagguuugaguagcuuccagguagagagcaaggauuuuucuaaugcuggaaagagagaaguguaaagggauagugacucagccuguuuguacugagaagcacaggcgcuggcuuuaguguauugagucaccuuuuguuuuguuuucagauggacacguacacuuauuuaaaagaaaugaguguagcuuuaaguaucgcccuccguuuuguuuucagagaaugugcccacuuuuuucuguuguuuucaaggggacacauaugcucuuauuuaaaagaagugaguguaacuaaauauauugagucucuuuucuuuuuguuuacagguagauguggauccucuuacuuaaaagaaaugaguguagcuagugcuguauuaagaguugaaaccuggcuuuuggcaacauggcauguuaagguaccuccaauguggcuggaagcuuguguuaacuggauccaagaagaaaauaauaaugcuacuuugagucaggcacaaauaaauaaacaaguguuggagcaauggcuucuuacugaccugagagacuuggaacauccucucuuaccugaugacauuuuagaacugccaaagggagaacugaauggguuuuaugcucuacagaucaauucuuugguugaugugagucagccugcuuauucacagauacagaagcugagaggaaagaauacaaccaaugaucucgucucagcugaaacgcagaguacuccaaaaccaugggaagugaggccuucucggaugcugaugcuacagcucacugauggugucacacacauucagggaauggaguaucagucuaucccagcucuccauaguggucuuccuccagguacaaaaauuuuaguucguggaugcauuuuguuccgucuugguguucucuuacugaaaccagaaaaugugaaggugcuagggggugagguagauggucuuucagaagaaaaugcccaagaaaaaguacuugcaagauuaauuggggaacuugauccuacaguuccagucauuccaaauaauuccauucacaacgugcccaaaguuucagggggcuuagaugcuguuuuggggcccucggaugaagaacucuuggcaagucuugaugaaagugaagagucugcagcaaauaaugacguggcuauggaaagaagcuguuucagcacaggcacuuccucaaauacuacuccgacaaauccgucugguuuugagccaggauguaacauuucuucaaggccaaaggagaaaccaccaaaccagcccacgcauuucacugauggagaauuugaugacuuuucacuggaagaggccuugcuuuuggaagagacuguccagaaagaacagauggaaacaaaagcaucgcagccacuaacuuugaaggaaaacacugguaaauguauggagauuuuuucacauaaaccuaguagucugaaccacacagcuuugauucauaaacaaggaaacagcaauuuugaugaaaaaacaucugaacaaaugauucaugaagacaaauuuuuugauugugcaucuacuagaaaccaucauaagagauucucagcucaugauuuuacaaaugacaguaagauuucagaaguagaugaugcagcacaacagacccucagcaguucaaauguacauugcuuacguaauaaaauauuaaacagaaagcuggaccuaucagaaaagaguucacaaauuucuaaagaaaauggccacccuuuccaggcuuguucuucaagaucauuugagaauaauacuuaucuaucuauuggcauggacuuacauucuccacccuuuaucuauuugucuguucuaauggccagaaagccaaaggaaguuacuacugugacagucaaagcguuuauugucacuuuaacuggaaaucucucaaguucugguggcuuuugggguguaacugcaaaaguuucugaugguacugcauaucuagauguagauuuuauagacgaaauacuuaccaguaugauaggguauucaguaccagaaaugaaacaauuaagaaaggacccucuuaaauauaaaacauuccuagaaggguuacagaaaugucagcgagaucugaucgauuuguguugccugaugacuauuucauacgauccuucuucauguaaagggguggugcuggaauugcaagauguugguauggaacacguggagaaccuaaagaaacgguugaauaaauaauuugccagaaugcuauuggagcacacuuuaaaacaggcaaauauuuggaaucaaauuuguguauucucaguuuuggaauucuguaagaaaaagcuucagagcuuaaagcuggggcagcuccgcgguugacagacacagugucugccaagugugguaacuggaguuuaaccaucuggucucucgaggcaaaaggcgagacccugcuuccagaauccguugguaguccucuacacagguggcagaggacacacacacacacacacguacuaaauaaaugacauuuaaaaauaaagauauuuaaucaaaauaugugaaagaauguuuauauuuuggugauacuggcccagagucuuguaaugcuagcaaguuucuaccauaguuacaucucuagauccuugggauguuuguuuguuuuguuuauuuuuuuguuuucccucccuggaaacuggaucucauacacaggcuguccucaaacucucuuguauagcugagagugaccucgaguuucuggucucuugccuucaccacccaagugcuagauuuaggguuguacauuuuuaccugugcgugcuaggcaaaugcucuaccaacugagccauauccccaguccuuguugaaggguuuagcugacccacucuggcugagaaacuuguuuuccacuugucauuggauaaaccuaaaauugauaaagaauagugauggacugacagcaguuuguuggguaaaggugcuugcugcugagccugacaaccugaugcuauuccugguaccacaugcuggaaagcgaaaacucucccacaagauggccucugauuuccaccugcaugccaaaacgugugugcucccucccauacauaaagguacacacaaugaaauaaaauuuaauaaagaguugauguuccccagugagauauuacugaaaguuaggaauugaaaauuaguaauuuuaccucuaauaaguugaauauuaaaaaaaauuguacugugauuuagauaucuuccauuuacuguguguauaggucagagggcagccugggacacuuggcuuucuccugcuguguggauucaugggguaaaauccucaggcucugcacgcaccuuguaccugcugagcugugaggauggcucuggcuuuugagauaguauccugauacguuuccaggauccugcgaauuggcuuugcauaugaguuauuuguguuauuguuuuaaagagacuagacuauuuccuuuugcuguacuagauuauguuugggagauguacuuuuaaaauuguaaaaguguguguguguguagagauugaugaauggaaugaaccucugaaccuguaagccauccccaauuaaauguccuuagaagag

SEQ ID NO: 7077 - RNA, 393 nt, Mus musculus
ggaggucgguccggcugcggagccggcgugcgcaaaggccgcugggagccuguggagcccagggcagugcgauggcgccagcggaggcucgaggcgcgcuccggggcuggaucuccgugcugggcuggggucuggcgcugugcugccugugcggggcgggcccacuguggaguggcagccaugaguggaaaaaacuaauuuugacccagcacuggcccccaacaguaugcaaggaaguuaacagcuaccaagacucucuggauuacuggacaauacauggacuauggcaagcaucuaauacaguaaaacuaaugaagcagucugggaaagcuagcuugaguccagucgccauaaguagaacuguuaaacuugguagaaguuucuccagcugac

SEQ ID NO: 7078 - RNA, 6117 nt, Mus musculus
caaauuuacagaaaauuuauuagcaaaggaauaagagacuauuguaaguaaaaacauaugccagagaaaaucuuuuuuucuuuuuuucuuuuguuaauggaaacaaaccucccaacagugccuuccacacaaagaagggcagccggaaacuccuagcuagcuucaugucuacagagaggacuuugguggggaagaaagcacaggggaggucuccacccucuuagcuuuuuccuguagggccacaccucucaggggcugucugucccuguccugggcugcaggacucagcccuuggcacuggagagcaggaaccucugcagcacaaguggggcagccucuggacaggcucugccugagccugcaggggcaccuccugcugagcuccuucagaccccaugaggggagacacagggaccugggggcagggggugacugucccaugccugugccccagcugcuuccucaggaccaucccaggcucccucacacaguucugagcuucaggguucccacaaaacucacuucucccuuugauggggcuugugcccuucccagaugcuaauggagagcagcccuuggccagggacuuuuccuguccuuuguguuucuucccaggggacagccucugccagaagcccuucaccuggcuggugaacugauuuuccugaggcugacucuuaggugucagugcuggggaggcugugaguccuugugucuccucuggugcccuggccugaacacagugucccuucccuguggucugggaugucccuaagccugcauccccucccccaaacuuuccugccucaguugccagcuguggcaauccccuggcagcagggagacaguccuuguucuugcucuugccugagacauaugcagggacccagggacccugccucgacuccaugcugaugcccacagugggcaugugcacacgcaguaccugagaaacugccauguccccaccggaggggcccugggguuuggaagucauuucuuguggggcaaagggcguggcaggcaggucuggcacuugguugugugucccgcccucugaguucagcugaacuucuguggacaccugacuuuuagagucagggcucucagaguuguggagaaaugacauucccuguggggacugacaugcagucacagggcucccuggggagcacaggccuugggugccuuucaagcucuuaguggacugugggugaagacccgggaguugcucucccuuguguagcucuguggagcccucggccucggagccgucuucccggcuccuccuuucuuccugagacccuuguguguuggugcuggaagccaaucucucauguguuggcccaccugggcucaugggcagcucugggccaggucuguugugugauccagacugcugcacgucaccuuugucugcccuccuggguguccagugcuggguuggcucucugucccuuggggcuaugcuaaggucucuaucuacacccaccuucuuguucucagaggcuggcuggcuguggcccaccagugaggcagcagggagagggcucuguuggguggggacugaagucauuguccccauucuaucuccaguaguguuucuccgaagggaccuggaggacuuggcagggucugcucuagaaacguugugggcuugaauguggagcugagggaaaggcugagaaggcucugcuuuuguaaggucugauucuaaggacuccucaacccuuuuugggaggccaaaugccauccuucugcggaaggcugugauguguucuuccagcgucuucucuuugcuaggaccaaucgcuaagcugugggggugccucgucagugcauccuccucacaugccaaugguuccaucugucuggggcaggucucagguggaggcugugucauguuccgagaaugccuugagcuguccacagcacuaggccucucacucccacuaauuucuuuaguguccuugcccagauguuuuugcagguaagcuucacauucuuucuggcacugucugacccaugaagccuuugaaauguuuccagacauauucccuagcugaaguucugggucugucucagaauuagaauguacagugcucuuuguagcuccacaggacuuacauuguaugggaucucuuugguuuaucccuggacggugucucugaacguugaugucuuuuuccuguggagggugacucucuaagggcuucuuacaggaucuuuccgauuggcuuaccccagagcuugguagguuuguguuggcauuaaacuuauagagagagacccgugagaguccaugggugucccuuggcuugggggccucaggaauuucugaaugaggacucaagaaugacagagauucaaggauccuguggggcaagccccagugucgcuggaugagucucuuucgaagaugguguucgaguuuccucuugaguguauggcugagagggaagucuccaggaaggauugucuugggagcauggaccuuggaugaauuucugguugaggagauuuuaggaggugggggacagaagcuuucuuggaauguuucaguuagaguggguaaacccaagaaacuuugcagcgcuuuuugcaauagguuguauuccagcuguugaauuucacauggggugagaggcugugccucauucuucaggcuaugaaaacgcaccccacauaucccaagcugggacugaggagaaggugacaggaguugggcuagggauugaggcugggccuuagaguuggcaagggagucaggcaugaucugagacugagguacaaucugcccuuguuggucacucucaggcaagggcagagguguggaguaaguaagauuggaagaaugacugccuguggaggccugagccacuuuguugaaauagucccuuccuggguaacuguuaccuguguuggcagccucauguuucagggacucacuguggagagaagggagaccccagaagagcuggauguccuuuaucucugacugguccucagaguucuucagaugagagggcuguuggaguaggugaggguccucuggcuuucccuuuucauuaccuaagaggugggagacuuccaaguucucuagaccagcaguugaugcugagauuuccccugaaguauuugauggcauuauauaagauacugcuuucucccuuuuaaguuuauacacagugccaucagcauccccuuccucuugcuucgugaagagugcuaagacaucggggcugggagacaaaugauccccaggcuccacagcauaggccuuugugagucccugguaugagcccugagaagcauaggagucugauggaggaggcugaugguuaauaacaugugucgaauuugucagggacuggucuucagcagugaacuguggccgggaggaugcuggcucauagacagugcuuuuggcaguugagacacugggggaccgcucccuagggcuuuccacgggaggcuggggaacuucugcuuggagagcuaacugugcuuccugaguggcguuuggauguagguguggaaaagaggcaaguguucugcguggggugugggccgguaacacugcaggguuuaaggaggcagcagcuuguggugacagagaggcgcugagcgauauggggggagaagauacaccauccaaaggagugauuugguucugcaaguggauggagcgagaaguguggggaggaguuucuggagcuggguguccuggucgguuggcaggaaagugagggggcagagcaagcgaagccucuaucaggggagcgguagauggcaaagaggacaccgaggcagcaccaucuuccaggggagccugagagagcaggugucugaccugagugcuugcuuuguuacauacgcgacaacggggaucugggcauagcgcuugccgaaagcccgugggaucauauggcuugucugggcuguaaggagagagaaaggucagagagcuuuagucaagucgggcaugugaaaaagcaagccugcuggccaggguagagagcugaggagaggggccaggacaggaggggaaugggucaccuuuguaggacugucugcagccuccuuccuuccucagggucucucgggccaacuuuccucccuggaaaauggagaacacguguacuccaggaggaggguagaaacgaaggcucacaaggugggccuuucagaaaaaacauucaagggggcuggagagauggcucagugguucaaagcacuugagauucuucuagaggacucggguucaguccuccgaacccacaugguggcucacaacgaccuuuggguccaaugauaggacagcggaugcccucuuacgaccucuaagggcugugguacacagauggacgugcaaggaaaacacccaucacauguacuaaauaucuagaucguuuaaaauggaagaaaaguguguaggagaaccugcagauggugacaagugcucugugggaacacucaggacauucacacguguguguguguguguguguguuugcgugugugcgcacaugcggcucauuugcuaaucuccccucccccacccccuguguuguuucaagugccucucaaaaccacugcaggaaacgcugcucaaugauuuccucauagcugucagcucccggggaaggaaacgggggacacagugucaggagacuuaagcugugcuucaaagcagccaguacccgccugcgcaucccacaagauuccugaagggccaugccugucucccugcucauuccacagccagggggcagaacuccauguucugagaugcugugcccacugcuucaggcgugggggaguagaggggacucagcucuaucucggguugaucuugugaaucggagucucaggagcaacaucuucaaaucauggaccugaaacuucauagaaaggacaucagggggacgcugggauggugacguuaauagguggacaccuacguuuaaaugcuuuccuuuguuugcgccugaugcuguucugccgcuguaaggaaaagagaaacacagugagcacgugagacuucuuuguacugcuucucuuuguuauauauucagaacuccuaaccacauuauccugaggucuauugaauaaaugagauuuaugcauucauuuuacuaacuuuagaaguaaucacuuauguucacugcuuuucucucugggaaaguagaggagaccacgacaauguccacacuuggggaucucaacaaaaagucuucuugauagcauggagucuggaggcagcauugacaucucugcucucuccaagggcugugugugaggcuaaagaccacgaaccaggcucuaaacagaggccuucaacacgcagcacugugauccugaccaguucauuguggaggaggguaggggaagggacaggugaugcgggaguggaucauaggaucacugucaggagagacuggucccauccccagaacccaaagacuggagccaagccacuaggaccaguuuccuacuuuguccuggaaaauucaggcacacagauaggaaggugaaugugggcuccaaaugggaaccuuaguccucccucucauaccucucuucuucuccccucuccaucuccccuccucuccuuuccccuucccucuuuuuuucccuuccccucuccucuccuuuccccuccucuccccucuucucucuccuccccccuuccuccuccccuuuccucuccucuccuccccucuccccuccccuccucucaccuucccuccccuccccuccccuccucuccucacucauucaucccagacaucccucugacagccaagcucaccccacagccaggacagaacuacagccuagcagugaagucucucuugggaacucaccauccuuccuuaccuuugggguguauuucuuucuccccagcaaauguauaagcaguuucaauaucagguaggagauguacagaagcaguagccccaguccacucagaagaguguaguugaggucuaugugguaggaagcugagccuagggucagccaugucucacugaggccauucagagcugagagaaucuucuccauggcagcaacagcauggcugccugaggugucugaggcugaggguuccug

SEQ ID NO: 7079 - RNA, 4186 nt, Mus musculus
acuuacauuuaauucuacacuucauuuggaaaugacaagagugacaguuuaagaagggagcuagcuuccuucucccccucagaaguuaugggugcaagccaggugugguggucaugguguaguauuuaauccccacacucagaagcaggcaaaaagcaauucuaggcuagccugggcuacauaaugaauuuuaagucauccaaggccucacaaugagauucugcuuuuaaaaccuguagcuggcaugguaccaguuacuaaacccuuugcauuccuuccauugguuugaguagagccuucauuguacaguaguagccacaugggcucucauucccucuuguaugugcucagacuccagaacacaguacauguuguaagcuguggauggcuucacuacuaauuaaguacagagaauuuuauuuucuccuuguacauccauaagguauuacuagacuucuaaaggguaaugguaugagguacuaauuucuggccagcgaucucuuugcagucugugagcuacaaacaaaaagaauauccuauguaaagaacuuucaaaauguuucuuccagccucagugccugccuguggcugcauugaacagccucggggcuguaccuuaccagcacugaggaagcagugucuaagcacugcccagugccucugauggcugugcacuuguuuauaccuagccuaacugcucgacucaggacgagugcccuuuguggugggacacgugucugucaguaacugacaauaaguauugugugacuuugcucaaacaccauucuuuucguuuauguuggauuuuguuuucccuccuagguagccuuuccaguaaauauaugacucaggggagagccucagugaagaggacccagcaggaaucaugagggaaggaacugcagcacuggaaaugccacucagguguccguggccacuugggaaauuagguucauggcacaggacacagugacacagaucaggcuucaacguaacaguugaggggcaucguaauuuuuuaaauuuuaaugaaauuguuaauaaggaaaagaaaaauuuuaauauagucuaacuauaccaccaaucuccagagauuugaagauuuuaauagaaagucaacuuaaaagaaaaauaugagggccagaauucaaugacuacagcgucauggauuuuaguucuuucaaagcacucuaaaaauagugugcugcucaccagaggaguuagcccucuuucccuacacauccccuuuuugauuuccaagaggggauucucucuguuguuccuggaucgugguauggacgcacaucaaggacauguggacuauacugcuguacauagggucuacaagcauucuucauggcucauuguagaaaugauagcauggaaugcaagcaccugucagugugggccucgguggacgaccacagcaccacuggcacaucuuugagggcuuccuucucuaaguaauugacagaacuguugugcucauaaaaaugaagucauaaaaauaaguaguccuuuuuugcugguuuaaaaaagaaaaauuaaaggagaaaaggacagaauaaaagugcuuuuuacuuuuuaugauacacagaaauuaggguggagagcuuuuacaaaccucugaagaucaaagaggcugcugucucugccaaucacaaguuugauuggcaaccuucuggucugacuggagcccucucuaaacuguuaaugaacuucacaagccuuucugaaauaguacagagucagaacuaugccgguuuauuuaucauuuugaaauaaaaucgaacuuugaacguguaauuuuauccacauuauuuucuuaugagucauuagaaaagucaaccaaagcgcugacaguacacaucuccuuaauagggugcccaugcuguuccccuuugauagcugugcaccgggucuggggugugcaagcaggagacuggggggcagagagagagcuugcuaaggacacuggcacaacgagggagacucacgagaggcauauaugugugaacuagacuggucauagucuaguuaugaaagagucaugucaaaauggaaaucauuaagaaauuggaaaucaugguaaaaaaauaaaaauggugaccaucaaacucauggguugugcaaccggggccucccugcuacgugacggcucagcugcuggccugcuuccuuuccuccugcucagcugcuggccugcuuccuuuccuccugccucuggcugugaagugacagcgcugcuuucuggcuggaacagugccacgccuacugaaaaagcgcuuaguguuguuuaucccucugccccuagaacggagaagaaauacgcagccaggccaaucuuuauaccugguaguuauuuucuacuuggauguuuugucgguuguugagggagaggaguguacuuaccccuaaaauuaaacagaauugucauguuuucuucuagccuuaaaaagguuuccuacauuuugauucuuaaaaaaaauucugcccagcagccugguguuuuugauggcuuauacugauaccauuagacaagugaggcacgcuucucagcggauaagauagcaggcucgcagccauggccaagucaaagcuuccucugcaagcgaucgcagggccagggccgaugcccuguucuguucuaaaacagcggaaacucagaauccaguuuuuacagcaggaguucugaacacccgaucuucaccuucuaacagucucuugcucacugugaacugcuuuggcaagcuuccugguaaaagauguaaaagauguguuuucaguguacagagaaacccugucucgaaaaaccaaaaaaaaaaaaaaaaaucagucuguuuuucuuuugcuucaaagguggcuucuaucuuaaggagaggauaucuucccaaguggaacaaaauccuugcaagagagagaucaaugaccgagugggguucacaguuuucagacacuaaaaauagaguugaaaacauggugugcccacucuuuguaaagcuaugaagaaagggucagaacauuuucuuagcuccugggcaggucuaggcagaauguacaaugucugucuuacucugucaguguuccagcauggcaaaguccccauuucggacggggaaacugccccuucuagucagaccagugagaucgcacuggaaaagaaaacacuuguucuuuccgucuagaccugaggccgaauccauuucccucccucggccuuccuggaaccauaagggggcgaucagggguagcaaaccccucaguacuccccacgcccacccaguucccgcacggggccagcugcugcuccgagauaaaggagcucccguucuuacgucaucacgggccgcgaaggaagccgaggcguggugacaggcgcacagcuaaucaaaugggaccggcuagcaggaaaggcuagccaaaugugcacggggcccgggaucgggacucaagaaccgaugcuaacguagcgcccagggcgcucgcucucagaggcucggauagagccaccaugcccgugcuuccaugcgaggcugguagcuacguacgugcucaguuuucuugacacaaacugcuacacaagagugacauuucaauaacuggaaaccugucguauggugucuacccgcuugcuuuacuaucgaagcagcuccagagucacagagccguguccccacuuccggggggucugucguuaguguacgccauacggaaggagccaucccacuuccgcuagcgcagugaccgcgaagcccgcaaggucacaggucaccucccuugccucgucagugaugacggccaaucggcccggcccgucacucacccggacuguccaaugguggagcgggacgggcgacgggaggcggggccuguggcgccugcgcaggagcuuguggcgucaaagugcccgccguguccauggagagaaguugaguccccacgcuccagccggaggcugcgggugccgcgacguggacaugucggcgucguugguccgcgccaccgugcgggcugugagcaagagaaaacugcagcccacgcgggcggcccucacacuggugagucaccucggcguccgcagggaggugguggcggcggcggcccggggugcagagcgagccuggacgcggacuagggucucccggcgggccgcgcgcggagcucgauggggcggacgggcugugug

SEQ ID NO: 7080 - RNA, 3134 nt, Mus musculus
aagcgggcaagccuggagcgcgcggggccagggcucggcgagccggaggagcguugcuaauguuuuuguuuguuugcuuuucuaugcaugcauaaugagggggcgccgcggcaccacacgggggcucccggcccacuuuuguauuuaaagccucgcggcgagcuaguccgcagccgggcuccgcggauccgcuccccaagcuccgggucucggagcagagaaacgcuccgaguuucgggguccucccugcgccuggcgcccagaacuucccggagcgcggcccagaccgggguagagggggaggggaccaagcguccuggccgcgggaaggcgggaugccagagcugcgaagugcuacgcgccgcugagccgggaaccgaggagccgccggccgcacgacugucugcaggcgccuagcaccaugcacccccggcgccgcgcgcuccugcagcuucgccgcguccccccggaacggcacugagcgccuccaaccgucuaccggacccggaccugcgucgccgcgcuucucagggagccccggccgcggugccggagcgaacacccgccuuuaccagccgcggggccgccggcauggauggaugaggacgcccaugccagaagugcgcggaacucggacaaacuuuuccagcggccccgcggccgccacccgagccucgucuccgcuccgcaccgcguccggcggccgcugcugcccgcgaugcuagccgcgcugcugggcggcgccggggcccgcacggggaccuugccgggcgccuugcugugccugauggcgcugcugcagcugcugugcucggcaccgcggggcucggggcuagcgcacggccgccgccucaucugcuggcaggcgcugcugcagugucagggcgagcccgacugcagcuacgccuacagccaguacgccgaggcuugugcgccggugcuagcgcagcgcggcggggcugaugcuccggggcccgccggcgccuuccccgccucggccgcguccucgccgcgcuggcgcugcccgagccacugcaucucggcgcuuauccagcucaaccacacgcgccgcgggcccgcgcuggaggacugcgacugcgcgcaggacgaacacugcagguccaccaagcgcgccaucgagcccugucugccgcgcaccagcagcgugggcccgggcgcgggagcgggcucggucaugggcugcacugaggcccggcggcgcugcgaccgggacagccgcugcaaccuggcgcucagccgcuaccuggccuacugcggcaagcuuuucaacgggcugcgcugcacagacgagugccgcgcggucaucgaggacaugcuggccgugcccaaggcggcgcugcucaacgacugcgugugcgaugggcuggagcggcccaucugcgaaucggucaaagagaacauggcccgccugugcuucggcccagaugcgagcaacgguccgggcagcagcggcucggacgggggccuggacgacuacuacgacgaagaauaugacgacgagcagcgcgcuggggccgcgggcggcgagcaaccccuggacgacgacgacggccuugcgcgcccgggcggcggcgcugcugcggcgggcggccgcggagacuugccccacggucccgggcgcaggagcagcagcagcggcaguggaggccacugggcgaaucgaagcgccuggaccccguuugccuguuugcugcugcuguugcuccugcugcucgggucacacuuguagcuccugcgccccugcugcaggcugcuccaggccgguaugcacgacccagcugguucccgagcagggcaccuguggcucggagaccggagauggucgggaacacugacccacacucuuccuggguggacagggcccagcucguaccgcagccaacauguucggcccucuucugugcgguuuuccaggcugcagagauaaccggcugaucuauacugccagcucuaaucugcagaauucgggacacccugcaaaagcaaaggaggccuagacucagagugcugaacggugggggucuuucaaguuccaauggacuuggagaagggauguugagggaauuagguuugcaaaggggccggguuuuuauuugucuguuuguuuuguuuuuaaacuguuuuccggugagggaacacauaguacugguaacgacuuaaauugcuugugaccacugagaaacacagcaaucguaaguaaauagaaaaguuccccuuaccgauucauuccugugcucuugguguaucuauccaucgguaaugcucaguguggagcuggcgauugccuuugggggggggaggggcuuccccgaaauuacaacugcauuauauuccuaacccuucaccuuuaauuuuccugccaccauucugaucccucugcaccacgugucuuagaauuaaggauccaaaagaagaaaaaaaguuaccaugguguugaacaaugcauguuuuuuauccuaaagcucgguacugccaucuaggaaaaccucuaugauguuuguucuguuguccuuuuuuuuuuuucccuccaccaagaaauucuaaauuugaauaugcagagauugaauauuaccucugccccuaucagggucuuccacccugguacgucguauauaaacuguauuaaaacugggguuucuuaccaguugcuguacuuuguauauagaauuuuuuauaaauuguaugcuucagaaaauaauuuauuuuuaaaaaaagaaauuaaaaguuuuaaaucugcaucauuguuguaucuccccuauccaagaaauguauagaauacauuggucaugaggaauccacuccugcagcccauccaagaaauguauagaauacauugcucaccaggaacccgcucccgcagcccauuuugaaaugugcccuguguagaagaauguacaguguauuuuacagauuugaaguaacguucuuauuuucaagagaauuuauggacauuguagaaauguauaaaugcauuuccaaacugccuuaaacauuguauuuuuauagacaucauuuuuuuaaaucccguguuuaaaaaaaaaaaacuaugacuuuguguauuuuugguuguuuuauuaaaaaugcacacaccaguaaagaguuuaaacaguguc

SEQ ID NO: 7081 - RNA, 1982 nt, Mus musculus
aggccucggccgcggccggcgccgucuagaggaggcccggccgucugccaccacgcacucggaagccgggaagcgcaggcgggucacgccgugggccgcggcggcgaugcagcgacgacagcgcgcuccgcccgcgucucaaccggcccaggacggcaggcgaagcgaggacauggaggugcaguucuccgccgggcguuugggcucggccgcgccugccuggccccccggcgcgcggcaccgcggaggacgaggagcagcuggagcgggagcacuucuggaaggucaucaaugcuuuccgcuacuauggcaccagcaugcacgaacgagugaacagaacagaaagacaguuucgaucacuuccagauaaccagcagaaacugcuuccucaguuuccucuucacuuggacaagauccggaaaugcauugaccauaaucaggaaauacugcugaccauugugaaugauugcauacauauguucgaaaauaaagaauauggagaagaugccaauggaaagauuaugccagcaucuacauuugacauggauaaguuaaaaucuacacugaaacaguuuguaagagacuggagugagaccgggaaagcagaaagggacgccugcuauaagccaaucauuaaagagauuaucaaaauuuuuccaaaagagagaugggauccuucuaaaguaaauauucugguaccuggugcuggacuaggaagauuggccugggaaguagcuaugcuagguuaugcuugucaaggaaaugaauggaguuuuuuuaugcucuuuucuuccaacguuguacucaacagauguucugaaauuaacaaauauaaacuuuaucccuggauccaucaguuuagcaauaaucggagaucagcugaucagauccgacccauucuuuucccugauguugacccccacagucguccuccugauucuaacuuuucgaugacagcaggagacuuucaggagauuuacuccgaaugcagugccugggacgguauugccaccuguuucuucauagacacagcucacaauguaaaugauuauauugauacguuauggagaauacucaagccacguggaaucuggauaaaucuugguccucuacuauaccauuuugaaaaucuggcaaaugaacuaucuauagaauugagcuaugaggauauuaaaaauguuguucugcaguauggauuucagcuagagguggagaaagaaucuguauugucaacauauacugugaaugaucucucuaugaugaaauacuacuaugaguguguuuuguuugugguccgaaagccacaauaauggucuuaagugcuauuacccagaaaaacauuuaauaagaguaaaugaugaaauaaacaacucacagucaacuaucagugacaacaggacauaaccucaaaucaguggugcuuucuuauuccuaacaaaauuuagaaauagugucuauuuucuuaaugaugucuauugcuuuuuucagaaauauacuaugccgugcaaauuuauaccacacaaguuaaaaaaaaaaugaagacauuaucucccauacagauaucuaauggaggaacuaucuucaaguacuuuuuuucuuugaagcccugaauugucuuuaagaaaauaaacuccagguuucaugaagcuauugugagucugcaauggaauuugaaacuauucuuucaucauccauaauaguuuuauuuuauuuuuuagcucagcugcauuuagagaacaucaaacaugucauguaugaaaugcuagaucaguuguauuacagguuaaaauucaugaacuacaguaacagagaaagucuuuguccauguuaaacugaaucuuauauuaaucacuggaucccuuugaaauguauguaaauauaaauauuuggaggcccaaaagcuccuuuuuuaaagcaguguuaauaaacuggaaaaauaagaauaaaaucuacccaucugaaauacaaaaaaaaaaaaaaag

SEQ ID NO: 7082 - RNA, 960 nt, Mus musculus
ucucaucagacacaaaacugacacuggacacuguugcuguugccaagaagcucuugcagacaguaaccugguguggcucuuccugggagguucugcuagugccugaugagagcagauguggaugcucccagcaaaacaucacacugagcucuggacccugguggaggaggucaggggaaggacuggaagagcggagugggauuguaaccccauagaaagaacaauguagauguguuccgacuuuccggguaaagauggcacagcacgauuacagcuucucgcugacuacauucagcccaucugguaagcuuguccagauugaauaugcuuuggcugcuguagcuggaggggccccuucagugggaauuaaagcugcaaauagcguaguauuagcaacugagaaaaagcagaaauccauccuguaugaugaaaggaguguucacaagguggagcccauaaccaaacacaucggugugguguauaguggcaugguucccgauuacagaguacuuguacucagaacucagaaacuugcucagcaauacugucuuguuuaccaagaacccauucccacagcccagcugguacagagaguaguaucugugaugcaggaguacaugcagucaggugguguuccuccaugugguguuucuuuacucaccuguggguggaaugagcgacggccauauuuauuucagugagauccaucuggagcuuacguuuucuggaaggccacagcaaugggaaagaacuaugugaacgggaaaacuuuccuugagaaaagauauaaugaagaccuagaacuggaggaugccauucauacagccaucuuaacccuaaaggaaagcuuggaagggcagaugacagaagauaacauagaaguugggaucugcaaugaggcucgcuuuaggaggcucacuccaacugaagugagggauuacuuggcugccauaguguaag

SEQ ID NO: 7083 - RNA, 1520 nt, Mus musculus
guguuuuuuuuuuuuuuucuuuuuuuacaguaguuaguuuuauuaaguacucuguaaacugagacuaauacgcugacaucagaggauaccacuuuuucacauuaucucaccaucguggcauagguuaugccaagugccagaaugccccuuucuacuuguccuaaggauugggugaagguggggacagauccuuccacuuuaggaaagucauguucaugucacaauacaccugguuuaaauggagcaacaaaauuccaaaggacauucuacccacuuuugagauguucuaaauccaaauauuucuauucaguugagugcaaugggguagacacagaaggaaccucaccucaacuuacaucuuugggauuaaacagcauuuaacaggguaggugauuuacagccaaaaucaagcaaagauuuucaaagaagcaucaacagaaauguuaagaaugacauuugaauuccaauccagaagaagugcuacugggagauacugaggucuuagccaauaucagaaagggaugggaaugaccuuuuagacacuguucuguaagaaugcuuuggccaauaaagucugggucugcugaaccagauaucucgaguccugcaaggcuggcaccugugcagcuccaucacagagugcucuccaguguguuauaguugucuuuaaagcucuucaguucgaggaagugcuuagggcguuugcacuucugacuggagggcagguaugugaccuggauuguuguuggcgacugaguuaggucuuuggcugcugacugguguugucacugagaacuuccaauucgugcuuugaccacaguggccagcucacucaaggccucuugauaucgcaaguacucacucuggccaaagaccccugucccauagugggcugucucauauccauccaggagaguaucaaugagggccuugccaacacccuugaaaggcgugcuaguauuucgcagaccuagcaaguaggagcagaaauucuuacccauuaaagaacagggguuccggccuucagcauggaaccggaucucagaggcacggaaggcaucuagagcuuucauucuguacagauaguuguagcaacuuugauuccccuggguuuccagcugcaguagucugguaucaucaucugcaaggagcugggguucauacuugauaucuugaacccuggauagucgauaucgaucuccucuuuuaaguccuugagugcauuguguccuacaggaacaugagguccccuucuagauuucauugcaaagcgcaugauuugucucuucacaaaaauaaacagcaguacgaauaccaggcucccguacgccaucaccaggaagacauucacuccagaaagccaguuacuacuagaugccaucgccucucucucugggaacaccugcuaggacagucacgucacgcucaacuguuagcccagguucugccgaagccagggcaccuagguuccuuggagcuuuccaaacauuuccauaugguuuucaauuaaaaaaaaaaau

SEQ ID NO: 7084 - RNA, 29083 nt, Mus musculus
uguuuagugcugcagauucaucucuauuguggaguagccuugaaugguuggugugacuugcuuugaccuuugcugcugggugccuuggcggagugcuugcgagcuauugagucucaucaugguaagcaugggaacacugccccuaaagggagggagcaguggucugagaagcaggagucuugguaguggguccuccccuggguuagguggaaaguagcagccaccugugagguuccaugaggucuuagccacuagauguacugagugguggcaucugaauaacuucaucaugggagcuuuaucugcacaaaccauuuggaacaagggcuugcauauagcaacauccuuaguggaugccaaauuuggagaggcccauuaucucugguuucuuuuggaacuuguguccuggccguuuaacauccauuuggaauuaauuuuguggugguuguaaaucccaucguuugugcugcguagcacuccaaauugaagccgugauaaggagaguagaaucgaugauguacaggauuuucuuucuuucuugagacaggguuucucuguguagcucuguguguccuggaacucacucuguagaccaggcuggccacgaacucaaaaucugccugccucugccucccgagugcugggauuaaaggcgugcaccaccaugcccugcuuaaaggauuuucaaaugcauaggaaauaguaagucacaacuaguagaauuuagcagagguagggacugccucuaaaauacuuuacagguaaguaauaugcuaacccaagcaucugagagauuaggauccugggauacaaauguuuguucaucaggauugucaggaauccaggucauaugaaaggagacaaccccgauuaacaaacagccacuuuaacaaacagccacuaggcccauguccagaucaaaggugaguacuugaacaaucugcucaauggagcauugcagggucacaaccaacacuaaggccuggugugccauaaaggaucaguuuucuucuugagaaaagcauaguucugucacgugggcaagacaucuggugaaaccauuugaaaaggaaaaacacuguugugguaaaaacuggccugcccaagcaaggcuguccaugaggccuucguggauggagaaugacacagguccuucucaaauacagauacaugcuuggcaaagccuguaacagccuguggucuaggacucaggaacuuucccuaaggucuugagguauuuauuuaagaacaaaaccaaagcugggaaugguggcuuacuccuuuaaucuccgcacuugggaggcagaggcaggcagauuucugaguuggaggccagccaggucuacaaagugaguuccaggacagccugggcuauacagagaaacccugucucaaaaaaaaaaaaaaacaaaacaaaacaaaaaacaaaaaacaaaaaaacaaacaaaccuaaaaaaacaaaaaccagaacugcuucccuuuaaccaggcauaugcuugagagagcugcuaaugguuuggggcuugguccuguggugaggggaugucucugaucuugagauuccaagaauuccucccauguuaggcugaugauaucaguuacaaaucacuguaggcaugguuaguaguguugaagagaguauccuguucucagagagcagcauuguuugauuagaucccucuuuaauuugucccauugugugguaguuucugcugacuucauagaagccucccauuucuuuccuuuuccccuguaggucguauacaaaaugccuuagcauaagccuuaucuccuggccaaccaccccagcuuuuauacuuucuaccuccuacuuuuuguaccuuuugccucgucugaggccuuccacuuaggacugugucagucaagaauggccugcucuuugaggguauuggugucuuaagaaauuauuagugaaauauauugguaguguaaaucuaccaaccgccaaguggcuaagccaaguagugccugcucuauccuuaaaguguucacaguugccaggcgugguggcacacgccuuuaaucccagcacucgggaggcagaggcagguugauuucugaguucgaggccagccuggucuacagauugaguuccaggacagccagugcuauacagagagacccugucucgaaaaaccaaaacaaacaaacaaacaaaaaaaccaaaaaacaaaaaaacaaaaaaaaaaaaaaucaaaaaaaguucacaguauacccuaggguguaaaccuaaaagagacauaaguaugacagaguauaugggaugcaaaaucucuucuggccuggcuccucuuugaccauuaaucagagcuagaugagugguauuauuacagagauuuuuuuuucuuaauguuuuguugucagauuuccuuccugggaagacauguauauucuagaauagcuguauuuucagcccuuuagaaaaauguuucugacacaaacauuuuugugcccucaggggaaauggcacugauaggagccugcugcuccccagggcaaugaccuugauuuccucuucauuaaaguuucuaaauucuuaaguuaaagggaaguagcgcaacaaaguuuuaaaauuacucguuugagucauguaaugaacugugcauugcaguaagagggaaaagauuugcaaguagagcauggcuugugcccucaaaccugaacaggaggaacaguguccuguguauagagcagaguaaaagagggaaaaugauagcuagaucacagacuaacucaaguucgagccaaccagcugcaggucucaccauuaugaagaaggagcugauggaugcagggugggugauuuuaaaauuuccuagcacguaucaauucaugcauguuaaugaaaauacacaugauaggugguuguacaauuaggagagauuggguugauccaaugaauauugaauuuccaguuaggguacugucuguccuuugugguuaccucugguccucaaugacaugguuaagucagcucagauuuuugggacacaggccauucauuggcugcagcugugugugucauguuacaggacucagcagcuaccaauugacauaagggcaagaucaaaaaguauuuuauuaaugccuuugccucugccaggggauggccugcuuuuuaaaaaaacaauauaccuaugucuuuuugcagauauauauauauauauauaucuuccccaaaaguccauuuuucucagaacauguuaaauuucauuuuuuaaagauucucagccuaauccuuuauuuguuucaauucuccaauguuucuccaucacuaaucuuuucacuuuuucccaguuacuuuauaucuguucauagcauuaucuuuuguuacuugcuugacuuauccuauuuaauugagaauuacuuugaacaguccaucuugacucugccacccaguuccuggaagacaguccugcaacaccuuccagcauaugcuaugacuggucaaugggaagggaaacagaccagugcaggacuguuuucugaggucucuaugcuuaauuacaaauaaagaagaacuuuuguaagaauugacugcacuguucucuaaggaaauauaggccuaucaagaaagcuuucauauaaauaguuauaauugauaaaugguucucuguauuuuuucauauuuuuaaauuuuguauuuauuuauuuaauguauauaaguacacauauguauaugugguuguuagguauuaaauuuaggaccaagacucacuuaggucaacuccacuugcucuggcugguucccuggcucaguccuucuuugcucuagcccaaagauuuacuuauuguuauaaauauguacacuguaccagucuucagacgcuccugaagagguccucagaucuaauuacgggugguugugagcccccaugugguugcugggaauagaacucgggaccuucugagaacaagucagugcucuuaccugcugagccaucucaucagcccaguucucaguaguuuuaugaggagucucucauaagauguuucuuguguaucuacaaauaaagccuccagucacuaauuacccagaagguacagugcagguuucuuguguguccauguagaguacaugccacagagauguuccacuaggaagaacagucauuggcaauaacuugcauuuuuugaaacuaagaaacuguuaguguaaauaauauucucaaauauuuccuuaaaggucaucaucuaauaaaucuuuuuacuugaaaauucaaaagcuguaaaguugcuaacguauagacuccuuauugcagguugauuuugaaagaauaacuugccaagggaaggaaaacuuaaagugaacaucucaagggucgaauacacuuugacccaagucauugcuccagaauugucauauccauuguguuaucuugcagaugagauagagcuugagauauauaucugacugugcacaucauaaugugccaguuagauuacucugcacuaucaaagcuaaaagaaucauacuugaucacaacucauucaguacaugucaugaugaguccagugauugacaaugaauuauaauguauuuauuuuagugcuuuaauuugauguauuuugcuaaugguaaaaugaacugucucuuaaagauaaaaugcugcucauugaaaaauaaaauaaaagaauugaccucacugacaacaucauguggaagaguggaucucugaagaccuguccugucugaguuacuugaucacuaaaucucaaguaggggagaugcuaaguuccugaggcccagcugugugguccaagugaaugagggacaugggcaggccuggcagucagcagcaccagagggaaauaaccugcagauacuccuaggauucuccugagacaaggccauuaguaacucugagggagacuacaguccuaccauggugaaggugaggaccaaugaccccagaccaggaaggucacauuggcagcacuaucagagggcaguggaagaugcagcaauagggguaacuaugacuacugugucucagauaacaguuacuggggaugguugccaugccucucuaaccugucccuauaacuaacaucuaaauaucgagcuuccaguucccuggauuaauguauucaguucuuuauuaauuuaaauuuuuauuguuguuaaucugugaaaaucguuuccuuuauuggcagcacuaucagagggcaguggaagaugcagcaguaaggguaaccaugacuacugugucucagauaacaguuacuggggaugguugucaugccucucuaauucagugagcugggcaggccacucaggaagcauuuugcuuggggugaccugaguucagauaccaacacccaugugaacuaccugcuacuccagauccagaggaucugacacccucuucucugcugugucacuugcacacauauggaauguauuuucugucacacauaaaaacauacauaugaaaauggagacuaaagcugugggugguggcgcacgccuuuaaucccagcacucgggaggcagaggcaaguggauuucugaguucgaggccagccuggucuacaaagugaguuccaggacagccaggacuauacagagaaacccugucucaaaaaaaaaaaaaaaaauggagacugacauguguugaaacgugcuaauaucuuauaaagcaaaucaagccaauuuauguguauaauagaacucauacacuuuuuaaauauguuauauuguauuuuuuaagguuuucauuucauaaaugugguacacacuuaacaucuaaucaucaaucauaggagaccacaugguuucuacguuauccuaacauguacccuuuuuucuuaacauaaaagaguuagguagcuuuaguuaucaacccuauuuauuccaaauuugaagugucagaaugcuuaaucucuucaauguguuggaagagccuccgcucccaguccaucucccacuauugucaaaggagagaaccugaaugaacagggugagugcuggccacugauuuuguaauuuuuauucugauuacaaucuugcaguucuuaauuuaaaugaccaugcuagguucgcaggucucuuuuuguguuucuuuuuuucaguguugccaucuaugguguaggguucauuaauaauaaucuuauuauauuguuauuucucuagggaaugauaaaccuuaaccucuuuugucuucugauaacuuacuguauuauaagaucuuugaguuuuuguugguuugggaauuucuuauggaaaaacaauuuuaguuuucucuuuuuaacccaaaaggauugccucucucauuucuuggaaaaucuguguuuuccaguucuuacaguaaucaauguuuggauucuuaauacuuaagugacugauuaaguuugggauucuuaaauuuuucucauauauuauuguccccaucuuaauuucuuaaauugucagcauuucagagccuacaaucauuugagggaacuacaauugaggaggugccccaaucagaauggcucuuugcuaacuuugugagagauuguggugauugacaauugucuagugaaggcucauccacugaguggggaugaaucccuaaggaggugggccuaggcuggaugagccagcuagcugagcaugagacaguggccaagggagcgagcaggccaggaaacaauguuugcccaugguuuuugcuuuuucuuuugaacuugaguuucuauuacaagcuuccuaaauaaugugauugggaagaaccaaccaaaugaaccuguuuguuccuugagacacauuggcuuuuagcacuucaucacaacaguucuaacaugcaagugagaaagauaaaauggaaagcaaaauguguuugcuuaggugcaacuccuuuuugaaaugagauuuaagugucuacagacuuaauccauuuccucucucuguauauucuucuuugcuugaaacucauccuucauuuuccaucucauguucuuccuuccugucaugccuuccccauaauagauucuguccuugaaucacauaaaauggaauagaaguaauagcuagcuauucagugcuaagcuguuuugcuuaguuaauguuuucauaguuuaaaauuauuuauuuuuauugucagaugggucuguaguguacauguuuuuauauggcaagcaugugcuuuugugcugagcuuugaccacaucuugauuuuucaaauucuggaugcauuaucauucucuuucccaggaugguacuacucaugaugauaauacugcugacccuucucagucauuggauggcaggugcugaccuucuuuuucccuuauguguuuguugugacuuauguuagguggacugugagucuuuugccuguaugcaugaauauaaacuucaugugugcccaguccuuacaguagucagagaugaccugagaccuccuguaagaggaagaaucgauagcugugggucccugaaaauacaggcaggcacuugagcucacauauuuguugggccagcaagagcuucucauguaguguguagccuuuuaacuaccucuucuucuuuuuguuuuuuuggauuuuguuugguuuuucgagacaggguuucucuguauagcccuggcuguccuggaacucacuuuguagaccaggcuggccucgaacucagaaauccuccugccucugcuucccaagugcugggauuaaaggcgugcaucaccaccagcuagcaacuaccucuucuuaagcuccacacaggcauacuaccagccccaacucugguucccuucgcuccauggauuaaaauuacacacaaacacacacacacacacacucuaauauuuuuacccugucuuauggcucaguggcugggcuuuucccugccucuggcagcuauuguguucuuuuuaguacuugcucaacagucuaaaucuuucauuagcuuauuugguguuaccuucuccuugcuccacaucuaaaaucugaccucagccuaguugcccugguuccuucuccuugcucaacacccuaaaucugcucucaguuuaguugcauuucuaaacugccaacugggaaaguguccagugucuucuccaguugggaucucaccuggcuggugacucucucucccucccaagccuggccaaucucccuuuccugcuuccugccucuuuuucccuccccuuuaggaaccuagaaauccugccucuuccauccucccauuggcugcucgacucuuuauugaugguucaagugccaauuggagaaaaggaccuucagaguuuacaggccaaaucccagucagagcaucagaaccaugcccuacacugcacuucugagcuaucucuacugcccuauguuguuuaccucuaaucaacauuaacauuacaaguauuuucuucuguccaauuauaacuguuuaaacauauauuccuuuuugauaguaucuuauuaauguuauaguuugaauugguguaccucagguuucuggaagaugaauucagaacuagauuguauguaucacucuauuaagaauuuaacuaaaaaccuaugaguucuuucuaacuuucugguuagguugaugaacucuggcaagggacaguucguacuuugaaccuuugucuguccuagaacuuacacuggcguccaacucaaugugauacuucugccucuguucccugacugcaguguuaacaacauaagguaguaggcccagcaugcuuacugauuuuuacguuuaguaauuguuaauguuacuacaauuucuuugaugugugguaagcacuauugaucuuguagagcuugucuccucuuuauaucuguaacugacauuucucuagaaaggcuacauccuauucaaagggcugagaaaugacagaggugaacuucauuauuaaguuaccuucuaauaugacuugguaguuaaaguacaacuucagugucaguaaauaaguggaguaggccccagaguuauaugaacacauugccuaugaagaauagaugcccgaugucucuauuguucuuucuuuuguacacguuuaugggaugcucuagaaugcagugacuuaugaggacgugcaugugaacuucacucgagaggagugggcucugcuggauccuucucagaagaagcucuacaaagaugugaugcuggagaccuacaggaaccucaacgcuauagguaagacuaugaauucccuuuccuguuuuaaaacuggaaaaaaguuucuuucuuuugaugcacaucuguaauuucaauagagauggacgaagaauuuugugaauaaaucauccauaauucuaagguucauuaaagauaguaacuuauauuuuaccuaauuuccacacauacauuuccuguuacucuauuuuaggauuuaauugggacgagaaacauauucaagaacauuguccaaguucuagaagacacagaagguaauuuucuuucuuucuuuuuuauuuauuuuuacuuuuauuuuuauuagauauuuucuuuauuuacauuucaaauguuauccccuuuccuaguuuccccugaaaaucccuuauuccuucuccccuucuccucccccuguucccuauugcaacuacuccugcuuccugucccugguguucccuuauaauggagcauagaaccuucacaagagcaaggaccucuccucccauugaugacugacuaggccauccucugcuacauaugcagcuagagccaugaguuccaccaucuguuuucuuugauuggugguuuagucucagggagcucuagggguacucguuaguucauauuguuguucauauuguaugggacugcaaaccaguucagcuccuuagguacuuucucuagcuccuucauuaggaaccccguucucuguccaauggauggcugugaacaucaacuucuauauuugucaggcacuggcagagccucucagaagacagcuauuucagccuccugacagcaaacucuuguuaacaucugcaauaguguuuggguuuggugguuguuucugggauggauccccagguuggguagucucuggauggucauuccuucagucccugcucugaauauugucuuuguaacuccuucaauggguauuuuuaccccuucuaauaaggaucagaguauccacacuuuggucuuucuucuucuugaguuucauguguuuugcaaauuauaucuuggguauucugagcuucugggcuaauauccacuuaucagugagugcauagcaugugugugcuuuugucauuggguuaccucacuuaggauaauauccuccagaucaguccauuugucuaagaauuucauaauuucauuguuuuuaauugcuguguauuccauucuguaaauguaccacauuuucuguauccauuccucuguugggagacaucuggguucuuuucagcuucuggcuauuacaaauaaggcugcuaugaacauaguggagccuguguccuuauuacaaguuggagcauauucuggguauaugcccaggagugguauugcaugaucuuccaguaguacuauguccaauuuucugaagaacugccaaagugauauccagagugguugucccagcuuucaaucccaccagcaauugaggaguguuucucuuucuccacaucuucaccagcaucuaccgucaccuguguuuuugauuuuggguauucugacugguaugagauggaaucccaggguuguuuugauuugcauuucccugauuauuaaggguguuaaauauuuuuuuagguguuucucagccacucauuauucuuuguuuaucucuguaccccguuuucaauaguguuauuugguuuucuggagucuuacuuauugaguucuuuguguauauuggauauuaucccuguguuggauuuaggauugguaaagaucuuuuccuaaucucuugguugcuuuuuggucuuauugauaguguccuuugccuuacagaagcuuugcaauuuuaugaagucccauuuguugauucuugaucuuagagcagaagacauugcuguucuguucaggaaguuuugcccggugcccauaucuucgaggcucuuucccacuuucuccucuauaaguuucagcaugucugguuuuauguggaguuccuugauccacuuagacuugagcuuuguacaaggagauaaaaauggaucaauuugcauucuucuacaugcuaaccaccauuugagccagcacuauuuguugaaaaugcuggguuuuuuucauuggaugguuuuagcuccuuugucaaagaucaagugaccauagguguguggauucuuuucugggucuucaguucuauuccauugaucuaccugucuuucacuguacccuuaucaugcaguuuuuaucacaguuguucuucaguacagcuugaggucaggcauggugauuccaccagagguucuuuuauuguugagaauaguuuuugauauccuagguuuuuuuguuauucccgaugaauuugcaaauugcacuuucuaacucugugaagaauugaguuggaauuuugaugggaauuguuuguuuugggucuguagauugcuuucagaaggauagccauuuuuacuuuauuacuccugccaauccacgagcaugggagaucuuuccaucuucugagaucuucuuugauuucuuucuucaaagucuugaaguucuuaucauacagaucuuucacuugcuuaguuagagccauaccaagguauuuuuuauuauuugugauuauuuugaaagguguuguuucccuaauuuccuucucagccuguuuauccuuuguguagagaaaggccacugauuuguuugaguuaauuuuauauccagcuacugcacucaaguucuuuaucagcugaaggaguucucugguauccagcuacugcacucaaguucuuuaucagcugaaggaguucucugguggaauuuuuggggucacuuauauauacuaucauaucaucugcaaagagugauauuuuaaauucuuucuuucuaauuuguaucccuuugauccacuuuuguugucuaauugcuauggguaggacuuugaguacuauauugaauagguggggagagaaugggcagccuugucuagucccugauuuuagugggauugcuucaacuuucucugcauuuaguuugauguuggcuacuguuugcuguauauugcuuuuauuauauuuagguaucguccuugaauuccugaucuuuccaagacuuuucucaugaauggguguuggauuuugucaaaugcuuucucagcauauaaugagaugaucauguguuuuuuuuuucuuucaguuuuuuuuguauaguggauuauguugauggauuucuguauauugaaccaaccuuucaucccugggaugaauccuacuugaucaugaugaaugauuguuuugauguguucuaggauuugguuugcaagaauuuuauugaguauuuucucauugauauucaugagggaaauuguucugaaguucucuuucuuuguugggucuuugugugguuuagguaucagaguaauuguggcuucauagaauggagaagguaauuuucaugugcaagcucauacaaauaugccucugaagaaauuuuaaggugugcugaagguuuuaaagaaaagcagcaguguaaauaaauacaacuauaauuuuauugguuauucuuacauucuaacaaaaccauaguccucaguguccuguaccugauuuguuuuugcaaggcauuccuuuaaaguagaggacauggaauuucauaaauucauucugauaaguggauauuagcccaaaaccuaggauacccaagauauaagauacaauuuccuaaacacaugaaacucaagaaaaaugaagacugaaguguggacacuaugccccuccuuagaagugggaacaaaacauccuuggaaggaguugcagagacaaaguuuggagcugagaugaaagaauggaccauguagagacugccauauucagggauccaccccauaaucagcuuccaaacgcugacaccauugcauacacuagcaagauuuugcugaaaggacccagauauagcugucucgugugagauuaugcuggggccuagcaaacacagaaguggaugcucacacauggauggaucacugggcucccaauggaggagcuagagaaaguacccaaggagcuaaagggaucugcaacccuauagguggaacaacauuaugaacuaaccaguaccccagagcucuugacucuagcugcauauguaucaaaagauggccuagucggccaucacuggcaagagaggcccauuggacaugcaaacuuuauaugccccaguacaggggaaugccagggccaaaaagggggaguggguggguaggggaguggggguggguggguaugggggacuuuugauauagcauuggacauguaaaugagcuaaauaccuaauaaaaaaugaaaaaaaaauaaaaaaaaauaaaguagaggacauggaaauagugccuuaguguauaucaucauuugaaauauagccauauuagagcuacacuguacagcuggcaauccauuucuucucauuauguaaaagcuauacacauuaaaugguaauacauauaggaccaaaaucuucuaagaagcaaauagucuauaguaaagauauuguuacucguauauuuguaguaacauugcuaaguugauugagacgagcagcuuaugggagguaagaaugauguuguaugguaaccuuagucccuagaucacauaucacugaggaacaaaauguuauacucagugaacgaaauguuaaaacuuuuuaguuguucguuguccuuuuauagaugugucauguauccuaauggauaccugccacguguccuuaagggauauugaaugaaacaguguacccccucugucucccagaacaauuagaagacaugcauuugcuugcaguuaggguagacuuuuugaaugcgauacaaguuucauaucauugguuuuccagcuucaaugacaauacaucagcaaccucauucuguaaaaaauucucuugaguccuaggaauguggaaaugcuccucuuucuccugauucacuuugcaaauauagaaugacccacagacuaggauaaauuggaauacacuuaugugguaaaggucugaguuguuccacuuuuguucaaauaugggaaaacccuuuaauagaaacagaauauauauagcugaaccauguaauacaugcucauuccuucucagguauccuugaagaugaaaaccaacccauaaugaugggguaacagcaugaauauaagcaaagugauaaaaaucuuaagaucugauuccucuuuauauuuagacaaauaguaccauuaaaucauacagaugaaaguauucaucaguuugauaaagcuuucacaugugccaauuuuuuucucaggcaugaaagaagucagagugcagagaaagcgucugaauauacucaaugugauaaaaucuuuuuuuuaugcucacagucaugcucaaaggcaugaaagaauucauacagaaaugaacccccuuggaauuauucaauuuguugaaaccuuugcucaacaucgucuccaacuucauaaagagcacaaacuggaaagaaacucuaugaauggaagcaauguaguaaagccuuugaagaucaagucaucuuaaaagcuaugaaggaauucauacgggagagaaaccuuaugaaugucaucagugugaaaaagccuuuucaagucacaguaaucuccuacaaccuaaacggacacauacuggagagaaaugcuaugaaugugaucugugugguaaagccuuuucacaacauagucggcuuaaaaggcauggaagaauucauacuggagagaaacccuacagauguaauaacugugagaaagccuuuucacaacaaauucaccuccagucacauagaagaauucauacuggagagaaacccuacaaauauaauaaaugugagaaagccauuuuacaacauuauaaccuccaaagucauaaaagaauacauauuggauagaaacccaaugaauguggucugugugugaaagccuguauaagucaaugguaucuucaaaagcauaaaaaaaaauucauacuguagagaaagcuuaugaacauauauaauaugguaaaaucuacaaauauccauagucuuaaucaucaugcacauauuuguauuggcaagaaauccucugaauauuaacugugugauaaaaccuauuucaacacacuuaucuccuaaugcaucaaugagcacauacuggggagacagaggugugaggaacuuaugaauguauacaaugugguaaaaguccaugcugcagggaagcccuacaaauguagucauucugauaaaauuuugcacuucacaguauguuucuguaagaggaaagucauuagcuuauacuaaaucuguuaauguuugcaugucacaguaauuuuucaacuucuaagaacucauaaguagggcagucuaugacucugauggccuugguacgaucuuuagccaguccacuuacauuaaguuacacaaaauuauuuauuccugagaaaaucucuagcaagugucaacuaucugcucaaauaugaugaugugucuuuuuuuuuuuaacauguaaauucauagguucaaaagcccuuucaauuucauugauaagguacugguuuaaauuucacagcucauuaaauuucacaguccauuaaauaacucauucaugugucaaacuuugggugcauauuuguguguuuucuguuaauaugauaaaacauuuuaaguacuguagaaaaaucccaaaccaugguuuccaccccaucuuuggccauuuguuuuucagguaaaagacauacagccuuuauacuaagccuugaucagcacaugagcuuggcagauauuuauccucuaugcuauuaugucuauuucccagccaaugauuucauccuagaauuugccuugcuucaucuaggcuacgcuuugucuguggcuaugugugauugugugaaugcugauuuccaagaaaauuaagcuguuguauagcagaaaauauaggaagauguaaaacccugaccugguuucagggaauaaacuuuucuuaauugcuuggccaugugucuaggcauguaaauauuuuacaguguuuuacaucaucuugaugucagaaaauugaaaacacuuauacaagagaaaaacccuauguauguugaugaucucauuauagacuguagacaccacaguuguuuuugauauuaaggaaaaaacucuguuucauuucuucuucaucauggccuugaaagaaguaaauuauuucccauguucagacaaguguuuuaguagagaucaccaauugugguggugguuuuuauuuucaaacuuuugggauagauauugacguuuguucuaugacuuucgaauccauuuacagguguuuauuaggggauccuugaguucauucugagacuuaaguucaccuuuauuucaacuuguugaaagguauuuuucugcugcaaugaauuuagugugauacuccucuucuaaguggcccauucuuuaaauauaaggaucugugugauuacacauuuccaguaagguugcugcuaaaagcauggugagcucuguuuuguguuucauuuuauucacaaacuucuuugagauaugguuguuauccagccuggagaugugguugauccagugaauauuaaauuuaccaguagagggcgcuccuugcagauauaucuuaucuacuuucauagguaauucaucucagaggggugagaaacaggccauugguuuuaacuguguguuugugauguuuccuauaugcuuggccuggggcaugucauuguuggagcuguggccuuguagguaugugcuuuaauacccuuguccuagcugccugggagccaguauucugcuggcagucuucagaugaagauggaaaacccucaggucccucugcaccaugcuucccuggacagagcuaugcuccuaccuugacgauaauugacugaaccuuugaaacugaaagccagccccaauuagaucuuugcuguauaagaguugcuuuguuaguggugucuguucaguaaaaccguaacuaaggaguaaaauccuaacuaacacauuguauguucacauaucuuacacugcauuuagauguuuacauugcauuuaggggcaagauuaaacaguaccuucuuaaugccauucucucugcaggggaauggccaucuuuuuuuuucccaagauuuauuuauuuauuacauguaaguacaauguaguuguagagggcaucagauauucuuacugaugguugugagccacaugugguugcugggguuugaauucaggaccuucagaaguucuuguaacugcugagccaucucuccagcccugccuucuccuuuucaaaguuaguacagcuacguagauuuuuuuuuagcauauuugccuuuuuaagacucaacaauugauuucauuuuuuaaaaaaauuauuuauuuucagcuaaaaucccaguaucagccccucuucuccaaccacccucucgaagcuccucuccacauucccuuuugagauggaggaaccagauccucaacucugccgccuccucaaccccucuacccugaacacaucauucucuacaggacuaggcacaucuucucacugaggccagauaugacagcccaguuaggguaauggaauccacaggcaggcaucaaaucaaagacagccaccacuauaguuguuggggaauccacauuaaaaccaauauguaccucuguuacauauaugagaaggagccuaguuccaguucaugcucacaguuuggaugguuguucagucucugggauccaucaagauuccaggguaguagauucuauuggucuuccuauggauucccuauuuucuuuggaucccucaaucuuuuccucaacucuucuaaacacaucucugcauguauuucuguuagcuguucauuagagucucucagagaagagguuugcuaguauccugucagcuagcauaacaugauaugauuaauauugugagggauugguucuuguccauuggaugguucucaauuugggccaguuaugauugaccacuucuuccuucuuugcucucuucucccuauuugucuuauagacagggcagauuuuauaacgaaguuuguguguguguguguguguguguguguguguguguguguguagagagagagagagagagacagagagacagacagagagacagagauagacagagagaguagagaauagaguuuauucagcacaggggaggggagauaagaagguaguagagauagacaagggcagagagagaacagaggaguagaggcuggccaugagcacuggagagagauggggagaggaauggggugaaagggggagcaggagggagaggacagagcuagagcaagaagucaagaguagauggaagauguuuuugaaugagguaauguccuuauuucuccacugggagaccugcuugucuacaggaaguggccaauucaugaucuacaucuuacaguccuaggaguuuuagcuagaggcuugcaauagucaucuugggggcucccccugucugcgguuccagcagaaccuagcgaugucuuuuggaucccuauaccaccacuuuccauuaucuccucugcuuccccugcaucuguacccgaauccucccacccacagcuuccuucugaauuucuuuuuccacccaguuugaaaucuuaugaggaacauucaaucagccuucaugggcccucugaauuaucccggugcuuuagaucugugaaguuuagugugauuauccuauacuuuaucuguaauauccacuuauaaaucagggcauaacauucauguauuuuugagucugugcuacugcaccuaggaugacauuuucuuauuucucccaucugccugcaugaugcccuuguuuuuaaugccugaguguuccucguguaauggaauggcuuguccuuuauccauucuucaggucagugacaugaaagguuuuuuugcaguuuauaucugguaugaauaaaccugcucuuaacauaguugagaaaguguccugguggagugggggagaauauuuuggguauaugcccaagagugauauuagcuggcucuugagguaaaauauuucccacuuuucuuggaagcugacaaaaugauuuccaaagugguucuacaaguuugcagcaauaggagaguguuucccuggcuccacauuuuuguuuguuuguuuguuuguuuguuuguuuuuuguuuuuuucaagacuggguuucucuguguagcccuggcuguccuggaccucacuuuuuaaaccaggcuggccucgaacucagaaauccagcugccucuaccucuggagugcugggauuaaaagcgugugccaccacgcccggucuggcuccacauucuuuccagcaugugcauuuuuugauguuagcaauuccaguggauguaagauggacccucauaguguugauuugaacuucccugaugaagaaagacuuugaacauuucuuuaauuauuccuuggccacucacaauuccucuguugagaauucucugauaagcacuguacccuauacuuuaagugggauauuuggguuguuggugucuaaccucuugaguucuuuagaaauuugaauauuaucccucugccagaugaaggauuauugaagauuaugauccaguguguaggcugcuguuugauccuacugacaguguccuuugccuuacagaaguuccgcuguuuuguuuuuuuguuuuauguuuuuuaaagauauauuuauuuauuuuauguauaugaguacacuauaguuaucuucagacacaccagaagagggcaucagaucccauuacagaugguugugagccaccaugugguugcugggaauuguacugaggacaucuggaaaagcagucagugcucuuaaccacugagccaucucuccagcccaaaaauguauguaugauuugacaauucaugcuccuucauauccccauuaguuauccauuugguacuuccucuugaauuacugacuucugauagaauuaucuagagaugcuagauauugcaagagcaaugagauguauuauuuuguuuuguguuguaugugugugaugugauaaugggccuuuaggcccccauggauauguggagacuggaagaugauuuugugugaucacauuuggccgucuuuauacguugaucaauaucaguuugccaaccuugcacaccagaaguguuucgcacugagccuucucauagaugcucaaauaagauuaggugaauggucccuccaucaggacuuaguuauuccaugggucuaggaggaccgaggccuguaagaaaaaccagcagagaaagggaagcgagaccaagcaaagacuucaaggucuguuuaauggaggcuaagaaccugguuauaagaacaaagagaaaaaauaggaaggugucaaggggguauaauaaaauacagagaaagggauggacaucuggggcagaugcugauugcaggcuucaaacaucuugcagcuucucuuggaaugucggcccuaaaacaguuccgggcagccuucaaacauccugcaguuuaucuuggagugucagcccugacuaaacagucccaggcagccaucaaacaucuuuuagcuuaccuuggagugccauaaacagucccaggcaccaaauggagacauggaggaggaggugaagcuggcagugccaggcgccagguggagacaaugaaggagggggugacauaacucccuucaaaggaucagccggaucuucagggugagaguuguugagggucuaguuucccacaguuuggucuuucacagugaaccaaacauuuaccagaaaacauugucuuccuuuuagauuguaaacauauuguccuauaaggauagaggaaaacaguacaaggugauaacacauuuuaucugcaaaagaaaaugauguacugcuaaguccuuuuaaaaauguguucuuuuauucuuaggugggaacccuucuuuagaacacuuuucucagcaccacaaaugaaugccagacaacugucucaguggguagagcuaguugcuucuacaccugaugaccugaguucagugucugggagacccauauuauccacaauuuuuucuccuuccuuucuuucucuuucuuucuuucuuucuuucuuucuuucuuucuuucuuucuuucuuuuuuauuuuauugguuuuucgagacagaguuucucuguauagaccuggcuguccuggaacucauuuuguagaccaggcuggccucgaacucagaaaucugccugccucugccucccaagugcugggauuaaaggcgugcaccaccucccagcugcuuauuucuauacuuagguucuggcuuaugcaugucacacaucagcaguauauaaacaaaauaaggaacaacggugugaguugccgccaaaaccucuuuggguuguaccucuagaacucacauauuggaaguagauaauagacagcuguaaggugcuuucucacugcuaccuacacccauggcacagguguauauccacaaacacaguugaaacaauuuuccauggaagaaauuaacaaagcaaaaaaagaacaaacccaguuuugaaaacauaugaaaugauuugccaguuuaaauuauuacuauuaaauuucaguagguauuacugaacaucaaaaccaugagguuuacucuuuaguccuuaccuugucauucauuguuugguucaaauguuaagucauugaaaaaaauaucucagcucaucuuagaggugcauaccuguaaaccuauuacauuagagauggugguaggccugucucugaguuuuaggccagggucguguacauagugaguucuuagacauguuuuauagugacauucuaucucaaaaaaaaaaauauuaaaagaaagagaaaagaaaaaucgacaaauuucauuuuauugaaauuuuucuaauggaaucuguauguuuucuggacucauuuggcagcaguaugagcccacaugcacaccugucaaugcaugucagguguaccuuggauguaauuuaugcuuuuuguaaugagagaagaguaccaugcauguaugaacauugacuagcugaauuggguccuauucugguuccuuaaugccuguaaaacauucauuucugaauucugagugauggugacucuaggugacaucaaggcuggugucaggggacccggggccucaaaacagaggucacucuagaacuguggaagucaggcauuucgaaagaaccuuagcauauggauugggggugguugaggcuuugauuuuaaaagaaagaggaagaaaaggcccucuggagugcaaugcuugggguguagcugaacaccagcugccuucuauugugcucucuguauccacucagcuguggugggucaguccuuuccuguucuuccccucuuuuuaucaaggcaacuacacagaucaguggaugauagcaucuugcauaccccauggggcgucuccaauuaggccauaaagccucucagccccuaccccauuaucccuguauccugcagggaugguaggaauuggauacucagcucucccuuugguugugguguaguguuacaguggacaccaggaauuuugaauuuuccuuggaugacuuuucccucuaguuaaggacuucuguguauaauaaauauucauuuguuaacuaaaugcuuuucaggagagcauggagcuaaaauucuguucagaacuuagaaaagggagaaaauucuguuucaaauuagucacacagaacaaauauuguauucuguuuucaauucucauuagaaauuuccuuuuuuauuuuauucacuuuuauuuuuguuuuuuguuuguuugguugguugguugguuugguuuuuugagacuggguuuaucuguauugcccuggcuguccuggaacucacuuuguagaccaggcuggccuggaacucagaaaucugccugccucugccuccugagugcugggauuaaaggcaugcgccaccacgccuggcuuuauuguuuuauuuuauuuuuuuuuaauuagguauuuagcucauuuacauuuccaaugcuauaccaaaagucccucauacccacccacccccacuccccuacccacccacucccccuuuuuggcccuggcgauccccuguacugggggauauaaaguuugcauuaccaaugggccucucuuuccagugauggccgacuaggccaucuuuugauacauaugcagcuagagucaagagcuccgggguacugguuaguucauaauguuguuccaccuauagcguugcagaucccuuuagcuccuuggguacuuucucuagcuccuccauugggagcccugugauccauccauuagcugacugugagcauccacuacuguguuugcuaggccccggcauaaucucacaagagacagcuacaucuggguccauucgaaaaaaucuugcuaguguaugcaauggugucagcauuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucaugaauucauucuuuuuaauagcugaguaguacuccauuguguagauguaccacauuuucuguauccauuccucuguugaggggcaucuagguccuuuccagcuucuggcuauuauaaauaaggcugcuaugaacauaguggagcauguguccuucuuaccaguuggggcaucuucuggauauaugcccaggagagguauugcuggauccuccaguaguacuauguccaauuuucugaggaaccgccagacugauuuccagagugguuguacaagccugcaaucccaccaacaauggaggaguguuccucuuucuccacauccacgccagcaccugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuuuuugaguuuuuuauacauuggauauuaguccccuaucugauuuaggauagguaaagauccuuucccaaucuguugguggucuuuuugucuuauugacggugucuuuugccuugcagaaacuuuggaguuucauuaggucccauuugucaauucucgcucuuacagcacaagccauugcuguucuguucaggaaauuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguuuugccagcaccaauuguugaaaauguugucuuucuuccacuggaugguuuuagcucccuugucgaagaucaagugaccauagguguguggguucauuucugggucuucaauucuguuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaacugaguuggaauuuugauggggauugcauugaaucuuuauuguuuuauuuuaaagcauauucuuacuaugaaccccuggauggcuuggaacuguacuaucuguucuaggacaucagagaauucugcccaccuugccucuagauuaccagcauuauaggugggcaugucacagcuagauaaaucaguccuuuuaaguggcuuaauaaggaugaguggcugaaucucucugguuaggguggcuaggacauagucuguggucuuagcucuacuaacagaagucaaucaugaaaugcagcccuccugccuuuaacuccacugucuuucaaauuaagagcacuauuguuuugcuuuaucauaacaucuguuauaagucaccaaaggacuagggcagauucuguccuuauucuauagauggugaaacugagccuucgaguguuaagucaauacugaauagauauguggaacuucucuucuuacucaugauguguuuccaaugacuuaaucaaugaaauaaaagcaaccucagccagacaugauggcccaggccuguaaucacagugcuugaaaaguggagacagaaagggacaggauaaaagagcugauaaaguucccucauuugacaguaccuaauauuaucaaugaacacugagguaaucauuuuuagaugcuugauaaguauccugcugguccauuuuuggguucaacaccaggcauucaagaaacugcauaaaaauugaauuuacugaaaaaucaaauuaccguaguuauacuaguccuaacaaaaauaguaucuagguacugauugugguugugccuaauaagacaaguuuuuuuuuuuuuuuucaaguuuuaagaugauccuccugagagacuaggccugaguaauacuuggugugcucuaauacacuucccuccucucuggagcacauaaucaucaagccuuuuccacuuuuaaaacuauauuuuuccauuauacuuacagcauucccaccaucucucuucugucucugaauuucuucauagacaauuuauuguuuuucaugagggauauuuuccuugaacaauaguuacuguuugaaugugaccuaugauuuccugcaggacuucucaacuaugaagcaaauugauggaugaacaggaauauagguguggaauagaauguacacaugauguacccuguuccuugauugaagaggaagacaugcucugggagacugcaagaauuucuucauaacuacaaaguuuccaaacucaguccaugucuaccccuauuguggcugugcagagcucaaugggccugugcugucugaauccuuucaucucucaucauccaguagcugugcugcuauuguccugagacccagcugggugacccuagauagugauggacucugggcagagcuaucaaucaauagcaacaguaggaggaaccuugugggauccuucuaggauucuccauugauguagcacuagugagcugugggguagacaacaagcaauucucuacugaguguggcagccacuguucagaacaguaggacaagaggagcagcuuuuaaaggaacugcaagcacauaauggaguuggccuaaaagugagacuaugugugcuucagagacagagguggaagacuagggaugccuaaguauauuguagucaggccauuucauuaucugaagaagcugaaaaauaagcuucaugauauuauauuuuucugcuggauuuggcauugcuuuggucuguuccaucgucgauaugcuuugauucucuguggaauaauauuguuuauucuuagcauuguauguuggaaacauaacacucucauugaugguccuggaagagugugguuggguaagagacagaauucacucucuaggcauugaagcaagauguggcguuuaaaugggaauguugcccuuugcuccuauguugcauacuuauuuuccaguaccuggaagucuuucagaggaguaggggaaaaguauaggauaaucauuguggagaauuugggugacagcuaccucuauaucuaaggugggagagguuuaccaccacaaaaagcaaaaagcucacuugcagcuuuuggauucaagguagguacuuuaucuacuucauagagaagagguccuaucuuauuuucauccuaaucugucauuugugcuccccaaguccuauugcuuauuaaagaggggaacucuuaaguaggagaauuagccccaggcaacgaguucccuguuuggcuaaucaaugcaagucagucaguccuugaaucauacacauaaccaauaaaaaugcagucagcaaguuuuauuuauguauuugagucuucauagucacacauguauguaacaagggugaaauuggcagggaagaauuuaggauggagaggggagaaguaaggggauaaauuguugaaggauauuugaauaugguuaauagaaaaccuaauugguauugaaauauccaagcuugggaagauacugccuuuucagaugcaccuaggugugucuuggaaagguguauuuugggugugccucugacagccaaagccucaauacaagagaaugcuaaggguuggaaagugccugcccauuuugaggcaaguuacuugggaggggucuugaggucuuugcugggugacuuggggcaaagucagcuuggauggcauugauaugcucuucuguaaaggugagaaguuucagcucccuacagacuugacccggguccucgcaccacuaccucccccuugagcugaccugcugcagccugccaaggauguaguaagggggauagagccugguuuuguagcaauaagacauuugagcuuucucuuggugggcauucucuuuggacucugucucuaucucuugacuuagaauagcauuguggaagcagagugguaagaaauagcaggacauagaugaggcaggauuugaagaaagagagcaaaggagcccuccuggguuucagugagcucaagagaaagguagacuauguaaaaaugggcauagacaaagagauuucugagcaucuagcaguuuaauuguacauucaagcuuguaaauaaauauauugcauauaguuaaggaaaugaaguuagcucacuaggcuagcauguuuuaaccaagccuucuaccucauuugacauuauugggaauauauauuauaaaauguaggcagggcggggcgggaggcuagguagggugacaacaggggcguccggucuucucugucucuagaaagcaggcaaccggagggaagaugguuuacaucuugaauggucagguguuggacagcauuaaucagucccuauggagagugucuuuccuaacagacuucuggggaauagcagaauuugucguuuucuguuucaaaacucugcuucggcaagauguaaagaaaagaagaggcuacgggagcuccucugauuccagauacgaugauagaagagggccaccaggaaacccuccacgaagaauggguaggaucaaucaccuucguggacccagcccuccuccaauggcugguggaugaggaagguaaaugucugcucugagaagcagacaacuagacauacacacguguagaaggaagccaucaagcagugaagagcggcucaugcaggaguagaugguguauguccaaacaaggauugcucuguguccucacagaugaaugaggccaugcuggaaauucccucugcaggaucuggccugacugauacacaguucuauaaauguacauguuugucuacuuaucucuuuuuuguauaguuuacgauaguauuaauauaguuuuaagaaguaaauauuuccagguugcaaaacuugauuguucaucuuuauaugaucauacccaaaaucuuugaucuggaagaaauaaaggccauguauuuaguccuggaaaaaaaaguguaaaaagguaaagguuacaugaagugguguauuaugaucuaauuuaaaugcauaaaaauuaacuuuacaagaaaaaauauaauaaauacagauauaguuaugagcaau

SEQ ID NO: 7085 - RNA, 973 nt, Mus musculus
cagcacaucuucauuacacuauggcagccaaguaauccaucacuucaguuggagugagccuccuaaagccaaccucauugcagaucccaacuucuauguuaucuucugucaucugcccuuccaagcuuuccuuuaggguuaagauggcuguaugaauggcauccuccaguucuaggucuucauuauaucuuuucucaaggaaaguuuucccguucacauaguucuuuccuguugcuguggccuuccaggcaaaguaagcuccagauggaucucacugaaauaaauauggccgucgcucauuccacccacaggugaguaaagaaacaccacauggaggaacaccaccugacugcguguacuccugcaucacaggugcuacucucuguaccagcugggcuguaggaaaggguucuugguaaacaagacaguauugcugagcaaguuucgagcucuguguacaaguacucuguaaucgggaaccaugccacuauacaccacaccgauguguuugguaaugggcuccaccuugugaacacuccuuucaucauacaggauggauuucugcuuuuucucaguugcuaauacuacgccauuugcagcuuuaauucccacugaaggggccccuccagcuacagcagccaaagcauauucaaucuggacaagcuuaccagaugggcugaauguagucagcgagaagcuguaaucgcgcugugccaucuuuacccggaaagucggaaaacaucuacauuguucuuucuaugggguuacaaucccacucugcucuuccaguccuuccccugaccucacccaccaggguucagagcucacugugaugauuugcugggagcauccacaucugcucucaucaggcacuaucagaaccucccaggaagagccacaccagguuacugucuacaagaguuucuuggcaacagcaacaguguccagugucagaguuuggugucugaugaga

SEQ ID NO: 7086 - RNA, 973 nt, Mus musculus
ucucaucagacaccaaacucugacacuggacacuguugcuguugccaagaaacucuuguagacaguaaccugguguggcucuuccugggagguucugauagugccugaugagagcagauguggaugcucccagcaaaucaucacagugagcucugaacccuggugggugaggucaggggaaggacuggaagagcagagugggauuguaaccccauagaaagaacaauguagauguuuuccgacuuuccggguaaagauggcacagcgcgauuacagcuucucgcugacuacauucagcccaucugguaagcuuguccagauugaauaugcuuuggcugcuguagcuggaggggccccuucagugggaauuaaagcugcaaauggcguaguauuagcaacugagaaaaagcagaaauccauccuguaugaugaaaggaguguucacaagguggagcccauuaccaaacacaucggugugguguauaguggcaugguucccgauuacagaguacuuguacacagagcucgaaacuugcucagcaauacugucuuguuuaccaagaacccuuuccuacagcccagcugguacagagaguagcaccugugaugcaggaguacacgcagucaggugguguuccuccaugugguguuucuuuacucaccuguggguggaaugagcgacggccauauuuauuucagugagauccaucuggagcuuacuuugccuggaaggccacagcaacaggaaagaacuaugugaacgggaaaacuuuccuugagaaaagauauaaugaagaccuagaacuggaggaugccauucauacagccaucuuaacccuaaaggaaagcuuggaagggcagaugacagaagauaacauagaaguugggaucugcaaugagguuggcuuuaggaggcucacuccaacugaagugauggauuacuuggcugccauaguguaaugaagaugugcug

SEQ ID NO: 7087 - RNA, 2098 nt, Mus musculus
aaugaaaacaccaaaaaagaagucacuucugaucaucaagauuugguugugucuuugccugacgagaagcacauugccagugguaggccaaguuaagaaaaauccuuaucgacuuuauaauuacaccuggcugaucaucaacgaggcaggugacauagcuaaugccaccuccaagauugaaggcucuaucccauggcccauccugagaguugaucuuuguaaauuagucuuaggaggucauaaugacuggggaacucacuuagaauuccugccacaagaacaagcuauugacgauccuagacaaguugccuauaccacuccuggaugugcuaguuuaagucgcaggagaacccuugccgguguuuaaaaaagauggggcacauacguuuguccuggccccagucaccggagucgcacucuuaaucauaaauguggcuccgccccugauuauuuuugugcuuccuggggcugugagaccacgggagacaccuauuggaaacccacuucugauugggaccuaauaaagguccggagcaggccagauuaugcugccugugcuaguuccaaccagaccuccaaaggauggugcaacaccuuagagaucuccuuuacugacgcaagaaaaaaaauuuaauugggaauauacacaaggagcugagugggguuuacguaucuauaaaaaugaaaaagauuucggaguaacuuucaaaauccaguuacuuaaaaacaccccaucuuuagggucggcugcuauaggccccaaucucuuuuuacauuccucauauccuagaaagccgaguauuccacagacuauuaccuuaggacuacccaagacuacuauauuccaaccuacuuuaccugcuggaucucccuccuccgcagaauuaauuuuauccuuaguuaaugcaucaauugcuacuauagaugcagcuaaugcuacucaauaugaagaauguuggguguguuuuucuccucaaccucccuuuuaugaagggguggcaacauucggaucagucguuacaauuaaugauuccagcaaacuuggauggcaccccgagagccaugaugggcucacuuuaagucaggugucuggcauaggcuuaugccuuuuggggccuuccauacuuccuccucaggccuuauuagagguuugcauucagacuauuauaguagaggccaccucuagauaucuagcagcaccuaaagguacuuauuuagcauguucuacuggacuuacuacauguauaguuacucagaccuuuuuagaugauagagauuauuguguuguaguucagcuucucccgaagcuaacaguacaccaugcagaagaccuccuccaguuuuagaagagugacacagaucaacccuguaauaagagagagccuauuucugcaguaaccuuagcagugauccuaggcuugggaguugcaggcacaggaacaggcauugcaucuuuagucacuucccagcaacaauauacucagcuucaccuugcuguagacagagauauucaagagcuacagagagguuuaaaaaauuuaaaagauuccuuggucucucugucugaaguaguauuacaaaacaggcgaggucuugauuuaguguuccuuaaagaaggaggguuaugugcagcccucaaggaagaaugucguuuuuacucugacaagacaggcuuaguucaagauaguauagauaaaguuagagcuagucuagaagaaagaaaacgcagcagagaaaaacaagaaucuugguauaaaaauugguuuucuacuucuccuugggucacuaccuugcuucccacacuucugggaccuuucuugggucuucugcugcuuuugucuuuuggccccugggccuuuaaaaaauuaaccaguuuuguuaacucacagauugaagcugcuuuagguaagccgguugcaguccacuaccaucagcuagauauccgagacucagacgaagaagauccuccucccaccgagacagaaacagcgacucgucuccaauuuuccacccuugcugcuaaagcagaguccccuugguuccuuagguuuuggagacaauagggacaaagaagggugaccuccagcucuuguuauag

SEQ ID NO: 7088 - RNA, 13364 nt, Mus musculus
ugugccuuguuccggugcucuguguuccuuuccguuucgagcaggcugaaagcuuggucugauuuguuuuaaucucugcugccaggggccuuagggaauugccagcgaucuacgacguggcgacauggugagcgugugaccacugcccuuaaccggaaggagcaggggucuaagaagcuggagucggggugacgggaugcaggggaccagcccuggccauucuugguuccucuucaggcaguggagggggaagagugucugaggugacaagacuugguuuucagggauguuuaggguugcuguuuaguauuaagacguuugccuaucuuaagucucagucgcguugcagcagaagcugaccugcccgaguuccucugaggcaaggcuggacgcugcgaucucugguauuuagagccuccucuuaaaaagacaggggauuaagugaguagcuuuuguucuaucuccacagaaacugggcugcucuaacuuccagcugcuaguugaagucacaggaagaaaagugggacacuuuuaaacaugucuuuaaucuuuauuuccaaguucuucuaaaaaguuuccuaugaaaguucucuaaggaaagggagugggugauuaaguaaaggagucauugcuagagccuuucccucuuguccagaugccucuugcuugauaagcuugggggaaguuuggagcaauaaacuucucuuaaaccaggagaagagagccacccucacaguagaaaagacuuuuacacaagcaaauauggauaaacucacauaaauucauaauacaaauuauuauacuuuugagcgguuaguuuguuccaauguauguugaauuuucaacuagaggggacuccuuugcagauaugucuaauccacuugcacaguuacuucagcucagaguguugagaagcuguguguuagguuacgucucuccgcagcucacauugcacguaggggugagaucuaacuguaucuucucuuuuuagugcuuuuuguuuuuuguuuuguuuuguuuuuggauuuuuuuugagacaggguuccucuguauaccucuugcuggccuggaacucacucuguagaccagauuggccucgaacucagaaacccgccugccucuuccucccaaaugcugggauuaaaggcgugcgccaccacugccuggccuaacuuuaucuucuuaugucauuaucucugcuagggaauagccugcaauuuuucaaaaucacucuccuuuaccaauaaccagaccaacaccaaauggcuucucaucucucucuuuuauagaagauucugaugcuaggaguauuugcucaaaagcgcauacauccugcuaucuauuauacuuuuaauauuuauuauacauuauauugugauuagugaaucaaagucagcugucugucuguaucagacccuaucucaaacacaggaaauaaucaaaauuguauuugugauaggcuugcagacuccaguuuuucuuucuuuuacaaauuaauauuaagguuaaaauuagauuccaaguuaaaagucaccuuuuuuuuuuuuugugacuuguucuucauuuguaauuuugugauuuccacaucagaaauggauuccaguguuccugguauguucuguuaacugugugauagugaacuaaguuacuaacugaaaaagauuccacuuuuguaagcacaugcuauguaccuaggccuugagcuugacuauaaaagcacuccccugcuuuuuaauaaaccgauuucucuuuauucaauuuacauccugcucacugccuuccucccagucaccccccccccccauaauucuucccccagcucccccuccccuucuccucugaguccaugagccacauuguauuaccuagauuugguaauacaauguauuucguaggacuuauguacuaucuugguuucacgguaaguucaaauuuuuauucagauucuugauugccugguguguggacccaaaaaaugggccagucagauugauugccucacuguucauucuugucuuuuuuuuuuucuaagauuuauuuauuauuauacauaaguacacuguagcugacuuuagacacaccagaagagggcgucagaucucauuacuggugguugugagccaccaugugguuucugggauuugaacucaggaccuucggaagaacagucagugcucuuacuugaugagccaucucgccagcccucacuguucauucucaauauuacauacugucaaagcagucaaguuaucuacuuccuuuuguccugacccuuucugggcugugacuacacuacuuucaaagguccugaacuagaauccugagcauugaagguguauaaugugugccuucaacacacuccaacccuaaggagcaugcuuaugucacucaagaaucacuggccaaucagggcguccaggcaggccaaucaggagaauaggaggguucuucugaguacuuucugccauaauggagguucagcucuaugcuaaccugaaagagcaggggcaugaacauuugaagcuggggaaaugggcacuuuccuugguugggugagaaccaguggucagaugugcugagccaucucuccugccccaaguuaaacaguuuaaaaaguugccuuggaugaaugaauggauggauggaucgauggauggauggaucgauggauggguggauggauggauggguagauggguggguggguggggcagaaccuucaaacagucuuauucugagguuagaaaagaucagcaggcauguucauauuagaacuguaacuacagugcuguuaggugauguuuacaugauauuuucugaauuucuguuuucuguccuuuauguaugggagaguuguggcauggaucuaucuuuuaaaacucuuuucuagaucuuacauuguggacuagaagauaguuuugcucuguaaaucuccaucagccucagugacuugcaauguccugucccccaguaaauuauucaaaguguaaccugggggcugauccuacaaggacuuauugaugacaucauauguggaauucaugcuguuuccugggcugggucuucuuugggcaucagccagaggugauuaagugaucucucccugggaaagauguuaauccacaccagcuguaccugcaggcuuuaaauaauguuucugagacaagcuuuccuagguugagucagguagcauugauuccgcucuguuuuucccuaguacaauaacauuguucuccuauugacuaaaccaacuaaauaccuaagucuaaaucacuaccaccacuguguuuuuaaauuacuugcugaaucauguauguaaucaacuuuuuuauuacaguaagaggaacaggauuugccugacaggaauagcuucugcauucacaccagaagaaaagggaguuuauugcgaucccuacuggggaaacaggguaggcaaucagcugcuggaguucccauuaugaacaagaccugauuauggcagggaagugauuuuuaauuuuggaucauguauuaaucacguucugugaugaagacagucuuuauugauggguguuugauuugugaaugucaguuaagccaaugagcauucaauuugcacguaggguacuguucuacagauacaugugcaaucuucacugacaucauuaggucagcucaagaauugaagcccaggccaucagguguaguugugugugugucaaguuguguaucaaguuacaggugucagcagcuaagaguccacauagagacaaguucaaauaguguuugauuaaugcuauuccugaugugaggauaugggcugcuaguuuugaaugucaguauggcuaugugguuuuuuaguaaaauuuaaguuugaaaaaaaucaauuauugguuccccuuucaauguaauuucugugaauucagcucugcucugaucucuuacuauuugcaauucugugguguuucccaaguauaagaaugucuuuccaauuuuccaauaccuggcucaugcuauguaauugauaacugcuuugcacaucugaucuuguccuuaagaucacagugcuguaucucuucuagccuaggcuuugaaggggaaaguuuuccugguuuggcuguacuugacauuagcaaugagagugaggucgauaaucaucuugacuggccaugacucuggcugcagaaaaggcaguccugaaucuggauaaagaacugaacuuauugucaacugcaaucgacacuacuucaaguaguucaaguuacuguauuaaaacaaguugaguuaccuaaaacugaaucaggugggcauugugaaaguguuuuuuauuauuugcaacauuuaacaugggagaaccccuucuuuauucuggaucuuuugaacugacaaaaacagucauuaaucuaggccacagcuucuggcgguagccuacauuuauaaaggacauugaagaugcucgcuccuucgcuuucucugcuugccauacucuggcaagagagaucaauugauuuuucuagcauuagagguucuauccuguauccuucaacuuuccauugguaugcaguuauugguuuccuaguuggaccacauucugugagccauucuuauauauccacuuucuacauacauagagagauccauacuaucaguuuuguucaaguggaaauccuuuaauaauacagauguguuuuucaccuuuccacucaggaagaugugcuggcuaagaguacugcuccacagugauuggaauccauuuccucauuuccugguuuucucccaggguugucuggagaaucauaaugaaagggcaagauaaacccuauuuuucuccaucuaaggagcccuuuuguugccauuugaggaccaguccugauuucaaaaagguaccagcuucaggaauaaacuguaaaucccaaaaguaagucauaagacagcagguuuaggaacagaccauaaaauccagaagaagauuguagagcccccuuccagagaccagacuggggauaaccacagaaauagggaacuauuugggcugggcagcccuguuucaugauauggugaaaaguucauggcauaggaaugcagaucacugacaaccugccacccccuacauccaccaaugaaauuuuagaauacccuaucauucuagaggguuccaccuguuuccuauaaggagguccucauaccuuugucugggguugucauuucaaagaaugcugguuguuucuccagaauaagugcuuuuucuuuuugcauauuaucuuaucuggggucuucagugaauuuucgacccuuucaauauguaguaggugaauauuagcugagguauuccugagaucagugcaaaaucacagaaacaaauaucacauuuuauaucuuaaaaugacacaguaauugauaauaugcauggaagcauucugcaugugguucauaugguucacucugcaccaagaugaauaaugaacugugcaagcuacccaucucgauucuaggaggaggaagacaggcagaggagggcagugagaagaagaaagggaggaagaggaggggugggggaacauuggaaagaagaggacgaggaggaagaacaguaggaugaagaggaggaggaggaauagaaggaggagauagaggaggaggaggaacaggagcaagaagggaggaggaggauuaggaaguggaggaggagaagcaggagaaagaggagagggggaggauuacaaaauggagggagaagauauuugugcucagugcuguuaacagaaagcuaggcuauuggaggacaggcacauugcaauacugaaacacagaucucgcaaaucugaaaagugucaaguccuguacugauuuccuggcguaggaagcccuaauaggcaagcuuugagcacagucugucccuaaggccagugcucuugucacuggccaaucagggccuccuggaaaaccauccaaucagacgaagagaggccucuuccagguguuuuguucccuguugcagguucaguagcauugcagagcaggcuucuaugguuggugugaugugcuuugaccucugaagcuggguguuuuugcagagugcaggcgagcuacuaagucucaucauggugagcaugugaccacugccacuaacguaaaggagcaguggugugagaagcaggaauccugauagugggcucuccccuggguuagguggaaacuaacagccagcugugggauuccaugaggucuuagccacuagauguacucagugguggcaucuuaacaacuucguuaugggagcuucaucugcacaaagcauuuggagcaagggcuugccauguagaaacauccuuagcaagaugccaaauuuggagaguccgagauucucugguauuuuauaaacauugugcccuggccgccauuuaagauccauuuggggccuaacaaacacagaaguggaugcucacagucagcuauuggaugggucacacggcccccaaucgaggagcuagggaaaguauccaaggagcuaaaggaaauugcaacccuauagguggaacaacaaugugaacuaauuaguaccccggagcucuugucucuagcugcauauguaucaaaagauggccuagucagccaucacuggaaagagaggcccuuuggacuugcaaacuauauaugccccuuacaggggaacaccagggccaaaaagggggaguugguggguaagggauucggggguggguaugggggacucuugggauagcauuggaaauguaaacaaggaaaauaucuaauaaaaacaaacaaacaaacaaaagauccauuuggaguuaauuuuguagcaguuguaaaccccauuccaguaacuccaaauuuaugcugugguaagcauagaguagaaacacugauguaaaagacuuuccaaugauaagaaaaugggaagucacauuuaguugagggagggacugccuccuaaacacccacagagaaguaguauaguaagcaagcaucugagagauuagaaugcugggauacaccggguuguucaucaggauuguggggaaauaugguuccaggucauaacaaaggggacaacccugauuaacaaauaggcccuuucccaggucacagaccagcccuuuaacaaguugcucaaugaaguauugcagacuuacaaccaacacuaaggccuggugucccauaaaggaccauuuuucuucuugauaaagcauaguucugccacauggucaagacaucugucaacaccauuuggaaaggaaaaacacuguuguggugaggacuguccugaucaagcaaggcuaucccugaggccuucauagauggagaaugacauagcuucucaaacucagcaacagucuugguugggccuguaacagccuggggccuagaccuugggauccuugccuaaggccaugagguauugacaaagaaacagaaaaagagcuccuucucuaaaaccaggcauauucuuggaagagcugguaauggucuggggccagagccuguggagaggggugguuucuuauccugagaaucuaauaguuccuaccacauagggcugaugaugucaaucacaaaccacuguaggcaugcgcagugauauugaugagauuacuuguguucuccuugagcagcaguguuugauuggauucuuccuuugucucauuguaugcucguuuccgcugacagaauuuagaagacgugauaguccaaagauugucuugagggucaaagagacuuuggacauuugaauacuguguaugcuguugcagauuuuauggguccaugaagugagaauaaaugcauuuuuaucaaggaaugaccaugagccuauagugaccaaggucagagcauaauaagguguaucaaagagguuccagauagauuguuggcuuuaaacucuuuucucuucuugguguucuuccuuuuugagaauauggaggcuuuuguaaaagagcccuacuagaugcauuuccuuauugacaugggauuuuagugucuauagacuuaauccauuuccucuuuuuucuguuuauuggguuuugauugaaauucauccuucagcuuccuuuucauauccuaccuuccugucaugcuuucuccauaguagacucugucuuuaaauuaccuaagaugcaguggaagcaauagcuagcuagucagucuuaaguuauuugccuaauguuuucauucuuuauuuguguuuucuguuuuugaugauaauguuucucugucgcccuaccuaguaauccuguaugccauccaggccuugaacauagauauaaaauugguucugacuucaaauguuggaaccaaaugugggccaacuagccuggccuguuuuauugacagaugggccuguaauguguguguauuuuguaugugugauuucaagcacaugcuuuugugcucagcuuuauccaccuccugguuuuugaaauuucacagacauuaucauccuauuucccagcauggcauguacgcauggcauuaauacuccuuagacuucucaguuauuggauggcaggugcugaccuuucuaccuucuguguuuguugugacuuauguugggaagacuaugagucuuuugccuguaugcacaaauauauaccucaugugugcccauuccucacaguagucagaagauggccugagaccuccugaaaguggaauaauggauagcuguggaaccccuguaaauagagggaacugagcucacucauuuguaggaccagcaagagcucuucauguugcaccuaacuuuuuaacuacccuucuuaagcucuggacagguugggcaguggugauacaugguuaauugccgcauuugggagacagaggcaggugacuuucugaguucaaggcagcugaucuauagagugaguuccagacagccaggucuauacagagaaacccuaucucggaaacaaaauacaacaaaacaaaaagaucuggaugaaagucuuccacaugcucuugcacgcacauacacacacacauuaauauucugauaugucugaagaaagcuacagugacauauacaugaaauaaauaaauaaaaucuuuuuuuuuaaguaagaacuuaaauaaaagcacaugaguucauucuauguuuccaguuucguugguuaauuauggcaggagauacagggucuuacuauguaucuucggcugucuuagaacccauuguauauaucacacugacaucugucucaaugugauacuucugcuuaugucuccugacugcauuguuaaaggcauaaaccaauagacccagcauguuuauugauuuauauauauauuguuaauacaauuucuuugguguaugcuaaacacuauuguucuuguagaguuuucucuguauauguguaauugaauguucuuuaaaaaggcuacauccuauucaaagggcugagaaaugacaggggugacagggcuagagagaugccucagugcuuaagaacacugauuguucuugcagagguccugaguuuaaugcccagcaaccaccuguaauagcuauccgaugcccucuucuugggugucugaagacagcaacagaguacucacauauaugaaauacauaacucuuaauaaaagaaaaaaagaaaugacagaggcgaaccuuauuauuaaauuuccuuuugacauacuugguagauacaguagaacuugggugugaguaaauaaguuuuacaggccccagaauuauaugaacacauugccuaugaagaauagaugcccgauguuguuucuauugugcuuucuuuuguacacguuuaugggaugcucuagaaugcagugacuuaugaggacgugcaugugaacuucacucaagaggagugggcucugcuggauccuucccagaagaagcucuacaaagaugucaugguggagaccuacaggaaccucaaugcuauagguaaauaugugauucccuuuccuguuuuaaaauucaagaaaacaguuuuuucuuuugaugcacuucuguaguuucaauaaaaaugaaggaaggauuugaugaauaaaucaugcaugacuauaagguucacugaagauaguaacuuacauuuugcuaaauuuuaaggcauacauuuucuguuuuaggcuuuaauugggaagcccauaauaucgaagaauauugucaaaguucuagaagacacagaagguaauuuucaugugcaagcucauacaaaucugccucuaaagauauguuaaugugugcugaaaauugauaagagaaggagcaguguagauuagcacagcuuuaaguguauugaugaguguuacauuccaacaaaaccauccucuuuaacguccuguaucugcuuuuuuguaaggccuuccuuuaagaaagaggacaagggcugggcgugguggugcacaccuguaaucccagcacucgggaggcagaggcaggcggauuucugauuuugaggccagccuggucuacaaagugaguuccaggacagccagggcuguacagagaaacccugucuuaaaauccaaaaaaaaaaaaaaaaaaaaaaaaaaaaagacgaagcaaggaaacaaugccuuaauguauagugcuacauaguacaacuggcagucuguuucuguuuacuuuggaaaagcuauacaaauugaauaguugguaaauauguguccaaaagcuucuaagaagcaauagucuauauuuaagcugguuguacucauuuauuugcaguaucagugcuaaguuuaguuagaagggcagcaauugauaggugaguaggagguuuugcaguaaccuuaauccauauuucacaugucuaugagaacaaugagucaaaccuugggaaugcacacuucaacaauuuauuuauuggacuuccuuucauaaguauauaauauuuuauaauggauacauaccauguauaccaaacagauaucccaaaaaacuaugucugucugucuuucucuacucucuuucccucacuuuccuaaaacuauuagaagauauauaguggguugcaguuauagaguacacuuuuugaacauaauaaaaguuaacaguuaauuacauuuccaccuuugauggcaauacaucagcaaccucauucuggagaaaauuuucuugaguccuagggauguagaaaugcuccuauuucuccugguucacuuugacccacaguacaguaaaauuuggaauacacuuagugcguuaaagcucugaaguccuccacuuuucuucaaguacgggaacaauguuuuauaguaaaacaauacauaaaucugugccauguaaucaauguucauacauucucaggugucucuaaccaugagaaagaacccauaaugaaggggaacagcaugaauguaagcaaagggauaaaaggucugauaucucuuuauauuuagacaaauaguaacauuaaauccuagagaugaauguauucugggacuucagagauggcucagcaguuaagagcaccaacugcccuucugaaggucccgaguucaaaucucagcaaccacaugguggcuaacaaccauccauaaugagaucuggagucucaaaagacaggacagcuacaguguacuuucauauaauaaguaaacaaacaaacaaacagaaaaacaagaagaaaguauucauucaugugguaaagcucucacaugggccaauucucuucucaggugugaaaggagucagagugcagagaaacccucugaauauacucaaugugguaaagccuuugcuuuacaugcucacagucaugcccaaaggcaugaaaggauucauacagaaaagaucaccucugaaguuauucacugugucgaggacuuuuuaccuuacacaagucuccaaguacauaaaagaacacaaacuggacagaaacccuaugaauguaaucagugugguaaaggauuuagaaugccuaguugucuuaaaaggcaugaaagaauucauacuggagagaaaccguaugaauguaaucagugugguaaaggauuuauaacacccagucaucuuaaaaggcaugaaagaauucauacuggagagaaacccuacaaauguaaucagugugauaaagccuuuucccaauacguucaucuccaaauucauagaagcacacauacuggagagaaacccuucaaaugugaugaaugugauaaagccuuuucaaaacacuuucaccuccaaaaucauaaaagaacacauacuggagagaagccuuacaaauguaaucaauguaacaaagccuuuucacaacacacuaaucuucacauucauagaagaacacauacaggagagaaacccuucaaauguaaugaaugugauaaagucuuuucccaauuuggucaucuccaaauucauauaaaaacacauacuggagauaaacccuacaaauguaaucaauguaauaaagccuucuaccagaaacguagucuccaaacacauauaagaauacauacuggagaaaaacccuacaaauguaaucaaugugauaaagccuuuucccaauacggucaucucuauauucauagaagaauacauacuggauagaaacccuucaaauguauugaaugugauaaaccauuuucaaaacaauuuugcuuccaaaaucauaaaagaacacauacuggagagaagccauacaaauguaaucaaugugacagccuuuucacaacacaguuaucuucaaauucauagaagaagacauacaggagagaaacccuucaaauguaaucaaugugauaaagccuuuucccaacacaguaaucuccacauucauagaagaacacauacgggagagaagccuuacaaauguacucaaagugacaaagccuuucacaacacaguuaucuucaaauucauagaagaagacauacaggaguuaaacccuacaaauggaaucagugugacaaagccuuuucccaaccuuguaaccuccaauccguugaagaauuuauacuggagugaaaucuugcaaaugaaaugaaugugacaaagccuuuccccaucauuauaaucuacaaauucauaaaggacauacuagagagaaaccuuacaaguguaaucagugugugaaagucuucaaaacauggucaucuucaaaagaauaaaagaauacauacuggagggaaaagcuacgaaggaaauggaugugagcaaccuuuuuacaacaccaucauuucugaauguauaagugaacauacugaagagaaagacuaugaaugugaucauagucuaaaucgucaugaacacauuuguaggggccagaauccugaguauaagcaauguggaaaaaucuaugcugugcaaaguuaucuccuaaugcaggaaggagcacauacaggagagagagagagagacacagagagagagagaaugaauaaauauacacaaugugguaaac

SEQ ID NO: 7089 - RNA, 2618 nt, Mus musculus
cuuuuuuuuucaaguuaugcuauauuaauuuauuacuagugugggucuuccauuagcuuccuacauaucagugaggacuuucucagcagcagguacaguagcuuuuaaacagaauucauaaagagaauaaucacaagagaaaacauaaauauccacaguaagugaaacaaaaccgucuaguguucuuacacgcguucucacgaccggccaggaaaaacgcaacaaaccggaaucuucugcggcaaagcuuuauugcuuacaucuucaggagccagagagcaagagagcaagagcucuauugcuuacaucuuuaggagccagagcgcaagagggcaagagagagaauggugaaaccccgucccuuuuaaagagaauuauccucccgccuaggacaugucacucccugauuggcugcagcccaucggccgaguugucgucacggggaaggcagagcacaugggguggagaacuacccuuggcacaugcgcagacuauuuguuuaccacuuagaacacaggaugucagcgccaucuugcaacagcgaaugugagggcagcuccccacauagugugaaauuuauccuaauuuauccuaauagacucccaugaguuuguuauuaaacuaaaaucaccuuauucuaagcacacuaugaaucaucauaaaagauucugacccuuaaagaucauggaaacuucaagauuuuacuaauaaaguuaaaaauccuagcuguugcguuacugguugacuuuggucuguaauuucuggacuucugcaggccacggauaacaaucagguaggaucuggucauaauuagugcuguacaucugggaggagacaacuucuucuuuguuuugggguucaggauaaacaguggccaucuuuucuuuguaugcaucuugcacaaucuuuacugcaauuuucaacgaaucgucucgaaugguauucaaaggaggauagagccggccuucuugcagguguuuaucugacacuugcugagauaugaccucagcaguggugaggaagaccuuaucaucgaugugucucaguccgcaggccaccaccccaagagcaacuccagggaacacguaggaauuguugccuuggccaggaaacagaguccguccaucugggagagugacuggaucaaaaggacugccgcuggcaaagauugcacgucccuuggucaccuuguagcacugcucugcagagcacuccgcuuugcuggucggauugcucaaagcaaagaugaugggccgcucguugaaggcagccauauccuugagaauuuguucagugaaagcaccaccaauugcagcaacuccuaugagagcaguugguuuuaucuuuugaacaauggcuuccagauucuucauuucuucauguucaugggcaaacaccucuuucucuucugugagagaagcacgacccuuaacuauuaguccuuuugagucaaccaaccaugucuucuuucuagcauucuccuuugauaaaccuucuuucuccauggccauaacaaccaagugagcaauccccaaggcagccucuccagcucccuggaacagcacugucugaucagagagcuuguucuugguaauucgaagagcugcaaggagacccgcaaccgcaacagacgcuguuccuugaauaucaucguuaaaugugcaacacuuguuucaauacuuguucaggagacgaaaugcauuccgauuggcaaaaucuucaaacugaauaaggcaauucaugcaguauuuggaagacgcugccuccaugaacucauccaggaaggcgucguacucagggccucugacucgccggugccgcagcccgauguacaguggauccuuaaguaacucauuuucuguucccacguccaaagugauggguagacacuguuguggguucaccccuccacaugccguguacaaggccaguuuacccauagggaugcccauuccauuacagccaaggucucccaagccaaggaugcgcucuccaucaguuaccacaauagccuugaggacauccucuggccaugcauuaagaacugaagcaaugugcccuuugucauggauacuaauaaagaggccucuuggcuuccggaaugccaaacuguacugcuggcaugcgaggcccacgguggggguguaaacaauaggcaugaacuuuucaacaucagacaugagcacgcuguagaagagcuucucauuucugucuugcagguccauuaacaggagauaccugucgaagucagaguucagucgcucgaaauucuuaauuauucuaaggaccuggaguuccuggcugaugaugcagggcggcaacaauccaugaauguucaacugcugucucucuuccagaguaaaagccaaguccuuguugagaugcggucccgcgucagcagguagccgcgcuggugggugugucggcggcggggggggcucggggcuccauggcuggcacgguggggggggggggggggcggacgcggagugcggcgggcggcggccgugcgacggaaggccccgcggccgggggcgggcgugggguggcgaggcgggaggagcccgcgccuagcugccgccgccgcggccaggcggccggcgagaagccaggacaug

SEQ ID NO: 7090 - RNA, 4064 nt, Mus musculus
uucacgcgucuggagucuugauaccguggccacuagcagcccugcgccugcgcaguagcggccgaggaacuggccuacagggggugggagggggaagcggccgacccuggcgcguguugaugacgcaauuaguguuugccugguagcccgugguaacccggagucugcggaaguguagcugcagcagcaccgcagcugagacagguaaccugcagcuccggugucaagcagccgcuccggguuaugcggacccacgaccucugguggggugagcagguaggauccgauccgucuugcccuguggugagccagugggauccuguucgccucuugugaagcgaggcggugggauccugucugacuugucuggggcgagcccuugggaugcugucacauaaauuguagccgcaguauuagcgcucagcacuugcggcgaccgcuaccugcaaagguggugcucaugguagacggaaaccacaccggccagcggagcggugcuuagagcuguuuucaaaggugacaacugggcucguguugaugcugaauucaauucugaucccucgugcuuuuguuuuguuuccacgugcaacuagcgcauucauuucagaaggguguguugugcuccgugugauuugagaaggcugcuagugauuuccuaguugguaaagauuagguugucccguauugggagcuacagagaauaauauuguuuacugucgacuugucuuuuagacuccagggauugugcccugcacuuacauuucauugucuccuuaguucaugcaguauugcaaguuaugaacuauuauguuugccuuacagagaaaauaacugaggcucagcuccaucaaauugacugggugaaaaauucccaguaaccaaaagcaaagggcaaguuuaaauucaagguuaugcauggcuucaaggucucucucucuccucuccucuuccuccccuuuaaaaauaaccaccaucaguggucaaauuccaggcuuuuuacauuagucauaugugauuccauacguuuauucacccaucugaccauaugaauuguguguguaacacacacaugcacgugugcaauacguguacgcauguggagacaagggauaacaucaacugugguuucauagaugcuggccaccguuuuuuguuuauguguuuuugagacagguucucucacuggccuagagcuugccagguagauugguuuagccagcaacucuugaaaaugcccgccucuaucuccccagcacuggaaucacagaccugaaacuuuccacucagguucuggggaccgaacuugcguccucgugcuuacacagcaggugguuuucagccugagaugccgccgaagcagcagcagcagcugcuucuucuucuucuucuucuucuucuucuucuucuucuucuucuucuucuucuucuugauucauuuauuuauuuuauguauauguguacaccagugcucucuucagacacaccagaagaggacaccagaucccauuacagacgguugugagccacgaugugguugcugggaauugaaaccaggaccaguggaagagcagucgguggucagugcucucaaccgcugagccaucucuccagcccacugagcugccucuuaagccccuauuuugauacuuuguaaauauguuguaaauucucauauucuuaaaguuaagacaucuggaaacaugucuucuuccuacaggcacgcgcacgcgcgcgcgcgcgcacacacacacacacacacacagagagagagagagagagagagagagagagaagagcgaaagcacccuuaucuuuaauugugacauacauggaaaaugauguugcuuuguaaguaccuucuauucagagauccaagaaaugagugauuuuacguuugccccccccccuuuuuuucuaguaauguaaauaucaauaaauaaauuaaaggcaucaagugguuuucuugccuucuuucuucugguaugcagucacaaacaucacuuggccugugcugaaaugugaugacuuccucagaaccuuugcugucucugacuccccaggugcuuugcauuugcgucugccgggcuuccccccccccccccccccccguguaccaaaggacauuuaaaaauccauuguuucuuacuuauuguuggauuaaguaaggccauuuuugguucaacuuauauuaguagcauacccaaagaagaaacaccugggcuuucagucuuuucuaaaggaagaaaauuuucuguguucagaaagguggauuuaaguugauaagaaagagcuugauaggaagaaaggaagagaaagaaaacaagacaccguuaggacacaaagguuuaugugauuuuagccauuacaacaggaguucagaaagaucucaaguguuacauugauguuaucgguauaacaaaaagagaaaaaaagugacaggcaacagugaagagcaccagagacccagcacaaaccuaagaccauucuccuuccuucaacugccaagguauuuucacagauuaagccccccaccccacccccuucuuucaucucagcuuucccuaaccugcuuggccuggggaacucaagccuuauucccgcccuccuccuccucgaacucacccugcucccugcucaucagccguggcauccugguacugcugguaccaggucguucauguugcucuccgccucggugaacuccaucucguccaugcccucgcccguguaucagugcaggaaagccuugcgcuggaacauggcagugaacugcucagagaugcgcuugaacagcuccuggauagcaaugcuauugccaaugaagguggcugacaucuugaggccacgaggagggaugucacacacggccgucuugacauuguuggggauccacuccacgaaguagcugcuguucguucuuguucugcacguugagcaucugcucauccaccuccuucauggacaugcggccacggaaaauggccauggucagguagcggccauggcgagggucgcagacagccaucauguucuuggaguugaacauaggcugggucagcucgggcacugucagggcucgguacuguuggcugcccuggcuggucagaggugcaaagccuggcaugaagaagugcaggcgugggaauggcaccauguucacagccagcuugugcaggucugcguucagcuggccugggaagcgcaggcagguggucacuucacucaugguggcugacaccaggugguugagaucgccauagguggguguggucagcuucagggugcggaagcagauguccuacagagccuaauugucgauagacuagguuucaucuguguucucuaccagcuggugcacucagagggugacauuauagggcuccaccacagugucagagaccuugggugagggcaugacgcugaaggucuucaugaugcggucuggguacuccucucugaucuugcugaugagcaggguccccaugccugagccagugccuccccccaguaagugggucagcuggaagcccuggagacagucacagcuuucugauuccuuccucaccacguccaggacagaguccacuagcucggcccccuuucuguaguggcccuuugcccaguuauuuccugcaucacucuggccgagcacaaaguugucugaccugaagaucuggccgaauggucccgaccucacggaguccauggugccaggcuccagguccacuaggauggcccaagguacauauuuguugccagcagcuucauuguaguacacauugauucucuccagcugcaagucacugucgccaugguaacugccaguggggucgaugcucgucgcuuaucaccucccaaaacuuagccccgauccgguugccacacuggcccgucuggaugugcaugaucucgcgcguggugcuggcuguagaaggaguggaggcucuugcccucggagcacuguauggacagagggcuaaggagcgcaaaagaccgucugccgggcuucuuguggaucguuuuccauugccuccaguggacaguaaggcacaauaaggaaacug

SEQ ID NO: 7091 - RNA, 899 nt, Mus musculus
uguacuacccucuuggacaucuacacuaugaaccaccaggaugcuccacuuggcccugaaguuugagacucugcagcccuggcuucagaauacuacaggaugcauaacuggggcacaugcgaagaggcaauacccaguuuagaaaaguggagugugguaaucaugaaaaacucaucuuuucuacaucccugagcagugugcuggauggacaggccugucuuacugagcagcgugcuggaugaacaggccuguaucagugcgaggccagguuccuaaccaaagccaaagcccccuccccccagucugacccagcuccuaaguaggaaucccuggcaaagccauguggcaacagcauccaacaggcuacguucucucaguauggcuccagucaagcagaauuccaggugucaaagcauagccaauugucccaccucucccuacuagaaacaggaggguauucacagcuugcccacagugccuuugcccaagggccucacaagccaguaaguguguugaggaaguuaguuauccaaacagaauuucaagacuguuucaccuuuaucccauguuuguuucagccccagcccucaugaugcuuuuacccacaucugcuucucauacaugcagcaugcucuccaacucccucagcugucugaccuguaccagaaccuggcuuaccagggcaguccauccuguggcucccuaacacugugugacacuccaaacuucaugcauggagaaugcagggacuccuuugugaaucacuguucaaucuacugucuaaaaagccuaauaaaaauacaggugaggugacaaguauuuaaccuugacuuugaggacaaagaaagaacagguguuucaaacagaaccgaaaccaggcacuuggaagcagaggcagg

SEQ ID NO: 7092 - RNA, 2252 nt, Mus musculus
ugaagacgugugccugcgcagaggcgcgagcucggagcucauaccuuugcgggagucugcgcgggacugcggggcggagauguccaucgggcuaggggcaggcacccggcagccccgccgcucucggcggcgaggagagcacggcacgugggccggcugccgggcaucgcccgcccggagcggggggcgcuauguggggccugacgcggcggcgucaccucagcgaccagccaacgcucgccagagcccguaaaucccgcgagaacgagcgccucugcgcuccaucgcucgccucccuccagauaucgcgagaagauggacuagccuuucagcgggcggaagcggcuucccuuccagacgaggucagccucgcgcaguucgcgaacgucccaaauaucgcgagauuuggcauuagucggcgaccucgacccucuucgcugagggaguccacgaccugaggugugugacauccucccagggcggaaaaagacagugugagcccugcacagaccauugacacugugguggccuugucgucuaggagcuucaggaggcgagccuuaagagggcguuuucuuggguuugccuacuuuaucguaacucacucgugcacaaacaaggcaaccccugggguucgguuuucuucgccaucugagaagagcagcgacugugccucgcccugagagagaagcacacaccacgcagccugcugccuccagcacagcguucugcgcacgagcugaauggauuuugccugucccaacaucuccugaacaagcucgugaagccaaauguauucuucaugucgaauucuugugauuuuuuuuuuuuuuaggccacugugccuguguacgggucucguagagcuaaaaauccagaagucagagaaauugcauuccuuccuagaaaguggaagaaucuccacuccuuggcuugaccucuuucuucaaagccaaggauagugcauuuccugagccuuccacaauggguuuggguuuuggggggguuuguuuguuuguuuguuuguuuguuuugagcucaccagaauaaucuuauuuucagguguacacucauaacuacaucagaaaaggccccuugacauguaagauaacauguauggguuccuggauuuagagacacaaauuccucuuggggaucauuauccugccuacuggaggaucuuauuuguauauacuauaugccuauucaacaaagagaucuccauucuuugcagauacuacuaagacuaguagacuauuuucaaaggagugcuauauuaagagugucacuuguuugcaaagcaauaggaaaagcuuuauaaagagaaacauuuaggaauauugauuuagcuaguaacaacagccugaauaaaggggaguaacugcaaaaaauaaagaguuaaauaaauuuuggggggaggcagggauuuugagacaggccuucucacugcguagcccuagcuauccuagaacucauucuguagaccaggcuggccuuugccuguugguuuaagauguaaggccuuacugaaacuacaagugauuugauaaauccaaaauaaacauugaaaugaaagaaaucaccuuguuaaaggaauauccuucuagcuaacaagacgacuccucaccuuugagugucucuuauguaacugcauugccaugauuguccuguuuaaugaaaugggaacagucauaacaugaacaugucuuaaagguuaagcauccugcccuuaggguagcuuuuguucuugucgguugccugucauccucuuguguggaugcugauguuguaaaccuccaacacuaggaugccaguuacuucaaggugaaauugugauauauuucugaagucaguauaaguguuguuggauugacuauauugcaugcaaaaccacugacaauugauaacacagcaaacauuaagacaauuuagacuacaaaaauauaacuguaguauagcauguuugauaugcaugagacccuaggcucaacaucuagcacccaauaacagucaugauaagcauuucaaaagaauuuuacuuggaugccaaagagacuuuuaauauaauuaacccugcaauacuuuauuaaaauugguuucuacuuauguucacaacauaaaaggcaaauauauauuaugugauaaaucuuuaaaauaauggauuuauugaguucgaggccagccuaaucuacaaauugaguuccaggacaacagccagggcuauacagagaaacccugucucgaaaaugcca

SEQ ID NO: 7093 - RNA, 2487 nt, Mus musculus
agagagagagagagagagagagagagagagagagagagagccagcagagaggacaggagcaauuauaacugcucaucugagaaggcuguuccuuaaggggcacagaaucugcuguugcucuaaaaacauuagccaacauuuaugugugacaaguuaccucuagcugggguagcuuuaagcauauuccaguuaacuugcuucaugcucacccagaccuccaaaguuagcuuuuuuuuccauguuccaaaugaggaaacuagggcauaaauugauuuaaugacuuccucaaggucauacugagaguagauacuuaguuaucuguuauugccaacacgauugcuacacaguuagcagcuuaaccaacccucugcccuuaucucccagggucugagaaucagaaucuaaagaaucuagcuuagggccucucaggagcugcaguccaguggucaggcagcacugaaguuucaucugggacaccagcaggaaaggaucuguggcugucggcagauggcuauuccugcagucguguuagagugacagccucaggacccagugacuguuggccagaggccuccuuggccucuugcuuuugggucucuaugugaucacuuacaaauaccaccuguguccucagagccaguuaaagagggcaccugcucuaaggaaagccagucuugcgcaccgccauugugcacauggcagcucaucauaguugcuguguugauuuauaagaagcaacaaagccccgugcaugcucgggaacagacaguacuggggagccacggucucuguaaaggcuccucugaaucugccagauaauggccuguauccgaacccagacagcuuggcuucaaagcccugcaucacuaaguuugcuuuagccuuggcaaacacccgauaauggugccuuacgggagaacagguuuguucuggucuguuauguggagcggcuuucgccuucaguccguaguagugcaguagguguggugacaggagcucgaugcagcugcucacguuuuguccccagagacuagaaugaaaaaagaugaauacaggggccaggcugccuucuccucuuugcauaguccaggaaccaagccuaugggacaauacugccuaccuuagagugaguuucuugcuucaauuauuccagcuuacaaucuaccucacaagcaugccguucauuuguucccauggugauucuagagccugucaagcuggcaaucaauauaaaccagcacagccuccggagcuaaccauugugcuccccgguagcucuaguguuccauugcugugagaaauuagccaaggcaaaggauucauggagggaaggguuuguuccaguuucagagguuucaguccacggcgacuugacugucauuguuuugcagcggugaagagggaguucauuuucuggggagcaugggauagagaaaaccgcucauaucgugguguccaggaaacaaaagggccccgacacccccuucaaaggaccuccagugacuaacucucuuccacuggacucuaccuccugugcuuaaggagaggcagaaacauacuacacagcguaugcugguuagcauaauaauauaacauggcauucggaagugagggauguugcaugguugugguuuaaguauggagugcccaccagcucaugguacugcucuggaaagcuguggaaccuucaggagguggagucucacugagacagugggucaguggggcugaagugguaugguuuuauaaccggguccuucugucugucuucuguccgcuuuccugacugcuggcacagugcgaccagucgccucaugcuccuucaggcgcgccuucccugccauauuaacuguaagccaccacagauaagagagaaguaguuaguacaacuguccugggcuacccugccaaacagucacuaaauuaauuauuaaauuaaauucauguaggacucaguuaaccuggauagauggucaucuuauauggaacauauaucuauguggaacccuugugugauuaucacuuuaaaacccacaugcacuuacuguaaagacgaaagacugaaaaugcaaacgaaaaccccuucucgggauguacuggacacacacaagacccccaguggggcacagcugaaggggcuccagccauacuguguucucugacccugcaagugcauucaugaauuccagagucugccccuugaccccgcaggugcuuaucgaaaauacauacuauuaacaacaaagauggauggggauguaugacucaacugguagugugcuuaccuaaaaugcacaaagcucuggguuugaucccagcauugcaucaacugggugagguagcauagacuuguaaccccagcaccuggaagauggagacaagaggaucagaauuucaaagucaccuucagguacuuagagaguuugaggucagucuaagcuacaugagaccccaucacaagagcaacuaccaccaccaucaccacca

SEQ ID NO: 7094 - RNA, 735 nt, Mus musculus
guuuuuuuuuuuuuuuuuuuuuuuuuuugaguggcagcacugagguuuauuggagcguccuaauacagacgcuggggcuugcccauggugcucuuaauguacaaagcccagacguuuugccaguuuuucuugagcaaggacaccaagaaauugacagccagaugaauguuguggaccagcucaucaucggucaucuucacguggccgacagcgacggccagacacaauaccuucuucaucuggaacuugauugucgauuucaccucauccacuuuggccgccauguuuucauugggugucagcagggaggggaacuugccagccuuguuuaagccugggcccggaucugcuugaucagagauucggaggccaaaaaggcaucguacuucuuggccagcuucuugaccaacuucuuguucuuguuaagcuucuugagcgccucgauguccaugugggggauauccacggccuuggcuucaucacagugcugcuggucccccagaaugcacacggagaacuuggggugagggguggacuuaagccugacggugcccgagaaacguuuguccuucugagggucguaguucuucagguugaucugcagcucuacugucuccagaaacuugcggugcuugcgcugguuccagugcaggacuucccgcaccgccuuguacagggugucgcgugagacuuugcugcucaugacugcggcugccgcggaaacuggaaaggaag

SEQ ID NO: 7095 - RNA, 20275 nt, Mus musculus
uuuaugcuuuaaauuaaaauaaaauuuuauucaaagcaucuuuuaaaauuacagcauguuuauuaauaugcuguuaacucugccaaacuacaacuuagccauaugaagcauaaaacacuucaaaaaucugaauguaaccacauuuuuaaaacaaaaagcagucauaacacaccucaaauuuuagaugccaauguauuuuguccaaguacauagcuuauaucaaaacaaaauauauaacccuuuaaaacauggccaaugguaagcaguuggaauaauuucuuaaacuauccaaucauacaaauaaaaaauucaugugaauauuaaccucaaugguugacaaaagucaauugaagaaacaaagcaagcccuuacuuuuugaaggccuuaaaucuuaucugcgaauugacuaauugcauuuuucaauuggacugcuguccuuaaggugagcugaucagauuuaaaauuucccaagacugaugaguguuauguuuugguucauacacucccauuuaucugaggaaaauuucuagagaaaauaucgaacccuaaaccaagaauauuuagaugcuauguauggucggucucuuaucauacuuauaagugcuccaaguuaaaauucuacauaccagauuacagauaacauucuuagaccauuacaaauauaaauucucuuauuacaaaaagccccuaaagaucugaaauugacuguacagaggaauuccauuuuuaaaguauguccucaucauacacauuauucuaacuaccacaacuucagcuucacauuggcgcuucucaagacauuucuucccuccacucuccaaggcuacacaauuuaacuacuuguguacugcaaccaccgagacuuuagccuacauucucaguaauguguaaucuacacuuguaggaugcuaccucaaaaaaaaaaaaaaggcacugaggagcccaucuuuccucccauuacuuugaagucuccaauuaaggagucuauaaaucacuaugcucugcauauaauuucauucaacuuuuaacaaaagcucaagugauagauucuugacuccauaaaagagguggcugcuuggccccuagaauucuauucaugccuuaguacacaacgugcucaauaacuucaucuauuuggagaaaaugguuuugaaccaccagacaagaaagacacuugcagcuaaaacuaucucagaagcccgcauauuugaguagccaauauuuacucaaguguuuaacugacagcuaaacuuagugaacacaaaauagcuuggcauguuauucugaagugaagcagaaagguggcaauaugcacugaaaauauaaauauggaggcuuccauccacuaauaacgcuaaacaagcagaacaauuaaaauuuaguguuuacuaucaaaagaccuaaaacauuucacuacaaaacaacccugcagaugucccuuuuauuaauacaaacacaagugccaaucucauuacagggcccauaauagaucucacugguguacacauacaugcaccaguugccagguuacauagacuuugcaagauuaaucacucagguccagcagcugagcaaugugcaaaagucuccagucaacaagccaagugacgagcgcuuucuaagcaucagcauuacagugaguuaaaaagcccaggaagaugggauaaaacucauuuuauaccaauuuuaaaaacuaguacccaucuuaccaagagccucaaauaccuuuuuucuuccaaguccauaacuuauaucaucuuuccaaauaguuggccucccauuucucuggacuuauuggccaugcuauucugcaauuuaaaaauauguauuuuauacauaugucucacacugcucugcuucaguguuuacaguacugucacacacacuaacauacacuguuaaaaaugaucuuauaaauaaucuauuucaaccuucuuuggcuauuuguaccaaucuguuuuuucacacaaaugucuuauucacaaagugcuuccugugagaacugcuuccaaugaaugcauuaaacuugcaaaaccuagcuucccacaacuuguagcuucuacccuguaacugcaauccauauuuacaaaauaguuuaaacuuuacaucaaaucuauuuccauauaaaaaaaaagugcaauucucucucaccccaucugaggcaacaacauucuucauaaauuucuacagaauagcagccuaugauaagcaaauaaggugcuuagcuuaugcccaaggaucuacuuuguaaguaugcugggcaguacuuuuguacagugaagagucagugugagggcuacuggcggaguggugccccugucagauuggccagcucaaugagugccagggccccaugcagccucucucguugcucuugcagccggcgcugggcgccacucuucucaucgucuuccucaucagacuggagguacuccagagggucuugcugcuccugaucagccuucugaacuagcuugccuuuuagggugggggugcguugcucucucaucucccaguaccuguguaaaaggcaaacauauuguuuauauggcagauaucagauugucaaguauuuucuuaguggaugcuggagaggugguucagagguuaagaguauuagcuccucuuccagaggaccuggauuggguucccaggacccacguggcagcucacaauugucuguaccuucaguuccaagggaucugaugcccucuuugggccccaugaacuccugcacacaaauacacucaaguacaaacacauaaaacacuuuucaaaaaucauuuuuaguucucaacagauggaguacaacaguaagaaacauguacauuuacaccgauaucucaucuugucuaaaucagacccauuacaaacugacaggaauacaaauagcucagccacuacugaaauuuuguggaacuucaucaaaauacucaagauacaacugccauaugacccagauaucccacacccaagucaacagacuauggagauacuugcacacguaguccagcacuguucauagugccacuggucacuguucacaguaaccaaaccuagguaaaaagaugaucaaagaaagaaaaugugguauguaacauuguugggauacaguccaagauugaaguagcaggagauuucugagugcuugugauaaaacucccaaaaaacaaaccaagagucuagugaccucaguuucuucaacaauauggaauuguucuuggauuaugcuuuugagcuccuuccagguacaguggauagaagugagcauauuaguuacaacaacgguuauuuguuuauaugccucuauggaaaaacauguuuaugcuguaugaggccugcccuuguaacuguacacuuguacaaguacuguacuuguauuguacagugacuccucuuaacccucagaguauaaauugucugacgcucagaauaaaguuggcuauugcaugagacauuaguucaccucauugauuggcuccacucucccaggucccaccaagggcaguauaacaaggaccuggagucagcuaagagauuagagaguaagagccaugauugagugucuacaucauuuuuuaaaagaacacaaguauuaaaaucacaacuauuaaauugcuugcaagauguuuauaauuacaaucacuuguuuucacaguaagaaauuuuagaugaaguauaggacagagucugaaagaauauugaaaaggcauaaaaagaaggugaaaagaucccauucaauuauggguugcuugggcauuaauuuggacuguuaucaaaacaccuaaggaggauauuaaucaugaggaagauauuccuugcauauuauauuccuugcaugaauauaaacuggaugauuaaacuuuaaaauggguaaaaaaaggcaaaaaggauuuuccccauucaggcaaaauucaaaguaaaaacagcuccaccaauaacuaugcuggcgaugucucccucagcacucuuaccagagcuuccuucaaauguguaucauccauggccugaaaaugacccagaagaauggggugagaaauuucauaaucuaauuuugaauucucuccauuuuuuugaugaggauuuaggagagccuaugaaaaaguuaacuuuauaaccuaagcaaacuaggguacagcaaggaaaugaaauucauuuaccaauuccucuccaagccccacgagcuguuucuuuccaaugcacuaaccaauccauuugaaacccuaaaaggaaagucaguguuggcuaguucccauauaguaucuccagaagcaagaaaagaguuagcuaucucaauucagacuaaaagaggcaacuaaaagaggcaacucauguggauccuugacggccuuuaaaccuauuuuccccaccuuuacacuguaagagccauaaaauacuaacugcuuaccuuccuuuucuuguaagucaggggaggacccaaugucaacaauuauauuaauuugauucuuguauuauaaucacccucaaccaacuaucaguuuuuaaaagcaugacagaagucuacagguaguuuucuuuuuguuguggauguuuucaagacaguuucucuguguagccauggcuauccuguaacuagcuccguagaccaggcuggccacaaacuugggagaucugucugcauuugccuuuugaguacuaggauuaaaggcgugcaccaaccaccccaguuacucccuuacuaugggcguagaggaaaucaugguccagcuggcaaucugugggguucucucauaugaacugaauugugauuauaaaaaaaguguccaaucuucucccauuccauagguaaauacuuauuuuauugaugguucaucuaaagguauaggagggauucaugguccagacugucauuuaccuaguaauacuuuucuucagcccaauagguagaacuggcuguuuuaauucaucuauuacgguuaauucauaaaaucuuuguaaacuauucuccgggcuaaccuaggccuaguccuggaggcuuccagccucuguacaaucuuaucuaugccuagaauguuuucagccucugaaacugcugcugaauaagcuuacccuuucuagcucuuucugagcucuggcuggaugguucaacucagcuguucuggcucaaacucuucuccacgcugacugauucaaucuggauucuuucucugccucuccugaauugcucugcuuagccucaaaauaacucuagcaaucugcucuaaaucuuuuagcuccuucucauucuguggcuccuccugccccaggccaucaaggaugguggagggcaguggaagucacuagaaagauagcaaaccuccaguuaaagggcaaaaaaagagacuguguccuaagucaugucuaccagucugggguacgauaagcccuaugcaccaagggagaaguaaacacacagagcccuaugucaccugagaauaucuuucuagcaaugccagcugcuuuggccuauggaucucugaguucauguauuggucuuauguuccucauccuccuugcccuucaauccguagauuguaugggcccagcuucuguuagguuuacuaaugaaugacuguguuuaugacuggaccuugggacuguaauaaacuuauucauucuaaaaggggaacacauuuaauuuuuccuugaauuuaaauaauuucccauuuucaaaggacaucaugauauuugugauccuaauaaagagcaaauaugggcuuccauucuacaagagaccaaaacaacuacucauaucaguuucuuuucaagcuagucccuagauuuucuuuuuugaucaauauacuaauacaaucaauaguauugacauaguuuugaucccuauucuugggggcagaguauuagacacaauacuuucacuacuuucacuacucuaaaauuauucacuauguuuauaauuuguuuaaaggauauucaugcaucaaaagacaauuuaucuacaacaucucaaauugaaacuacucuggauauccuucauuuaaaauauugagaacaugguccuagaaugaagucaugugagauuucugagugcuugugagagaacaccaagaaaccaagacaagggucgugauuuguuugguuuuugguuuuugaagacaagguuucuguguagcccuggcuguccuggaauccuuuuuguagaccagguuggccauaaacucagagauucaccugcuucugucucccaagugcuggaauuaaaggccugugccaccgccaccuagcaaggcuuaugaucucaguuucuucaaauauacaugcuuucaagcaccucccagguguaguggccuggagugaguuuacuucagauuauucauuacaacuagcuguuauuuguuuauaaugcccuugugauuguacacuuugcauauguuacuccucuuauuacucagaguauaaacugucugauguucugaauaaaguuagcuauugcaugagacuucagucugucucauuuaauggcuccauucucccaggucccaucacaguaaacaauacauaauggauuuuuuuguuuguuuguuuguuuuuucgagacaggguuucucuguguagcccuggcuguccuggaacucacuuuguagaccaggcuguucuccaacucagaaauccgccugccucugccucccaagcgcugggauuaaaggcgugcgccaccaccgccuggcauggauuuuauuuuauucagccaugaaauuguauagagacagaaagacaaaugucacauuuucucucauuuguggauuucagacuuuauauagccacacuaaauuauuuauaugucgugaaaguagaaauaagacugagggaaugaaggggacuaggaggacacagggauugcugucaucaacguacuuguauguauuuuaugaaacccauuacaguaucuaaugaauguacacuacuaaaaaugaaauuuuguuaaaauggauccuuaguaaguaucugaagcuauucagagguaguacauggaaaucccauuuauauggaaaacuuagauuggagaauaaagauuccuguucacgugucuauaaucagacacuugcuguuuuaaaccucccacugcauucucuaaucacguuugccauuacacuauaugaugcccuggauauguagcucagagguagaauaucugcauaacauguaugaagcaaggcccugaguucaauccccaacacaacaaacaaacaaaagaacccuaccuuuauuuauaaucuaucuauauuauguaugagugaacccuaggaaccuaucuuaucuucugauucaguagcagaguaucuaccuaauacauacaagggccucagcaucaggagcuucagaaccaugggggaggggggaaaacuacuuuuuauuuaacaaaauaaugguuuuuguuuuuuucaagacaggguuucucuauauagccaccaccccagcuuugguuucuuuuggggggggugcuggguggagggggcagugcaaggguaacuuuugacaggauuaaacauuaaacguaugaaauaagaucaacagccagguauggagucaggcaggucuccaaguugaguccaaccuggucuacagagugaacagucacggccacacagagaaacccugucuggaaaaacagaagcaaaccaacaaacauaaaagaaaaaagaaauaugaccaagaaaguaaugucaauaauacacuuuauccaaaaauauuuaacauuaguuuuaauucuagcuuagucuuauuguaaccacuugauaagucacaagagaaaaugaaaauguccacucacugugucuaaaaugcuuauuuaaauugucaucauguacacagugccaauauaaagccuuguauacuaaugcuuacagccuuauuuaaaauacuaaacgcaacucaaacaucuaucaaaaggugacugacuaaacaagcugauuuagagcuacacaauaaauuacuacccugaaauaaaaggaagagacucuugaaacacucaauaugcaugaaccucaaaugaugcugcugaguuaaagcagccacuugauaacauuucuauaaagccuuagaaaauacaaacuaguuuacugucccagaagaggagugcuagcuggaagcugugcaguugagaggggcuauaaaggagcuugaggaaacuuggauaugacagacacauccauuacuuugacuauggggguuccaugauguagacaaaugucacauguaucaaacuguacacuuuaauacaaccuaucauacaugccuuuaaucccugcagaucagaggcagacucagauaaaucucugugaguuucagggcagccuacucuacauagcaaguuccagaacugccaggacaacacuguaagacccuguuuacaaauaaauaaaauacaccuaugucccuuuaggaaaucuaucucugaacacuaggaacauuggcaguacauaagcauuaaaagaacuguuaguucaguacaacuugaagacuggaaaaagagaauccugacgggucacaggggcucugaguacuacagcaaagguuuggguuccacacucaggaugauacuagccuccaucuaugaaguuggucccagauuguuuguucuaggaguuccaggggaaggucaaguaagcuuuuccugaaaugauauuuagcccaaguaagaaaaaaagaugagcagaauggcuaaaggaagaagugaggccuccuguaaagagcagagaagccugaaacaacagugacaugguuaucaauaaauaccugcccauuguggcauagcuagcaggaagagcuguagcagcacaauaagggacccaacagcacugcagagaaacuucagugauguuaacaacaaacaaguucuuaagucaaauauucucagagaaagauuuuuaugcugaccuccuuguugccauucauguugccuccuuguugcaaauucaugaguguuccauacuuuucaacagugaaacaaagaaaaugaaauacacugugcuuggggcacauaaacuauuauuucugucacacacagaucccaagcacucaugacaacucuacaggaaauuaaggauuauucugaacuauuuuauaaaacauacguaaguaauuuacuuaaaaugaaagaaugcccaaacucuaacauaaacccaagccccaaagacaucuucugggagaccacacacaaacaccgccuuacuuugccagccacucagcagcagccuuguuguccggagacugguguuugcugagugcguccguuggcucuucucucuucagccgggcauaagggugcuuuggacaauggcgguuugcaugggugaaucugcuuaggcacccuuuaaaacacagaaggaaaugcucaccagaaugugaccauucaggcauacgaaauauauacagcuucgagauauacaaggaaggcagagagaugcugaauccuuuaaccauacaagcuucuauggacgcuuccgaggcacauccauaaaguccaaugcccucuuuuuuaaauaaauaaauaaauaaauaaauaauuuuuuccaaacauuuauuuauuuaguguaugugagcacauuguagcugucuucagacacaccagaagagggcaucggaucccauuacagaugguugugaaccaccauaggguugcugggaauugaacucugggagagcagccagugcucuuuacugaugagcaaucucuccagcccccacccccacguccucucugagcaugguacauauacauacauauauaauauauauacaaauauacauauacacaaccacauacucauaagauaaauuuuaaauacaaacaaaacaaggguuuucuaaugagucaggcaugguguuacacaccucugauucuaauucuagcacucaggaggcagaggcagguggauaucuuugaguuugaagccagccuagcuuauauagggaguuccaggccaugcaauacuacacagugagacccuguuucagagagaaacaaaaagguuuccucucauauguagaaacuaaaaauaaauagccuguaaacacuuauaagauuuuaaaaaauauucaagaaaacuacaaaaagggggcaggacuacacugaaauguguguguauaugugucugugauuaaacuaaccaaccaaccaaccaaccaaccaaccauucauuuaagagggccagcaagauggcucacugaguaaaggguuugccaccugcuggguagugguggagcaugccuuuaaucccagcacuugggaggcagaggcauucggauuuuugaguuccaggacagccugaaaagaaaaagaagaaaaagaaaaagaaagaaaaaagaaagaaagaaaaagguguugcuaccaccaagccugauaaccuaagugguucucuuauugccacacacucaaauagauggauguaaaaauaggucccuuuaagaaaagauacacaggagccaggcagugguggugcaugccuguaaucccagcacuugggaggcagagguaggcggauuucugaguucaaggccagccuggucuacagagugaguuccaggacagccauggcuacacagagaaacccugucucgaaaaacaaaacaaaacaaaccaaaaaaccaaaaaaccaaaaaaaaaaagugcuuuuaaagaaaagauacacgaggcuggagagauggcucagagguuaagagcacugauugcucuuccacagguccugaguucaauucccagaaagcacaugguggcucacagccaucuguaaugggaucugaugccuucuucugguaugugugaagacagcuacaguguacucacauacauaaaauaaaucaaucuuuaagaaaaaaaagagaaaaagaaaagauacacuuacucuaguuaaauaguuuaucaaccaauauaaaagccuaccucaaaggcuacauuuauuaugaauguuucuacuucuuaaagcuugggcuggguauguagcuccaugagaguaccugucuagcaugugcaaaggugugcauagcuuggggaugggaguuuaugauguuuuauaaaagcuuaucaaaaauuuccucuugucaaaaaaauauaaguaaaacuuacucuaacuacuagcugguuaguagcuauuccuaaaauaucaccuuaacaccauaccguuuucugaacagacaaaaggcuucucuccgguaugaagacguugguggguuuugagcuguccacuuugaacaaaggcuuuuccacagucuggguagucacacagguauggccucucaccuaaggagacagacaucaaaaucagacaugagggaacaagaaggggcaggaggaaaauccucuucauaugggucagaacuccagugagaaaugacauaccgcauuacagugcacaggcaggcagacaaaggguggcacuggagcgccucuccuccauaaagcacauuaccuccucuaggucuugagcauuuagaaacccagguucaacccuuguuauuagcaucuucagcuuaucuauacuuuucuccucaacaguccaacuaugagcucuuuucugaucuauaaacuaucuccaacuuccacuuucuguggcuauuuucuuggucucacucaaccauaggggauacuccaauggguugcuagcuggcaucuagccuccuucauacauuguauuucaagauggaggcaccagcacaaaacucuuagcaccagucauuucucaaacuaucccaaccccuccugagcuccuuggacugcuaaaaaguugccugauaauucuucucagcaugcaaaaugucaccaaauucauuuaucuauuuggagaugggagaacuguccuuaguuuccuccagaagauauuccagccaggaggcaaugccucuucaucugguucuuauccuuaagaucgcaucuucccugcccauucaaauucagaguuugcaggcuuucagcugcacucggugucugccugggaaguguccuguaaugauuaugcacauaggaaucuccuucugaagaaauucuucacuuucuguuucauuuaaauuuuuaaguacugcagcauagugcuaaccuagauaaggugcucaaaaauggcaaucauaauuaauguauuauuuauuacugauuuacuauaaggcuccucucccuggggucaacauuauagaaagaacauaggccuucuacaaaguauuuugcuuucuauacagacugcaaggacuucuauauacaaauaaaaaugucugacauguaaguguuagaggaaacaaaauucagguagguggagauggaauaacaaugacacaacugacaauguuuuguuuaaccuagacccaccauuccccaccaaaaagcaacugaguaacaguggcugauuuuuaaaacuucaaaguaauaguggcaauauaaaaaaaauaacacaauuuauaugaacauuauuuaacccaauuaaauaacauuaauuaacaacuuaaguaccaaaucaaguuuuaaucuaguaucacuucuagccacuucuacacuguugucaucuuaccuguaugaguccuuuugugagccuggagugauuucucccuuggaaauacccuguuacagauguuacagcgaauccugcuagaugaaugcucuccuucauuuauuaaaucccgaacagugucugcucugggccuuccacgucggauuccauccuguuaacaugguuuauaaacuuuaauaugauuuccuggaaucacuaaagcagcauaagauacaaacugagugagugguucuaguagcccaccucucugcagauaccagcaaacaccccuaaaguacuccacuugcccauucuuccuuuaccugguagcaaaccuucaaaagguuucuguucuuagugugugacuuuguucccacaugcagaaagcagaccagaaccuauccugaaaaacuaucugcuaugaccuggaugggccacuaaguggacugacacaaggcacuuauguuuaccccaucuaaucuagguaucuuucaggacauacaacuauuuagagggcauuguucacaaacaacuugcugcucucuggacuaaaaaauuggguuuaccuaaagcaagcagacacaggaaaagcccaugggaaagucagggagauuucacagaaaauggagcaugcucucaguaaaccaugaacccagucagaagcucuacccaaagaaaguggaggcuguagcagagauguaaacagcuggguaaggaaaacaaaguguguguccugucagugccucccaccacaccgcccugcccguauaaggcacuugccuaggccaguggccuugagcuugaucucaguauucugcacuaaaaaagggacauuaauaagaggggauagauggagcuacacagaaguaguucuaauaggcuuacccacugaagcuaagguaauucaaaauacauucuuuuuuuuuuuuuuuuugcuuuuuacaucacuuuauuccaaccugagcaccucaauauaaaacuaaacaccggugaacuguucuccuuacuaguuuugaguuacuguaaaauguacaaguucugcuagcagaucaacacuuaaauagauuaaaucaucugacacaugguagauuucauauaaugaaaauaccuaaaauaauuagugcaauauacugauuaaaauaaaauggacuucaaaaaacaaggcuucaagauuauuacuaauaacauuguaauacuuauguuacaauugcaaguacauuguuuauuaugguucuagccauguaagaacagcaaagccccuuccuuucauaggggaagaaagaaauaauuagcuguuuuaguaacuguacauuuuguauauguuuaggcaauucuuaaauauuauaggaaauaauaaacauauggagacuacaaugcaguacucuauuuacaguacagcugaagaucauauuuaaaauaaucaaguuugaauguacauaauuguuagugcacugacuaauuaugcccaaagggaagcagagcccccucccuguuccagacacaccucuauggaauagccaacagugauuaacuagaaagcagauaccugguuuguuuccacuuuuuaaaagaagcucauaugaagggaccacuaucauuaaaaugcauuuuucaaauucccucaggccuaacugcugacccucucccagaaugcucugcucuaacccuuuuuuuuuuuuuaaagauuuauuuauuuauuauauguaaguacacuguagcuaucuucagacacuccagaagagggugucagaucuuguuacagaugguugugagccaccaugugguugcugggauuugaacuccagaccuucagaagagcagucgggugcucuuacccacugagccaucucaccagccaaaauacauucuuauaaguuuaaaaaacaaauuaaaaaguccaggguacacuuuaaaauauuaacuuuauguuucauaaauuaaaaacugagaaggccacauguagugguacaaaccuuugauccuagcacuugggaggcaaagguaaguggaucugugaguucaaggucagccaagacuucauagcagagaacuugucuuuaaaaaacaauaaacaaucuauuaagacauauaccuguaaaucccugcucugaggagcugaggcaggacgacugcaacugagucugaggccugccuaggcuacaaaaccaaucugaggacagucuaggcuauauaaugagacuaucucaaaaaacaaacacacaaaaaaccaagacaacuugaauaguuaauagcguaccaacauggucacaaauguauuacacuuauuuaacaugcaagcaaacaacuaaacugaguauuauccauggaacgccugcacuaucuucucuaaucuaaaacaaacauguucuuguaaaaaaaaauuccuuuucuuucccagguaaguugucacaucuguagguuacacgaaaaaccuaacagugcuauaagugucacgcacagcuaagagaugucacuguucuccauguaaaaaccuauagguuucuaaagcuuaaaucuuauccucauaccuaaaaugauaagcucuaaccuauuuuccuucagucaaauguuucacuuucaaagacguucaugccagauacgguggugcacaccuuuaacuccagugcuguggaucugugcauuuaaagccagccuggucuacagagugaguuccaggacauccagggcuacacaaagaaacccugucucaaaaaaaaaaaaaaaaaaaaaaccaaaccaaaacaaacccaaaacacagaaaaaaagaaaaacuaaaauaaauuacccacuauuuucuuugcuaccagagaaaaauaaaacaugcccaguuggaacaacacaugcauaaauuauauauauguauauguguacacacacacauauaaauuguagucauaaauacaacauacuugccacauauagguaauaguuaaauaaaugcauucuuuuaauuaaggaaauaagauuggaaauaaucaucuaauguuccaaauaaaugagcuguaucuacauaucugugugcaugccuguguguguguacaucuagaagccagagaucaaugucaggugucuucuuucucuuuccaccauauuuuugagacaaggucucucacuaaacccaaaauucaccauuucuacuaggcuggacagaggccuugagacccucuacacccucacuccuaucaauguguuauaaacaugcuucagauggcuuucauguggauacuggaugcuaaggcucaaaacagaagucuucaugcuuauguagcaaacauuuugcacccugagccaucucaccagcuccaaccauauauauuaaaauaagcaauauuacuugaauaggccauucucauuuuugucuuaauaauaagaaaacaauguuucuaggcauguuuaucagcauccaauuaaguuuaucuguagacugaaggacaaauguugucaagacuauugacucaaagaaaaaaugucaacaugaaauuuuggaugauuacaccacuaaaaacuuuuguauaaucucccaaccucuagaaaguauuuauaauuauaugaagacagaagaccuaaaaaguccuugaauguuuuugacaaguucaacuaaaaggccagacuuagcauuucuauuguguaacaagacaccauaagccauagaaucaagccaguaaauagcgcucuguauccggcuccugcccuccagguuccugcccugccuuccaaguugcuuuugguuaugguguuuaaucacagcaauagaaaccuaucuaagauagauuuaaaauauuaagccuauuaagauagguuuaagcacaauaaaucaggaaaaaggaggaggagaaagaagaggaagaggaagaggaggaggaggagaagcagcagcagaugaugaucuuuagaaauguuugugagccuugaugacacauuugggucuggauccaaacuccccaugcugcucagaucugcuuacucucacccgaucuauauucacaacuuuccaagucucuacgucaauagucaaugucaagcuaugugcccuuauauaaagcaucucaacugauuuggauaagccauaaauaaguuacauaugcuuacaucaacuuaauauuuuaaaaauuaaucccuaaaaguccauuuacacguguacauaugggaacaauauaauguagagugaaaacaagaguucugcuggugucagaaguucugcuaccuaucauaugaccuuuaucuuagggacacuuuuucucauucucagcagguaaaugauauuagauaaauuaaaaaauucagagugcucaacagacagccugguaguuuacuccuaacauuacaaagugcccacuccacgacagguaaaaaaugguagcuacuauugcuaacagaauaaauguuucuacgaugauuaaaagccacuauauacaaaucaauuaugugaacacacaaucuagauguuuggauauuaaaaguggauacaggucagacaggggcaagaucggugcccuacagcauauaucaugaauacaauaugaacagggaguacagggguacagacaggggaauauaguaccugggaagacaaggacucuguaguuguucuuggucucuccuagaauucaaccacaaacgauaaugcuauauauacacaaauagugcuaagugaccuuaaaacgaggguccaaaacaugcuggcaggugauaggugcucuuuacccacucaguguagggugaaagcugacauaggguguguacaacucagauguuaacaccuccccugggagucauagcaacaagcagaaacaaacgcugaucucccucacagcuguuagugccuuagagugacagaaugaagggugaugggagcacugcugacacuagccauacuacacacucaucuccaucuuccuggaaagugagcagauucagcagccaagccagcaucaucacucacucaaagccuggagaaguagaucaucaccguaagaaccucagcgccaaaacagcauaaagggggcugggcucccucucccucuuuaaaccaacaacaucuugaccauaaauaaauaaggucacuuucucaaauaaaggccuauucgaauuuucucucuuaaguugagaauccuaaaugaauuucuggagcugcccuugaaccacuccaauaauuaaaaaaagaacuagacuguuaucaaaucaauucugaaaauuaaguguucugugagaaggggaaaauauacaucuauaucagcccuuucauuuccacauuacuucuaguauacuucccucugaaagggguaaagauguagaaacaaaacucaagcuuauguaccgugaguaccgugagaacauguacacagaucuauggaaagagaagucugauucaagccaaaagcacacaccuaugauuucaucucuuuacaacaauucucaccagcucgagaccggaggcaggaggaucucugagacugaagccaccuugucuacagagugaguuccaggacaguccaggcuacacagagaaacccugucuggaaaaacaaauaaauacaagcaacagcaguucucaaccuacgggguccagaccccuuugggggucgaacaacucuuucacagggaucaccuaaggucauuggggaaaacagauauugacguuaugauucauaacuguagcaaauuuauaacuaugaaguagcaacgaaaauaauuuuaugguuggggucaucacaacuggagcuguauuacagggaugcagcacuaggaagguugagaaccacugauuuacgacaguuuuuuuuuuuuuuuugauaauccaaaaaucaaauugaggggaaaaggggacagagagauagcucaaugguuaaaagcacuuguugcucuuccaaagaacuugagcuagauucccagcacccucaaagugguucauaaaacugacuucagugucagucauacacaagugcagacacaauauaaauuaacuacaacuuuaaaaagucaaauacaagaaacuuccacgguauuuuuguaugucacuuaacuguacaaugcauuuucuaaggacuaaaauauugaauuaauacaaaaguuauagauaccuaaaguaccuaagaugacaugucaggaggggcgaccugaagccagcaacaauagcuguuccuuacaccaacgcaguuucuacuaccaacaucucuacuguucuuucaaauaugcacuguggugcaaguuucaacuuuacugcucuauaauaauaccacuagcuaaguaccuacuuccucacacaaaacaguuucaccuuuuuggcuaccgcccauacacaauguuaccaaacuugcuucaauugauaaacuaggcaucccuuaauccgcuggguaauuugcuuugcuacaccuguagcaaaucaaguuauucuggcagucaaccaacaacagaaaacugcauauuuaucuugcaauaccauguauucgacacacagauuuaccgauaccuuccugagcucugaugaauguccaguauuaagucuagccccauaaacacacucccgguuccuuccgagcacagucaccgugugccaacacucccacuagcuagcuauacauacgauuuucaugaagacgcuuuaacaaacucccuaacccucagcugcuccggauguaaaggguauaguagggcauggugucgcuagccuugaauuccagcacucggaaaguagaacucugagagucccaggcaggccagggauacagugcgauacuuggcccccgccccaaugugggcuggagccaaaugcucacauccuuccuucccacaucuaagcaggccgaggccgcgagguuacaagcacagcagugcaaggcaucuggacacagcgagccucccccucaucaccccgcugcaccugcugcccucagaccggccuucgcgccgcacccgucacaugaccaccuugcccccaaagguccgguuuuggcgcgcggcagugacgucagcguccugucagccaccgcccccgccaccccgcuuuuccucuccggccccgccccgcuggcgagcggcgccguuaacgggccccaggccgccccgcgcccggggccgcccgagccacucaccuugagguggccgcugucugggcugcucgccuccuccucguccuccccgcccgacacggcggccacggaggcggaggacugaggcgcaccccgcagcgucgggaguucagccgccacgggcaguccggcugaaacgacgccgcccgccgcccccgggcugagcgucacguuaugcgcguucucaccccagcgccacggguacaccaugaagucgcugaagccggggcuaguggggacgagcggcggcggcggcucgggcucccccacgcugcugcacggaggcguugccggcgugguccugaugaccgauaccaguacgcgcuucggggagucguggcagaagacgaccggcggcggcuccgccaugggugccggggcgccgcggaucaugcuggcucgucugcagcccucgcgcucucggcggcccgagcuugccuugcucgcccgcgcugcuacgucucggcgccucacagccgccggcucauggcaggcggcuccgggcgaucaggcugcagcagcguugcugacaggaaaacgggacgcgaggcgccgaguccccgagaauaacaaccugccgccgcgguccccgcuucggcuuuucccgcguuacauuucgcgccugggcggaaccagucaccgcgaggacccugcggcuggccaccgcgacgagugacaggucgcgagagccaauag

SEQ ID NO: 7096 - RNA, 20275 nt, Mus musculus
cuauuggcucucgcgaccugucacucgucgcgguggccagccgcaggguccucgcggugacugguuccgcccaggcgcgaaauguaacgcgggaaaagccgaagcggggaccgcggcggcagguuguuauucucggggacucggcgccucgcgucccguuuuccugucagcaacgcugcugcagccugaucgcccggagccgccugccaugagccggcggcugugaggcgccgagacguagcagcgcgggcgagcaaggcaagcucgggccgccgagagcgcgagggcugcagacgagccagcaugauccgcggcgccccggcacccauggcggagccgccgccggucgucuucugccacgacuccccgaagcgcguacugguaucggucaucaggaccacgccggcaacgccuccgugcagcagcgugggggagcccgagccgccgccgccgcucguccccacuagccccggcuucagcgacuucaugguguacccguggcgcuggggugagaacgcgcauaacgugacgcucagcccgggggcggcgggcggcgucguuucagccggacugcccguggcggcugaacucccgacgcugcggggugcgccucaguccuccgccuccguggccgccgugucgggcggggaggacgaggaggaggcgagcagcccagacagcggccaccucaaggugaguggcucgggcggccccgggcgcggggcggccuggggcccguuaacggcgccgcucgccagcggggcggggccggagaggaaaagcgggguggcgggggcgguggcugacaggacgcugacgucacugccgcgcgccaaaaccggaccuuugggggcaagguggucaugugacgggugcggcgcgaaggccggucugagggcagcaggugcagcggggugaugagggggaggcucgcuguguccagaugccuugcacugcugugcuuguaaccucgcggccucggccugcuuagaugugggaaggaaggaugugagcauuuggcuccagcccacauuggggcgggggccaaguaucgcacuguaucccuggccugccugggacucucagaguucuacuuuccgagugcuggaauucaaggcuagcgacaccaugcccuacuauacccuuuacauccggagcagcugaggguuagggaguuuguuaaagcgucuucaugaaaaucguauguauagcuagcuagugggaguguuggcacacggugacugugcucggaaggaaccgggaguguguuuauggggcuagacuuaauacuggacauucaucagagcucaggaagguaucgguaaaucugugugucgaauacaugguauugcaagauaaauaugcaguuuucuguuguugguugacugccagaauaacuugauuugcuacagguguagcaaagcaaauuacccagcggauuaagggaugccuaguuuaucaauugaagcaaguuugguaacauuguguaugggcgguagccaaaaaggugaaacuguuuugugugaggaaguagguacuuagcuagugguauuauuauagagcaguaaaguugaaacuugcaccacagugcauauuugaaagaacaguagagauguugguaguagaaacugcguugguguaaggaacagcuauuguugcuggcuucaggucgccccuccugacaugucaucuuagguacuuuagguaucuauaacuuuuguauuaauucaauauuuuaguccuuagaaaaugcauuguacaguuaagugacauacaaaaauaccguggaaguuucuuguauuugacuuuuuaaaguuguaguuaauuuauauugugucugcacuuguguaugacugacacugaagucaguuuuaugaaccacuuugagggugcugggaaucuagcucaaguucuuuggaagagcaacaagugcuuuuaaccauugagcuaucucucuguccccuuuuccccucaauuugauuuuuggauuaucaaaaaaaaaaaaaaaacugucguaaaucagugguucucaaccuuccuagugcugcaucccuguaauacagcuccaguugugaugaccccaaccauaaaauuauuuucguugcuacuucauaguuauaaauuugcuacaguuaugaaucauaacgucaauaucuguuuuccccaaugaccuuaggugaucccugugaaagaguuguucgacccccaaaggggucuggaccccguagguugagaacugcuguugcuuguauuuauuuguuuuuccagacaggguuucucuguguagccuggacuguccuggaacucacucuguagacaagguggcuucagucucagagauccuccugccuccggucucgagcuggugagaauuguuguaaagagaugaaaucauaggugugugcuuuuggcuugaaucagacuucucuuuccauagaucuguguacauguucucacgguacucacgguacauaagcuugaguuuuguuucuacaucuuuaccccuuucagagggaaguauacuagaaguaauguggaaaugaaagggcugauauagauguauauuuuccccuucucacagaacacuuaauuuucagaauugauuugauaacagucuaguucuuuuuuuaauuauuggagugguucaagggcagcuccagaaauucauuuaggauucucaacuuaagagagaaaauucgaauaggccuuuauuugagaaagugaccuuauuuauuuauggucaagauguuguugguuuaaagagggagagggagcccagcccccuuuaugcuguuuuggcgcugagguucuuacggugaugaucuacuucuccaggcuuugagugagugaugaugcuggcuuggcugcugaaucugcucacuuuccaggaagauggagaugaguguguaguauggcuagugucagcagugcucccaucacccuucauucugucacucuaaggcacuaacagcugugagggagaucagcguuuguuucugcuuguugcuaugacucccaggggagguguuaacaucugaguuguacacacccuaugucagcuuucacccuacacugaguggguaaagagcaccuaucaccugccagcauguuuuggacccucguuuuaaggucacuuagcacuauuuguguauauauagcauuaucguuugugguugaauucuaggagagaccaagaacaacuacagaguccuugucuucccagguacuauauuccccugucuguaccccuguacucccuguucauauuguauucaugauauaugcuguagggcaccgaucuugccccugucugaccuguauccacuuuuaauauccaaacaucuagauuguguguucacauaauugauuuguauauaguggcuuuuaaucaucguagaaacauuuauucuguuagcaauaguagcuaccauuuuuuaccugucguggagugggcacuuuguaauguuaggaguaaacuaccaggcugucuguugagcacucugaauuuuuuaauuuaucuaauaucauuuaccugcugagaaugagaaaaagugucccuaagauaaaggucauaugauagguagcagaacuucugacaccagcagaacucuuguuuucacucuacauuauauuguucccauauguacacguguaaauggacuuuuagggauuaauuuuuaaaauauuaaguugauguaagcauauguaacuuauuuauggcuuauccaaaucaguugagaugcuuuauauaagggcacauagcuugacauugacuauugacguagagacuuggaaaguugugaauauagaucgggugagaguaagcagaucugagcagcauggggaguuuggauccagacccaaaugugucaucaaggcucacaaacauuucuaaagaucaucaucugcugcugcuucuccuccuccuccucuuccucuuccucuucuuucuccuccuccuuuuuccugauuuauugugcuuaaaccuaucuuaauaggcuuaauauuuuaaaucuaucuuagauagguuucuauugcugugauuaaacaccauaaccaaaagcaacuuggaaggcagggcaggaaccuggagggcaggagccggauacagagcgcuauuuacuggcuugauucuauggcuuauggugucuuguuacacaauagaaaugcuaagucuggccuuuuaguugaacuugucaaaaacauucaaggacuuuuuaggucuucugucuucauauaauuauaaauacuuucuagagguugggagauuauacaaaaguuuuuagugguguaaucauccaaaauuucauguugacauuuuuucuuugagucaauagucuugacaacauuuguccuucagucuacagauaaacuuaauuggaugcugauaaacaugccuagaaacauuguuuucuuauuauuaagacaaaaaugagaauggccuauucaaguaauauugcuuauuuuaauauauaugguuggagcuggugagauggcucagggugcaaaauguuugcuacauaagcaugaagacuucuguuuugagccuuagcauccaguauccacaugaaagccaucugaagcauguuuauaacacauugauaggagugaggguguagagggucucaaggccucuguccagccuaguagaaauggugaauuuuggguuuagugagagaccuugucucaaaaauaugguggaaagagaaagaagacaccugacauugaucucuggcuucuagauguacacacacacaggcaugcacacagauauguagauacagcucauuuauuuggaacauuagaugauuauuuccaaucuuauuuccuuaauuaaaagaaugcauuuauuuaacuauuaccuauauguggcaaguauguuguauuuaugacuacaauuuauauguguguguguacacauauacauauauauaauuuaugcauguguuguuccaacugggcauguuuuauuuuucucugguagcaaagaaaauaguggguaauuuauuuuaguuuuucuuuuuuucuguguuuuggguuuguuuugguuugguuuuuuuuuuuuuuuuuuuuuugagacaggguuucuuuguguagcccuggauguccuggaacucacucuguagaccaggcuggcuuuaaaugcacagauccacagcacuggaguuaaaggugugcaccaccguaucuggcaugaacgucuuugaaagugaaacauuugacugaaggaaaauagguuagagcuuaucauuuuagguaugaggauaagauuuaagcuuuagaaaccuauagguuuuuacauggagaacagugacaucucuuagcugugcgugacacuuauagcacuguuagguuuuucguguaaccuacagaugugacaacuuaccugggaaagaaaaggaauuuuuuuuuacaagaacauguuuguuuuagauuagagaagauagugcaggcguuccauggauaauacucaguuuaguuguuugcuugcauguuaaauaaguguaauacauuugugaccauguugguacgcuauuaacuauucaaguugucuugguuuuuuguguguuuguuuuuugagauagucucauuauauagccuagacuguccucagauugguuuuguagccuaggcaggccucagacucaguugcagucguccugccucagcuccucagagcagggauuuacagguauaugucuuaauagauuguuuauuguuuuuuaaagacaaguucucugcuaugaagucuuggcugaccuugaacucacagauccacuuaccuuugccucccaagugcuaggaucaaagguuuguaccacuacauguggccuucucaguuuuuaauuuaugaaacauaaaguuaauauuuuaaaguguacccuggacuuuuuaauuuguuuuuuaaacuuauaagaauguauuuuggcuggugagauggcucaguggguaagagcacccgacugcucuucugaaggucuggaguucaaaucccagcaaccacaugguggcucacaaccaucuguaacaagaucugacacccucuucuggagugucugaagauagcuacaguguacuuacauauaauaaauaaauaaaucuuuaaaaaaaaaaaaaggguuagagcagagcauucugggagagggucagcaguuaggccugagggaauuugaaaaaugcauuuuaaugauaguggucccuucauaugagcuucuuuuaaaaaguggaaacaaaccagguaucugcuuucuaguuaaucacuguuggcuauuccauagaggugugucuggaacagggagggggcucugcuucccuuugggcauaauuagucagugcacuaacaauuauguacauucaaacuugauuauuuuaaauaugaucuucagcuguacuguaaauagaguacugcauuguagucuccauauguuuauuauuuccuauaauauuuaagaauugccuaaacauauacaaaauguacaguuacuaaaacagcuaauuauuucuuucuuccccuaugaaaggaaggggcuuugcuguucuuacauggcuagaaccauaauaaacaauguacuugcaauuguaacauaaguauuacaauguuauuaguaauaaucuugaagccuuguuuuuugaaguccauuuuauuuuaaucaguauauugcacuaauuauuuuagguauuuucauuauaugaaaucuaccaugugucagaugauuuaaucuauuuaaguguugaucugcuagcagaacuuguacauuuuacaguaacucaaaacuaguaaggagaacaguucaccgguguuuaguuuuauauugaggugcucagguuggaauaaagugauguaaaaagcaaaaaaaaaaaaaaaaagaauguauuuugaauuaccuuagcuucaguggguaagccuauuagaacuacuucuguguagcuccaucuauccccucuuauuaaugucccuuuuuuagugcagaauacugagaucaagcucaaggccacuggccuaggcaagugccuuauacgggcagggcgguguggugggaggcacugacaggacacacacuuuguuuuccuuacccagcuguuuacaucucugcuacagccuccacuuucuuuggguagagcuucugacuggguucaugguuuacugagagcaugcuccauuuucugugaaaucucccugacuuucccaugggcuuuuccugugucugcuugcuuuagguaaacccaauuuuuuaguccagagagcagcaaguuguuugugaacaaugcccucuaaauaguuguauguccugaaagauaccuagauuagaugggguaaacauaagugccuugugucaguccacuuaguggcccauccaggucauagcagauaguuuuucaggauagguucuggucugcuuucugcaugugggaacaaagucacacacuaagaacagaaaccuuuugaagguuugcuaccagguaaaggaagaaugggcaaguggaguacuuuagggguguuugcugguaucugcagagaggugggcuacuagaaccacucacucaguuuguaucuuaugcugcuuuagugauuccaggaaaucauauuaaaguuuauaaaccauguuaacaggauggaauccgacguggaaggcccagagcagacacuguucgggauuuaauaaaugaaggagagcauucaucuagcaggauucgcuguaacaucuguaacaggguauuuccaagggagaaaucacuccaggcucacaaaaggacucauacagguaagaugacaacaguguagaaguggcuagaagugauacuagauuaaaacuugauuugguacuuaaguuguuaauuaauguuauuuaauuggguuaaauaauguucauauaaauuguguuauuuuuuuuauauugccacuauuacuuugaaguuuuaaaaaucagccacuguuacucaguugcuuuuugguggggaauggugggucuagguuaaacaaaacauugucaguugugucauuguuauuccaucuccaccuaccugaauuuuguuuccucuaacacuuacaugucagacauuuuuauuuguauauagaaguccuugcagucuguauagaaagcaaaauacuuuguagaaggccuauguucuuucuauaauguugaccccagggagaggagccuuauaguaaaucaguaauaaauaauacauuaauuaugauugccauuuuugagcaccuuaucuagguuagcacuaugcugcaguacuuaaaaauuuaaaugaaacagaaagugaagaauuucuucagaaggagauuccuaugugcauaaucauuacaggacacuucccaggcagacaccgagugcagcugaaagccugcaaacucugaauuugaaugggcagggaagaugcgaucuuaaggauaagaaccagaugaagaggcauugccuccuggcuggaauaucuucuggaggaaacuaaggacaguucucccaucuccaaauagauaaaugaauuuggugacauuuugcaugcugagaagaauuaucaggcaacuuuuuagcaguccaaggagcucaggagggguugggauaguuugagaaaugacuggugcuaagaguuuugugcuggugccuccaucuugaaauacaauguaugaaggaggcuagaugccagcuagcaacccauuggaguauccccuaugguugagugagaccaagaaaauagccacagaaaguggaaguuggagauaguuuauagaucagaaaagagcucauaguuggacuguugaggagaaaaguauagauaagcugaagaugcuaauaacaaggguugaaccuggguuucuaaaugcucaagaccuagaggagguaaugugcuuuauggaggagaggcgcuccagugccacccuuugucugccugccugugcacuguaaugcgguaugucauuucucacuggaguucugacccauaugaagaggauuuuccuccugccccuucuuguucccucaugucugauuuugaugucugucuccuuaggugagaggccauaccugugugacuacccagacuguggaaaagccuuuguucaaaguggacagcucaaaacccaccaacgucuucauaccggagagaagccuuuugucuguucagaaaacgguaugguguuaaggugauauuuuaggaauagcuacuaaccagcuaguaguuagaguaaguuuuacuuauauuuuuuugacaagaggaaauuuuugauaagcuuuuauaaaacaucauaaacucccauccccaagcuaugcacaccuuugcacaugcuagacagguacucucauggagcuacauacccagcccaagcuuuaagaaguagaaacauucauaauaaauguagccuuugagguaggcuuuuauauugguugauaaacuauuuaacuagaguaaguguaucuuuucuuuuucucuuuuuuuucuuaaagauugauuuauuuuauguaugugaguacacuguagcugucuucacacauaccagaagaaggcaucagaucccauuacagauggcugugagccaccaugugcuuucugggaauugaacucaggaccuguggaagagcaaucagugcucuuaaccucugagccaucucuccagccucguguaucuuuucuuuaaaagcacuuuuuuuuuuugguuuuuugguuuuuugguuuguuuuguuuuguuuuucgagacaggguuucucuguguagccauggcuguccuggaacucacucuguagaccaggcuggccuugaacucagaaauccgccuaccucugccucccaagugcugggauuacaggcaugcaccaccacugccuggcuccuguguaucuuuucuuaaagggaccuauuuuuacauccaucuauuugaguguguggcaauaagagaaccacuuagguuaucaggcuuggugguagcaacaccuuuuucuuucuuucuuuuuucuuucuuuuucuuuuucuucuuuuucuuuucaggcuguccuggaacucaaaaauccgaaugccucugccucccaagugcugggauuaaaggcaugcuccaccacuacccagcagguggcaaacccuuuacucagugagccaucuugcuggcccucuuaaaugaaugguugguugguugguugguugguugguuaguuuaaucacagacacauauacacacacauuucaguguaguccugcccccuuuuuguaguuuucuugaauauuuuuuaaaaucuuauaaguguuuacaggcuauuuauuuuuaguuucuacauaugagaggaaaccuuuuuguuucucucugaaacagggucucacuguguaguauugcauggccuggaacucccuauauaagcuaggcuggcuucaaacucaaagauauccaccugccucugccuccugagugcuagaauuagaaucagagguguguaacaccaugccugacucauuagaaaacccuuguuuuguuuguauuuaaaauuuaucuuaugaguaugugguuguguauauguauauuuguauauauauuauauauguauguauauguaccaugcucagagaggacgugggggugggggcuggagagauugcucaucaguaaagagcacuggcugcucucccagaguucaauucccagcaacccuauggugguucacaaccaucuguaaugggauccgaugcccucuucuggugugucugaagacagcuacaaugugcucacauacacuaaauaaauaaauguuuggaaaaaauuauuuauuuauuuauuuauuuauuuaaaaaagagggcauuggacuuuauggaugugccucggaagcguccauagaagcuuguaugguuaaaggauucagcaucucucugccuuccuuguauaucucgaagcuguauauauuucguaugccugaauggucacauucuggugagcauuuccuucuguguuuuaaagggugccuaagcagauucacccaugcaaaccgccauuguccaaagcacccuuaugcccggcugaagagagaagagccaacggacgcacucagcaaacaccagucuccggacaacaaggcugcugcugaguggcuggcaaaguaaggcgguguuuguguguggucucccagaagaugucuuuggggcuuggguuuauguuagaguuugggcauucuuucauuuuaaguaaauuacuuacguauguuuuauaaaauaguucagaauaauccuuaauuuccuguagaguugucaugagugcuugggaucugugugugacagaaauaauaguuuaugugccccaagcacaguguauuucauuuucuuuguuucacuguugaaaaguauggaacacucaugaauuugcaacaaggaggcaacaugaauggcaacaaggaggucagcauaaaaaucuuucucugagaauauuugacuuaagaacuuguuuguuguuaacaucacugaaguuucucugcagugcuguugggucccuuauugugcugcuacagcucuuccugcuagcuaugccacaaugggcagguauuuauugauaaccaugucacuguuguuucaggcuucucugcucuuuacaggaggccucacuucuuccuuuagccauucugcucaucuuuuuuucuuacuugggcuaaauaucauuucaggaaaagcuuacuugaccuuccccuggaacuccuagaacaaacaaucugggaccaacuucauagauggaggcuaguaucauccugaguguggaacccaaaccuuugcuguaguacucagagccccugugacccgucaggauucucuuuuuccagucuucaaguuguacugaacuaacaguucuuuuaaugcuuauguacugccaauguuccuaguguucagagauagauuuccuaaagggacauagguguauuuuauuuauuuguaaacagggucuuacaguguuguccuggcaguucuggaacuugcuauguagaguaggcugcccugaaacucacagagauuuaucugagucugccucugaucugcagggauuaaaggcauguaugauagguuguauuaaaguguacaguuugauacaugugacauuugucuacaucauggaacccccauagucaaaguaauggaugugucugucauauccaaguuuccucaagcuccuuuauagccccucucaacugcacagcuuccagcuagcacuccucuucugggacaguaaacuaguuuguauuuucuaaggcuuuauagaaauguuaucaaguggcugcuuuaacucagcagcaucauuugagguucaugcauauugaguguuucaagagucucuuccuuuuauuucaggguaguaauuuauuguguagcucuaaaucagcuuguuuagucagucaccuuuugauagauguuugaguugcguuuaguauuuuaaauaaggcuguaagcauuaguauacaaggcuuuauauuggcacuguguacaugaugacaauuuaaauaagcauuuuagacacagugaguggacauuuucauuuucucuugugacuuaucaagugguuacaauaagacuaagcuagaauuaaaacuaauguuaaauauuuuuggauaaaguguauuauugacauuacuuucuuggucauauuucuuuuuucuuuuauguuuguugguuugcuucuguuuuuccagacaggguuucucuguguggccgugacuguucacucuguagaccagguuggacucaacuuggagaccugccugacuccauaccuggcuguugaucuuauuucauacguuuaauguuuaauccugucaaaaguuacccuugcacugcccccuccacccagcaccccccccaaaagaaaccaaagcuggggugguggcuauauagagaaacccugucuugaaaaaaacaaaaaccauuauuuuguuaaauaaaaaguaguuuuccccccucccccaugguucugaagcuccugaugcugaggcccuuguauguauuagguagauacucugcuacugaaucagaagauaagauagguuccuaggguucacucauacauaauauagauagauuauaaauaaagguaggguucuuuuguuuguuuguuguguuggggauugaacucagggccuugcuucauacauguuaugcagauauucuaccucugagcuacauauccagggcaucauauaguguaauggcaaacgugauuagagaaugcagugggagguuuaaaacagcaagugucugauuauagacacgugaacaggaaucuuuauucuccaaucuaaguuuuccauauaaaugggauuuccauguacuaccucugaauagcuucagauacuuacuaaggauccauuuuaacaaaauuucauuuuuaguaguguacauucauuagauacuguaauggguuucauaaaauacauacaaguacguugaugacagcaaucccuguguccuccuaguccccuucauucccucagucuuauuucuacuuucacgacauauaaauaauuuaguguggcuauauaaagucugaaauccacaaaugagagaaaaugugacauuugucuuucugucucuauacaauuucauggcugaauaaaauaaaauccaugccaggcggugguggcgcacgccuuuaaucccagcgcuugggaggcagaggcaggcggauuucugaguuggagaacagccuggucuacaaagugaguuccaggacagccagggcuacacagagaaacccugucucgaaaaaacaaacaaacaaacaaaaaaauccauuauguauuguuuacugugaugggaccugggagaauggagccauuaaaugagacagacugaagucucaugcaauagcuaacuuuauucagaacaucagacaguuuauacucugaguaauaagaggaguaacauaugcaaaguguacaaucacaagggcauuauaaacaaauaacagcuaguuguaaugaauaaucugaaguaaacucacuccaggccacuacaccugggaggugcuugaaagcauguauauuugaagaaacugagaucauaagccuugcuagguggcgguggcacaggccuuuaauuccagcacuugggagacagaagcaggugaaucucugaguuuauggccaaccuggucuacaaaaaggauuccaggacagccagggcuacacagaaaccuugucuucaaaaaccaaaaaccaaacaaaucacgacccuugucuugguuucuugguguucucucacaagcacucagaaaucucacaugacuucauucuaggaccauguucucaauauuuuaaaugaaggauauccagaguaguuucaauuugagauguuguagauaaauugucuuuugaugcaugaauauccuuuaaacaaauuauaaacauagugaauaauuuuagaguagugaaaguagugaaaguauugugucuaauacucugcccccaagaauagggaucaaaacuaugucaauacuauugauuguauuaguauauugaucaaaaaagaaaaucuagggacuagcuugaaaagaaacugauaugaguaguuguuuuggucucuuguagaauggaagcccauauuugcucuuuauuaggaucacaaauaucaugauguccuuugaaaaugggaaauuauuuaaauucaaggaaaaauuaaauguguuccccuuuuagaaugaauaaguuuauuacagucccaagguccagucauaaacacagucauucauuaguaaaccuaacagaagcugggcccauacaaucuacggauugaagggcaaggaggaugaggaacauaagaccaauacaugaacucagagauccauaggccaaagcagcuggcauugcuagaaagauauucucaggugacauagggcucuguguguuuacuucucccuuggugcauagggcuuaucguaccccagacugguagacaugacuuaggacacagucucuuuuuuugcccuuuaacuggagguuugcuaucuuucuagugacuuccacugcccuccaccauccuugauggccuggggcaggaggagccacagaaugagaaggagcuaaaagauuuagagcagauugcuagaguuauuuugaggcuaagcagagcaauucaggagaggcagagaaagaauccagauugaaucagucagcguggagaagaguuugagccagaacagcugaguugaaccauccagccagagcucagaaagagcuagaaaggguaagcuuauucagcagcaguuucagaggcugaaaacauucuaggcauagauaagauuguacagaggcuggaagccuccaggacuaggccuagguuagcccggagaauaguuuacaaagauuuuaugaauuaaccguaauagaugaauuaaaacagccaguucuaccuauugggcugaagaaaaguauuacuagguaaaugacagucuggaccaugaaucccuccuauaccuuuagaugaaccaucaauaaaauaaguauuuaccuauggaaugggagaagauuggacacuuuuuuuauaaucacaauucaguucauaugagagaaccccacagauugccagcuggaccaugauuuccucuacgcccauaguaagggaguaacuggggugguuggugcacgccuuuaauccuaguacucaaaaggcaaaugcagacagaucucccaaguuuguggccagccuggucuacggagcuaguuacaggauagccauggcuacacagagaaacugucuugaaaacauccacaacaaaaagaaaacuaccuguagacuucugucaugcuuuuaaaaacugauaguugguugagggugauuauaauacaagaaucaaauuaauauaauuguugacauuggguccuccccugacuuacaagaaaaggaagguaagcaguuaguauuuuauggcucuuacaguguaaagguggggaaaauagguuuaaaggccgucaaggauccacaugaguugccucuuuuaguugccucuuuuagucugaauugagauagcuaacucuuuucuugcuucuggagauacuauaugggaacuagccaacacugacuuuccuuuuaggguuucaaauggauugguuagugcauuggaaagaaacagcucguggggcuuggagaggaauugguaaaugaauuucauuuccuugcuguacccuaguuugcuuagguuauaaaguuaacuuuuucauaggcucuccuaaauccucaucaaaaaaauggagagaauucaaaauuagauuaugaaauuucucaccccauucuucugggucauuuucaggccauggaugauacacauuugaaggaagcucugguaagagugcugagggagacaucgccagcauaguuauugguggagcuguuuuuacuuugaauuuugccugaauggggaaaauccuuuuugccuuuuuuuacccauuuuaaaguuuaaucauccaguuuauauucaugcaaggaauauaauaugcaaggaauaucuuccucaugauuaauauccuccuuagguguuuugauaacaguccaaauuaaugcccaagcaacccauaauugaaugggaucuuuucaccuucuuuuuaugccuuuucaauauucuuucagacucuguccuauacuucaucuaaaauuucuuacugugaaaacaagugauuguaauuauaaacaucuugcaagcaauuuaauaguugugauuuuaauacuuguguucuuuuaaaaaaugauguagacacucaaucauggcucuuacucucuaaucucuuagcugacuccagguccuuguuauacugcccuuggugggaccugggagaguggagccaaucaaugaggugaacuaaugucucaugcaauagccaacuuuauucugagcgucagacaauuuauacucugaggguuaagaggagucacuguacaauacaaguacaguacuuguacaaguguacaguuacaagggcaggccucauacagcauaaacauguuuuuccauagaggcauauaaacaaauaaccguuguuguaacuaauaugcucacuucuauccacuguaccuggaaggagcucaaaagcauaauccaagaacaauuccauauuguugaagaaacugaggucacuagacucuugguuuguuuuuugggaguuuuaucacaagcacucagaaaucuccugcuacuucaaucuuggacuguaucccaacaauguuacauaccacauuuucuuucuuugaucaucuuuuuaccuagguuugguuacugugaacagugaccaguggcacuaugaacagugcuggacuacgugugcaaguaucuccauagucuguugacuugggugugggauaucugggucauauggcaguuguaucuugaguauuuugaugaaguuccacaaaauuucaguaguggcugagcuauuuguauuccugucaguuuguaaugggucugauuuagacaagaugagauaucgguguaaauguacauguuucuuacuguuguacuccaucuguugagaacuaaaaaugauuuuugaaaaguguuuuauguguuuguacuugaguguauuugugugcaggaguucauggggcccaaagagggcaucagaucccuuggaacugaagguacagacaauugugagcugccacguggguccugggaacccaauccagguccucuggaagaggagcuaauacucuuaaccucugaaccaccucuccagcauccacuaagaaaauacuugacaaucugauaucugccauauaaacaauauguuugccuuuuacacagguacugggagaugagagagcaacgcacccccacccuaaaaggcaagcuaguucagaaggcugaucaggagcagcaagacccucuggaguaccuccagucugaugaggaagacgaugagaagaguggcgcccagcgccggcugcaagagcaacgagagaggcugcauggggcccuggcacucauugagcuggccaaucugacaggggcaccacuccgccaguagcccucacacugacucuucacuguacaaaaguacugcccagcauacuuacaaaguagauccuugggcauaagcuaagcaccuuauuugcuuaucauaggcugcuauucuguagaaauuuaugaagaauguuguugccucagauggggugagagagaauugcacuuuuuuuuuauauggaaauagauuugauguaaaguuuaaacuauuuuguaaauauggauugcaguuacaggguagaagcuacaaguugugggaagcuagguuuugcaaguuuaaugcauucauuggaagcaguucucacaggaagcacuuugugaauaagacauuugugugaaaaaacagauugguacaaauagccaaagaagguugaaauagauuauuuauaagaucauuuuuaacaguguauguuagugugugugacaguacuguaaacacugaagcagagcagugugagacauauguauaaaauacauauuuuuaaauugcagaauagcauggccaauaaguccagagaaaugggaggccaacuauuuggaaagaugauauaaguuauggacuuggaagaaaaaagguauuugaggcucuugguaagauggguacuaguuuuuaaaauugguauaaaaugaguuuuaucccaucuuccugggcuuuuuaacucacuguaaugcugaugcuuagaaagcgcucgucacuuggcuuguugacuggagacuuuugcacauugcucagcugcuggaccugagugauuaaucuugcaaagucuauguaaccuggcaacuggugcauguauguguacaccagugagaucuauuaugggcccuguaaugagauuggcacuuguguuuguauuaauaaaagggacaucugcaggguuguuuuguagugaaauguuuuaggucuuuugauaguaaacacuaaauuuuaauuguucugcuuguuuagcguuauuaguggauggaagccuccauauuuauauuuucagugcauauugccaccuuucugcuucacuucagaauaacaugccaagcuauuuuguguucacuaaguuuagcugucaguuaaacacuugaguaaauauuggcuacucaaauaugcgggcuucugagauaguuuuagcugcaagugucuuucuugucuggugguucaaaaccauuuucuccaaauagaugaaguuauugagcacguuguguacuaaggcaugaauagaauucuaggggccaagcagccaccucuuuuauggagucaagaaucuaucacuugagcuuuuguuaaaaguugaaugaaauuauaugcagagcauagugauuuauagacuccuuaauuggagacuucaaaguaaugggaggaaagaugggcuccucagugccuuuuuuuuuuuuuugagguagcauccuacaaguguagauuacacauuacugagaauguaggcuaaagucucggugguugcaguacacaaguaguuaaauuguguagccuuggagaguggagggaagaaaugucuugagaagcgccaaugugaagcugaaguugugguaguuagaauaauguguaugaugaggacauacuuuaaaaauggaauuccucuguacagucaauuucagaucuuuaggggcuuuuuguaauaagagaauuuauauuuguaauggucuaagaauguuaucuguaaucugguauguagaauuuuaacuuggagcacuuauaaguaugauaagagaccgaccauacauagcaucuaaauauucuugguuuaggguucgauauuuucucuagaaauuuuccucagauaaaugggaguguaugaaccaaaacauaacacucaucagucuugggaaauuuuaaaucugaucagcucaccuuaaggacagcaguccaauugaaaaaugcaauuagucaauucgcagauaagauuuaaggccuucaaaaaguaagggcuugcuuuguuucuucaauugacuuuugucaaccauugagguuaauauucacaugaauuuuuuauuuguaugauuggauaguuuaagaaauuauuccaacugcuuaccauuggccauguuuuaaaggguuauauauuuuguuuugauauaagcuauguacuuggacaaaauacauuggcaucuaaaauuugagguguguuaugacugcuuuuuguuuuaaaaaugugguuacauucagauuuuugaaguguuuuaugcuucauauggcuaaguuguaguuuggcagaguuaacagcauauuaauaaacaugcuguaauuuuaaaagaugcuuugaauaaaauuuuauuuuaauuuaaagcauaaa

SEQ ID NO: 7097 - RNA, 2018 nt, Mus musculus
gggccgcccgagccacucaccuugagguggccgcugucugggcugcucgccuccuccucguccuccccgcccgacacggcggccacggaggcggaggacugaggcgcaccccgcagcgucgggaguucagccgccacgggcaguccggcugaaacgacgccgcccgccgcccccgggcugagcgucacguuaugcgcguucucaccccagcgccacggguacaccaugaagucgcugaagccggggcuaguggggacgagcggcggcggcggcucgggcucccccacgcugcugcacggaggcguugccggcgugguccugaugaccgauaccaguacgcgcuucggggagucguggcagaagacgaccggcggcggcuccgccaugggugccggggcgccgcggaucaugcuggcucgucugcagcccucgcgcucucggcggcccgagcuugccuugcucgcccgcgcugcuacgucucggcgccucacagccgccggcucauggcaggcggcuccgggcgaucaggcugcagcagcguugcugacaggaaaacgggacgcgaggcgccgaguccccgagaauaacaaccugccgccgcgguccccgcuucggcuuuucccgcguuacauuucgcgccugggcggaaccagucaccgcgaggacccugcggcuggccaccgcgacgagugacaggucgcgagagccaauagccggguccaggcuguguuccguccggagggggcggaaccaauucgagcgcggguccuuacugccacgucauuggccgccgcucucauacuuuuuugucuggagggccaacugcguucgaaagucuguaggagcgcgcgucuuguccugacacacccgucgggagccccacccuggccggaugacuccugcgaagguggggagggggaaagaggcuguugauuggaggagcugcgggaaaggggcgugguggugggcggggcgagcaugcugggucccucccccaccagaagaagaggggguguaaagaggguaggagucuggagaaguugcaguggagagggcccuccccaucgccccacccaauccgcccccucccgcgcgcagccaguuuaaagggcugaggccgcgcccgucccaccccaccccacccacggcugcucaaggcgccagcaaagcaccacuucuuuuugggcguugggggguuguuguugguuuuguuuuguuuuucgagacaggguuucucugcauagcccuagcugcccuggaacucacuuuguagaccaagcuggccucgaacucagaaauccaccugccuuugccucccaagugcugggauuaaaggcaugagccaccaccgcccggcuuguuuuuguuuugagacagggucucuauagaguccuggcugcccuguaacucccuauguagggaccaggagggccucgaagucagagaucccauucgccccccccccuccauacacacacacacccaguacugggacuaaagacgugagucaccacuccugccuaagggcauggguucuuaaugugagucccgugaccagcccugcuacgguucccggacuauugguucuugcugccaggcucgggaccgcggugggacgcaugagcaaccauucgcacaguagucagcucccggucguacuugcuugcaguguuucccaggcagucugauggugguagcaguucaaagauuuuuuaaaaaucucuuuagaggcuaaaggauagaacuggcaacuggagcucauuugcuugcugcguuucccaggcagccuguuccuaguagagacuccauaaagauuuuuauaucugaaugaguauccagugguuaagcgauagaaccgguaacuaaacuccaucaaauacaaagcuaugccuaaauuaauuuaggcaccagaguguuguuuuagagaaaacugccuaaauuaacaaaucaaagcagccaauagugugaccuuauuuuuagccacaucuuuauuuuggguaaauaaacuauaccuagca

SEQ ID NO: 7098 - RNA, 123442 nt, Mus musculus
ugaccugagcggucgcccuccuccgcgauggccgcgccggugacgcggcaggucagcggcugcgcaggccgggucccgagcccggcuggcucggucacagagcgcgggcagccgcuagcggccgccguagcggagcugcccgugcuggacgcgucugggagacgggugacguucggagcgcuguuccgagagcggcgagccguggugguguuugugagggugagcacggguagggcgggaggggaagugccucucguuggccgcccagauccugggccgcggcgggugcagcaccucgccuggaaccgaccgcccggaccuucuggaaccuggcugcuaccuuguugacgugcucuucugcaugguugccuuucagcauuucuuguguuacgucuguaaagaauaugucgaagaucuggccaaaauccccaagagcguccuccgaguaaguuucccgagugagcaacagcggccgaugcagugggggugagcuguggguggguggccccuccuucauccucuggggcugcugagacccacgggggucuauuucuguccuaaugcgcucuuuugcgcccucuugggaucggacuaccauaauuuuaccugguaaaaaugccugugucaaaauguugcguaagaacgcaaaaaaucaaaacacagacagcaacuguguuuacaacccaaauaguaauccauuauaggaaaauguaacguauauuaaaagugcagcuuugcguuuuucuucagucgccagaagagcuuuguaacugaagacacugggcauuuguaaaacuaagaucuauuuucagcacacauuuacaggaugagugaggaaaaaauuaaaaacuucugccugcccuucuauuccuuuuguuuauaauacacugaagcaucuuugcguuguaaacauuuuuaauauuguuggcauaaguuacucagcauaaagagaaaugggucucgugauauuuucauacaugccuauucuguuauuauauguggucaccccuucuugcugcuucccuccuccagagccacacuggucaucuuugucuucuuaauauuccuuuacccucucauucccucaugcaucuagaccucauccucacaacacccuuucuacucuacauaaauaugugcauauaaacuuaagccuaguucugcaugugagagaaaacaauacuauauuugucugucuguggcuuguuugacuuggcauaauguccauuuccacucauuuccugcaguucauaaacauuaccucauucuucauaacugauuacauuucccaguguguguguaugugugcguuuauguguguaugugaugugggggguuguuguuguuggguuguuuggguuuuuuuuguacaugcaucugcuggcagauacccacacugguucuguauugugaauaaugaagcaauaaacaugauguguaugugcuuacaaagaacauauaaagauuauuuuauuuauaugaguacacugucacugucuucagaaacaccagaagagggcauccuaucucauuacagaugguugugagccacuaugugguugcugggaacugaacucaggaccucuggaauagcagucaguguucuuaaccauugagccaucucuccagcccucacaaagaacauuuaaaguagauggcuuuuggugauuuuggaguagcacauuacuaguaacugugucacugugcuggacagcacauuucuaaaaggaucccucuugcucaugucucccugaaauuguacccuuugagcacguuucaguguguuccacccccuuucucccagcccgugguagccacuguuuuguucucuacuuccaugaguuauaauguuugacuccguauguauuccgugugaggucauccaguguuugucuuucugucccuggcuuauuucacucagcagaauggccuccauguuuuacagauaacaaaaacaaacaaaccccucagccaggcuugcuggcccaugccuuuaaugccagcacucaggaagcagagagaggcaggaguagcucugaaaguuagagagcagccuggccuacaaaucaaaucuaggaccgccagggcucuuacacagagaaacccuguuucggaaaaaccagaaccaauuucuuuuuuaugguuggaugcuacuucuugggguaccacacuuuaugcauuuguccacugauggacaccugaguugcuuccucaccucagcugguguugacggugcuacggugaacauggaagugugggguuucuuuggcgugcucauuuuaauucuuucggcugugucacccacaguagcaguucugaaucacguggcaguucucuuuaaguuuuggaagaacccuuguacugcccugauuguagaagcuguucaguucauucuuaccagcaccguguaaagauccucuuuguuccauguccucaccgauacuuccuucuguuugauuaguagcaucucuccuagggugaaggaauaccucauuucuguuuucaugucucuaaugauaagcgaugcucaacaguuugugucgagaguguacaaauuugugcacguggguguacaaguuugcacaugcaugugcgugaaggccagaggguaaaccacaaguguugcuccucaggggcuauucgugguuuuuauguaacaucucgcuggucuggagcuugcugauaugaauggacugacuggacggggagcgacaggauccaccugcuuccuccucugucuugcugggguuuugugggguuuugcacacacgugcagcugcacuagccuuugugcauggauucuggggacagaacucagauccucagcaagcacuuuacccccccgaaccaucuccccagcccgagaaugauuucacacggcuucuggcuuaguccuugguuguuagaggucaaaucucagaaccugagaguacuagacagguccugaucccuaucccauuuuugguccauuuuuaaaaacuggauugucuucuugcuguauuugaauuuguaacauagacuucauaggucuuuuugacaagugccuacuuugcauagguuuucuuaguccagucaguggguugugucuuuucucugucguuuuccuuugcuauaaggaauacacaaccuucuugguguguuaacuuucguuucugugucuuauugacuuauaugugcaaguguggaggucaggcagcucgcaggagucaguucuccccaccacgugggucccugagauggaacucaggucagcaggcacaacagcaccuuuacucaccgagccagaccacugcuacacaagugcuacugagcuucccucugcguuuccuucuaauaguuuuauguuugacucuuaggccuugaaauucuuaccuagagaaaacaaaucaucugaguuacucaaauaucguaguaugcauuucuuucuacucaagcaauuuuguuuucuauucucuucgaagccuauagguggcauuagaacaaaaugaaagaauugcuuuagggaaaguucuuucgaauacacauaguuucuaauaauauguacuuguccuucuuccucccaaaggaagcagaugucacccucauagugauuggacaaucaucauaccaucauauugagguaacuaucuagcaaacugaggggccacuguuuuaaauagguuucagauacaaaauuacauuuguugagcugaguauaggcuccuuggcagaaagcuagguuguccuuauuugucucucauuuguucucaugagaaauuccaauuauuuuauucucuuuuuuuagccuuucugcaaacugacuggauauucucaugaaaucuauguugauccugagagagaaauuuacaaaagauugggaaugaaaagaggugaagaaauuuccuccucugguaagacauguuucacuugugauaugauucucucagacacaugugucuucucauacuaggaguuguacauggcaaggcuguguucaauagucuuugugacaaaauaguuauccaaggggcuggugaguuggcuuaauggucaagggcacgugcugcuauuucagaggaccuagguucaggucccaacacccacacacuggcuuacaacaaccuggaacuccaguucugagggaucugacacccucuccugguguccaagggcuccuguacacaugaacacauauacacauacacaccucuauaugauuuuuuagauaauaauaaauaauccaaaggcuuuucugagauucaggcuucgaacugucagcucccuguaaaauaaauuauuuuuaaaauuuuacacauuuucaauauacagugguguagaguaaauacuuucauuugagaaaaaaggaaugauaaugggugucuuaggguuucuuuuguggugauaaacaccaucaccaaacauaacuuggugaggaaaggguuuauuuugucuuauacuuacacaucacaguccgucaaugaagcaagucggggcaugaacuuaaggcaaggaccuggaggcaggaagugaaacaggagccauagaggagcacugcugacuggcuuguccccauagcuuggucagccugcuuuucuguacagccuaggagcacucacccaaaaguagucccacccacaaugagacagacuuucccacaccaaucaucuauuaagauguccuacagacuugcuuacagaccagucuuauugaagagggauuuucucagucaagauuccuucaucucagauauuuuuuugugucagguugauaaaaacuaaccaagacagcaaggaaagaccaaauuacagcaggacuaauaccaaaagccaaacuccaugucccucaccuggaacucuugguggaguccugcgcuccaauaagccuagacagccccacccauccauuucugcugucugcagcauguguugcccuucugcugagcuggcuccacucuaugugggaggcuuucuuuagcagaugucccacaguccuggcgucuguaguauccugggauccccauugcaacaucguaagcuuuaccuucacagcucuaugggguggccuuucaagccacuugcaggaaugugacacugcuacacauggccuggccccagcagcucugugggacauuggugcaagcugucacggucccauaacuucugcauuucucauguuuacaaccgccacagucagugcugcccaguucucugccaguucacauugcaggcugacucccuucuacaguagugaugaugaccugagccucagugguugaaccaggucccuaagccguucuuuuagggcagagaaccccucaguaguacugucagcgcgggcucuucuucagguggacuuauaucuccuuaagcccgagccuccagucuugggguccuguccuccaagcaccucaccuccuuagcagucacaucguccuucucugcacaggacuugucuguagaauuugcucacacccucuuuuuugcuaugucaugucucugcccucccucugacugcacggcugauggggaagagugaauuguaaccaugcacagcuuguacuaacguuaccuguguuaccuguugugagacggcuucggccugacaaccuaguccauuaccuuugaguucaaccuugcuuuuuuuuuuuuuuuuuuuuuuuuuuuucuccaggaggugggcauaguguagccagauucuuugucagagugugacacuaauggucaguagcccuguucccacuuaaguccuguucuccuuuaugccucaggagccaggcuuccacaguuuguguguuucuccuggcauucuggucuuccuggguuuuuguuguuguuuuguuuuuuucuuuauuucauuucaaaugcuauccccuuuccuaguuuccucucugaaaauccccccucccccugcuccccaacccacccacucccgcuuccuggcccuggcauuccccuguaccggggcauaugaucgucacaagaccaagggccucuccucccacugauggccgacuaggccauccucugcuacauaugcagcagcuagagacacaaaucccaccauauguuuucuuugauugguguuuuagucccagagagcucuggggguucuggucuuccuguuaagcuccgauucuuuaggaaguuccuuauaacccacagcaaauaacgugggggcggggaggggggcauuggaugaacaagcagccaggagaaaaguguucucuuuaguccuguuuuuugugaaaacaaaaacaauuuccacaaagacuucuaguauuuauuuuuauauuuaagggaaaagguucuagaagauauuacaguauucaccucaaaguugaagugagaaaauuggcauuuugagaggaccagagaagccuuguauaugcuaggcaagcugucugccaccagguggcacccuagccaaccuuucaucagggcaucuuacuuccaugauuaauauaaaaacauggugaguuuacaugcuuuugugacucagugccagucagcuucccaguaacaguugaagcagagagcgaggcuucucuuccuguacuguaaugaucccuugcagcucacuguaugcccacuggaccacgaguuauagaguucuauguuauucaacguugcauugcccacauucccuacucuugcuauaacuucagugugcuuaguagaccuuaacaagcauuagcaacucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggagugggugggcaggggaguggggguggguggguaugggggacuuuugguauagcauuggaaauguaaaugagcuaaauaccuaauaaaaaauggaaaaaaaauaaaaaagaaaaaaaacaagcauuagcaauauuuuuauuuauuuugauauugggucucacuguguauguagcuccagucuggacuugaacuugugguccugccacaucugccuccugagugcucacagcacuaagcccagcugaguuaaccugucuuuuguagacugaaguugcuuuccaaauacuagauaugagaacucuauugcagagcuuucugggggcccgcuugagguuuaauuauaaagauggggagacaucuguauaguacaaggcagucucucagcuagcuucuaaccuaccucuacuucccugccauugcaucccgcuaugcaugucucucucuuucucucuucuucccugauuuguuccugaccaugcuuuugccuucugccuguccuucugcucaauucuagccagccuccagcucuuuauuuaaaagcuauuagcuauuagcauagugagagagguuccaucacucauucauucauacugagccaaacagcagcaggacuacaaagaguccauaucuuaguguugcuuuuggcuaguuagagggcaacaugaccauccaugauuucucccguggcagcuugcccucuuuaggggcaggugggaaggugacaaacauuuaaauuauagaaagcaggugaugauccacagaagggacaacaccuuugaaaauacauggccacaccuacauaaccaugugauacagcuuguauggguauagaucaucccaacagaacucacacuccagucaguaauucucaacaguucuuaucugugaugcccacaguguaggaugcuucacgagggacggugauaaagggcagccucugccuucccgagauuucagugcagcuuagcaaacugugaugcaagagaagcggaagggacgagugccuguuugggggaugugggagaggggucuagagguaacugacuuuggagaugaagucccagcucaccaugaaaguuacuggugguaucagggugggaaaggggugcucuagacaaagaggaauguacaaaggcucugggaaaugccacucgcuugaagacaggcagguacuggugugggccacuggauaggcuggacuaguucacauuuaacucggaguuugacuuuauccucggggaauccucagggguuuuguggcagcuaagugaaggagucacaguguuguggagaaggaaugagaccugggcaagcugaagccagugauuguggcaacgauguugucagccaaggaagucucacugagauggggcuagaaggggcucgugaagcugacgugccauggccuuuuuauuguuuuuuacguguaugagcauuggccuguagauauccucuuacucugccucccuggugcugggauuaacggcaugcaccauggccacccagcaacauuugauaaaguaauuuuuuuuuaaauauuuauuuauuuauuauauguaaguacacugcagcugucuucagacacaccagucagaucuccuuaaggaugguugugagccaccaugugguugcugggacuugaacucaggaccuucagaagagcagucgggugcucuuacccgcugagccaucucaccagcccccgauaaaguaauuuuuaagauuuauuuuuauuuuauauguaugaauauuuugccuguaugugccugugggacaauggaagacagaagaacugguaagguaguagcaaaaauucagagccccaacucuuaauugagaacggcaggaguucacuagcuccugacuagaauccuguccuggagcaggugaccacaacacccuauuaagaugaccaugacaacugaccauguagcauagaaacccagaguucuccaugagaacuagaugguaccuagaugggccccaaggguuuagcaaauaagcuucccuucccaggcauucuuccugcaaauuuaaucuuuguucacccugaguaaaucuuaagcaucuuauuuacuuauuuauauauauauauauauauauuuguuuuguuuuguuuuuuuuugagacaggguuucucuguagagcccuggcuguccuggaacucacuuuguagaccaggcuggccucgaacucagaaauccgccugccucugccucccaaaugcugggauuaaaggagugcgccaccacgccuggcucaaucuuaagcaucuuucuccaccaugaauaaagaguuuggacaagcaaggacugucucucucaucacagagugccuaaguauccuguagaaggccucucucuccccacuccuggcacucacccugagcuaagcugucccccauccccaguuuaucugagcccucccuagucucccacccccuacacccccaccugguuuucaacucuuagagguucccaguggugucuugaguauccaggaauuuaagaaccacagccccagcguccccccaucgcccccccugucucucacuaagagaaacuugagcuggggccccuaucuuaggcuauguuuugccuccccuaagugccauguugguaccacaguggugaagggacauucagaaccgcgugagccaugugcaguggccaugaggauaggaagagggaguuggaucccuggagcuggagguuuauacuguugugaccuacuucggguccugagaauuaagcuagcuccccagcuucauauuucuuuaaagguuucuccuugugaggcaaguguaacucugagagucauucuuaggauacucacuuaaaaauuaaagcauuggcugcucgucuaagggacauggugucuuaaacuguuuauaaucugguucugggaaccggauggaugccuugugagcacagcaugcacguggugcacagauguauaugcaggcaaaaugcccauacuaguaaaauagaauucaacauuuuaaaaauuuggggcuggauauauggcucagcagcuggaaauacuguuuccuauuccagaggacccagguucaaaucccagcacccauaugguagaugucuuagucaggguuucuauucuugcacaaacaucgugaccaagaagcaaguuggggaggaaaggguuuauucggcuuacacuuccauguugcuguucaucaccaaaggaagucaggacuggaacucaagcaggucagggagcaggagcugaugcagaggccguggagggauguuucuuacuggcuuacuuccuuugccuugcucagcuugcuuucuucuuuguuuguuuguuuguuuguuuguuucgagacaggguuucucuguguagcccuggcuauccuggaacucacucuguagaccaggcuggccucgaacucagaaaugcgccugccucugccucccgagugcugggauuaaaggcgugcaccaccacgccuggcgcuugcucucuuauagaacccaagauggcaacacccacaaagggcccucccccuccuugaucacuaauugagaaaaugccuuacagcuggaucucacggaggcauuuccccaacugaagcuuuuuucucugugauaacuucagccugugucaaguugacacacaaaacuaagccaauacaauugaccccuugucaacuugacacacaaacacaucacuauuaagccucaacccuuucuuucuuauucauccccaagaucuaaauagcuuuaaaagucccagucuuugcaaauucuuacacauuaaaauuucaaucccuuuaaauuauucaaucucuuuuaaaauccaaagucuuuuuacaauuaaaagucuuuuaacugugggcuccacuaaaauacuuucuuccuucaagagggaaaaauaucagggcauagucacaaucaaaagcaaaaucaaacuccaacuguccaaugucugugauccacucaugaccuucugggcuccuuuaagggcuugggucaccucuccagcccugcccuuuguaguacacaccuugucuucuaagcuccagcugccuguacuccacugcugcugcuguucuugguggucaucucaugguacuggcaucuccaaaacacugcaacuagguuucaccaauugccucucauaggcucucuucauggugccaacccucagcuccuuugcaugaccccuucaguccugagccaucuauuguaacugaggcugcacauggcgcucacagugcugagccucagcugcucuucaugaccccuucaugccuucaaaccaguaccaccugggugacucuuacacauuacuaaguccugcugcagcacuagguacaaccuuggcuaucucuggaacacagcgucuuuguguucucagaaaacacuuuccagaagauuugaccucagugaugcuggucuccuucuccuccuccuccuucuuuuuaauuuaauuuuauuuguaauccauuuuuuuacacuccguauuccauuccaccccucaccuaccacccuccaacugcuccacaucccacaccuccuccccgccacaccucgucuccacauugaugcacccacccuccaccccaucugaccucuaaacucccuggggccuccagucucuugagaguuaggugcaucaucucugaaugaacauagaccuggaaguccucuacuguauguguguugggggccucguaucagcugguguaugcugucuguuuggugguccaguuuuugaaagaucucaggggauccagauuaauugagacugcugguuuuccuauaggaucacccuucuccucaaauucuuucagucuucccuaauucaacaacaggggucagcugcuucuguccauugguugggugcaaauaucugcaucugacucuuucagcuucuugucgggucuuucggagggcagucaugauaagucccuuuuugugagcacuccauagcaugaguaauagugucaggccuugggaccucccuuugaccuggaucccacuuugggccugucgcugggccuucuuuucuucaggcuccucuccauuuccaucccuguaauucuuucaaacagaaacaauucuuucagacagaaacagaggugugacugugggauggcaaucucauccuucacaugauguacugucuuccugcuggaagugagcucuauaaguucccucucacuacugucaggcauuuuaucaaaggucccuucccugagaguccugggagccucucaccucccaggucucuggugcacucucagggggggggugguggggggguggggggggcggguaguuccucccccuaaccuucuauuuccugagguugccuguuuacauucuuucugcaggcccucugggcuucaguccuuuucccucacccaauaccagauaagguuccccuccuccucauccacuuucccucccaagucccucccucccucccuccccacuuaaugauugcuuucuucucucucccaagugggacugagacauccuuacuugggcacuucagcuuguugagccuuuugaauuuuugaaaucugugggcuguaucuuauguagucuguauuguuuuuuuuuuuuccuggucucuucuuaauuacugcuaauuucuuagcuccagcuaaccagcaucaguagucccaguaacacaaagguuuguuuuaguaugucugguaucuuuuuaaucacagcugaaucuucagccccagcuaaccaaaaccacagaaucuucacaaucaaaacauggcccugauaagagucuuuaaucuucccucugaaauuucacaagccaggccuccaucuucugcacuguucucaacauuaucuuccaagcucuuacagaacaucacacagagaucuuaacauucuaauggcucuucuagcucagaauuccaaaguccuuccacgguccuccccaaaacauggucagguugucacaggaauacccuccuaugcugguaccaguuugucuuagucaggguuucuacuuagucaggguuucuauuccugcacaaacaucaugaccaacaagcagguuggggaggaaaagguuuauucagcuuacaauuucuacaucgcuguuuaucaccaaaggaagucaggacuggcacucaagcaagccaguaagaaacaucccuccauggccucugcaucaucuccugcuuccugaccugcuugaguuccaguccugacuuccuuuggugaugaacagcaauguggaaguguaagcugaauaaacccuucccuccccaacuugcucuuuggucauaugcaggaauagaaacccugagacaguagcucacaacugccugcaaucccuacgucagacauccucacacacauacaagcaggcaaaacaucaaugcacauaaaaugaaauaaaauaaaaacacaaggcagaaaaacauuuuuuuuauuuuaaaaaguuaaagcacuuagauauuuuaugcuaagucuaaguguuaagugauuaugucaugguuucauuucuguugcugugauaaaaaacauccuguggcaugcagcuuaaaggaguaauuuuacuuggcucacaauucuggguuacaggccaucacuacaggaacucaaggcagcaggaauuguauguauguauguauguguguguguguguguguguguguguguaauguaggaucuguaugaucacguuacauccucagucaagagccagggccuugaauuaacacauguaugcuuaugcucagccuccuuucucuaccaauaauacaaaaucuccuaaccagaggauggugccacccacaguggguacacugaucaaggugauuccccacaaacuugucuacaggccaauuuaauguagaccaguucuucacugagacucccuucccagacgauucuagaucaugucaauuuaauuuauuucaauucaguuuaauugaaaguuaaaauuaacuaucauagacugcuuggauucuguugagccacucaagaaaauucauuguaucccaauaggguuuaugagaaucccacuuuauagccagccacagucuucugcugugcagacaugcaugcagacaaaacacucaucuacauaagcuguaaauaaauauuuguuaaaauuaagcaacccaggcuugugguuagugucuuuguuaaguagggccccaacaugcgacuuagcuucccgccugucugaccugacauuaucuucugggagaauauaucuccacugaggcucugcuuaguuggcacagguagcuggagucaaacugaccagaaggaugucaggauggcgcaguaggggaagguaagcuuaggccugaguguuuuucucuacagucaucaguuuagagcuuaaagucugguguaaacaaggcaagaauaagagauaaaauaguucuaaaacgagcagauaccgaguuucucagcucaaauggagcaggaauguuagucacagagcagaaucgucgucagucauugugaaaacaguagaaaaugacaggcaucaagcagcacuugugaggcccgugcccugcccuccuguggcacugucauuuccaauccaagcuuuccaagaacuuggagggagauuuggggauccuggccaggaagcagcuacuuuacucacuggcuagaacaucuccaaggcuaaugggagugaaccuggagggagcagccuagucauaggcccaggaggagaaaaaggugaaaaucauuaacugccuguguagcagaguauguccuggagaggagcaugcggugagaaaucagcaaguauacaugggaaguuaagauagaagggguacaaaucugagaaaugggucaccgauguccuuucuggcagaugagucaggucuguugcacuucuuccuuuaagacaguguccucagaagggacauuacccccuuccaguauguuuguccuggagauguuuuugguuguccagcucggcgaccaguguuacucgaauuuagcugguguagaaggcaaggauguugccaaaugccuuucugugcaauagaaaaggacaucugagccagugugagugacagguuugccaguguugcaaagaaggaaaaggucaguggaaaguucagugcugugaucuccauugcagaguaaggaaaggagggcggggcacaauagagaagguuugcguggcuggagagaugguggcuucaccauuaagaguucacgguguucuugcaaaggacccaaguucaguuugcaaugggagacucacaacugccuguaacuccacuuccaggggccuccagcgggcacagcaugaacaugcagaaccacacacaaauacacacauaaacacauaaugcaaacauguuuuaaagacuguuucauauaagaacuggcaccauaucuaacuggaauauaaaaugauaacaccuaaagacaguuuucaauauuuucaggacagagcccccacauaaaguccaaccugcucucgggaagccuucagagccuguggcgggcagucacuggcccacuuuuugauuuccaaggagacccagcucagcaaggaggaacccucauuuuagguccaggugagcaucaagggcagguuacuuuccagucccccuauccaagucucagagccacccacuugucuugcauccuagaacagcguggaaguggaagucuugggcuaaugagguggcacggcacgcuuugguaagaggcauccucaucuucagaggcuucuguguauugauguuuguguuuggugaggaguccccacauuccacuccugaggggcggacagcagggauuugagacccagaaaguaagcucggaguuacugauaccugacuauuauggucuuuaaaaagugcaacaagggggggcuggugagauggcucaguggguaagaacacccaacugcucuuccgaaggucuggaguucaaaucccagcaaccauaugguggcucacaaccauccguaacgaaaucugacucccucuucuggagugucugaagacagcgacaguguacuuacauauaauaaauaaauaaaaucuuuaaaaaaaaaagugcaacaagggucaaagagauggcucacuguuuacaggcacuggcugcucugugggguaccgacguuuaguucccacaccuauaucaggugacucacaaccacauggaacuuuugcuccuuggggaucugacugccucuucuggccuccuugggcacccauacucauguguaaaaaccuccccccucacacacacaaccacacauaaaaauacacauaauuaaaaacaaaguaaaucuuaaaagugcucacuuuggcaacacauauucuaaaauuagcauggucccugcacaaaugauggcauacaaauucacaaaguaucccauauuuuuccuugggcgcucaaagaaaucuggaaauuucccacgaaggagaugggggauccauaugugcauagcaaugccagucucaacagagccaucuggcccaaaggaauaggagugcacgagagcagaucccuguacauuuguccaggaaacauaaugagggugaggauucacccaacaagcucugcauguugauaaccagugccucuguuaccacauucaaaaaucuucaaacagaaaaacaaaccgacaaaaaagccaggcagugguggcagcucaugucuuuaauuccccacaguugggaggcagguagaucucuugaguuugaggccugccagggcuacagcaaaaacugaagcaaaauaauaauaauaauaaaugagaagauaaaucuacagacaguguagaugagaauaugaaauaaguuacagaaguucaauggggccagcuagauagcgucccaggaaaggacacuugcuguucacacuuggaaagcugacucccuuuuguaaaugagaagaauccuuaguuuuacuaaccaaaccaggagaaccacacaguucaagccauugccaguguguacccuuuccgaagugagaacugucacauaccacaggcaucaacaacuuuauugacugugucugagccagagaugucucuagcuccauccuggucagugguaagcuggcugucaccacauucaaguucugcauaggcagauuuuucgucauucuuaauaaacauaccuuccaagaaucacuaaguuaacgcuucuuuaagucccagacugcuggaaggagaggucugacugaggguuuugguucuuuacagcaggcacagcucuuagccaucucucacaaauuuagaucagcuuaauuuaaaagaugcccuuuggggcugaaguuguuuaucaguggcagguacaugcuuccugggcucagcaccaauaaguaaguaaauaaaugagcccguuuuaugagucguauaaauuuacccaaaugccacucaucuacuuggaagcuuguuuuuggugcuggggauugagcccacuagggcauagcuguguguacacaccacacacaguuuaaagucccuucccuucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucucccuucccuucuuucucccuucccuucuuucucccuucccuucuuucucccuucccuucucccuucccuucucccuucccuucccuucccuucccuucccuucccuucccuucccuucccuucccuucccuucccuucccuucccuucccuucccuucccuucccuucccuucccuucccuucccuucccuucccuucccuucccuucccuucccuuuuuucucuuuucucuuuucucuuuccuucccuucccuucccuucccuucccuucccuucccuucccuucccuucccuucccuucucccuucccuucccuucccuucucccuucccuucccuucucccuucccuucccuucccuucccuucccuucccuucccuucccuucccuucccuucccuucccuucccuucccuucccuucccuucccuucccuuuuuucucuuuucucuuuucucuucccuucccuucccuucccuucccuucccuucccuucccuucccuucccuucccuucccuucccuucccuucccuucccuucccuucccuucccuuuuuucucuuuucucuuuucucuuuccuuuccuuuccuuuccuuuccuuuccuuuccuuuccuuuccuuuucuuuccuuuucuuuucuuuucuuguucauuuauucauuuauuucuccuuauguaucccuggcuguucuagaaaucaguguguagaccagguuggccuuaaacucacagagauucaccugccucugccuuuuugaaaaagauuuuguuuugcuuuguuuugcaacauguucuuacuuugcggcccuaguugaccagucacuggcucugcaaagcagacuggccucagacucacagauuugccugucuuugccuccugaguacugucaucaaucauuuugcauuucuuuguuuauuuaguauguauaugggugagcaugcuugcaugggggcaggacaugugugccuuaguucauuggaauguccgagaacaacuugcaggagucgguucucuccuuccaugauguggguccuagggaucaaacucagguugucaagcuuaguggcaaacaccuuuacccccugagacaucucaucaacccauaaucuuuucacucucuguggugcugguauuuugcuggggccuugugcacacucuguuggugcgucuaucacugagcuacaucccaucuuccagugucauauuuuucaauaacuaguuugcauccucagaccuggaaggaguguaguugguucuuuuguuuguuuuguuuuuuuaaagauuuuauuuauuuauuauauguaaguccacuggagcugucuucagacacaccagaagagggcaucagaucucguuauggaugguugugagccaccaugugguugcugggauuugaacuccggaccuuuggaagagcagugggugcucuuacccacugagccaucucaccagcccaguuguuuuguuuuuaacuguguuucucaucucaugucacugagucacauggcuguuguuuuuguuaggguucaauuacugugaaaagacaccauggccacugaacucuuagacagggagacauuuaauuggggcugucaguucagagguuuuucagcaugacaugcaggcagauacggugcugaagagguagcugagaguucuacauuaggaugggcaggaagagucucugggccucuucugaaaccucaaagcccacccccauugacacaauuucuucaacaaggccacaccuucuaauccuuucaaauaaucccacuuccugugagucugggggggggcauuuuuauugaaaucaccacagccaagucuucagggggugaagaauuaaaccuguuacuauagguguugccaguggauguaaugcuugaagcaaugccauuugaucgaagauuucaagcuaaauuuuuguuuugaggauaugguugcacacaucuugaauccuaacacuuugggggcagagacaggaggaucucuuugaggucaaggacagccugcucuacauagugaguugcagaccugccagggcuauuuaauagagagaucccaucucaaagcaaacagaaacucugguuuuguguuuaaaguggaauuaacaggacuuagaugauaaauuauaacuugaguggauauaggaggauugugcauacuagguauucuguaguaauugguuuacgcugucucuuagguuaguuauagaacauccuaugaagucaauguuucgcuccccucuccuuccccgucuccccucucucucucucccucuuccccucucucucccccccucccccccccuuuauuuuggcagugcuagggaugacccagauccucaugagugagguagccccuagcccaggaguaaauauuuugaagcaagcaaauuuuuugaagugagauuuauuaguacaugugcuuagaaaauaaaugcaauuucccagcugauacauauguuagucccagauuccaucugucugguuagauguuuuauuuaauucuacuugaugaagcugaauagaagguuaaauuuaggaugcuguccccucggaacucuaacauauuaaauagcacucuuauucagacauugucuugucgugguuaauugccacgaugcagaauuacgguggcauuguguagggaacauaagggacuccagguaauuaauuuucccucuggacuauuuaggaguugaaaugcuuccuugauccuuaucagcuguaacucuaaagacuagugugacguuugcccucagcggucuguccuuguucucuuccagguaacaacauccacuuugugcaccgagacaggaauagguuggaucacaaacccauaaacucuguuuuacagcuuguggggguucagccugugaacuucaugagcagaccuacagucauccacgugugacuuuacguggcaucuuccacuugugaaugggcccuuaaaacgugaaccaaaaugccaggcaccauggcuucauagggcuaugaaacacagaacuuaugugccuauagaacuacaugcugagggacaucaguugucagaaauggaacagacaguuuaaauuuuauaacuucuauaauuuuauacaaaauauauaaaagucaaacauuauaaaacuaucauuguuaauaucauuuuaugaguauccacucaauaaaagauuuuuggcaacuaaaauauaagaagggggcgcuagaaaaaucacucagugguuaagagcacuugcuucucuugcagaagacccaggacccagguuugguuccuaauacccacaugguagcuuucaaucaucuguaacuccaguuccaauggauccaacaccuuauagccucugguacacaugcauacauauaggcaaacacucauacacauaaaacgacagaucuuuuaagaaauacauauguguguauagggaagagaaucgaagaaggggccagauaugauggcacaggcuuguaauccuagcccugagaaauggagacgagucaggccugagcuauauagagagaaccuuucugagaaaaagucagggcuggugagauggcucaguggauaagagcacugacugcucuuccaaagguccugaguucaaaucccagcaaccacaugguggcuugcaaccacccauaagaucugaugcccucuucuggugcaucugaagauagcuacaguguacuuacuuauaauaauaaauaauuuuuuuuuaaaaagaaaaagucaguuaauugcagggaggaauacauaaagggaaagaaaagcaguucaggaaaguuacucuguaaacaguguagccacagauguguauguacuugguuuuuuuuuuuuuuuuuugguaugcuuggagaaaaaauggcaaauaaacacagaacaacuuuaugugucuguggugaaaguuucgguuuuuuuuugguuugguuuuuuuuuuuuuuugguuuuuugagacaggguuucucuguauagcccuggcuguccuggaacucacuuuguagaccaggcuggccucgaacucagaaauccaccugccucugccucccaagugcugggauuaaaggcgugcgccaccaccgcccggcaguuuugguauuucugcuugcuuuccaagcucuuuauuucccgugcucucucauaagcuuggcugaguugggggugagucaggaaagaaucuuuaaacauuaaagugaaaaugccugccuacaucaacuucuuuggaggugcagguaauuucuugcacagggguuaucucccaagugaggauucauggaaccucuuacagacagcagaugccugcuaccgauugcccuaagcuuguuuugguggaauaaguugaaggaaauacuacuugguuugguuugauuugauuuggggacugugcugggaauaaaaaaccaaaguuuuuaugcaugugagcacauucuguuacacugagcuacauccccagcccugaucauguuuuaaauaucuaggacaaaggggaccuagaauauguauaacucuagauacuucuccuagcaguucacauggaugugcacgcgcgcgcgcgcacacacacacacacacacauauucugcuuuuuaaagggcaauauuaagauuuuuuuaaaaaccuuuguaaugaaaagguaugcugugugauugauuggguauguuagcccacacucaugaucucagcacaggcagagucaguaagacagggguagauacugaguuccaggccagucugggcuauauauggugaaauugugucucaaaaauaacaaaaagaagugugcagccaaauauggugauucacgaggaagcagaggcaggagggucucggugaguuccaagacagccaagggcuacauagagagacgcugucucaaaaacagaacaauuaaagacaaaugugcauuggguuagguuguacaguaguaaacaucugcauuuucucaccccagaucugucuuauuuggaaaacuauuuucauauuuuaccucucaaaaaucuuacuuuugucccagaaauucucaugaaauguaucauaaaaucaaaccacugguaauccuuaguaacuguaguacuacuaggaccuuauacuuuuauauaaaacauauuaaggcacaaaaauguauuucaauguacuuuuacacgaguauauacggacagucacguuuuuaaauaaaaaaaugaauauuuucagaauuuaaaauuaaaauuuuuuguuuggguuauuuuguuuguucuggguucuuugggauaagggagaagaguguccauggagagggggcucagguacuaaaagcacacacuccucuuauagagguccagaguuuguuuuccugcacccauaucaggccacucacaaaugccuaaaacaucaguuccagagcaccuggucucaucagcaggucacaugguguacauaucuguacucugauacacauacguagcauaaaguauaaggaauagauguuaaagcagcagcaaguacagacuuuucuaacauaggcuggccuugaacacucaauucuccauucccagcccucuaagugcugggauuauaggcaugugcugucauacccagccuguuccuuucugaacauaaaagaaagaguaauagccagauuccuuuuuuugcccguucuagcuaaaauuuaaugccaaggaccagcgucagccuggagagagguuccugagagaugggguugucugggagcagcagcgaaacaaaccacuggaagucaaaugguggguuauaagcugacagccuguguucugcucaaacagcuuccagacuguuccuaccgaguucugcauucucuggagaucuccagacagcucuccgcuccagacaaccuuuuuuuuuugcaauucuaaaaacucuguaccucucaucucuagcaggcccaaagccgagucguuuauuuuauaucaacucagucauccccccagguucucuuuugauuaucccaugaaucaacaacacaugaccccagcuccuugauucuuagagggagacagcaagcacaaacacagacaauaagcuagcugguugggacccccaaaaccucccuccccacacccugaaauugcuguuacuaccagccccaggccuggaucuaaacucccucugccccaggcugaccuugaacucagaaaucugucuaucuuuguaagcauaaacaaaaaacuuagcuggaugagauauuguccugcgaucaccacuuucuaaaucuuuuuaucuccuuccuuaguauuuuucugacaagcucgcucaaggugcagcugccucuguuccuuuagauccaugaagcuccuugcacaauucauauugcauccuuauuauuuuugcauaguugagaaauuacguauuuucaaacucauguuuuuagcuugcuuccccacagccuuaagggcuguccugaaggucacaguguucugccauuuugcugagacacagacacagcccugccuccuggacucagugcugucucugauuaucauggagucauuaaucuuggcaaagaagacauuccuugaaggaggaaugugaaaauauguacacuauuauacaaaccuuaugcucauagcaaccaucaacacucguggaggcccaugcccugcuggcucuguuccaggaagcaggaagcaugccauuccgacccuuacaugcccuugccggacucagcaaauuuauauauuugaaagucuaaauaaguguucuuuauguagguuuagggagguacaguuccauaaugacugugcaggugauugccacccaaacaaauacauguaauaccaaggcacuaguucuccugugcaaggaugacacaaauuuguaacgcauuucauauuuuugguagaauauacacuaaaaaaaaaagaugcuaaaaaggcauuugaguagcugggugugguggcgcgcaccuuuuaaucccagcacucgggggcgggggugggggggugcagaggcaggcgaauuucugaguucgaggccagccuggucuacaaagugaguuccagggcuacagggcuacacagagaaacccugucucgaaaaaccaaaaaaaaaaaaaaaaaaaaaaaaaaaaaaaaaaaaaaaaaaaaaaggcauuugcgugcuugcugagaguuucagaugcuaaggggauuagcaucaugguugggagcaugguggcacauagacagggguuggagcugagacuuuuacauccugguuugcagagagagacucugggcuuaugaaaccucagaguccacucucagugacacaauuccucuaacaaggccacagcuccuaacccaucuaauucuuucaaacacuuccauucccuggugacuaagcauucaaauauaugagccuauggggaccauucuuacuuaaaccaccacagguaguguguaccuguagucccaguccagguacuugggagacagcucacucaugggagcucaggaccagccugagcuugugugugugugugugugugugugugugugcguguguguuaguguuaguguuauaaaauuaccuguaguacacuaaugcacacugaacuucccaggagcaagucaagauuauacuagaauugaaauccugaaacccuuuugguagaauauauacuuuaaaaaaaagggggggggugcuaaaaaggcauuugcgugcuugcugagaguuucagaugcuaaggggauuagcaucaugguugggagcauggugguacauagacggggguuguuucugugaagaacauagaaauuuguagauacaaugcauuuugugaugcucucugugugcaccagaucuuacccauacagucugcacacuguguggaauugcuauuauaaccaucaucgauaacacacauuucacagagaacauuuuuuuuacaagacauuccagaagggccacaaacaaccagagagcaggcuaaugacaguguguaaaucuacuggcaccuggaaaacaagaauucauucccggcuuaugagaaaccuguacuuuagccaguucaaacacccgagaugguagaguuaaacuaugaccuggggccugaggcccacaggcugcagccuucuuagaacagucagaucucuccaggggucaugaccccaugagggaauucauuaggaacuuuuugcagugaacugcugugagaagaaaaaaaaaucucgauaauacagcagcagauuuguaaaagcauggcuaaaagaaagaaacaucaagguuucugcaguuccagcuacugagagugcugaggcaagaagaccucuugagcccacagguugcagaccagcccuagcuacagcagaccucagugaauaaaggaaaucaaaaugaaucaggcuggucuguguacaaauauuuuaauaaaucacagcacaggguuacuaccuaccucaaugguuuauauucccggaugaaagacacacacacagccuuuauauuuuaauaugccuuaucagcacaauagcugggccacugccuaaccucagugcuguuagaaucuaccacccaccaacuccaaguugcuacuuacuaaucucuauguuccaucuuggcuggcugcucuuaacuccaauuagucagcccucugggccacauuuucuuggcccagagucccagagcgcuuucuuuguuucucuaccccauggcagcucuugucucauccguccugcacucucuuaagguauguugacuccguuuccucaagcuuccugaggucuccaguccgggaacccuauauccucccucuccaucucucuccuccccagcuauuggcugauggcaucuuuauuuacuaaucagaauuaacgggggcuggggggggggcagguucccagaagguaugugcagacccucucgugcaaacuaauuuggggaacccaaauuagcguuagaguacaagcagcuacacuggucuguagcucaguaagaguuuuugucuaggaaaugugagacccuagguucuucuuuccuucccacuggggggaaauguacaacguuccagaguuccauccuuagaggcaaaguaaauuauuuaaaaauagaagaaugacugccaaggagacuggggauagacuaguaguccacacacauuugcucuguacugcacagcugagauagacuauauagaucugggagagcaacuuucuaagaauguaucaugucuacuucaaaaucuaaguuauuuuaagcgguguguucuagggccggggcgagacucaguuguagagcucuugccuggcagcacaggcagauggauggauggauggaucauuuaagacaugcacuugacguacaaacauuuuguaaaagguagucuucaaguuagauuaaagaauucauuuuagcuaggcaugguagcacacaccuuuaauaccagcaugcaggaggcaggaggcagaggcgggggcgggggcgggggcgggggcaggggcagcuagauuucucugaguuugaggucaggcuuuuacauagugaguuccaggauaccuagguuacauagugagaccaugacucaaaacaaacaaacaaaccaaccaacaaaaaacaaaaccaaaaaaacaaaacaaaaccaaccaaaaccaaaacaaaccaaacuaaacaaacaaacaaacaaaaauuagaaauaaauaaauaaggaaaaaaauacccuaaacuaaacaacccaaaacccccacaguuccuaaggggcuaguuaagaugacucagugaggaaaacaugcuagucaccaugccuaaaaaccugguuucaguacccaggacugacaguagaaagggggagucaacuucugaaaguuguucucuaaccacccauaaaacugugguguguacaaacacacaugcacauacauacccuaaauauuuuuuuaaaacacacacacaaccaaaaauguuucuuagaaaauuaucaacgauguuuugauuuuaggcacagauucagacaaaaggaaacagacuaaauaauaaaaauguuuaaaaauaauuauucuguuuauacuuagcuaagaauuagucaauacuaauagcacucacugaucuucagaggacccauauccaguucccauaccaugucagaaacucacaaauaaagguaacuccagcuccagaggacacagugcccucuuaagggcucuuugggaacugcaugcauaugugcauauacucagacacgcauaguuuuaaauaaagucccaauaauaagccaggcgugguaguacacaccugcaauaccagcacccaguacaucuccagaguccaccucacacagaagccagacaagaggcuggagauggcagcagcuacacuguuagagcuaugaacuggggaugacccaaaugucuagcacuaggaaaauggaugaggacauuguggguuaucauguacaccugugaagaauaaacaagaagugugcauaucugagaggcugugucucaguuacuuuucuauugcugugaggagauaucauggccaagggaguuuaugagaaaagcauuuaauauggcucaugguuucaaagagagucugccacugccacgguaggguagggaguguggcagcagacagacaggcauggugguauuggagcaguaguugagaggucacaaguugaagcgauguggcagagccaacuggaaugguaugggcuuuugaagccucaaaaccuucacuuagugacauaccuccuccaauaaggccauacccucuucaguaggccacaccuucuuauccuucccaaacaguuccaccaacuggggaccaaguauucaaauauaugaacuuaugggggccacuaccacacaacacaagcccagaaaacaaagcaguuacagaaaaaaaauccuuuauauacauacaaacauggaugcaccuaaacauuaauauauaaguugcuauguguguuuguguguguugauuuugugugugugugugugugugugugugugugugugugugugugugugugugugugugugugugugugugugagagagagagagagagagagagagagagagagagagagaggaucucacucuguaucccuggcuggccuggagcuuacuauauggguuagacuggcuuaaaacucacagaucuaccuaccucugauucccaagugcuaagauuaaauccccaugaacugaguucaauuccugggacccaugugaugggaugugagaaugaauaaugcaaguuguucucugacagccccucaaugcacacacacacacacacacacacacagaggagaaagagagagagagagagagagagagagagagacugaaauaaugcacauaacuacacguugauauguacucacacauaaaaacaaacaaauguaauuuuaaaauauuggguuagggaacggagcucaauugguagaguaguuaacauccgccaaucucagauggauggugguacaucucuguaguucaaacccuugggagauggaggcaggaggaucaaaagcucaaagucugagaccacacugggcuacaugagccccugacucaggaagaaaguaggaaacaggacaauagaagcaccaguucuccuuuacauggugucgacggugucacuggagcuggaaaaagauggggacuauagccaguugaagcacuccaaaagauuugcucugaaguacuucaaagcaacuccccaaagccacagugugauuagccuuguucaucacaaugagguauuugaugaaagcauuuauggaagucaaauguguuucuagaaaagaacuucaaauacuacgccacucuucguacagugacguaagaauauaaguagguagucggagugcuuuaaaagaugcuuuagcaaucauuacaacuugcuguuauuuaguuuuacucaacuagcagucuggaauccaugagucacugacauuuccagaucucaacccgucaggacuuaaaaugccauacaggaacacguuuacugacuuaaugucaauagggauuagcuuuuuauuuccaagcacugugugggaacaggggccugcauucucuucuaucuagaagacaagacagggggaugucagcucaagagcagacugugccgcuuaaugagacccugucuuaaaguugacaacgaggguugguacuguaccucagugacugaguucuugccuagcuugcuugugccuaucgauuuguucccccagcacuucaaaugcaucuacccacacaaacgauccauauuuguuaggauuuuaggaaauuaaaauugagcuccagagauauaucaccacauuuaaacauaagcaucugacaccuuugcaggagagggaaaaaauuuaucacuucccuacacugagaacugaguuuguggauggagaaccccaggcuuuuaaaucaaaucacacaaaauccauuaaaaucccagcacuugggacagaggcaaacagagcucuagggaguaccagaccauccaggguugcagugauacugucucaaacuaaacaacauaccccaaagauggggauauaaguuagucguagaacauuuagaacaugggaucagcucauguacacacacacacacacacacacacacacacacacacacacacacacacguuuggcugagugcauugguacaugcccuuaguuccagcacucagaaggcugagucagguggaucucugugauaaagaaacaauaagagguaucuguagaaggcaaugugucuccuagaagggaauguaaggguggaggcagauggaucccugaagcucauuagcuagccagccacugaaacagaugaacuucugauucgauucaauaagagacucugccucaagaaauaaaaguggaagggcuggagauggcucaaaacaccagcugcucuuccaaaagaacaggguuguauucuauaugguagcucacaacuaucuguaaauccaguuccagaggauucaauauccucuccugauguccacaggcaccaggcauccaagagggucccagucauauaugcaggcaaaacacacacacacacacacacacacacacacacacacacacacacacacacacacacacauuuaaaaauuaauuaauauaaaaaaagaaauuaauuggggaaagacaucugucaaccucuguccaccacacacuggcacaggugcauguguguaacacacgcacacaaacacaaagucaggcacacacaagacaugagucacuuucauuaauuuucagaaguagauugccuaugcuaaggguuccuuaaccuuugggguuuuuuccccauaaccucuaacuuuggauuaaaagauucacugcucugcugggugguguggcgcacaccuuuaaucccagcacucgggaggcagaggcaggcagauuucugaguucgaggccagccuggucuacaaagugaguuccaggacagccagggcuauacagagaaacccugucucaaagaaaaagaaaaaaagaaaaagaaagaaaaagaaaaagaaaaagaaagaaaagaaaagaaaaagaaagaaaagaaaagaaaagaaaagaaaagaaaagaaaagaaaagaaaagaaaagaaaagaaaagaaaagaaaagaaaagaaaagauucauugcucaugggcuggagagauggcucagcaguucagagcacugacugcucuuccagagguucugaguucaauucucagcaaccacaugguggcucacaaccaucuguaaugggauccgaugcucucuucuggugugucugaagacagcuauauuguauucauauacauaaaauaaaucuuuuuuuaaaaaauaggauucacugcucacaugacugcauuuaaaaauagaauacgggcuggggugguucagcaguuacguguccagaguucauuuccucauuucccagagcauagaugguggauuacagccucucagagcucaggcuccaagggauucgaggcccucuuccagccuucgugaacaaauggagacccaaggguggcuaugauuuccuccucaauaggaggcuuuagccaggaagugguugcacacaccuuuucuuuuccuuuuuuuuucuuucuuucuuucuuuucuuuucuuuucuuuucuuuucuuuucuuuucuuuucuuuuuuuuuuuaagcaggaccuuuggaagugcaguuagugcucuuaacugcugagccaucucuccagccuggugcacgccuuuaaucccagaacucgggaggcagaggcagguggauuucugaguucaaggccagccuggucuacagagugauuuccaggacagccagcgcuacacagggaaacccugucuugaacccccccccccuccaaaaagggcaggggggggguuaauaaaaaagacacagagaaaaucacuguaauucaaauucauaguucucuucucaaacuaaaaaguuugcaugaauguuccuccuagccacaacaguugaugaagaauaaguugcuuuaacguuucuacaacuucagaagagacuugaaucuaugccuucaguuacuuccuugucaauaaggagugagacaagaacaucuuucuuguucuguaauaguuggcaagaaaaaugugugaaguguggguuauaaaggaggugguuagcuaucucuaauuaccugauuaucuuugcugauuaggacugugaagcuuguuguguccugcccuaggggcaggaggccugguuuggcugcugccacaggcagcaucaacuuggaucucugcagccacuuuugcagaguucaagaaagacuguaggaacccgguguguuuagaggaccaggacucagccagaauugcugauccaacucggucaggaggagagcgccagaaauaaauuucagaagccaaaauauuaugccagaagaugcaucuugacguggagagcagcgagcaaagcaaggagcagcaaucagaggcagggaaaugucuagaggacaaggucuccaccgaggucugauauaggaaucuugcccuugucugcauggagggguuuuuagcucauggucuguuguuguaacauaguaccagagcugggguacuuuauuuuauuuuauuuaucgagauaggguuucucuguguagcucuggcugucuuggaacucacucuguagaucaggcuggccuugaacucagaaauccgccugccucugccucccaagugcugggauuaaaggcguguaccaccacugccgggcugagcuggguacuuuaaaacaaacaaacaaacaaaaaccaaaaaagguuuguuuagcucacaguguuggaaguucacuagcacugcgccaagcccaggguaguggcacauaacuuaccuuaaaccccaacacuugaggcauagcaccuguauggauuggagaaguggugaaggaccucaugguagacagcuuaacaauggcugcaguguaagagugguaagugucacaugcagaagagaugggggaaguaccaaccucuccuauaauaacuuaacccuuuuaggggcuaaccucuuccaggagaucugcauuaauccuuaugaggguggugccccccagaccuccugaauuccacuaaucucuuaaagguuucaucaugucaguaucccugaggaacaccaagcugccaacauacaaauuuuggggugauauggucaaaucauauuuaaaccacagugggugguauuuuuaaaaggcuuauugggagccccacaugauaucaaaugccuuugauaccagcacucaguaaggagaggcagauaaagcuugaggucacccuggucuauauagugaauuccaggacagagcuacauagaaucugucucaaaacaaaacaaaaaaccaaaccaaccaacaaaaagagaggagagaggggggagagagggagagagagauuaauugguucuauaacuuauuuugggcagugguuacauaccaugugugauuuuauaacucgcugaacgaauaucuauuguguuagauuucuauuccuguaagaaaauaccugagauaaucaacuuaaaaagaacaaaggguauuuuggcuuucagugcuuaagcuugguuggcccauugcuuuggggccauugguaagacaauagaucauggcaagaauaaaguguagaauaaaacugcuuauguuauagccaagaauaaugaaagaagagucccacaucucacaguucccuauaaucaugcauccaauuacagauccuuugacacaugggccuucagaguacacucaaaauccugugcaaucuuuguauugaucaugugcugauuauacuuuuaaaaaauuuuagaagcaggcugguuuuuguaaauuuaagggcagcuuggucuacaaagcaaguucuaggacagccagggcuauucuacagaaaaaaaaccugucucaaaaagaaaaaugaaaaacaaaaacaaaaaccaguuacuuugagccagcaugguguuuucuucccagcacuuggaaggcagagauaagcagaucucugugaguuugaggucauccuggucuacacagcaaguuccaggauccaggacaauuagaacuauguagugagacccugucucaaaaaaaaaaaaauaauucuuuuggauuuugagauaaugucccucucuauauccaguuaaccuggaauucacaaaguggcccaggguggccucagauucacaguguuucuccuaccucaucuaaggacugggauuaaaaguguguguccuuaugaccagcaggaacaaguuuauuuauuaaaaauuuuuaaauguuuuuauaugcccuguuuuuccugcacgcaugcaugucugugugauauuucagauccucuggaacagguacagguaguagugagcugccauauaaaaauuuuaaccugggacaucuggaagaucagucaguaugcauaacacagggccaucucucuagcccccagggggccaguuuguuuuuaacagauacagaauaccaccagccccugacaauauuucuauauaaaagaaauacauucuccaauuuggaaccuuuacagcaaguagcguguuggaauuguauauguguguguguguucauguagggacaccuguuaggcgucucccacugauuaagcuagacuguugccacuccacacuagaaacccuccuguuuuuguguccccagugcugggauuaugcauacuuacucaguuuuuuacaugggcacuaggacucuagaucagguccucauuguuacagggucgacacacuacccacugagccaccuggaagccagccaagccagaacucuucuguuuuaaaaaaagauuaauuuuauuucugugcacugguggguaguugcgugugaaugcagguguagccagauccccaagcuggaguuacaggcaguugugaccagccugaccuggguacuagaaaccaaaccgagguauuccacgguagcagcauucaccgguaauugcucagccaucucuccagccccagccugaacuucuugauucucagcuucggagagaugucagucauauuccagagugaggggcuucuccuucucgggcccccaugcuuucaaaggcuacaauucuaugaucagugaccaaacaaugaacaauaauguacucaaugcacgcaaacucagguucuuucccaaagagccaaauucucagaacucagaggucagcuugcugaggagagaaaucagacaauucaaaggaaaugucacacauauacacaaugaaaaucagcuaauguauuuuccgccacuaucuaaacaugacaggaaaacaaaacauaaagagaguuugagguuacauuuacuuauuucuuuaguauguguggaggggaugugugucaaagacagcuuguaggaacugguucucguccagugaguagauuccugaggauuaaacucagauugucauagcugcuggcuagugccuuucccccugugccaccugacuggccuuuuugguuuuuguuguuuguuuugaggcuggaucugguuguugccuuggcuagcuuccaacuccuucgguagcagagggugaccaugaaguccuguuccccuagccuccacuuucaaguacagauauuacaggcaguguggccacacccaagugaauauguuuagcacauggacuucuaguucccaagacaugucugaauacuuaggaguaauaaaaagccuugcuuuaaaaauauuacuucagcaggaucauaacuaugcaucugcaaaauaggaaaaugcguacacggcauaacuauguacaccuaagauuuuucccuuuauuuaaaccaugugcauuuuguuagacuuucuaguggccagaaucuagccaaagcauucuauuugaaggugagagaaaaaucaacugacguauggaaaguacuuggcuguuagacauucaacuaagccagucucaaaaaguaacgaaugugggccaggaauguggcuugcugggguagaucauuugguccagcacaagcaaggguugagucccaaaagcucaaaaaaaaaaaaaaaaaaaggaacauacuagacacacacacacaagagagagaggggggggagagagagagagagagagagagagagagggagagagagagagagagagagagagagagagagagagagagagagagagagagagagagagagagggagggagaauccaguaaggugccugcaguggcucacaccaggaaucccagcacuggagaggcagaugccauuuucagcccagucugggcuguguaguggaacacuuucuuccauguaauccuauggauuauaguggugguuaaaaaaaaaaaaaacaaaccaaaaaaaaaaaaacuuuucauaaaauuucugauugugacauuugguggcccuucuacugugaguccuuggaaccgugugaaggacuuucucuuccugggcaaaaguuuuugcuaacacuacagacauuuuaaauguaaggccuucguugauguccuauggaaacccgaaaggugaacaagcagguucuuaagggccccuggcuaaggaaagccagucccauaucuuaucuuuuccgaagcagcaggcuuaagguagggcuucaaaacaaaagaagccuucccuaggggaaggaacuucgugaaaucugcauuucugagagguucuuugggggaggggaggagggacugaaauuuaucccucugacucuugacuucccuuucagacuaaaucgcuguugacuacaguccugccgauggggacuuugggacuaccgacugcuuccagucuccucgcccaaguagaugcuaccgugaagcugggcucuucaaaauggcagcuauggucaaguuccagaaagaucugauaucuuuuuaacccaguagcaaaauauggggcgguaccacugcagacccaaaggagaaaaggccguuugcucagcuggccacaugcuccaacacuucgugcuaagucggaccguggccaccucggcuacccacagcgagagcuagcgcgcuccuggguuccgaggugaggugucggaagguucaaaccaccgcgguaaaucgcaucuccaggugguuucaccgacgcuaagaagcccuuaucgauccgauccgaucggauaggugggaaaacggcgcuggucugaacuucuaaguucugagguccacucugccuugcguccacagagcugaggaccguuucagcagccuacacacucuccuagcaggcggccaugacaaggcucccuuggcgcgaauuacaggggagacccaagaaacacuuaaaaaagaaaaaaauuccaucucaaagauccgaaguggaguuauuaggguaggguugugcaggaacucggagacucacucgaggaacuggggacugaggcgucaacaccuggacacaagagacaaaaguuagaggggucccaccaagggggucgccagcacgcuuucugcccgauuggcggaagcgcucagacuuuucuuuauggcgucaccgaguaccugccuguaggaaggcuccaguugcgugacgucacgccgcacugaccaaugagcggcccgagccgguaggccccgaggaggguugugggcccuucuuuuugugaaugaagcuccacggaacaucccuccuggggguccccgggagccgcggcccgcugagcucggacgccacggcagcagcgucccagggagcgcgcgcuuugcuccagccaccggccagcgcuguggggcccccgggucgcgggcggcgggagacgcagcgcgaggacccgggccggguugccgggccauggucgcgguccccugacgggccgcgaccgccuccaugaagcguaagagcgagcggcgcucggcuugggccaccgcgccccccugcucacgccgcagcucguccuccucucccggcgugaagaagagccgcagcuccacgccgcaggagcugcaccgccuggagcagcaggacgaccuguaccuggacaucacgggugagccccgccacacccccacgaggcucgcgccuccucgagccucuagucgcccgugcgcccgcgguagcaacuuuaccggagaugggccgaggggucacuccugcaagugaguccggccucgggagcggggcggcucugcccucgaacccaccucaucgcgggaugagccggcgcgguuguucccacgcgaguccgagccucugcugagucccgcuggucuuugcugucccgagggcccaaagccucgcugagccuuagcaacgcgugggauccggcccgagcccccggccguccgacaccccccccccgccccccacgcugucgcgcccucucaggccuccugagggaucuuugcccucccucucgugccuccagaaaggugucacguugauggcguuugaaccaccaagcgugcuaagagcucagaggugucacuuuugagaaauccccgccagccggagcggguagaauagccgcuuucgagggugauuuuuuuucuuggugucucaguucuugaagacgaaagaaauccguuuuggcagccgcucgguuugcugggguugauagagaagccagagcuuugccuucguuguacugauguacguggaaaagcguugucagcugcauagcugccugcgcgguugaaggaaggugccgcguuuucuggggcggaugguguccaccucuuggugggguuuuuagaaaagguuuccaagacuugaacuuggacuuugcuaggugggcucucgauuggugacauuuauuuauuuaggaaguguuuagacaaacaaauuuaguagaaaguauauucuagauuaaugggcaacuagaaaguaagaccgguuuuuaaaggaagcugagaggagaggaaaggguuuuuuuuuuuagcguuugaaggaggaagacgaaggacuuguuuuaacuauagccccugacuagugucugcccaggucuaccggugugugacccugaaggaggagacacccuugcccggguuccuuccagagacuucgugcugguugaaucugcacauuauuucugcucuuuuuuuuguauggggcaaacuuauuuucguauagcucuaaauuguaaagauacacagaguauacugagaaaacuuuguggcaaagacaaagaagugcccccuaaauguaacagauguugccaaguucucgugaaucuuuccagaaauauccuccacuggcacacauauguaucuauucuuugcaaacccaugcaggaugguauacgauugauuuuugcauugcucugcacgguacuucauagcagaaugcuagccuccaauugauguguucaaaaucucauuugauuuuaaaugcuuuguaagccaaaggguguguggcuuuaaaggguuaaacuauaaaaaauguuuauggauuuaaacgcguuuauaguuuuaaauguuuuaugaacauuuuaggcaguucucuguugaauauuuaggugauuuucaacaagaaaaauuguaaggcugggugugguagcccaugccuuuaauucuaguacuuuggaggaucuuugugaauucaaggucagccuuguguacuuaaugaguucuaggaucuauguagagaguaucuugucucaaaacaaaaagaaaaaaauuguaagauuuaggcaguucucagucagaaaaacuguuaguggaucugaagcgaacauucagggccuuugugcaugcuagaccagcucuucagcucugagcuaggacccaccaaaagaauauugaccccaggcguugggggaaaucuuucucuuucguggggauaaaguguaacuuggcaagccuuccugaggaagucaucaaagaaauaauguuuaaaaaggucaguaauacugaaggcgcuugugcauuuuaugcacaaaaucaaaauacucuccaguuacaagccuugauaauggagcaauccagacuuagagcaagaugcugcacuagcuccaggggacaaggcuugcaacccuucagugaguaaauucaguuucaagaaaggaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaagaaaagaaagacaaccaaacaagaaaaacccaagacacuaaaacagucuguuucuguguuauuugcuaaaaaaauugaaguaauuguuuuuuuuucuaaaugacuuacuuguauguguauguaugugugccugagugcauauauguuuaccacauggaugcagagccuccgggagcuagacuuggauccucugcaagaguagacaucucucagcaccaugcaccucuacaccucuaaaaacacugggucucauuuuguagucuagcccagcuuggaacucacuaaaccacaccagccuuaaacuugagauccugcuguuucagccuccucagugcagggguuacaggcaucagcuagcuaccagguaaagucgccgcgcucagauuacuuuuauuucuuauuuugugugagguaguaauggaggcagggagguauaaggaaggcucugcgcuuagcaaaaggcagcuuggucccuucauuuacaacuuuuuucccaucacucguuguuuuauuguuauuugcuuuuugagacagggucuuacuauguauauguagcaggcugaucugggacucuggguagacaaggguggccuugaacucacagagaucuacuaccuugaacucacagagagagacagggauauuuaacucuuaccaugacuguaugcgcaaaucagaggacagcccuuggaaacuaguucacuucuucauguuaguuuucagaauugcacgaaggucaucaggccuggcuguaggcucucuuagcagcugagccacccggauguucuccguuucauugcccagugcuguccuguugcauggcugaguccugaucuccuuagcaguaguaaguugggauuugggaauauguuagguucuauggcaaauggcugcagaagcaacggugcguggagucuucguacuucuucauacaugugugacucuguaagugaauuuuagaagugaaaauguugggccagcauuacacaguggacuuuuggacuugugugcauauugccacugugcacauucauucaugugcaggccuuugcagggacaggcuuucaucuccuuuggaugcguagcuuguugccaugugugauaacuccauauucucacaucucgcucgggugcuuucacugucagcuuuccuaucuuugaggugccagucauuucuacgucaucuuuacuaacacuuguuccugagcaggaagacuuuuguaguaagacaugguuuggaaauauuaaggcaugcugucuauuuugccugcucuuccccuaaggcuuuccuaaaacuuacuguguagcuuugaauggcuaagcccuuugcuuccaccugagugcugcgguuaugaacacgaaucauugugccuggugucaugugaugcuggggacuaaaccaagcuuugcaugcaucccaggcaagcccuaguccccacacucuuuuaccccaaagacccuuuuuuaaaaaaauauuuuucaacaggauuucucuguguagcccuggguauccuggaacuagaccaggcuggccuccagcucacagagaugcgucugucucugccuccugagugcugggauuaaaggcuugugccaccaacaaacacccaacaacccuugauuuguuugguuuuuguuuguuugcuuuuuguuuuuuguuuguguuuuuguuuuuugagauaggguuucucuguguagcccuggcuguccuggaacucagaaauccgcccgggauuaaaggcgugcaccaccacagccuggcaacccuugauauuuuuauagcagccuguuaaaaauguaaaugaauuucugccaacaccagggucuuuugacugugcgcugcuugcucauuguagauguuugcgugaucacucuuguucuugacuaacuaugacuagccucauuucugugggguuuacuccuaucagaagcagaccuacucaauagggguagaauucccaccccaauccacucagcgugcuuuguuguuacuguuuuuguuuuguuuuaaaauugaacuguauuucugauguaccaugaaaaccaaaucuaaagacggugaacugugcaccaaaugcccugagauacuaaaaaugccagaggaagcuucaauuaguuaaggaaccagggagaaaagaggucuugaguuuuuaguguguugaaaacuguaagacucggaauugggggaaaucagugagaaaaaucaaaggacaaaggaauuuuaucuuucuaugaaccucuuuggugccagaguuccaaagcuuuuuucaauuaucaaauaauuaaaauagagccuuccuuaaaugagcaugcaaagguuccuuauuuuguuuucuuggguuuuuuuuuuuuuuuuuuuuuuuggucuuuucuuuucucugcuucgauucucuucucuucuugucuucucuucucucucucucucucucucucucucucucucucucucucucucucucucucuuucuuucuuucuuucuuucuuucuuucuuuccgagacaggguuucucuguguagcccuggcuguccuggaacucacucuguagaccaggcuggccucgaagucauaaauccgccugccucugccucccaagugcugagauuaaaggcaugugccaccaccgccuggcuggcuaacugaggacauuuuuaagcaauugaacacagcuacaaaucugaucaucucauaguugauacagaacguugauuuauuucacuguuuuaucuuuuaaguuucuaauuauugaagaaaaauaguaaauaguuacuauuggcugacuaaagacuuuguuuuuauuuuauuuaugcuuguuuuuagaggcagagucuuuacucauguaggucaguauaucuugaaauugauagguagccacguaugacuuugaacuugugauccucaugccuucaccuccguagugcugugauuacaggccugguuuacacagugcuggggauuaagccaagagccuuccacuaggcaagggcuuuacugacagagcuacauccgaagccccuguuuuaaguuucuuuauucucccuccuuuuaaguuuccuaggaucugccaugguuuaguguauaucauaauaacuuacaggauaaucucuaguuggggucaugcuagucauuuccaagcacugggugucuuaugggcagcacaggcuccucagacaaaugagagcaaccaaagcagcacuccccucuccccucuccccucucccuuuaggaucuuuaaaauucacagcagaugccauuggcuagggacguuuauucauuaauucaagaaguguuuauugaaugcuuacuauguaaaauucuuuuguguauucauuguuugcccugugggaguguauuuuucuggauagaagaggaaauacugugugacacagaacacagaggacaaaguaaauccauuuccauugcucuuguuguagcggaggagaaucuccucgacguguccguuugucuuugcaccugcaaugugccugugcacucuuaccuuugcugcauccugaacccgucuugauuucucugcuuccuagcucuaaugcaucuucuagcucuggcaguuccaccgcacauaggcaaagaaguuaagccucaaaugcuauuucuuuuauggcuuuauaguggcaaauaggugaggagggaguggugcaggaccagcccuaaagucagggaaucaccagccagcggucaucggcuauguucuguguuuauaaaugauauuggagagagcucagccaaaaccacacugagaauucuuaggauguagguagacggcauggugcaugcugauaacaguucuggaaaaauucugauugugaguuuuaggaaaggugcuuugugggugugcaauuuuuaacauuuuaaauuauguuaauucucucucucucucucucucucucucucucucucucucucucucucucucucuguguguguguguguguguguuuguuuguuuguuugggaguggguggauguauggcagucagaggacaacuugcaggaacuauuuuuucccuuccacugugugaguccuaggguuugaauucaggcgguuaggcuugggcagcaagcaccuuuacugaucuacccaucuucccagccauguguguguuuuaaauaauuucaagugauuaucuaaagauaauaugacccuucacuuucccaagaggaugccaucaaaugcuggagauuagagauuugggcaaauggauggucucuguuuaauaaagcugugacugcccaacuuuuccuuuuuccaacagauacaacugcuucauaguuguauaaaaauuacucggcacgcuggacauuugccagcucaucccuugccacuuaggcaagcaggcaugugaugacggucucuuggugaacaguaccugcaaaucgaauuuagaacugagaaacuagugaauuuggacaaauacacaacacaaauacaguaugcaggucguccuccaugcgugcuguuucccaaauugaccacuagcacgggcccaacuuucggacacgucauuuauucaauaaugcccauugaauacuauccucaggugcuagaaauaaagacccgguaccaggacaucucuguucuccuguauuuguuuuuguguugagaaaacagaacuuggaaggugagggugagagacaggggauggcaaucgagugcugugcuugaaaucugcggggcagguuuugaagagcgaggucucaggccaagcuuuugggaggcugaaggacucaggaggaaccuuacuuggucucugccagucacuuggacugauuguucacaaccuucuggagccccgauucuccagugugucaaagaugaaauaaagggacaugcauggccuggucuucaaaugccuggauugaggcuccaggguuacccagguaacaauggugggguggcaccgggugacagcagugagguggaggucauucugcucgaaggcuccucccagcugagaggcgcacaguccccucuccgugaaucagcacugaggcagugagugcaguugagcugacagcucucagcugcuacacugcuggcacacgaugcaucagagucagcgaugaggccagccuucagagacaccgaguguccuuuaaagacuucaaagagcaccaguacaccaaagcuccaauuucacaucugagcuguuauccuggagugcuuauagguuguuaguuuacucgugucucaaugccgaggcuucacuugggagccacagaggugaagugggggccuuacaacgacagacauggacaacagaggcccuuccauuacuucauccguagcagagacauguuaugugcaagggucaaagcuggaaauagauuuuuuaaaauuauuaugaacuagacuuuucccuuuacauuuaucugugugugaaugcacaugcccuggguaugugugagccuguucucuccuacgugggagacucuaguauaccaguucugagguuuaacugcuuagccaucuucccagccccacauuaaugucuuuauuuuuauauuuauucguuugagguaggauauuccuauguagcccugauuggccuggagcuuaucacuaaguggaccaggcuguuuucagcagacacacagaauuccacuugccucugccucccaagugcuggaauuaaagauguacuuaguugcuauaauuuccaaucccgauaaacccauauaaaaacacacacacaauccaauuauaaauauaaacuauaugcuuagauugggcagaucuagacacuauacucacuuauuccccagcuauaagacccuuugcuacuuacuguuucuccuggccaugugguucagguccauggaggcuuccuccucuucugucuucucuccuccucucuugccucuucucucuucuucugcccccacucucaagccuccugagaggaagguucacaugagaucaacugaguauucgaaggacugcucuucugggggaaccccucuugaggaagcagaauuaacaucagaauacaaacaacagcaggacaacccacaaccggucuuuuauuauuuuggcuaagauuuaaaaauuaauguuuggggaaguucacuuccguaaacaguauuuuaccauagcuacagaauauuuuugccuaagucaguccucuaagaugcuuuguuggauuuuuuuuuggggggggggagcaaagaacuggacauacuguuuaugugaacaucucaaagccguuugucaccuggaaggcaccuuuaccaguugcauaagcaggaucagaaggugaagaaacuguacuagacauagagaauuggagucuguagaagccaaccagucuucuaacauggcuucuuuuaaucucauguuuaaagcuuccaaacuuggucauuuagcuucugguugguguuuuguuuguuuguuuuggguuuuauuuuguuuuguuuuguuuuugagacaagguuuuucuguguagucccggcuguccuagaacucacucuguagaccagacacuggccucaaacuuagagauauaccugccucugccuuccaagugcugggauuaaaggcgugcgccaccacugccuggcuguuuguuuuuaaauuaguuuuuuuguuugguuuguuuuaaauuacuuuuuaugugcaugaguguuuugccugcaugugugucuggugccugcugaggccagaaguaggugucagauccccuggaccacgaguuacagaauguuguggggugcugggaauggaacccaaguccucuaccagugcacuaagugcucucaagcccccauggugucuauugguauuuguuuguuuuuaggugaccuggcuucaauauuaugcagagauuauuguagaaaaacgcuuccaaaaacagaguugauuauaaaaacaaggcaggagagauggcuuagcaguuaagacuauauacuguccuuauauuuucuaucuaaaauuuauuuauuuauuuauuuauuauaugugagugcacuguagcugucuucagacacaccagaagagggcgucagaucucauuauggaugguugugagccaccuuguaguugcuaggauuugaacucaggaccuucagaagagcagucagugcucucaacugcuggcugagccaucuuuccauccccagcuuucagcuucuuauaacuucagcucuaggugaauucagugcccucuuggcuucguuuagaaccuguacacauuugauaugcacacauagacacacaauuaaaaaguagaaauaaaucuuaaaagcugguuuuaaccuucccaaaguagaauauauauauucuaaagauuuuaaacuuacauuuauuuaguguguauguuugugugugagaaagaaagagagacucugugugugucugugugaacaagcauagaugcuggcgaauugguuuucuuauuucacaaugugugucccagcuaucgaacucaguuuuuugggcuugguggcaaguuucuacaaguuaugccaucuugcuggcccuuaaagucaaggcucuugacgugugauacguacaacucauuugggcccuguuuuguagagguuuuaugccccgcccccuuuuaaagcaacuuuucaugaauauugcuccaucaaagguagucagguccuugacuccuuuaugguucuuucugauacuuguaaauaguaaaaucuaaucugugaguugugagucucgguugugucuauuucugcuuguccuugguuugguuugaggugacagcagcucugacuauagaucaccuucuucacaacugaagcugaaacugcccuuccugugaaaagaggaguugaucucuguauaugcguaauaccaaaugugauuuccggguauuuuuuuguuaugaauguuaaaugaugaaugcuuuugguaguaccaaauuugucuuuuaaaauugaaguaccuuuuaaaauggugcuuucugaaauaauauuuacaauuaacugauguaagaguuauucuuuuugguuuguuuguuuugagagagggucuuuaaaauaauaguuucuuucuguuugggcauuucugugccuaccuggcagguuuauguaauuuuuuaauucugugaagcacaagggaaauuucaugaaaugcuaguuucaauugggucucugggaagggcuuuuauguucuguuuuggauucagacaggaaaucaagcugugugcuagggaugggacccaggagggccucuuguaugauugucaagcucucucgcaaaacuacagucuuagucacuuuuuuuuuuaaguauucuaauuuauuuugauuuucaaguuaaauaagggaaccaguggucccaaccauauaacauguuucaauaauuauucucucucucucucucucuguguguauguuuugccuguauggaagugcacucuauguauucgauaaccugagaaaggccaucagauccucucaguggaguuacagaugguugugagccaccacgugggugcugggaauggaucgugggucucggcgagggcagcagaugaucuugggcacugagccccugcucuaggacuguccaguucuuccuaguucucaacaucaguuauacgccagaggagcaggucccuuagagggugcauuguucaccagucagaagauuuagucccucugucuggaaagcagaggaaagcugugcuggaauuaauucuagaccagcaucacacaugacuccaugacuucccagguaguucauuuuuaucccauuaaaauucuguuggcagccugcuuuucacaaaagcaaaacaucuuguuccugaugucacuggaauuuguuguuccuucagguucucauuugaaagugaaauuacucucagcucugcugugcaguuuacgacauugaucucuuuauacccaauccauaacgcuuuagcaucguuuacgaauuucgaauucugcaaagcucucuauuuuaggaccaucucugcugaaucauucucugaguuuugcucuucuguaugaauuauucuauggaauuaauuaaaguaucuauucaguaaggaauuaucacacaauugcuaugagcaagaaauuguaccaagaauuuauuccugagggagggggcagaggacuggaagauuuauaauauugugucccuaucucuaaacagggagaacaguagauuuuuagucaucucagagaagacagcuaacaaggacuuaaccauguggcuguucucuuuaaacuaucaguuugagauaguuuuauguuugaagugucacuugacaguuccugcaugauuucaguuacuuuccccaguaaguugucggaaaggauccauuuuaaugguguaucuuugugugucuaucugugugauguuuuauguuuguuuuguuuuguuuuguuuuuuaauucuaugcuuuaccuuuguucuguuuggacacaaacuagagucaucuggaaauagggaaucuuaauugaggaaugucuuuuaucagauuggccugugggcaugacugugggacuucugggauguagaaguagauguagauguagauguagauguagauguagauguagaaguuucccuuaucacagaacauggagcagaaaauuagucauccuagggaagacagguaacagggacucaacugaguggcuucagaucccaccgccagguuccugcuugaguucccuuggugauagacuaucaccuggaaauguaagaugaaauaagccccccucuaccccaaguugcuugugguagaagccacugaauauuuaguugcuaaauauuucaguagcuacauuaggugugugagcugaacugaaaagcacacuaacuuucacauucuuuuagggugcugagggagaaaugcuuugacaaggaugucugauguaauugaaaauuauguucuuaacucuaugaaagauguucucaaacugcauuuggaauuaauuguugaaauaauaaguagcuuguuggaagugccucacacaugagacugaaacauccuaacgugcguuucuuccccuuuugguauugaaauaucagcaaagcuuaguuuaugaagguaauguguucuuguuuuaaaucauugacuccgaaagggccuaaagcacaaauucagucaagacacauuuggauacauuuucaaguugcauccuugccuuggcugcagggagaacugcaacagggaucucaggaagggagcugggaaagguguggcugguguauguagccuuugcugccugcaaagggaggacacuuagcaguggaugccuugggaugaugggauaccuaaaguuugaacugagauuuuuagaguuuccuuccuuuccuuccucccuuccuuucuuccuuccuuauuaaaaaguguuuuuuuuuuuuuuuuugaguccaggucucacucauuauguguuccuggcuggcuuggaaccugcuuuguagaugaggcuagucacagaucugccugccucuuauuccuaaaugcugggauuaaagguguuugccaccacacccaguuacauuacuuuuauuuaguuugagcaccugcacacaugccagggacaguuauauccugcccugagggucuugggggaucaaacucaggcugucagccuuggcagcagaauacggacuuuucuuauuuucucuguagagcaggaacugacuuuauuuguuuauuugagcacuucauuuaauuuuugaggcagguuucaaguggccaggcuagcuacgauuuuacuagauagauagucacggguguucuugaacuucugauccuucugccucuagcuggugcugggauuucagauguaucuccccaggcauuuuuccuuaauuaaaacauuuucauaguuuccaaaaugaagauguccagggguugcaggcauguuuauuaauuuccuuuuuuuuuuuuucuuuuuuuggauuuccaagacaggguuucucuguauagcccuggcuguccuggaacucacuuuguagaccaggcuggccucgaacucagaaauccaccugccucugccucccgagugcugggauuaaaggccuggcucuuaaaacuuuuuaauugaagcuuuaagaacuccuacuuagcaugauauacgagggcccaagcccuugagcagaaaugacuggaagaugcuauaucaccaauggggugcugcccaccccauugugagugaacuuacgaauauggcaaccuggaacacauaagcacagccugccagcagcugaaauagguuggagaauguccuuuccaggugccucaaguuggccaaaucucucucucucuuuuuuuuuuuuuuuuuuuuuuugguuuuucgagacaggguuucucuguauagcccuggcuguccuggaacuuacguuguagaccaggcuggccucgaacucagagauccgccugccucugccuccgaagugcugggauuaaaggcgugcaccaccacgcccgcccggcuggccaaaucucuuucaggcaccucagcuaguuucuucugccagaccgcuuaucugguuucagucuuagcagcuuuguaugagaaucuuugcagcuuggcuucauuuugucugagagggacucuucagccuuucuuuauucuugaaaagaggggccuagugaauaugaucaguuucagggacuuccuagguuauuuguuuguuguuaucauuguuuugagacaaaguuucucuggaacuagcucuauauagacaagucuggcuuugaauucagagaucugccugccucugcuuucagacugcugguauuaacggcaagaugcgaccuuuuaccuuccuguuuuuaaaagcuucccugcaggaccugauuuuucaguaugggaggaaacuguuacacaacagugcauucaggggaaggagggaaaaggggaaaaaaaaaaaaaccaaucugcagauucuagucaucuggggcugaagaaucagcugucauuaacaagaaaccagagccucugaagugaaacauuuggcuuuuggaacaaucaaugcuggugagccaggcugaagaaucagcugugauuaaugaaagcaucaggucugaggcucaugaagucuucugcgaggugaggugcguaaagagucaaggucaagaccuguaggcaauaaggacuuguguggcuuuaggguucuauuggcgguugugugaggagcauccagaaggccgacgggcagacagauccugacuguggugaauguguuaagacuggaagaaucaaagcauugccaaggugcaaugccaggaauggaucuccauggagacucagcggauucagagucaaguuccauuuccaggaacucauuguucucaacuaaauggagcgugucugagggucugaagccaacucuaagucuguuuucuaacaagcuagguaacaacuguuaggaauucuugagacuacuguaagauugacaccgcccccuccccuguccccacccccauguuuaaccacucaggacuuugaugggcugugugcgauagccuuguaugaagucauuuagcuagcaaggagggaagucauggguuacaggaugugauuacccaaagucuucaaccaguaccuuuugguugcagucucuuacugaccaaagccuugcacuguauaccuuguuucuucagaauucuucuuuugguuuuucgagacaggguuucucuguguagcccuggcuguccuggaacucacucuguagaccaggcuggccuugaacucagaaaucugccugccucugccucccaagugcugggauuaaaggugugcaccaccacugcccagcuuacucuuuuuuagcacagggaaaagaaacuuguuaccacucacccugucagauguguaauugaacaaagcugaaucuuucuucugggacccagaguuagagaucguuccuuuccuuagccuacugaauauugguuggcaacauuggaauuuaguggacuaauuaguuccucucaucuuacccagcccuuuaagcccguuccucaacuaaggguguaguuacuauucuggguucuuaacaaacugugugucagcguucuggucacacuugaugguacugccuugagaaccauugaaaaagauaaaaucaucccuagucauuuagaaauauuugccuuuuucagggacaaguuugggagcaacaguggggacaaagguggcaaguuacggagccucaacaacuugguaucugaacaaagagggccguggagagcucagugguagagcacuugcuuagcaugcacaaggcucuagguucaauucccaguaccauauacauaaaauuuucauguuuacucuuaaaaauuaauuacacuuauuuguuguuggucucuguauuauggcauaccauaaaccccgaggccugauauuauuugaugucacucggacauugcuggguaucacaacucaggugucgagguguuucagaugggcuacccccauauugucauaacaacuugagaaauauauagagaacguuuguuugcuugagacaggguuucuuuguguagcccaggcugaccuggaacucugaucuaccugccucugccucccaagugcugggauuaaaggcgugcgccaacacugcccacaccaagagcuuuuugcccuccaaaaaaaaaaaaaagaaaaaaaaaucaaagcaugcacagcuuguccugagagaccuuggcuucccacuucccguggagcugaugccaggccugugcagcacagagagcauagaggcuguggcacggagcuaaaugacacuacagggaaaucagauguaauuaagugaccuguaaguaaagguguggaugccuggcagagcaguguggcuuggccaucuagauugaugaauacagggcuauuggugggcaccccaccugcucccuucuguuuucacucugcugggcagcauuccucaagaugcagagcuucgggggaaagcucacuuuuauggauuucguugcuccuaacccaccuuguccucuuaaacaaauaaaaucuugcacaccaucucauccaaaaucugcaguuugguguggaauucaguucccugagcuacuuaauuacuucccaccaggcauucacagaagucaugcugagaugcaauaaugagaaaugagcugagggcagucgcagccaguaaugcuugcccagcacgcacaaagccuugcauucuauccuuagcccugucaaggugaugcaugccuuuacucagugcugggaagguagagacuggaacagagaggcuuuuccucaguccuagaugugucugcacaugccccaccccugagucaguucuaagucguagacugguucuguggggucagagcuuggaauuacccagaugccacagccaaaugacauugucucccuugaugcucucugcugucacuuuauuuguuagguucagggucugaggcagcccagagaaaucagccuuggccaccuguuccuaguaggccagucaaaugaggcauaguaaaagcauacaugaauuuauuuaauguggccacuuugagaagaggaaugaauaaagagauccagugcccaucccaaguucuaggguucugauggggaauuuagguuuaaauaggcgucggagcuugccauagcugugcacaccuuuaguuccagcaccugggagacagaagcagguggaucuaugugaguuccaggccagucuggucuauguaucaacuucuacuaagucagccagggcuacauaguaagacaagguaucuaacuaggcaagacuggcugagguauggcccuacccaucauuggcuaggcuccagaguuucccaacaggcaguuugguuaucagaagguugcuccuggcuguuaccagacuuccguguuucccuuuuucucaacuuggaauuucugaggaaaucccaaucucuuggaguauauagucugauggccaaagggaggggcacaaggucucuagacuauuuccauuccugccaagauugugacacucccuguggugagguggggaugacugcuggacgccgagagucuagugcuuagguaagauggacccuguuagcguuuccuuuuguucugcuuagcuugccuuuccuucaggucauuuaaccggugacggaugagugccuggugugugucuggcccccaucgguucacgugucaggaugcuuggcucauagggaguugcauuauuaggagguguggccuuguugaaggaagugggucacuguaggggagggcuuugaggucucauauauaagcucaagcuauguccacgcccaguguggaaucagagucuccuccuggcugccugaaaauuaguuuacuucugcugcuuuuggaucaagguguagaacuugcuccuccagcaccgugucugccagcacacggccaugcuuccugccaugcuugguagugguggacugaaccucugaaacuaaggcagccccaauuaaaugguuuucuuguguuuuuguuucguuuuauuuuauuuuaugaguugccuuguucauggugucucuucacagcaauggaaauccuaagacauagaguaugucuaagucuaagaggcuuagugcugggaagucgagacugaggccacucaggcauccacaguggagggaagccuaucuccuaguauuugcuuugcugaccagggaggcugugggucucacuucucagcaguuauguuagaacugagagaccgauugccuauaagccugcugccaugccugagagcugccagaguaagcacaggcacccucuccgcagagggccgugcuagaccguuucagaaguggagcucugaggagcaaagcuaguauagauggagccaugugguaugucaucagcagagccacucugucuccuuauucuuaaucuacuuuaccuuuuaaauaguaaauagauacauaaauaaaugugguuagcaugucaggaaggaacagauaguccuccuaagaaaacauaauuuagaagcagucggcauguaguaugagccaguccuggcuaagucccucccuacccaccacugcccagagaacaauuggcuucuguacucuuuccuuugugagaccucagcaccgcaguuccuacuuuuuaaauuuuacuacuacuacuacuauuauuuuuuugagcaguuuugacugaaaauagguaaaaauauuauuuuuguuacuuuauuuugagacaggucucuauuuuguagcucuggcuguccuggaaccagaauggccucaaacucaagagagauccacccgccucugccucccaagugcugggauuaaggguauacaccacuaccacaucuggcagauaaaaaugcuauuuaaauucccauguuuucuggugaaucuuuguuaucagggucucuguagcccaggcuagcuuuggacuucagcugaggauaacccuaaccuucugaucauccuaccgcugcuguccacagugcugggauugcagguuuauaucccacaccaguguuaggcaguucuggggagccagccagucucugaauuccugcgucccaagcucauuauuaucuucuucuuccucuucuuccuccuccuccuccuucuucuuccuuaucuucuuuuuuucuucuucuuugagacgggguuucucuguguagcccuggcuguccuggaacucacucuguagaccaggcuggucucagacucagaaaucugccugccucugccucccaaguacuaggauuaaaggcgugugccaccaugccaggcguggaguugguuuugauaucugcugggcccaagcucauuuucuuuucuaauuuuagguugcgauauaauuauuuaugaucuuaagguaauuauauuaagauuaccauucauuguguuucaaguccaaagaagucaagauucuuuuauuuuuuucaauuuaauuuuuaaguucauguguguguguguuuggcauucccauauucauguggguauccuuggaggccaggaaaggacauuagauccccuggaccugggauuacaaguggucaugucccaccugaggugggugcugggaacaaacucaguuccucugcaagagcaguacagcucuuaacugccgcacucacugucucuccagcacccgagaugcuuucuucagcuaccuauucagcucuggcuccuugaaguuauaaaguacagcuuacauacaaucaaauguuuaguuagaguuuaucaaguguaugaaccacugcucugaaccuucuuuccgugggguuucuugucucauacccacuccaugaacaagucaauuugugucugggccaguuuugccugcacuugaacuuuuguguacacaauccugaagugugagcuucucugcuugaggucaaagaugcagguguuggucugagcaucaugcacuugcucucuuugguuggcguuucacuggggagucugcucauugacugauggucucuaguuguuacugguuguuucuagguguugucuauaacaaagcugcugugcauauaugugcaccaguccuuuuguagacacuuuucuuggguauauggagaggucaaagggaaaguuaacuuggaagaaauugccaaccauuuuuauugggguuuuguguauuucugugccugcaggugggugaagaggccagggucaauguugggugucuucuugauucacgggcaguuuccaccccccccccccacuagcauaugggguucuaauguauggaggcuucuuuucuguguuuugugucucccuuuuuguuaggaguaggaaggggugagguuagguucgagaguguuuuaguuugccucucuguugcuaugauaacaccacgacuaaaagaaacuuggggagcaaaggguuuauuucacuuacaggucacaucuaggacgaccuagggcaagagcugaaauaggaacugaaacggggguggggggguggggaacgggacucagacuugcuucauggaggggcuugcccagcuaaccuuuuuauacagauaagggauggcacuacucacagugggcugacucuuccacauucauuagcaauuuuuuuuuuuuuuuuuuuugguuuuucgagacaagguuucucuguauagcccuggcuguccuggagcucacucuguagaccaggcuggccucgaacucagaaauccgccugccucugccuccccagugcugggacuaaaggcgugcgccaccacgcccggcuuucauuagcaauuuuuaaaaaaugucucaaauaucacaggccagucugauugggacaguucuucaguugagguuucucugcccaagugacacagaaaggcacagaauugaacuguccuucuggcaaaagggacuugggaggacugaaguaaaacuaagccaguccaggaaaaacaaaggauguucuuuuaaggucuucuaagguuugccuguguguguguguggugugugugugugugugugugugugugugugugugugugugugcugugcccugaggaguaagugaauccaaggucaguugccauuaucaaguuaaguuaagaaacacuguguucuuugcaauuuaggguagggcagguguuuggaaagucccaaggacacuguuggauaaggaaggggcuucuuaaaauuccacagaauaaugagccucauuaguguaugacuuauaggacauggccauagucagucagcuuuaggucugcauguguucuuucccugccugcaguuuuucuuugaggccuuuauuacuuaaagucuuguuugcaggagggucaggcuuccacuuugccacuuuucuguguuaguggaccguuaauauuauuuuaugguucuuaggaguauaggcauaugcucauggcucuauuucuuucccaacaagcagacguagucuuucuaaucuuagccauucuagcagacggaccgugcugcuuccccgugauugaaucugcauuacucugacuuugcauacuucuuuuucaugaacuacaggccauuuauuuucuuuuguuaacuaucuucaagucuuuuguuccaguuuccauuuuaaaaaaauauaauguauuaaucuaugugcgccacagaagaaaaacacaacaguacuaccguaguaguguuuuuuaaaucacucugaauuuuucuaaaggaaaauuaucagaauggacuagaauugugacuuguccaaauuguuguuuugagagacuuuaaacauaggagauaaaguauaauuaagaccuugcuucugauaaagaaaggcucagcuuucuagucugugggugcaaacucauauagagcuggugacugaauguggggguuggcuaauaguaaaacguuucuaaaacgugcagcgagugaauauuguagucuuugcuuguguugcugccuguguagcuagcuucauugcacccuuugguucugaacuugcagugggacagaauugacaguuuuugaaaucuccugaaacuuaugccguuauuuauguaaaauagcauguguucuuagcaccaaugacuguaaaaucaaaaugacuccgaagaaaucuuucagaugcuuuguguccuguaauaucagauuauuugcccccaaauccuuuuuuguuuguuugaagacaggguuucucuguguuaagcccugacuauucuggaacucucuuugcagacccggguuuaaaggugugcaccaguaucacccucgccaacaguuuauucacgugaauguaaagaagcacacccaaaaaucugugggcaaagugguuuccuguaagaaaguuuaagagggucugaagugaaguucuuucaaaauguuccuuuaggcaagucuuuauuuugaaaugagguaaauauugacauccaucuuucccccccucugaaguuauuacuuaaauagaaaaauaagacucuguucaaguuucuggcuuauaacuguagaugagcauccaucugccuaaagugcccuguaugucucuucugugacuucucccugggucagcucugacaguugugccugauggccacgugacaugccugcgguaaaaucugaccacacccuccugcccuacuauucuguccgacugagucaguguccucagacucgaggauccaccagacucugccuccccagugccaggaaugaaggcaugcgucaucacugcuagauuuuuauugcugugccaugaccaaaagcaacuuggagaaaaagguuuauuuuagcuuaaaacuuacaggucaaagucuuaucacugagggaagccagggcaggaaccuggaggcaggaacugaagcagagaccgugaaggagcucugcuuaccggcugcugcucaugucugucugugugucugucuguguugguaauggagccccaggccuuuacugaagggcagcagcacugggcuauacuuuugccgaauacuaaggucuuguuuguuucugagacaaggucuuguguauccccaacuggccugaccucaaaguuuauguggcugaguauguccuugaacuccuguuccuccugaucccacuucuuaagugcugagauugcagguguaggacaccaugcucaguuuucuauggugcugggcacaaacucaggcuuuuugcacaggcaaacagcaucucacuaagcugcaucugcagcugacacuaggauaugaacuggacuuuuucacauagccagaaugcaugugagacguguuggauagcugcagugaagcuucagggccccuuguuuaaaagauaaaagauaggggaagucaauguuuuuucucucagucaguggucauaaacuucagaagucacacaacagggcugaaggaggggacaguaagagguagcugacuagagguagcaacuggcuagagagacauuguccauugagagugaguggcugaucuuuggccuugggucuguauggggagaucuuaguggaagagcugcugcugcauauacuauacugaacaggggagcucagcacacacaggcugacagggaaagaaagcuuccuuucuacccagaggaauauguuuucccgugguaaacuaauuccaagauguucuuaguaaguccaagucugucuggguauagaucccuggcagagcucucacuugacagugcuugcaacuguugguugcaaguuaacugguuuaguucucaggccugaagaaaccagaaauuugcaaaacccaggacuuuuuguuguugcuagagacagaaucuagaugaguacucuguacacccccaagccccaaagacucgggcguggugguacaugccuuuaauuccagcacuugggaggcagaggcaggcggauuuuugaguucaaggccagccuggucuacaaagugaguuccaggacaaccagagcuaugcagagaaacccugucucgaaaaaaaaaaaaaaaaaaaaagguugugugaaucuguguguguuguggggucagaggaugacucaggaauucauuccguccuuccacaguguggaucccaggaauugaacucaaguuguuaggcuuaauagcaaaugccuuaagccauugagacauccugcuacccugcuucuuuuaguuuguaaaaaagguuuguuuuuaaauccugaggcuagguguagaggcacaccuuuaaucccaacacucauggaggcaaagccaggcugaucuguguuaaaggcuagccugaccuaccuguuaaguuccaggacagccagggggauauagagagacacugucucaaaaaaaaaaaaaaaaaaaaaaaaaaacaaagcaaaaaauaaccaaaacaaaguaagcaagcaaacaaaagucaaaaucgugcaauuuccaaagauuagagagugcacaccuuucaguguguggagagggcccucuucaggcagccucaugaagugcuucacaucucaauaugaauuuagcuuugaauaaacauuacccugcaagcuuaguuuucaaaaucuugcccuuuugaauagauaauauguaaccaaaaguucaaaagcuauaaaaaggcauaaaucuuucuuacucuccuuuguuucaugcugggucaucugcucuaaaaaaugcuaaaacugcuuaacaauuuucugacuuaggugucaguaguugcaggcacacagguuuuaaggcacacauggaaggcauccucacggguaggggugcuugcaagacggccugaugacuuuagguuggucacuggaacucacaagguggcaggagaugaaaggaccucaaagagugguccucugacugccacacacacauaauaaugaaaagaaaaaaaaaaaccucaaacuuuaaaauggcauuucuguaauuuuuguaauaauauaauugaaacuggguuugcuuggugaauuuagaauauucuugacuugcuuauuguuuauuacugugaaaacuaaggaauguaucgccagggcggugguggcgcacgccuuuaaucccagcacuugggaggcagaggcaggcggauuucugagugugaggccaaacucaggucuacagagugaguucuaggacagccagagcuacagguacaaguauagaaagaauccgugccccauacugacugcuguggggugugugugugugacagagagagagagagagagagagagagagagagagagagagagagagagagagagagagagagagagagagagguaggucaugaucucagucugauacaucugagauucuagaauaagguuaagaaauaugcaggucuuuggggaucacaaauaaugugucauuuuuaggagaacuugcccuuuucauuuucuuucaagggacuuucauuggcgacuuuucacuucucagcacuuuucuguagaaaguuugggaaaacuuggggagguaauaaagaucuacagacucagcaccauaugacacccaacaaaaguggggucaacuccaucccauccuguguguuaacuuguucccuugagauuaagaacauagacugaaaacugugaaugguugcuaggaagcacaucaacuguuuugcuuuuagaccauccccauaccuuuaacauagcaaaugaccggaguauuacauuuauuuuaauuaaaaauuugugcgcccuacccccacuguguggggaggucagaggauaacuuuguagagugguuucugggcauuaaacucugguccucaggcuuacaacauugaagggcaaguacuuuuaccugaugaguuuucuuuaggggagacugaccuugaacucuugaucuuccuuccucuuucugccuccacguacuggauuauauucauguccaacuccagcagagucacuuggcaguuuccgaacucuggugcaagagcccaggugcaggccugucugaucugagcugugacucuccguugcuugggucggggagugcccccugguggcaggcagcgguggugggcgggagaccgaguuuguggggaagguugcgccggccuggccucuaaauccuuuaucacgcgugccugggucguaccggccagccgguuuugagcuggcccaguguacccaaagcuagcuuagucgcucccuuuucaagacaucuggucucuggccgcgcgugccugugugucugcuuucuuccuuugcaggacacuuggaccuaguugcgugugcucgugggccaggucucuuuccuucucucuuucucccucugcagggcggcugaccucuggucgcgccugcccgugggccuggccccuuuugcaggagacuggccccuggcugccccagggacguccuagaguuuggacuuccgggguuggcucccagucugcugcuugucacccgccagggcguuuccgugcccaugcaugggcgcggcccuuuaaacuucacuguuuuuuagacuuuggggguguggucacacuuucuuuuuuuuucuucccguccguccgucgcggucaucccagacucgcggguccuucucuugcccugcuuuccagaugcuuuggagucaugagacgggagggcgcagggaccccucugauggccgaggugauccgaggugagugcacggggcaggacuuaggauggcuggaggagcgacuugcugcccuaggagcccaacuggccuccuuucuggguccacugacuuuggggguaaaccuuaaugugccuuaaugugcuugugaccccuauguccuacagccucuccacccacccugugugggagcuggugaaauucccaguccagccaaagaucaaaggucauuugugauuagaaaggacaaagcccugucacccauuugaaugcggcugcaagaaguuuguugcauuuacuaggagauauuugcagcuguucugagagaggagauacagauuggaaaguuuaaaguaccauuugagaaaaggacgucucggcucuuguuucuuaccacuuugauuuuugccauguuuuggguguagguaucugagugcuguuaagauguugccuuuuucuggggguuggugggaauaaagauggauggagccuuugaacaucacuucccuucuugcugaacuccacagcaucugacucaugcaacacagauucuaccccagucuggccuccccucacauucaccuugauuuuaaacagcaauuuauaagaaacccaaagcagugauuccaauuuaaaaaauacguaucuaugagauuaauuguauaaacauaccaccuuguguucuauaguuguaaacagcaacauguauuuucauguauugcuacauguauuuucagugugucaucguaaacuuaaugcaugguuauaggcuagcuaucagagguaugcugaauuuccugaaauuucuuagucuaguugcugcagaaacugaaacaguaccacuacaugaaauaaucaccuaccaccaugguccuuacuaagauuaagacaauuucuucuuuaaagcuuugcuuauuuauuaauauucaccaaagagacuuuuugaaguuacacauugucaccucugccaucugaaacaugggguggggugggggggacacaacaaaaucaaacaagccaucuuugaauucaucagaaaggaguugggucuuggcuggggacaccuguuuaagaacuugaagaaaagaacacugcuguuuuccauugcagaucgccuuuguuuugccauucucuacagcagaccaaagagugcaacaaacgaacauuauuucagcauagauaacgagcuagaguaugagaaguaaguauugccucuuggaagacucaaacuuuugaaauuuccucugaggaaucucuagguaugugugcagaugacauaggcuuggaaaaauuguauaucugaaaaacacuugcagcugggugcuguuucagauucuugguuaaaaaaaaaaagaucuuugaggauacaaagaaccucuauuuaaacccugauuaguuauucuuauaguuuauacuauagagcuguguaaaauaagaauguguaaaauacugguuuugcuaguggauaauaugucaagaacaauuuuuuuuuuuaaauugagguuaguuauucuacgauugguguguguguguguguguguguguguguguguguguagggcuauguuagggggagguaacaagaucuggugcaaguagcugagcucucugcuaaugaggugcauaacucuagcucacuuguugaauaauuauguagguauuguuuaccagaauaauuccuucuguuaguauuaguagggcaggaccuuagaauuguauggccaguguuaauuuggguugguggaugcccucuugccguaauuuuaggagcguuuacauucagagcagcuaaaacauguauacuuguuucuauuuauuuuuuuuaaagcuucuaugcggauuuuggaccacucaaucuggccaugguuuacagauauuguugcaagauaaauaagaagcucaagguaaaucuuuuaacucaagguuugacugaagugaucagauucaaaacgggaaagagugcuucuuccucuuacaaaacaaaaccguuugagaccaggugugcugagcacucaggcgagagaucccaaguucaagacaagccugugcuacacagcaagaucuuaucuuuagaaaacagaaaaaguuuaccaagacaccaguugccuacugaguuauguuuuaggaugcuuugaaaacguagcgaacguuuagaagguguggcggagcgcccccgguagucucaguacuuggaagaaauagccgugagaucacuuggugcacagcggcuguuuaagacuguacagccugaccgacauugugagauuuucuaagugguguuucucauugugggaguauuuauuuagauuguguacuuuuauuuuucugagucugcaaaaaauggcucuguaaucaagagugcuggauacucuuucagagacccacacuguacaucaugacuaucugucacuagaguucuagaggacaugacacuaccuucuggccugugugccucugcaagcacauaguacauucauacgugcaugcaagcagaaacacauguuaaaaauauucuuuuuccuaaacuuauacugccaucuauuuguuuccuagaguuuuuucugggcuuugagacacacuuauaugcaaccccggcuggccuagaagugucugcauccccucauggauacaccaacacaugucacuuguguuuucuaauuuuaauggaauggguuauauuuggguucuuugguuccgguuuggguugaagaagcucaaacaaaacaguaacucacagcgaaaggcagcuacuuaacuaagucccuugucugaccucaugggaacugaagcagacaagggaaacgcuucccugcuuuggccagaguuucuccugccucccuuucaaagagagugcuggugaaugguuggggaaaacauugcccucucugagcuggaaucucacucuucaaccaugucucagauuuuuacaaaguaccuagucauuguaaacuguucagcagaaaauacuaaguuuguuagcaggaauuacaaauaaauaaaaacuucggauggauuuccuaccagagaacuaugugaaacaaguagcauuuauuuuugcuuaacacuauuacagauuuauggguaagggagauagucuuuuuuucccgagcaucagcugcauucacuauacauuuagacacaaguguagacuucuuccuaggccuucuuagcaaaguaaacauccauggccuucugucuuugagucccccuccccuuuccccuucuucagugacagucuuguucccacagggccaaaaggcuaaauauaauucccucuccucccaucuauuguuccugugcuuuaguuuugaaagggugagucuaugcaugugugcaccugugcacacaccuucaugccuaaccugucggagucuuuuauucuucagaauaaaugaguguguuccuuucuagugacuugcuggaggcacugacaagguguugagcaacaagccuaagaucucacuguccgcugagcuagugagauugacagugccccggucgaagagggugcccauggcuggcuggguuuuguuuuuguuuuuaauugauuuaggucccuuaguccauauaaaccacuaugggaaaauacacucacauugauugaugauggagacacuagaacauucaaacaagcaugggccagugagauaagcagugcauucaaacaugcugaacauacucuguugcagcauacugauacauuucacauuagugaaccacuggggaccugcugggugauggugucuuccuuuucuuuuaacuucuuguugaaguauaacauacuuaaagaaacauucacagaucccaaguauauacuuaauuuucauaaauuaagaagaggccuuucaguugcugucucacggacugucuuuaacuaguagcuuuaggacuagagauauuuuguuguuguuuuuguuuuuguuuuuuugagacaggguuucucuguauagcccuggacuagagauuuuuuuuuccaaaaagauuguuuuuauguguguaaguguucuucaugcauguauguucaugcauguaugucuuugcaccaugugugugcagugcccucagaugucagaguacauggaaucccuggaauaggagucagagacugauguggcaggugggcuucugggauuucaaggccagcuugguguaccuaaugaguucagcauagccagggcuaauaaugagaccuugucucaaaaaaauagggcuucuucaggugacuuucccagcuuguuacaucuccuguuauaggaagcccugcauuguugguuucucauauuggcacaucuauccaguuucuuuugucacuagcuguggauacuucugugaccuuauaucuccucagaaaaauauggcacuguugagggacaguggccuccaacaagaacuuuaguccccacaggcucuggacuuaucagucuuccuucucucuuggcucuauccagagcuuucugaacugauccgaagguugccugucuuuaggccuguaucuguucacauuucccugccucccuuuuauuuuaaauaauucuaguaucacagaauggcuccugggauuucagggcuucaggguuguuguucucagaguuuuaauaucgagguugcuuaugcaugugagguguagaauuugucacaaagcaaaauuuuaggaaacuugaaguggucaagaaaauacuaacaacaguuuguuuugaugcaguccauuacaaugcugaggaagaaaauuauccauuuuacuggcacugaucagagaaagcaagcgaaugccgccuuccuugucggguguuauaugguaaguguccugcucugaaggucagugagcgcagccgucccgcuguacaggcaggccugggguuucgaagcuacucuuuccuaagaugcuguuucuagaggcugugcgcuuguuugcuuugaaaaucauucacuccaggaagacuugcacccgugcuguggggagcaugugcgagucucugugugcucagugauucgcuuuguuuuguaauuaaaguuuuuugacugauuacaacggagaaaguugauaaucuguuaagccuuuaaggugaguggauaugccuuccaaagcugcugcuuuuauuaauucauaauuuguuuagagaguuguaaagucauuuuacuggggucaggcccccucucucucucucucucucucucucucucucucucucuguguguguguguguguguguguguguguguguguguguguguguguguguaugauagaagauggcuuucaggguuuucagauuaucaagcuuggugacaagcagccauacaugcugagccaucucuccagauaacucuguucuccuuaaagauguauuuauuuguggaaaguauuucuuugugaguguauaagcaugcauguguagcugugugcacauguugaguguuaaaccuggaauuaaaggucuccccucucccucucugcuguuuuguuauguuaguaccagaaucugaacuccaguucucaugauuguguaacaaggcagcaagagcucaaacucaccccugcuuugauacauuuguuugcuuacacuugugaccuugacccuaagcuuaugguaucucuacacugggcuuugcccccagcaccuuauaccuccucauacucuaggaccugcaugauagaaggaaagaacugacuccacuaagaugucuucugaccuccacacaugugccaugcuggccaugcaugugcacucuccccuucccuucccucuccucccucauccaugugaauuaccuuauaccaccucauacuccuauaaucuucuguuaccuaguuugguaaucuguaguuuacaaaaauuggguuaguagaguuaguugaaauugcaccucagaauuagauucuuuuagguauguagggugucucauuaccagcugccuaggccuuuuggauuauucuuuccugguuaugcuuaaaaaaguagcagagagaaaaguuucagagaaaacuugacauuuuuaguacuucauccuugaaggucugagauacaggaagugaauugugucgguugaaaucugaauucuucagcugaguuguuucugucucuugguguuucuuacacuggcagcaaguccuuaaaaaaagaaaaaagaaagaauggagaacuuguugcucuugcaggggaccugaguuugaguuccaaaacccaugaugacuacccauaacuaacugccuauaacuccaguuuaagggaaccaaucuccucuuuuggcuucuagggacaccugcaugcaaauguacauaugcauaauuaaaaauaaaauaaaccccacagugucucauuguauagcccugucuggccuguaauucacauggaugagggaggagaaggaagggaaggggagagugcacaugcauggccagcauggcacauguguggaggucagaagacaucuuaguggagucaguuuuuuccuucuaucaugcagguccuggagaucaggcucagguccuagggcuugguggcaaguagcuuuaucucugacccaucucacuggcugggcagguggaucccuuaacuaugacauugguuccauuauuugcccaacucaacuggggaggagagccucgacuaaaugacaccuuaaagagaaagugaaauuaggauuaucaggguucacaaaacauuaauggcaaccuggagaaucaguccucagugugacagaaaaacuucuaagguguuuguggggucuccccacauucuguccaagagaaagucugcaguggccccgacaguuccaccucagggacagggcccauauccaugaauucuuaaccaggcuucccuucucuuuccacugucaaguaaagcucuacuggccacauugugugaagccaguggcugcaacuccaggguggagaacucagaaaauggucaagaggaaugguggaaucacaggguuaaaaccagaaagaaaguacuggauaauuuuauaaauaggaaguugcucuugcuguggugguuuuuuguuuuguuuguuuuuccaaggcagaguuucucugugcaauaauuguggcugucccggagcucccuuuguagaccaggcugaucuugaacucacagaucugccugccucugcuuccugaguucuagcauuaaaggcugcauugcuagugcccugcucauucuucuguuuuaauuuguuguuucugaggauuaaacucagggccuccagcauccaaucagguguucugccaucaacugguacaccuagcccauggcugguguuuuuucaacagugaaugagaaagauaacuucuuguauuuguggacaauaucuuguuguauuugguccauuuugaugcaccuuuaacuuugcuaaugguuauaucugggcacacagaacuuuaguuucguuucuguguuuucaugguuaauauauggguuuaaaauuccucugagggguuuagccuugcacaucaaugcugguuccgugguuaagaauuugccagauguacuggcugguuuuguguaucauuuugacacaaguuagcaucaucaaagaagaaggagcgccucagcugaggacgugagcuccaugagacccugcuguaaggcauucucucaauuagucagcggggagggcccagcccaucaugggcggugccaucccugggcuggugguucugaguccuauaaugaagcagacugaggaagccagggguagcaagcagcaccccuccguggccucucugcaucagcucuugccucagguucuugcucugcuugaacagugccgagaaaguguaagccaaauaaaccccuuucuccccagccuggucuuagucacagggguuucaucgcggcaguagagacccugacuaaggaaacuggauagauuuggaaagucaucaaguuuauuacucuccucauauggaagccaguuugugagaagaccagaguuuguggugugacaggcgucuuucgagccacgaugggugggcuaaugggggagcuuggaguaguuauaaugcuuuguggggaagcaggagaaagacuuccaauaaaagaaaguuauuaauaguaggaaagaguguugacaugugauaaagacacuucgaaagauaaaacaccuaagugagcaaggcuucuuuuguuugagccaauuuaguucucugguuaaagucuuguggagaugaacgcuaauuccuaggaacugaagucuuaauaacuuuuccuggagcuguugaaguuuagagguaguauaaagcuugagcaguaauguugaaacaaaccaaagaccuggaaagacuuuuagcucagcggcagccuagcuagcccuaacacuugccuagcaugauagggaccccaaguuuacauuccuggcacugcaggggaaaacaacaacaacagaaaggaacagaaggacuggagagacaaagcaguggguaagagugcuuacugugcacaugugagugcuuacugugcgugugugagaaucugcauuuuuuuaaaagauuuuauuuauuuuauauauaugaugaguacaucguagcuaucuucagacacaccagaagagggcaucggaucccauuacagaugguuguaaacuaccaugugguuguugggaauugaacucagggccucuggaagaacaaucuguguucuuaaccgcugagccaucucuccagccccgaggaucugcauucuuauuucaguacucaucugugacuuggagacuuauuuuuggccuguucccaguagcucauuucuauauuaucccauuuauaguguucuaugccuaccacauggcuggucgccucuucucaguuucaugugugggacuucuuccgacguccaggcggugaaucucucucaccugccuauuucccagaguuguucuuucucucugccagaugucccaccuucuaauccugccucaguuuauuggccaucagaauuuucuuggugaugcuuuuacacauuguacaagagauuaucccuacagucauguaaaaaauugagcauggcuacacauuagcccucgcauugagcagucaagagaaaugagccuccaguucagugacagacuugguuucaaggguuucaaguuagaaauacaggaaaacaacugaugucuuccuuuggccucugcauauauguggauagguaugugcccacacaaacauguggauguaacacacacauacauacacguuuauacacauauacacauauccauacauagguacauauaauuugcauacauuucacaaacacugaauuaauaugcacgcauaugugaaaaaauaauaugcacagcaauacuuccuuuuuuuauuagguauuuuccucguuuacauuuccagggcuaucccaaaagccccccauaccccccccuuuuuuuuuuaaucuuuuuaaaaaccuuuaucaauacaagacucuuugguccucuggaaaccagauuuccuaaggaaaauguaaagugaguagcauuugcuauuugugcaaauaaaaacauuaggccaggcagugguggugugcaccuuuaaugccaacagcaguugggagguagaggcaggcagaguucaagaccagucuaguuuacagagugaguccugggacagccagggcuaaaaagggaaacccugaguaaacaaaacaaaacaacccccccccaaaaaaaguauuuuuuaguagcuacaaaacaauuuuauuauugguuuuaaagguuuuaaacaagggucaguggguuuuggacauacuuguucaacauuuuacaaaaugccaaucaacuucccuuuaaaaaaagauuuaugaauauggaugcuuaccuucugacaugugugugcuucauguguaugccugguaccagauccccuaaaacuguugaguucugguugugagcugccuaauguggcugcugggaccugaacuuggguucccuggaaaagcaacaagugcucauaaccacugagccauuuuuccaggucuggugcuuuuguuuuguuuuguuuuguuaucccuuuaccuaggacuuaaugcaugcugguuaggugcucuaccauugagcuacauuuauguguauauguguauuaguguuauuuguguauuuaugugcuugugcaaaccauuugggggcucagaagacaacuuuaagaugauguucaccacuugggacccagggaucaaacugagacugucagccuuggggggcagguuccuguauccacugagcuaucuugcugucuugggaucugcuuuuuaaauugaaagcaguuaccauucugucuuuuauacuguuaucaucugugguuacauccuccuguuaagcuuuucuucaggcugccucagcucucccuuagguuacuuguauacagggcaaaacuuguaacauuuuuaucuguuaaaaaaacaaaacaaaacaaagccuccaaguguauacuuaaugacacagcagaguacuuaccuguagcuugcaaauuugcucucuuccaugguuaauaaauuacucuggaagaguugauugugguaacuuguaaguccccugguaaauauuuaucauuguaguuuucuaagcaguucuuaacaguccuuagaauggcuugccuuuuaagcauucauauggaaaauuaugguccuaauuaauuccugagacuauacuugcuuagcagucuaugaguagacucccacagucugaaaaguggaaagacuuuaugucuuuaauggugaacuuuuggcccucugguccacuuuuaagggauucuguugauuuggacucugagcagucagcuaagguagcuucagggcaaaggaacuggauguaaagugggacugagaccggugucuggaagcugagggccagauugcauucagccaccagugcagauggugcaguggagaccauaagggagagccagguggauggacacaggcucuguaaacacucuccuguguaaaccuccuccucguguguuauaagagguagagagaacaacaaggcaacuguagacacagcagccaggccccagacagaagccacagauacagcaccucagcugcucaugaggcuuacaucucuauccacuccaguaagcaccccagacacuguggccccugggauguuggccgagcugccuuaacuuugacucuuugaccaugugugauucuuguuugcaaaucuguugcucuuaucuuuauuucaguccuggcuuuaggcaggaugguuucuugucuauaaauaagggcugagcagcggccuccuaucaguaacaagcagggugaucccagaugagcagcuaaugccuccuuuggagaagaucagccugcaaggguuauguaacucaugggguauuuuuaaaugguugugucccuccacccccaccccauguuuaaaaauugagaucacagugcuagggauauaguuugagaguacuugccuagcaugcagcaagccuuggguuugaucucugauacugaauaaaccugaugugauguacuuauaguccuuaagucuugagaguuagagacaggaguaucaagaguucagccuaggcuacaugagacucuguucuuuaaaaaacaaacaaacaaacaaaaaaaaaucuuucuuuuuuaaaaaaaugaaaauguucugagcauggugguauauguuugccuuuaugaauuccagcccuggaaaggcagaagcaggugggucuuuuuaaauucgaggcuggcccuggccugcauagcaaguuacaggcaagccaagguaacauagugagauccugccucuaaagacagcaucaaaaccaaaaugacuaaacauuuuuagagacacgugugaagccaucagaaaaaagucagagaaggaaucaagaguuuauuuuuuguuuuuuggguuuuuuuguuuuuguuuuuguuuuguuuuuuuuuauauacuguagcagcguucagggcuuacccccaaguccagcucacucauuuuuacuaacugguuucuguagagaggaauauuuauuuauccauuuguuugcuuguuuauuuggggggugguuggaggcaguguuucucuggcuaauagccccuagcugucuuaggcuggccucaaacucacaaagaucugccuacuucugucucuugaaugcuaggauuaaagacaugugauguuauaccuggcugguaacaaggcauucgauauucuagacuucaaguuccuguaccuaaaguaaggacaacuauaauauucaguaaaaguaauuaacaaagcuaaggcuguugaaguguaaggccaucugguguuuuuauuuuuuuguuucccuuggaagcagggcagagcuuuguggcucaaguugauuucugagucucaguucucuugccucagcuucucugguacugagauaacaggcccaugccaccauaccuggcaaucugauuaguuuggggaaaaaaaugaguuaggggcugggcucaguugcuaaagugguugaggaucugaguuugauucccagagccccugaacagaagcuggguguggugguaggcaagaaaccacagugcuggggguuggagacaggauuucugaucaccacgguagccucacugagcuucaggacagugagaggcuggucucaaaggaggaggacaccggcgauuuucuuccagcuuccacacauguguacaacauacacacacacacacacaaaaucaaaccacacgugcauacaacauacacacacaucagaagaaaaaccaacugugauuuuuuuguuguuguuguucguaguuuuguagcucuguguuguguauauucugcuucugccuaccuuuuagcagcugaauaugaacuuguauugauuuuaugcacaugcugugguaauuuggagagaguuuuguuuuguuuuuguuuuaaacucagucaaauucuuggcacaggaaggacugugucaucuggcugacaugugaaaauaguuacaggagcuuuuaaaggcugcaaacauugugacauuuucugcauaaagaguauuugcaaauagcuuauugguuucuccuguggcuguguugguuguugggacccaaaugccuuuuguuguucuuaagucuggcucaguaacugguguucuguuuggucuggacacauuaucagagccucucuuaaguguguagaugaagcuucaaaguguguauaagaacagaaaugagaaacacauguuuaguugggcuuugcugcuggaggccaggcuugucaggauuaaaaccaugcacggugggguagggaugcuuuucuggguuacgaguccuucugucugucacucaggugcaccuucgaguauucaggggucacaggcccucacaaggcccagaaccuguuaucacagaccuaaaacaaaacaaaaacaaaacagugagguuugucuagaagggacccucauguuuugguuuucuuccuguaccagagaguugaguacucaagguggcuuugugcuccuggccuuaugcuuucugccucaguucccaaguagccuggaccacagucucucugucuguuuaucugucugucucucucccccucccccccagacuugcgcucauauucucucucucucucucucucucucucucucucucucucucucucccucccuuacccauacaccaccauucuuggcuguuguuucauugauuuaaaaaggaucuugaaaaacccuaccaucuuuucccuacgauauuuuuauguguauuuauuucacauguauacauggaagccaggcaaccacuuuugagauuuaguucucuccaccuugugaacaccagagaucaaaggcaggcuuuguagcaagcgcuuucaccugcaagaccaucuugcuacagguacuuaguuuuuccuuugugacuucuguuucugcacagacaugacuggccgcaucacaucucugcaauggccauguaauuuuucaguuguuuaguuugucugguuuuauaaacugaguuguuuccuuacugcugggugugcugcuacaugaccuacugaugccuaagucaccucuagaguuagugacuuaacacaguaaauaaccagguuuuuucaauguuuauuuauucacuuuauaucccaauaucugccucccccaacccuguuuauuuuguagcccuugccauguuuuauguggugcuggagacagaagccaggacuuugugcaugcugggugauaacucuuucagcugaauuacauucccagcaacuccuuagguuaggaguugcaguugcuucucuuuagugggucagguucucagccuccugguguuuagucaucuggacgauugucuucagagguggcucacacacaucccugagaagccacuguugaacuuuagcagagacacuccucccuguguggucugcuuaggauugcccccaccaugacaguuuacauuacccaggaagagcaaggcggagacaccuucucuaugaucucaucccaaaagccccacucugucaggucguuucccccuccuuuuauaauuaauuaauuaauuaauuaaugugcauggaaguuuugucugcauguaugccugugcaccacauguguucaaugcccuuggaggccaaaagauggugucucauccccuggaauuggaguuacagaccauugugugguaucauguguauguugggaggaaaaaccucugagagugugcuugagaucuggcucagauguuuaagagcacugggcaaucuuuuagaggugcugaguucaauucccagcaaccacaugguggcucaaaaccaacuauauuggaaugugaugcccucuucugggaugcaggcggaagacuguguacauaauaaauaaauugacaaauaaaucaguaaaucuugaggaggaggggaaaaucuggaaguaaaaaggguucucuagaacagcagcuccuaaccacugagccagcuuuucagcccuacacuccuucauuucugacgcugugagaagguagguuaaagguggaaauacaaggagcucauugaggcugucuuggaaucuggcugucauaguagccagucuuugucuggguaaucaucuguuucuuagcuucagaauagcaccaugacauucgagugggcauucuguauacauagcugcugauauaaauauccugaaagaauuugccgaggcauuucuugugucuaaauaagcagcagugcuauauuauaaaauuguguugauuuagaguuugcuaaacugaacacuuguuuuaggauagaaaucacuuaauacgauuccuccuaagagccacauagagaagagcuucaugugggaaagucuucucaucagaaaaaugaguugcuuugaaagcaaaagcugcagauauuuuuuaaaaagauuuauuuccaaaguugagcaugucuuuaauucuagcucuugugaggcagaagcaugcagaucucugagacugagaccagucguauacagagcgagcuccagggcuuccaggauuacacagaaacccugucuugaaaaacaaacagaaaaguauaaggguuugccuguauguaauuaugugcaccacacuacaugcacacugcauacaguguuugugcguggaguguauagagggugugagauccccuguguuuacagucguacauaguugugagcuaccaacugggaacugaacccaguccucuucaaguucagcagcugcucuuaaccacugaaccaucucuccaaccugcugacaaauacuuaauaguuauguucagagguuuagacuaaaucucucaguuucuuucaggguuaggauuaagucuuauuuuuuuguauagucauuccccaaacagauuuaaaacauuuuuuaaaaauucaucauugggaaucuggaguguucucucaccacccauugugggggaaaaugcuguauuacucuagucuuugaauugaacuuguguucuaagacuagcccacaguuauuaaugaauuaaaugcuacuuuguuuugaaguuuagaaggaaauaagggcuuuacccuuuugguauuuaaagaaaccaagaagcuacggucuuguggaguaaaaauugccuuaaauugcuguuuaaggaaaaacggguguauuuguauaaaggagaugaugaucuuggaaagcuagagaaauucugaauuauagguucucuggauuucauuugaauuauauacacacguucauggacacacacacagcaaauccagcucuuucgucuuauugacuuacagguacuuugguuuuacauuuuguuuuggugauucauuaagaaauauacugucuuagaggguuuuuuuuuuccuucuugacgguucuguuuaauauuuuuuuguaaccuucaggagaucucuugucugaaguguugcacacauucaggaguuuuauacuaugaugucuguuuugaucacuauaaugaaaguugcagugagugcucuauauagaguuccaggcuagccacacggccccauggugaacucugaucagucagccagucagucagucauucagucauaguacuacagguguacccuuaucaaucaaucagucaauuaaucaggccagcuagaagauacuuggugaacucuuauccaucagucagucagucagucagucaggcuagccacaaggcuacauggugaaccuuuaccaaaaaaggaaggaaggaaaauaagcaguuucgaugaaauagugggucugaucaucauccucuuguuaccugaacaggugauaacuguccauuugaaagcaagauguugccuuuuccuaggcucaccaacauguuugugagucucugguaugaccccauggguggcaucauugguuuucuauugcuuugggcucuuuacauauauccaccaaggcuuuuuaccccaaagacauugcaaaaggacccagaugaccgugaacuaaaccucucuaaauugaaccaaaauaaaccuugcccccccccauguaaaauuauuauccuaggcauuaugucacagagauggaaaucgaacuaacacaguugcaaauuggggcaaaaccuaggaauuguaauuuuucagccauaauucuguggccuuccacacauagccaaaacuauauaucuuaaagaaggcuaccaggaaguuuauggguuggagagacuccaggaaugcagugacaugaacauaaaugcugaaguucucagaucuuuuuuaguuuuucgagacaggguuucucuguguagcccuggcuguccuggaacucacucuguagaccaagcuggccucgaacucagaaauucgcccgccucugccucccaagcguugggauuaaaggccaacacugccucaggucucaucuuguccuuuacuguuguagccaauagggcugguauuggaaaaagugauaaggccugguucucacacaaccaaaaccugauuuugauuaaaaaaaaaauuuuuuuuuuuuuguuaagacaucaagcauauggggcacucccaggcuuuauuuuguuuuggaaauaaguagguagagaauuucaugguguucacuugcguguucaaccuccacaaugcugcuucacaggaaauaugauucaaagucacuuuucucuucuugaguugcuacuugcuguuuugucuguaccagcuagcaggugauccacaggaagaaguggcauuguggcaggauuuuuaaauuuaguuuuggguuuugguuucagcaguccuuuuuuuuuuuguuuuuuguuuuuguuuuuuuuuaauagaguggagaaaaaaaaccaagauuuuauuagaguuauuggguuuuagucaauuuucuagcaccgaaacauaccugagaucauaccuugugcuaaggggagcuucaugaugggcugugcuuuuguguuuaugccugugcucaguuugugcuggggcuuuuggggccugugacgaggggacagugcauuagggcaaggaucaugugguggagccaccugcuuacuucauguauauucagaaugguugaaagaagaaacugcaaaaucccaaagccuccuucaaggacacccccagugaccuaaacccuuugauuuccccccccccuucuccauggcaacaagcugaagaccagacuuuaauacccaggaugguggaggccaugccagguccacauuagagcaaggggcaggagacaccuggagguuauaaggguauucuaguuucauggccuaguuucugugguugugauaaaagaucucaacaagcaagagaagaaacaagcaaagagagaaaggggcuuacuugacuuacaguugcaaguuacaauccauuauugagguaggaacuuauaucacauuuacaaucaagagcaaaaagaaacaaauacauguauucuugcuugucugcuugcuuucagcuagcuuccuccucucuuuucacuguuuagaagcccugccuagggaaugggugucuuccauaaugaauugagucuuccuauaaauuaacaacuaggguaauccccauaggcaugccucucagcaagaaucucuuccuaggugauucuaggucuugucaagcuaauagcaucaaccagcauagcaggaaugaaguaaaauauaaaagaaaauauuuuuaaaccgguuggauuuuuaaaauuuacacuuguuuuuuaaagauuuauuuauuuauaugaguacacuguaggugucuucagacacaccagaagaggcaucaguucccauuacagauaguugugagccaccauguaguugcugggaccuuuggaagagcagucagugcuauuaaccucuaagccaucucuccaacccaauuuauaguuuuguuuuguuuuguuuuguuuuuuaaagauguaucaguuuauuuuauauauauauauaccagugcucaggcuucacccauaccaggagagucagaucucauuauagacagcugugagccaccauguguucgccagucuguaguccuaaauuauaguuuauaugaagcaguggcaucuuuuuuuuuccccuaaauaaauaguaauagaacuguuguuaggcucugcuuaaaagauguauguguugaaugagaguauagaugauauauguaaauucguucauuuuacuugaaaacuugauaauguaagcaauuugauaauuagguaagacuucugaguucgaggccagccuggucuacaaagugaguuccaggacagccagggcuguacagagaaacccugucucgaaaaaaauaaaaaacaaacaaacaaacaaacguuuaacaacaacaacacauuucuuagcuaggugucaguggcgagaaccuuuaaccucagcacucaggaggcagaagcagguggaucggucagccagggaacacauuucuuucuuugggggauugauugacauuuugcuggaccuuuuuccuuacugccacugaggauaaauaaauauuugagcauucuguuaauuaguguaucacuuuuuccauucugugacuaaauaccuauuaagaacaacgugauagaaggauuuauuuuggcucaugguugaagauaggugaacccgucauguaggaggauguggcuggcauucuucucagcuguuaaggaaacagggaaucuugucuugucuucacuuugcccuuuuuauuugauuuaaaaccucagcccaugggaaggcaagucauuuaucuuuagauaaaccucucuggaaaugccuucagacacucacagaagagcaucaucgagauuacuccaaugcaaucaaguugauagugaagguuaacuaucacagcuguagucuguggagagaguaaauggaauuaaauuccaguaagaaaccauucagaccuuggggaaaugguccauuuauaacuguucaaacagaaaauaaguggaauguccucucgaaauugucaaaucuuuauaauuaguucuaagaucuagcuuuauguuuaaaagguuguuuuuagguuuguuuacucugugugccugcacacacauauauguauagagaccaaaaguagacaugugugucuucucaguuauuuuccaccucucucucucucucucucucucucucucucucucucucucucucucucucucucucucucucucucucucuuuugaggcaggauuucucacugagcccagggcgccccagucuggucaggcuguucuggccacugcacuucaggcaucugccuguuuuuugugcuccagcccugggguuagacaccuguacuauuaccugaucgucuuuuacauggaaucuggggucugacuuguaguucucaugcuucuauuguaaucccuuuauccaagccccuccccuuccccggcuguggucuuuuaauccuuguuuuguugucuuauuucgagacaagguuucucuggauagcccuggcuguccuggaacuagcuccauagucuugaacucagagauccaccugucucugccuccugaguacgggcccagcagccuuuguugaggcuacaaaaacaaacauuucucaggaggcuuauaaaggaaaaacccacaaugagcccauaugcaggugcaggaagugcugcccaguggucagcucugacucaagccauuuuagacauaaaagcacauauuggccuuuaauuugauagguccuauguaaagcuuuguggagaauucuuaagauuaacaaaccucauacagaacacaccaaggguuguggucagcaugacccuguucuaugucaaguuauaucaaacauuugcauauuacugcauauugcauaaauagcuggcaggcauggaacagcuaugcuggggguguagaccucaacaauaaguacauugaguucaacguaauaggcaaaaccuuagagcccauccauuuaugcuuggaccaggaguuaagagauuggagacaaagccuucacuucagagugccuccugccaugaaaacagcuuccacauacaguauuaagcacuggagguaagaacccuguauagagguaaugguaguggcccacaccuucaguuguagcacuagaaaggcagaggcaggggcaucucugaguucaaugccagccuggucuacagaguaaguuccaggcuacacagaguaacccugucuggaaaacccaaaccaaaccaaaccaaaccaaaaaaaccacaaaacaaacaaacaaacaaaaaacaaaaaaaaaaaaauagaaguucauaauuaacuugguaacguuuucucccuuuucagccaugucuuggcuccagggaugaaacucagugccacgugcacuguagaaccugugcuucugaguuacaguuuuaaccuagacuggaauuauucuauugugaucuaaaauauauuuuccauagaucagcuuuggaauuuaauuuaguuuugaucuuuuuauguguuuaacugaaugcaugcgggucccuggcuccugcgugggagcugggaacaccugcagccaguggcagaugguagguggugaaaguagcaacagcuugauagauacaggugacugaccucucaagugaagaggccucagaacaauaaacacugaggaaaacacugcagggcacaguuggcaaagcaggggguuuggccaggugugauagggaguuccuggggcagguggaucucugcaaguucagaaccagccugguuuacauggugaguuccaggucagccaaggcuaugcacacagcucaugaaaacucugucaacaaaaagaagaaaagaaaauacguuuuugaaguauuuuaccagaggaagaccgaaacacaccacaguugugaagacagaaggagcagaugagaguaggagcagauguaguuaguccaguggcaaacguucacuguggagagagugaaucaaggccuuuguuuuggaaaagagugcaguucagugguacaccuccuccaccccuccacucccacccuguggccuuugcagaucuggguucaauucccagcacccgaauagccguucacaacugucucuaacccugauaccuccuccuguccuccucaacacugcauguacacaguacacugauauacacggaggcaaaacacucauagcauaaaaauaaauaacuuaaaaaaaauagcuugggaucagugagauugcuuagcagguaaagccacuugcugcauaggucuggggacuuaaagaguuuggcccuugggggcuggagagauggcucaguggauaggggcacugacuacucuuccagagguccugaguucaagucccagcaaccacaugguugcucacgacuuuaauggagaucugauguccucuucuugugugucugaagacaguggcaguauacucacauacauaaaauaacauacauuaaauaaauaaauaaauaaauaaauaaauucuuuuuuaaaaaagcuauauuaaaaaaaaaguuuggucuuuggaacugacaugguagaaaggagagaaccaacuucacaaaguuguccugugacuuccacaaguguccuguuggccauuucacaaguacuaaaauaauaaauucaucgacuccaaguuccacuuuaccccacuccagucagcagcuccaccuccacuuguccacuucugaggaugcucaggaaggagaauuuaaagcaugucacucuaacaucuggaucuggaaaaugugcguuuuaagacgcugcauuucugggcacaaguuguuugaaguguugguguggcagggagaaaucucugacagguugagacaagcaguuacuugugagaacauggcucugcagauuggcugcagcuugugcagaaauggcuucuuggugacagaacugugucacugagaaguaaaaaugcccuuuucuuuucuuuccaaauguagguuauauauuuggggaggacaccagaagacgcguauagaacauuaaucuucggagauacagccuauauuccuuucagguaaaugugcagguuaugugguagauguauuugaucagacucuuaccaggaaccuuaaaagaaacaaaacaaaacagaaaggugaagcccuggcaggaaggcauguuaaugauuguaacaccauagauccaagagucuuaacagugacacuguuggaauguugucacuucuggccucuguuugguagagacuggugacucugacuacacacacacacacacacacacacacacaccacacucaugcuccacuuguguuaucagaaugucaaaagucucccaguuuugccuuuuagcucuucgaaaugguagggguggagucggacuuugcugagaaccacgcugugauguagcuaggggagaauccucaugguacugugcccauugcugccccagguuccugugcaauugaucagggaguuucccuacucagcagaguuuaugggacaucaccugacaccuuuucccaagagcaccaccagaagagguggugggugcgguugaggaugucgacacaaccuguaacagccugucaaacagcucuguguggaggcgucaggccucgaugcuccaacucugugaguggauagcagccuuaccuccuagcuagugugaugaucuugaaagaauuguaaaggaaaaaaaaaauguuuuaaaagcugugugcugauuaauuugguguccuauaaaugaacucuggaaugucuuccuaacugaagacagucuccccagauaguucuguggaacccucuccauuugaaacagggcuuccauuguuggggcaauguucagauuauggugaaauggugguugaaggccaugacugagccaguguuucuucccugcugccuagcagacugucccaaguguucugcgauuugagguguguaggaagagagaaggcgcugaggugaagugagccagccacucaucuuuucaacuuguaacagcacccauuugugucuguuaggagcaauuuuugcaucugugaucccagagugagcaguaggcauauaguucugcugcuacaacacagcugugaccuuguuuggagcguucucuccaaaguguuaagcccuuguugccauucucauagcuuagaacacaaggaugcauaaugugaacaagcuuacuugcuagaacauagcacagacagccucaagcuggguuccgcuaaagccuccccagauaguccuuaauuucccuuucucauauuuuaucauuuuauuuuuuugagacaggcucuuacaggccuuguguccuggaaaacucuguguagacuaggcuguccucagacucagaucugccccacaucugccuccugaaggcuggaauuaaaagugugugccacugccaaggaccaaccucagcuuggagaggggguucugagagaugggaugucugggagcagcaaaaaugacugguccaaaucaugguccaagcugcugacgccuuuguucugcugagaugguuuuccagaccgaccucccccccacuucccauauccccccccccccccguguguguguucuuugcucuagacagcuuuuucuugcuauucuaaaagcuccuagucgagauagcuaacuuucugcucgagacaguuuucucugugagugaaaauugcaaaagcucucuggauagcucaugaauuuucuaaccaaagucagaaaaaccgcuauaaagaaaauccuuggaucaacucaaaauucuaaaaguaauucuugggcuuuccaaucaaaaucagaagucagaaaguguuuaaaagaacuguguucgcucuucaaagagccuucucuggauagcugcuagaaaacuaugaaacauucuaaaagagcugugcucauucuccauggauuuuccuauuaaaaucagaaauccuguuagaaaaaaaaaacaaaccuuuauuuauuauuauauguuaguaugcuguggcugucuucagacacaccagaagaaggcaucagaucucauuacaggugguuguaagccaccauguggcugcugggauuugaacucaggaccuucagaagagcaguuaaugcucuuaaccacugagccaucucuccaaccccagaaaaaauucuugaaggcagagaucuccagauagcucagcucuugcuagaaaaaaaaaauucuaaaaaagaacugcuuucacuuucuucuagcucaucucaugcagacccuaaaagcccacucuuauuuacauaucaauucaguuauuccagguucccuuuuaaccaucccgugaaucagcauuccaugucuuuagcuccuugacucuuagaaagagacagcaaacauaagcacagacaauaagauagcugggugagacccagcucuggaaucagcauucuaccuaagccuggaccuaaauuagcucuguccuagguuggcccugaacuugggaaucugcuggcauuuguaagcauaaacaaugacaaaacaaaaccuuuucuuuccuucuuuagcaucuaucugacaagcuggaucauagugcagcugcuucuguuccuuuagaugggugaugccccucauauaauucauauuauguccuuagauuuucgaauaguugagaaauuacauauuuugaacucguguuuuuagaguucuuuuccauugccuuaaggaccguccugaaggucccaguguuuaccauuuugcugagacaauagccacaucuuugccuaugcuguccuuauuaucauggagucaucaauauuaacagaguggacauucuucagaggaacgccaaaauacacacauuauuauacaaacaagcuuaaggccacagccgccaucgacacucauggagcccaugcuugcuggcucugucucgggggcaggacauauuauucugucccuaccaaggccaugcucgacuuggcagugacaccgugaccagccuauuucuuuuccuuccuuccuuccuuccuuccuuccuuccuuccuuccuuccuuccuuccuuccuuccuuccuuccuuccuuccuuccuuccucccuuucccuccccuccccuccccuccccuccccuccccuccccuccuucuaacuucuauuccucucucccuuuugagacggggucucucuacaacucuggcuauccuggaacuuacuauauagaucaaacucacaaagcucuaccauucucugccuugcuaaugcuggaauuaaagguguauacgaccauacucaguauccuaugauaucuuacuaaauugugucaguuaucuucuaucuuagugagggaaauagucugaaagagcacacuuguauuacuguugucuguaguaaugcucugcuucuuagauuuguuguacuuuuugugagagaguuugcauuguccccugacucucuuguuucuaccucccaaaugcuaaaguuacgggugugcaccacagugcccaucaccagguugucaaugguuuacuuugguuaucaguuagagaagugacucuuaaccuuugcuguugcuguguccuuuacagacuugagccuuacucugaagaaaaauagcaguaccugugcuauuauaauaggaguuaugugcccaaaagaaaacaagcaauaaauaaauaaauaaauuuuaaaaagccugcccucacauaguuuguacaauauccauagcccuuuuucuccuuuuuaaaaauugauaaauacaauuuguuaacagucaaacaaacaucuaauacauguguguggagugcuuagggaauagacucaggacauuauacaaaggcacacacuguaccauggggccuguaccccagcugaaaacacuaaucugacuuguacagccaggucuuacacauguguuuguguaugugacuaccacacuuugggauauagaacauggcuaucaccccaaagauucccuccugcccugugcagucaguuaucacccucccauagagacugcucuuaacacucccuuucuacugucacuuaggcuuguuugcuuuggaucuuugugugucuggaaccaucuaguaugcauuggauggcucaggggcuagagcacuuucugcacaggucgggggacuaggguuuagauucuucacagcccacauaaaugguagguggguaugacagcccaacuaucauuucugccuugguaggcaggcacagugcaucccuagagcaagcugacuagcaaggccagucauacucauacuggugggcucuggguuuguugagagauuuuugccucagugaauaagguggaggagcaauugaggaugauucccuauggcuccagugggaggacugggguguguugggggccuggaucuucaagaagcaagcuuuuauguuaggauuguguaaggcagggcuugaguaaaguaggccuugagccauuauuauucuuggaaaaaaaaaucuaugcaucaaauucuuugcaugguugaauuggugugccuuuaacuagguuaacuaaguuggagaaguguuggccauguuaagaaguuaaugcaaguaguuaacuacuuucaaaguuaugcauuacuucaguuugagaguucacucucuguugauugcugauagggccgauacaguauuugaguggaacuaucuguuuuguaguuauaagcuuggugggaugcggagugauuuuacuggaugcuauuggaauucuaacccuuaagaacaggaaaagguuacccaguuaaauuuauucaaaguucuacuauaacuaugggagcagaaugcuuguuucuguagugaacagauuaucgaagcaaguuugguuuugaauucuagucagcuuuuucuuggggugagugugguguagaacauuaacggaguaacacuuugggaauuucagagaugcugccuauggaagcugcaguuucuauauuacacuucucgacuguuuucacgcaguaaagaaggugagugucuugcagaagaugaauucuucuccacagggcuguuagaguuccuucagcuguguaagguaccgguuaacauuaaagugaucccaaaccaauaaacagcucguucuaaauuucugauuguuucuaugcuugaaugggauggaaagggcacuuacagacaggaggcaggcugggguugucauucaguugggugagcacuugcuuagcaugcgagaggccaaggguuuaauaccaacaccacaaaaacaaggcacaagagaguuaaguaauuugguuuuagcuagagacagcguuagcuuugaguguaccucauuuaaagaaaaaaaaaguugaauacuguuccccuccaaguuauuuuuauguauauacaacacaguaacugucaggugcaguggcagugucagcuuagcacaugcaacguccuaagucccuccugggcaccagcaauacaguaagugugaggcucaguuuugucucuaggugcuuuacuuugaauucaacagaauuuggacaauuaauuuguuacaaaguuuuauauaaaacuaagugugucacaguugcagucagaaaguugcaggaaugugggggguguguggcauaggggcuuagccuuugaaaauguucagcauugcauagaguacuuucuaggauacauccugguucuuaauagaaaauuggcauuuuccuuaugccuuuguucauaaacauuuucuuuuggauuuuaggcaaugcaguauggcuucuuuaauuucaacucauuuaaccuugacgaauaugaacacuaugaaguaaguucuagguuacugauuucagucucucuacucugcacuuuaccaaggugucagugaucaauauaucuguauuucaucaccguuuuguguguguguguguaugugugugagagagagagacagagacagagacacaggcauauuggugaguuuuugaggucagaagacauguuugcagagucauuuccuucucuucacuucuacauggguucuggacucaaacucacacccucagacuugcguagcgagugcuugaccugucagauaauauuuugauggauauaugcuugugaaaugacuugcagauucaaacuuguucacacaugugcuaucuagauaugcucaggacauuuaagaugcaggaacaaccugcauguaacacccagaacuuauuacuggaaguuuaggcucucaucagaauucuauuugcccauauacuuuucaaucuguuauccuaccuaaagaaauaaggagaaaaauauuaagcaauaugacaaggugcuucagagguuaauggaauuugaauaccccaagcccacaaaaauauuagguggguaugauguccugccuaucuaucagucauauuugggcucagcugaaugauccugccucaauauaggagguggaaagagaaaacaacuuauguuagccuugggcuuccacaugcuuauaccacacaugugcacccaacauacauacauacaugcauggacacacaugcacaugaagaaaaaaauaaaauaagauuguacaguaaggaauagcacaccuuuaacucuuaguuccgcauuugugauucuuagugguaguuucuaagaaugaucagguacaucuuuauaaagcuuaguuuaaguucuguuuuuaguguuggugaccuuccuauugugauguggauauagguuugaaguccacaggguggacugcuaagguauacuugguuguuauagcccaauuguacuaucuguuuaaaguaauuaaagcuaagcagaaauagccaggcaugguggcaaacaucuuuagucggagcacucagaagagauagaacucugcaaguucgaagccagccugguguacauggugaguuucaggccacucaaggcuucacggugacacccugucuuaaaacaacacacccaaauguuuuaaacaaaagagugaacauuuuguuggauucugcaaguuaaaaaucuaggagcagagcuggggaggugucuuagcagacaaauugcucucugcucaagaaagagaaccugagcugggugugguggcgaacgccuuuaaucccagcacucgggaggcagaggcaggcggauuucugaguucgaggccagccuggucuacaaagugaguuccaggacagccagggcuacacagagaacccugucuugaaaaaccaaaagauaaaaaaauaaaauaagggcuggugagauggcucaguggguaagagcacccgacugcucuuccgaagguccagaguucaaaucccagcaaccacaugguggcucacaaccauccguaagaaaaucugacucccucuucuggugugucugaagacagcuacaguguacuuacauauaauaauaaauaaaucuuuaaaaaaaauuaaaaaaaaaagaaaugucaauuuaaaaaaaaaauaaauaaauaaaauaaaauaaauaaaauaaaaaagaaagagccugaauuuagauccccccaacaccuguggaaacaggccaaggucgcaguaaacucccgucaugggaggugcagagagcaguaucccuggggcucaccggucaacuaauguaacugaaucagguucugggagaaaacuuguuucgaugaacaagguggauggccuauguauacacagcguguguucaagcacgcauacauacacgcacaugcacacacacuguguguguguguguguguguauguguguguguguguguguguuagaauguggaauguuauugauagacugaauucucugucccugccaagagcucugguccuggccugccuuaucaaaugaaacaauggagcaggagaacauguccaggcaggcaaauucauagguaucuucuauauuuuuaaacauaaauauuaagaaaaacaaaauuucuaggguuccuuccuccaaauauauggguaaggcgcuguauuaagggcccuuguagggaggaaagcguauagauucuuuguguucugcuguggcuauuuagagcgaggagaggcucuguagacagcacuccaugcguucauaucccacauccacagauaacuagcuuuggcuguuauuucuuuuuuuucuuuuuuaucuuuugguuuuuugagacaggguuucucuguauagcccuggcuauccuggaacucacucaguagaccaggcuggccuuaaacucagaaaucugccugccucuguuucccgagugcugggauuaaaggcgugcgccaccacugccuggcuuggcuguuauuucuaaagaagaccuaugauugaagucugagcuauuuucacugcaaagauaaagcacauccugggguucacuccugucagcgagcgguaucuuguaauaccacugucucuaaaguauaacuccuucagugacuguguaaccgaauuacuaagaucuuuuuuuuuuuuuuuuuuuuuuugcuugucccuaugucuuggggcuagguagagagcucagcgcuuaaaguaauugcuguacaagcaugagggccagaauuuggauuuucuagaagccacauaugccaggcagcaggcauacauggcugaggccucuaaccccagcacugaaaagaagagacagaugaucccuggggugagcuagacuagccugaguuaaagucugcaagcucuagcuucagaaauagucuguuccaaaaaaaaaaaugguguagaaaguaauugaacaucagauacacacgcacacacacaugcacacacucgcacacgcgcagaauauaaaaaaaacugaaaauggcaauuggugcaugaaguacaauguuucuauuaccucaauuguuaaagugauuuuuuucucuccuggcacugauuccgucauaguccauugguuuuuacuucuuaaaaguauguaucaugcugggcguaguuggccaugcuuguuaccccagcccuugggaggcaguggcacagagcuugguugaguccaagggagagcaucuuagcaacuuagcaucacagcaaguucagaccugccaagguuacauggagagauucugcccuagaaaagaaaaaaaggaggguggcuagcaccugaagagugacauccauggcuguauccuguccaguguguguguguguuguuguuucuucucuguggagagagugcuucucucugacacuuuuauucuccaggcuaaugacccaagcaaagaaacaguuuuaaagugauugacaccagggaagucacccguucccuggggauacucaaagcaaaauagagucucccucugucuauuaauaaacagcagacacgcuaaagacaauggcuuugaaaugaguguugacaagggagguggaaggagaugugguucaaaguuaauugugcuggucucuucuuugcagaaagcagaaaauggagauuucaacuggauaauaccagagcgauuucuugccuucugugggccccauucaagauccaggcuggaaagugguaugcaaaacucuggaauccaaguagcuuccucuuuuuccuuuugcaauagacuucugagcugggcacugcggcauuugccuguugucccacaucuuugugaguacguaaggcaggaagacacguugaguccugacuucuggugugcuguaagguucgggugucugcugggcucagccuuguucugcuugcuuccugggaaggaggccuuugagccgccugcugggggaaugaccccacccuguuuagaaagagaccaaagaauuaagcuaagcuugacucagucuucacgauuuaaccacucuugguuauuugagcacacuucugccuggauguuaacuuuuuaaacuuuuggcuuuuacaguuauaaaauugguauucagucccuaguccagacauuguuuccacccacuuuugggugggacuguuuuccauuguguucuuccuguguguuccaagcuuugugcaucucuuuauguagguuaccaccaacauucuccggagacuuauauuccauauuuuaagaaucacaauguaacuaccauuauucgucugaauaaaaggauguaugaugcuaagcgcuuuacggaugcuggauucgaucaccaugaucuuuucuuuccggauggcagcaccccugcugagucaauuguccaagaauuucuggauauuugugaaaaugucaagggugccauugcugugcauugcaaagguaaauaagcagcuagguugggcagugugcaugugagaguauauauguagauacggguuauauccuuuuauguuacauggcaagacaacuguguuuuugaaagaauaauuuaaggguuuuuugugacaucauuguggcauguguguuuuagagagagagagagagagagagaccaaccaaagacaacaugugggaaucacuucucaguucucuucuaccauguaguucccaagaauggagcacauaguaucaaauuuggcagcaacugcuuuuacuaguugauccaucuggcuucccagaaagagcgauuuuaaaauccuuaauuuguauauagaguauaguaaauuaucuucacgaguaagccuaccacagcuuuguuuugaggcaggaucucauggagcgcaugcuggccuagaacucccaacgcagcugcagacaccacacccagauccgccuuuuacagcugugugccaucauccucaguccuuaugccaugcuggggacugaacacauggaucugugcuugcuaggcaaaugcuuuacaagcuuagccacauccccagcccccagccuaccacagcuuauuacacugaaauguguauauuuauuucuucugucugucgugugcccaugagaugaguucucagguugucagcaguagaccaaagucuugcagcagcuugguguagacuaagauguguuucagcaguuauagcaguuucugaaucuaaauguuccaggaauaacuguaaugaugcacugugugaauauaguagagugucuuuaacuuuaauuuaaaaauaagguaauuaagaaaacaagggauauuaaauggcaagguuaaaaagaaaaaccaccaaauuaauuuccagcgcuaaaacuauuuuuaguuaggaauguagcuauaaucacaacauucaaauguucaguuugcaguggaagaugacaaggcauaccaaaaaguaaaauggagccaggaaaguaugaaaaacccacaaaaacuauucuugacaaggaucagauaguacauuuuccagacagaugauuuaaaacagcuaccucaacagugugcacaacgaaaagaaaaugugggaaaggaggguaaaaaauaugugagcaaaauccaagugucaauagaaaacaaaaaccaugaaguaaacccaaaaugcaauucugaaaauggauugaaaaacguacuggcaggguuccaaaggagaccugaauaggcagaaggaagaagccaagauugugaagagcagagccauuaaaaagacaccaggagaacaaggagaaaaggauugucaagaaaagaaaguagcaaaguguacaguuuggggacggagcugggcagaacccccccccaugugcacagugggagguccagcagaggagagagcagaaggaggcacauggccuggaaauauuucccacuuuugggaaaggcaugauugugaacauucucaaaacucagcaaacuccaaacagaacaaacucagaaacuaacaugaagacacuuuaugaugauacugucuaaagcuaaagacauugaaagaagagagaggaaacucagguuaccaauucugccauuagaaacuguggaggaagagcccuauaaaccuucaaaacucccucaaaauagaaguaaaaccauccucagauggucaagugcugggggaauuguuacaacuugaccuguacgauaucaguuaggacucuagacaguacucaaagccacaugaagaagcaagugucuacuguagagguugauauguacauagguuaaagucuaguaauugcuuguaaaauauugucacuguuuugauauaaauacuauaacacauaaaaacagaaaaccauuauagaaaucaacaaaauccagguguggucaguucuucacaaaguuuaacaagaauaaaaauaagcacaaaccuuuaguuuuguguuugaugauugaagauaaaagagaaaaaaggcuuaaguuauugcaugagaaguggcaguggggacaauacucgucuguagacgagguaagagaaccugaacucggauccgcauguaaaaagguagguauggcugcaugcaccccuaaccucugcaaaggggauggguagacuuacucagcuuacuggccuguccaucuggcugaauccagugagaucuagguucauugauagacccugucucgaggggaauaagguggacugguagagcuggacaucugugaauauauacacgugugaacaaccaguaagagaugacugaauagccaacagaauguuggaugauggaaaugaaauagaaaauucccaggaacaaaacaggccaauacagaaucaccaugagaugugggcagugggcacagaaucuagaacacugagaagguaacagaguuucccagcuaaggaagaggaccugaugcauggccugugacuaacaccaauucucugagauuauucaaauuugaagggaauggagaacacuguucucuaaggccaggauugcuuugcuaccaaacacaagcaaagaagccgucuuuguaaaagccacacaagguaaaagacucauauggagcugggucucgauugguagagggcuugcuuugcaaacgugaagauugcaguuugauuugcagcucuggauaacccaugguauagaucugcagucauagacacaagagggucagagauuuaagauuauccucagccacauagugaguuugaggccagcuuguaguucaggagacccuguacaguagaguacaauacaauucaccguaccaaaccauuuuccuggaacuacagaacuaaaguaacauaggaaagucauuguaagucuccacaguaacugugaagcucaaaaaacacauaaucaucucuguuaguauaggaauagcauuuggcagacuucucgccccccuuuugugauaaaaccacuaagaacaaaauggaacuggaaggaaacuacguccacacagccucucacugaaaccuuuucuuugcuugcccucaucugagguggcuuuccuaacagcuacuucagucuucucccauacaguuauagcauguuuauauagagauuuauuaaaagaaacuguagucacugagucucucaucuguacuguagcugccuaacugaggcgugaaugcagggugcaggaggaccuccuucggguggaaggcuaaucuuuuuguucuauuuagaucuuaaauggauuggaggagcacugccuacauuauggaaagugaugugcuuacuaaaauuggcacuggaugaaaugccaaucuugaccaaaauuccuuccaaguugauauaacacauuaaccaucaugggaguuaaguauaauggucuccauaagaggaaagaaauagggcuggagaugacucaucauauaaaguguuugccaggcaaaugugagacugcaguucuggucucuagaagacacagaaauacucgguggccuuguagcucaccaguaauuucagccuagaagggagagagauggggcauuuccagaccagacuggccagccaaauggccacagcuguuagguucaguucagaaacccucccuuagugaauaagguggagagcaaucaaggacgauuccuagacaucuacuuagggccuccuaaugauugugccccccaccccaccccauacacaaucaaaaauacgcacugcuggauuaucucugaugcaccagcucccaaauaaugacacugacaccuuuuauuaauuaugaaugcuuuaagccuaaguuuaggcuuguucccagcuaacucuuauaacuuaaauuaacccguuuuuacuaaccuauguucugccacguggcacacuacuucuccucagcaccaguacuugcuucuucucugcaacuggcuggcaaaucucuccaaccauuuuuuuuccaaaguuccuaucugugucggauggcccaccuguccucuccagccuagcuauuggcuguucagcucuuuauuaaaccaaucagaaggugcuuuagacaggugaggaaggacagagaaacaucuucaaacaguauccuaaaagauuaucccagcaaacaugcacacauacucacaugcacaccacauugcagagacacauacacaacagaauaaagaguuaaaaguaaaaaugagguauaguuuagguugaagugcuugucuaacauaucccaggguuggguucugucccuagcucuccuguaaagcggagugugaacugauacaaauguugaguagguaauacuguuggauaugguaacaaaugcaaagcuugggcagaaaacagcauacuuaaaaauacuuguauuugugugugagugcgcgcgcaugugcacacgcaugcacaugcaugugccugagugaauauguguaccacacuugugcgggugccuuugaggccagaggguauuugaucuccuagaaauggaauuccaagcaguuacuaucugggugcugggaauugagucugggauuuuagguccucgguaagaguaguaaguacucuuagcgcuaagccguuucuccagcucaaacuccacauuucuuagaggucccuguucagaaagugauuuucaaucuuuggcuuuacauugauguaaaauccucuggggggacuucagaagacccuggauucagucuucugcuccuaggcuguuaccacuuaaaccuugagggucaggccuggcaccuagccuuuuuuuuuuuuuuuuuuuaaacuucuucacauuuuuauucuuugugcacaaagacuagcaugaucgguuccacuuccuagucagucgaauccauucaaggucguuuaguccaacuuaaugaagccuauguccuucgcauacugccggaagcauuggaggcacauguucaccccguauuugcagaucagaucguggcgguuagagcaggcgcggcaagagcaggaacccuggccgaacuuccgugggugacuccagcagagcugcuagugacccaucuugccuucagacgcccgacaagggaaaaggggcaccuagccuuuuaaaaccucuucagauugacucagagaaccucuguagagggaggcaauacccugagaaggcuguaacuuuuuuuuucuuccuccuauucagaaauuucuggaagaugugcaaacagauuucauugaugugguuuguuuuucuagcuggccuuggucgaacaggcacucugauaggcugcuaccucaugaagcauuacaggaugacagcagcugagagcauugccuggcucagaaucuguagacccggcucaguaauugggccccagcaacaguuucuggucauguaaguguacuugaagcuugucuucuguaagaaccaguggcugugggauggggguggaggcgauguccuuacggaaagcuguauuuuugauguuguuuaaacacuguaggaaacaaucaagccucuggcuagaaggcgacuauuuccgucaaaaguuaagagggcaggagaauggcccccucagagaagccuucuccaaacaccuuucggaugcugaugaccuguccuuaaaugggcuugagaaucaagacaaucaagagccugagccgguaauggaaccaccucggucacgcuguuguaauugcuguaaaugcuuuugagauccuuguagggcauggcgaaacuguagguaaagcuuaaaauaaaguggcuuuuaggggcugauaccacacagucauguuuacauauauucauaaccuucucuagaaauguuugacugaaaagaaaguugugugcuuauagaacauuccguugacuuccuaaacacagauggcaauuaucaguggggaguaagcuccuaagacagagcugcuuacacuccaaccugagugugccaucuucaucucaacuggauuaguaguucaaauggagaacuuucaaagaaccacuguuguagcaggcaacaguacuauacuagguuaaguaguaaugaauggauauucagacuuuaacaaguucuaaaacuaaaagcccauucuauuauguaucuuuaccccuuuauagagggcuuugugacuagugucccugaaagucagcuuugauuguuuugaaauauggcugguagcuugauuuuugaaaacugccgcuuagcauucagaagaaaguguguguguguguguguguguguguguguguguguguguguguguguguguguguguaugucugaaugucuggguaaguagccacuuggcugcaauagaaccuaaguuagcucaguguuuauuuuuuuuuuguuguuuguuguuguuguuguuuuaacacauguaguauagugaugaugaugaagucaguggaaugacacaaggagacagacuucgggcccugaaaagccggagacagccgaaagccagcgcuaucccccucacgugagugccucccucccuucugaucacuugucuguuauguuuccuguauacuuuucuccauagcugcacaccauuacuuuguagugaucacuugugugguuuaaaaucuagaggugcucugcugggaagugcuaagcacguacagucugaggagaugaaugcauuuaucucuguguccuacuguaaccucuagagccaugauugguaagaaaacaauauuaaggaaguuuuguccauagacaguccagagagugacagcagaugucaagaccagguuaauagauuugucucuagguauuaaaaugguuacuuguuauuccacucccuuauacauguccgucaucagucuguacacaggaaaauugagucaguugucaugauguucugucaucucagaguaaugauaaacucauccccuaauuauguuuuuauuuauuuauuuauuuuuggucuggagaauugaaaugcagacaaagguuuaucacaagaauaaaaaguuucauaguuaguagguguuuuuaucuccauaugaacuucuuaagcacuuguauuaauuuggauccaacuacagggaacauccucgaucggcauucaaauacagggaagcaaaguaugaagcugcuguacguuucucugggcucucucccauaggugacccccccaggccauugcuccugucauuauugguguuucccuuucucugugagaaggcugauggagauaagucucuuuaccauagcucucuggcagugcaguaaauguuagggaugugguucuucagcaugccucggcguccagcacguuguguguggggggaggguuccugacacaaagggucaacauuuucaacauaaagucuuuugugaauucugauuuuaagugucuauuaagaauucuccucuuuacaaauaguaccuuuuguuuaauuuauuuuauaugaauagauaaaaauauagugaagaaauaagaaaaauauauugaagaaauaucuucaaaugccaaguuuuaaaauuauuaauguuuuuaucugaggccuuucuaguuauuuuuauucacaaaauaaucauccccaaacuaauucugugccugauagaggaagguaggucauaccccacagcagccacccacagaccuagccgagccuuggagucaugugggagcuuaccauauaaugcaucuuguaugagauucugauuuccaacaaaccuucuugcuugccccuugcugguuguggugguguuggggagacuuugacauccuuugaauugcaaauuuuacggguuacacacacuuuuuguuuuaagauuggcuguugccaaguuuacuucuuuuuuuuuuuuuuuuuuuuuuuuuuuuuuugguuuucugagacaggguuucucuguauagcccuggcuguccuggaacucacucuguagaccaggcuggccucaaacucagaaauccgccuaccucugccucccgagugcugggauuaaaggcgugcgccaccaugcccggcuaccaguuuacuucuuaguagguuguuuugcccuacauucaugagccagguuaggagugagaggggagacaaauucuuucuggucaaaaguucuuguuggggagcuggagaaaugguucagugauuaagagcauuaguuguucuuccagaggucuuaaguucaauucccagcaaccacaggguggcucacaaccaucuguaauggaaucugaugcccuacucugguguuuaugaagacaaagcacucaugaacauaaaauucauaaauuuaaaaaaaaucuaccaaacuaaaguuauuuuuuuaaaaaguucuuauuggacuggauaagaggaccggguucaauucccagcacccacauggcagcucacaacccucuguaacuccacuuccaggggaucugucaugaucacauggauuuacaugcaggcaaaacuccaauguacauaaauuaauuaaaucauuaaaaagcuuuuguuagcugcuguaaaaaugcccggcaguugaaagugcuguccauacagaggccccaaguuuggcuuccaccaccuagaucagguacaauacaaucagcuguagcuccagcuccaggaaauuucugcguucucucucucucucucucucucucucucucucucccucccucuuucucucucucucuccccuucccccucccccuccccuucccccucucccucucucucucucucucucuuucucucucacacacacacacaaaaucuuuuugcaaaaguucauauuaaauagaacuuucaggaaauuuuacucuccacucuguucagaaaaguguuuuuuggaacucaaaucauuuagugaucucuuuuguuagauaaacugagauuauggaguucauagccugaggguauauggugacagaaaagcacaagaagauuaaaauuuaaagacccccggaacuugcagguggcuucagauguccuaccauucagcagauugugcaaggcucuuuggacuagaagucugaugcucucagaaauggcugaaugagaacagcuagaugguuuggggagagcuuagugggaccugcacauauauguguguucacacaugugacgacauacagcacaagcacacacacaggaaacacgaggccaaaacuggguauguggcacagcacuuggaagguggugguaggaagaucagagguuuaagggcacuguaaacuacauagaaaggucaaggccagccugagaagugggagaccugaagacagaaggaagagaagggaaaacauaccaaacucuagugugcacuaguuacuuuuucuguugcuaugaugaaacaccauaaccagggcaacuuaauagaaggaaauguuuauuugggcuuaagguuucagggcuuuggaguccccaguacagggaagcaacaguauacgugugguaagcauggcagcuggagccggaaaugaaaacuuaaauuuugaacugcaggcaggaagcaccgagagcuaacugggaauggcaagccaccuugaaaccucaagguccacgcccaaugauaugucugccccucaccuccccacccccaaucuccccaccccauccccgucgauaccacacauccuacaccuaccccagcugucucaacuacuugaggacuaaguauuuaaaugccugaggccaugaguaccaucucagaaacauacaaggccacaguagcgaaauugauggcucuuggucaggugcacuucuguaauccacauugccaauugugccguucacuggaccucccaacugacugaggaguguucuguuuuuguucagaggcguucccuggucgcagucaccccuccccugaucauauuagacugucuguggguuguuucuguguccguuucuacuuguguucagguguaguguuuugcauaucuaaggauggccagcuggaguacugucagucaguaugaugggagauggagucuaaccauuuguuccuguguguugaaccuguuuaaacuaaagucagcguuuuugucucaacagaagcuggaccaccaccacccuuguuuccugccccuuugccaucacagucgcugcucugggccuuuuagggugucuuaaauccacagguggcucuauguauuuuauuauaugauuuauuuuggcuucccaaugugaacaucuguucuuucccuuccacccucuccagauguccccuagcugugcugaccucugcacuguguaguguugccaucugguggauugugugugacuacauucuucccacccugcuguucugucuugauggcuucagaacacaguagccaucuggacccuuugacagauaguuugcuguguaaguuuccuguuccguuucucuccuacccucccccccaccccccuguguccugugugguuccuaugguguauguguuucuccuucuggcucuccuagcuuuguuguuuugcuuguuuuccagggcucucuuuccgaaucucuucaaugaaugggaugguaccagcaggggagggccucaaggagccuucugagucaaggauguuaaaaauaacaccuaguuuugaaaaguuguacuagcuauucauaaauguggacauuggaauaguuuucucaccugucaaaaaaccagguaguugagccaaccagccugguuucguguccaccagggggcuguauucaccucucguguucaaugccuggaaugugucuucagucaagugugucucucaccauuucugcuuuuagcaaagauugggcuuuguugccuuagaggcuagugaggaugguggcccaaucucuucaggucaccugucuugagucuauagaacuguccauucuuucaucacaucuucuuuguguuaagugagaaaaggagagggguagcuggcugucucccuugcuuguguuucuauagucucuggacucuuccuucucuuccccaaaauaggcagaccaucuuuguuagauucuguacacaaguguaaucuccugacaugucauucucucaagggagacacuugucagcagaaagcagcagaaaaccucuguguguaacaucacagcccaggaacacagagggagacaugugccacaccaccaccauccucuaucuguuuucugagacccuucuucaucauuucauuccaaaaauuuacuuuucuuguaccagcuuggacuuagagauugccaaagcauucagaauucccuucuaggaucuccuccaagugaaaaucugucacagccaacccuugcccuuugagguucuguugagaguuucauguagcuaagaaagauuuaaaaaggaaucaagaguccacuaaagaaaacuugcugaauaaauacuuauuuacagugguguuuccuuguauaucuuagaugaguuuauaaucucacauuucacuuuuuuuuuuugcccccucuaucuauugaagaacaaugauaccuuuuauaguuaguucuucccaaacuauucuaaguggccaagauguucugaauggguagguggaguugcugcuaauaauauuugucuucaggcccagcuuaaauguugcuuuaaauguuacuucuacuggcgagcuccucagaguccucugcaagagcguuagauuaguccuguagcuuaugucaccacuacguuuccagaccaaaacaggguguuccguuuagccugccuacugacuugaauuaaaagcuuucugugacugagguagguaacaguguggucuucauagccacucgcucuuggugugagacucuucccaagaggcuuaauuuguggguaacaguucacugcucuguggugacuggcccugcugugagcugguaggugagcuuugccuuguagugaguuccaucagcugguggccucgagccuaagaccagaaagcauuuuauguucucuaucuacugcacacagugggggacagugcuauuagagaaugguucaggggcuuguggggcauccuacagaaagcucuguggcagugauccucuagaaagccaucuaugcauuuugaggcuuggcaggucacuccugguccguaagacuguuuuucuaacuuugcugugcaucucgucauugucagugucuaaaaucugcagcugcugcggcuuuagaaauaccacagacagggcagcagucuaugguuugggcacagggucaggaggaugaaggcaaacuugguuggggaagagagagagaaaagaaaaauguauauuuuguguauugauaggaagaaccaugugagcagggcagguggcccucucguucugucugagcagcucuggggcuuucucacuuuauuuaauggauuaaguguuugcucaggccagauaaccuaaggccuccccggugugguuaauacguacuaaauuuccuucugaguuuuaaagcuccacagaaauuaguaaccacuaauaucauuauuucacauuuguuuacaacuguuucuuagaaaaauaaaucaagcaguaguagaucuuuguuuuguguagcauuuaagcauuucaguaauuuaagagaucaggaguagguuuccugagcaggcauuagaguguguguguguguguguguguguguguguguguuuuaaaaguuaccaagcguuugcccucagauggucugagaugggggaguggugggcguuacagaagaagccacucauuuuucucccuuguaaagaagcagcagagggaaaugaaguacacacacugccagaagccuggagaaaucagcagguggauuugguugccuuaaagcaacauucuagauucauguccuuaugagauaaauauuuccccugugauuguauuaacagaaauuguaacaguuggauaagagaaguagcauuaauacucuguauagcccaguacaggguaacccugaucaacaacuaacagaauuuuuuaaggagagggucuuggagguucccaacaugagguaugauguauaaggcuauggcugagccagccaguccucuuauuguuaacacauuauguccguauaagugaguccgcaugcccaguaacuaugcaucuugauaauaugccuacuaaaguguuuaauucauuuuaauaagcccuguuuggggaaggagaguuccuuggagcagcucguuccuccuugaggcaccgagucacauuucuguaugugccuacaguuucugcugaaauauuucagaugagcuuugagaguugagccgauucaccagggcuagacugcucuucuuguacagucggagagccaagcagagagcuguuuggcuuccucuggaagcuuugcugcaguggaggagccaggguugucagucacccgggcacgacagccugugaaguagaugccuccuuaguuggaaucaucucuuuuuacucucuuacaggcugcuuucccaaucguaggaaaauuuacucugaagggaggaaacuuuuaagucaguguuuucuccuucauugaugcgaauacaucggugcacauggcucugaagcaaagagucaacaauuuuugauguuuucuguuauuuuucuucugacaguuuacugagaauuacuuacagagagugugcucuguguagccgauucuuucugauucacgauuuuucuccugggcagucuucuguuaagagaaggcuuuuagauuuuaauuaggacaaguuucacagcauuuaaguaauuguagucuuguuaugauacuuaaagauuuaguaaguaguuaugaugcagacaaaauugaaaucucgcuugaacauuuaaaacuuugcuugccauaaaauuauuacuuuguuguuuauuauacuuucuuucuucgcugaccagugaauauuauguagcuguuuugcuaaauuuauauuuaaacacuuuaaaaggguuuaugacuugucuuugugacuguaauuugagacccugcuuugacagguuugacgaauagguuucuuugguuuguaaauuguacagaaugccaggucauucauuuuccccaaagcaaagcacccuggcuaccucuguaauaaccuucaaagagaagugagaugcuugguauaaaaaugugcuucaaguuuguuuuguguauaaauggcaauguuauugugaaaaauugccuccucugucaauuauuuaacaguuguuuuagugaauauaaucuuaccuuuuuucaacuguuuucagaguaauucuucaguccaguguucagagcuguaaaaccccugaaccuaaccuuucuggcagugcaggcauuacuaaacgaaccaccagaucugcuucggggaaaagcaguuuuaaaaggugagaaaagucucucauucuggcaagucucauguuuguuuccaguucacucuucuggacccugcuucuggagacugacaugaagauaggaaguuggaggcucugugaugggaauggaggcugcuguguuaacuggcuuuucagagcaaauaccucuuguuggaaguguggucucuggcaugguuugauauggggaagcugagagaacuuugccuaagugcuuguugcuccucuucucccauaucagauagagcuuagugagucauggcagagccucugggcucucaaccugaccacggguucuccugccgcggugcuucccgacaccugccacugcucuccccuuuaucuccuugguuguuacuucuaccuacucuaggcucugagaauguucuccaccaucucuggaugucugucauaaaccaaagucagacaugucauucucaaguuauuccuagacccagccccugccaagcaaagaaaagaccacaccauugcuccuuccugaccugugaaaagcagcugccuugaucaugcuugggcaccaucacuugacaggggugacuucacuuguuuuuguuuuuuguuuuuuguuuuuuuugagagagggucucuuggugcagccaugacuaucucauagaccugcuuaccucugccuuccaaaugcugugauuaaaggcaugcaccacuaccauccaucaauacuucacucugaaaucggauggcucugaagaaaaacagggccagauucuacauucuacuugacucuuuuaucaguucuuguuuguuuguuggacgcuuucucaccuucaugacguaggucauuguaagcucauugaugugguccaccaucacugucccaagagcucugggcacucuggauucuaaggaaugcuuuugaguuuuguuacuuuuccuuguugcugacuuuauaacauuucacuuuggagugagagccuccugagaacagaaaaaagaacaaccuacguggguacuugagaaacuucagucagccgcugacucagaaaguugggauuugaucuuaaggauuuuauguguguggaguguugguuaccacagaagccaggaagcauuauuuuuaauuagauauguacuuagguguuuguuucuuuuauacuguaguuccaacuugacaagaaaaguaggaaugggucagauuuagguacacuauauaacauaguaucugaguucugacagaaaaauaggagaugggccgaguugugcccauuuaauuucauuaauuaaugaugaaucaggaaccauuuauuuacugauugacagugcugaugcuggaacucaggguuucauguggacaagacaagugcuuuacuacugaaguaaauaccaacccgaguuaugucuuaaaagauaauuuaaugacucggauaaaugcuucugaaacaaguaagauaaauaaauaaaauuccuauguaaaacuucugagcuaaaacuccaguuugaaaguauacacuauggccgggugugguggcgcacgccuguaaucccagcacucgggaggcagaggcagguggauuaaugaguucgaggccagccuggucuacaaagugaguuccaggacagccagggcuauacagagaaauccugucucaaaaaaaaaaaaagagaaauuauacacuaugacauauagagaaaaguguaucgucauaauuauuucaauaugcaaauuucuaauuaugcauacaauugaagcacaaaaccccccaugcuucuugauucuucuuggugugacuguugaggcuuuagauuccaacuuuuccauuaaguuaauaggaaaugcaaauaccuuuuaugugcagucagacugucaaaaguucccugugaaugguggccuuuaauuccagccccuaggagacagacagggagccuggucuacauagcaaggucuaggucaaguagggcuauguagugagaccuugucucaaaccagaacauuagcugugucagaaaguguggugucaguguugauaucuaagugcucgagcuuuugguauaauuaauccaguaagucuugcucauuugauucugagugauagaauuuagcccaagcuuugaacgacaccaugccuauuccaccgaggaagguugacuaugcacuacugauccuuauaucuagguuucuuggcugugcauggcccuccugugaccuccacuuagccucccuggauagugguuucugauuuucagugagcuccuccugagguccuagauuggaugcuuugaggauucuaaauaagcuggguuaaaugaacuggaccaaagugccuuuccggaauuugggguagagauaagccaaagagauuuggaaguugagguaggaguacuguggccuauauucauaguacuuuauuaucacuucuagccuacaaaagaaaggcgcacgacugugcacggcauuccaccacuucuaggaaauaaggagaaucagagauuuccaggauauagccugcauuuaaccugcugaauaauguucagcuucuguuuacaggguauuaaaggaaugcccucuauauaccauuaacauugguauauaaucuacuccaggaaaaauaucucagcugagaugauuggguaauucuaacauacuuaguugaagucucuucucuuuaaacaauagcccccccuccccccaaaaaaagcacaucaaaacaaaaauuacaauuucuuucaaugucugucucccuucaggcucaccaggccuccugguucuuuugugggaaagucccucucuguuccagguccuugcacucacacaucuccugcgauggcaacauuaauguuuaauccccccucccacacacacacacagaggcuucuaggauggagauucucgccaaccucccuuugcacugaguggacuccugaguuuugacauuguaucaagagagacuucaacuuucagagacuuucccagcaaaaccucuuaaaagauuggcuacuugcgcugagaaaauggguggauuaugauagaggagaugggcggauuugcuguuggaggagaaaaaccacugugcuccuccuaugagauggccuucuugucuuaugucauuuggauggaagccacaugcauucagaaguccuggggcuucugugucggagcacacagcuugugugggauggagucguuugguuggugcuguguuucucauuuucauuugucaggcucugaaggaaguucguggguuucuacaccucucacuuucuacuaggaccauaaaucuauuauaacagcucauaacugacauaaugaauuggcuuuuuuccagcauucccauacuaacucugaagcgcucucucagagcaagccuugaacacugucacaccgguagagggcuugccggugccuugugugggccauucaccccaguucacaacucuuucuguagcucuuuacuccuguguuucuggaagcuuguaaaguuucuuuugggccaucuuuucuuuuuccauuauuucaucccauuuccugaaaaaucucucuugucccaaugaccuucuuuauauuuaagaugcaucacucugcuucugccacgauaaugccuguggcuccgggaaacuuguacuuacaggugugaugcucaaggcccuucauugcuccaaacucaugccuugcgaccaucuccguggagugccugccuguacuuccugggcuuucucuaaguccuugcuguggaauucauuuccgucuugccugucauugcaucauagcucucugggccucagcuccugguuucuguuccguugcuuccgggauuucauauuucaucggccauuaucuccaggaaccccaggauguucucccucuauucuucuuaagcuaacauccuguggaauggcagauacauuuccacuugacucgacccagagauugucuuugcacucaagacucucugcuccaguguguaaaaacuaugcacccaguucgggucagucuucgcuuuccaagugagggucgucuccggaucagaaguaauuucauagguggguuugucuuuucucauuuguacuuucuucuuuuccuuuuucucugaaaguugcuaaugaguuugagguauaacagcacauugugggagaaagaaagagaggaagggugaguuagguugauuuugggugagcccagaggggcccuuggcugucccugcccagaucucuuuacagacaggccaagugcuccaagaggaugggccuggcucgaaaccacccaguaauuccucuuuaucucuuccuucucuccucuuuccccacagccuggcuccguggagggagcggaggagaaggagcgcuuugcagcaaaugcccaugcuggccuuaugguaccugccuugcucugcugcccaugccugccugucuuuguuuauuucuauugcuuuuuuuuuccccuccuuuaaacaaaauuugaacuuuucucugcccugccuuucucuccugucugccuuuuuaugguugauguuguauugucucuucuaaaggaugccauuaaaaaucacaccuagugugugcuuuuagcaugccgauguucuccuuguguugcccuccuugucuuugaaauuuuccuaaggaauacuuuagagucuucaugguaaaucucucucucucucuuuuuuuuuuucuccucaguccagccauuucaaggacuaagacagucuuacguuaaaguaaaaaaacggugaccagcacuccagggaagacuaggaacagaaaacccaaaaaggauuuagccaaucaaucugagaacaaagcagacucugcaauggccuuagcuucuuaccacauaagaaguucauucaaugaagaaaaugucacuggccucucauccacucacugacucuggggugugguugaaccauuugagggccugacucucccuuuuguuaucucaaguuggacaaaagcugcuguugugaacuuagucucaggugucaauauccuguccucugccaccagagaguugucuggugagugugguacaugugugugugucccugugauggcaaucauguuugcugcuggccuccagaagaguugaggaucugauggagauaucuuagguauuuauuuuuuguucaaccuugugacccugacucgcaguuuauaaagaugaaagagaugaacaucccaccagugguacccuccaucuucagguaugauuugguacaaucagcuucacuuuccucuuguuaauccuguugugauguucacugugugaaguacccaagcugcuuguuuuucaccaaagagugcuuuauuaacaaccugugaacacugcauuuaaacacuguuguauguuguugugguuacugaaaaccugcuaggaaauguugagaauguuggaacccuuucucaguuaccugguuccuacaaauccuuccuugugucauuuuaggaugaagauuucagagcugggauguuguuggguugcucagccacguuauaauuguguuuacuucauuacaucaaaaccaaacaucaacccuagcauuuuccuuugggaaagcauccuaaauaaugguggcuuuaacaacaaaauugugagccuugcuguauuggcgcacgccuugaaucccagcauugggaggcagaggcagguggaucuccagguggaguuccaggccagccaaugauacacaaggaaauccugucucaaaaauaaaacaaagcaaaacaaaaaaaccaaacccaaaaucccaaaauuguuaacccuuuguagagucuuucucuguaacgcuguggaguuuuuuccuugugauccacaguuugauuuuagugacaaucacuugcuucuggaguuaggcuguuuguguaagagaucucacuguugccuuugguuagggaauaugacuagaaacuguagugugccuuuucucuucacccugcuggaagccagcagcacccgugccaugaagcaauugcaaaaccagaauuuaucugcugccacaaaaaaaaaaaaaaaaaaaaagacagagcccauaauuagaaaauacucuauaguugucuugguuacuuccacaauugaggcuaaugguuuuuugacucucccaguuuagaaacuggagaaaugcaauauugaaagccauugacagccaaugccuucccaagacaggugaaugugucaggugagcaggcaaucccacuugaaaagcugccuuccuuguaguugauauugacagguuaaagucuaguuaauguaaaaauauugaaagacaauagguccccccuuucaguguuucuauccucaaacugcauugguuggccuuggauuggaggcaugaggauucaauguaaauccacacaaagagccccccuuccuaggcagcacguagcuuucaaacaacgggaaaaaacaguuaagguaaaguuuguuaucucuggauaugaauuggauuggaucuagguaggagggcaaacguuucauuuaccaaucaugcucaaucaaacugccuaagucuaaaauagaaccuuccugggugguucuuccuucccugaacaagcuaggccaggcaccaggagacagaaggagacuccauuccaucugaacuaagcuagauuuguucgcauggaucagaaugaguuggucagggccugcccacacuggcucguggucugcaaguuugggaggaaaccaccugggcuucagagaugaccacagugcuuuuuaaaaggcacuuuuuuguguuugcagcuccauucaucuagaagugcugccacuguggcucuucccugcauuuaacucccuugcuaaaguuacuuaggaaacgugaguuggugaggacacauucauuucuaggaaaagcuacuugauguugucugggcaggacugcuuagcaacugaccaccagugacaucaggacccaggaagucuuugaucagacuaauggaaaguccuuccuguugggaauuaguggacaaccucuccccaaacuacaacuacccagaaacuucugggauagaagacccuguagcuauaaagcaugacucaguagauaugggauggaggggccccuuuaacuuaagaacuuuaaaugccuuuguaagugcaucaaagcuucuuccagcagaaugaaaauuagaaaaguauauuuauaggugcccuugacgcuuuuggggaacgcauacuauccagagucuaagagaagaaugucugcauuagcugagcugagggcuuauagacagauugucuuaggguuucuauuccugcacaaacaucaugaccaagaagcaaauuggggaggaaaggguuuauucggcuugcgcuuccaugcugcuguucaucaccaaaggaagucaggacuggaacucaaacaggucagggagcaggagcugaugcagaggccauggugggauguuccuuacuggcuugcucagcuugcucuuuuauagaacccaagacuaccagcccagggaugguuccaccuacaaggagccuuucauccuugaucacuaauugagaaaaugccuuacaguuggaucucauggaggcauuuccuuaacugaagcuccuuucucugugauaacuccaggugagucaaguugaaacaaaacuaggcaguacacagauuaauacaauucugaggcccagcuauaacucuugauuugaggcaagaaggacggacccugaguagugccacaaucaaggguagcaguauuugucgaaacuaacauggccacaugcugcucuuccucauuaacuccccagcuuuaauugguccccaaaaccuaguucuauccauugcccugcccugcccuacugccccccugucggguggcuucuaccucuuggcuugggcccugacaggucacaggggcuuccaagcguucuccugaggcucuuugagcacaaucaggucugucgaccuuuccagcuuucugggucuggaauuccucaggccuuuguuagcuugaauagcugucugugacaagugaguauguguucuagaaacaucagcuguuuuuccucacauauuuuuuuuaaaaguucuuacuugcauuuuggaaagcaguuggucagaaaccuuaaaaccuauuuuuuuuuuuuaagcugggcaauuguagcaggcagaucucuugugaguucaagaccuaccuggucuucaaagugaguuccaguauaguuagagcuacacagagaaucccugucucaaacaaaacaaagcaaaacaaacaaacaaacaaacaaaacagauaauacaaacuauauuuuaagauuucucucccacugaagugaccucuugagaauagccacuguucuugcauuucuucauaaaucugaguguuccccaucucacugaguggaaauacuacagauacauuuaaaagaucgccuauacuguguaagaaauuaccuccugaugauccaguagaacucacuguggauagacacgucugucagauuacgguacugcaguuuuacauccauuguuugaagacuuuauuguacacucaugugcagaugaaguuuuaaaauguuacugacgagucaccauuugaucagucauugucuugauauuuuauuaaauuguauauuucuaauaauauuuuuuaaaguugagagaacugguuggauguuuauucuccugaagguauuuuuaagauaaagcuucaccauagccuguaaacuuggcacauaaguaguuuuugauacuuuuuguugcauuugaaaaaucuuguguauuguaaaaugguuuuauacaaaauacuaaauaguagaaauuguauaauuuacaaucguauaauuaaaaauauuaaacagucuuuugguuuguuguauucacuuacugagcaugccuaauagauagcaauuuaauuaugaaauggaucuaauucuuaguuuacagaaggcaucaugacaaaguacuacagacugggugggacaaguaaagaaaaauguguuccuucuuggugccagaagcaugaggcucugaccaagaugucaucaggauggguuuuuccugagauguucuguucuuugcuuacucauggacacuucucacuggacuucauaugcccuuuuuccucuguacugcccaucccuggucuuggaagcuuagcagugagcauggauuaggaccacccuccuggccucauuuacauuugccucuuuaaagguccugucuccagauguaggcaacuguaugguacagagggauuaaggcuuccggaacucaauuucaaaguguccaggaggggagggagugacuuccugcugugagaucacuccaugugcaccucugugccagcuugaauaaccuggagauuugaugguuaagacuuaggaguccuguaggccauugaucaugauuuguagcuuggccugaggaagcccucaggcucccugggugaucugcuuuauaaagauugauuuuaguccucuguuucugauauuuuugguauguagucucauacaccugagugugauaacccacauugucuuuacccgaaggugagaacauguuugaugcagguaagucuuggcuuguacagaggucuugccuaagggauugugaguggaaagauaggcaaaaaaugcuaccaagauggcgcagcagauaaacgcauuuccacaacaggccuggugacuuaaguucuauccuagacccacauaaagguagaaggaaagaacugacucugcaaaccauccucggcucucaacaggauguacacgccccaaucccaacacacacaccagccccccacaggauguacaugccccaucccaacacacacacacacaccagccccccacaggauguacaugccccaaucccaacacacacacacacaccagccccccacaggauguacaugccccaaucccaacacacacacacauacacacacacacacacacacacacacaccagccccccacaggauguacaugccccaaucccaacacacacacacaccagucccccacaggauguacacgccccaaucccaacacauacacacacacacacacacacacacaccagccccccacaggauguacaugccccaaucccaacacacacacacaccagccccccacacgauguacaugccccaucccaacacacacacacacacaccagccccccacaggauguacaugccccaucccaacacacacauaaaacaucucuuaaaaagcaaagccaggagccaggcgugguggcgcacgccuuuaaucccagcacuugagaggcagugucaggcggauuucugaguucgaggccagccuggucuacaaagugaguuccaggacagccagggcuaugcagagaaacccugucuugaaaaaacaaacaaacaaacgcaaagccaguuuucaagccuguguuauauccugcauaaaggagcaguuugcuagaaucaucuggagcccagacuguuuuguacaaaacuuagcucuggccauuuacuucuugauuaggcuuagucagccuacauaguucuguuuccacucaugagaugaggauaguaagauuccagcugggauaggaugugagugaugugcgaaaaugccaggagccacucagugcaagagcuuggcauguacuaauauaucuguauuauguucaaugaaaaaaugaaaauauugcuauaaugcuuuucaaauagauggugacagcucccauuagcagcucuugggacaugcaugugcuaguuaguaaaauaacaggacauugaccccuaauacugaggucauggggucucuuccuuuuuuccauuauccaguguuuuuuguucuuggugguuggcacaguaugaccucaucucuaucauauuugguggggcaguuggggggagggguggaccuuucugggcaaccuguacaguguccuucccagcucccuuucugaggguacugguuguguguugguguguaaguccuuacgugcugcccuguaccacaacugcugccuugucuuguuucuaacuaagucucgucuuuuugccagcaagucugcguggcuuugacgagcuucuggaugaacaauguucuguccaaacggaaauggccagguaaaggagcccuuggcuuggagggccagaucuaccagaucucauagagagcuaccagugaucgccggggccucacagagcagcaugguuuuggaacagaggcucugggugggaagagaaagcggaggaggagguggugcagguugguggguggugcuuguggaacaaaucucaggucaauucuuccuuauguaggaacagugccuagagaaugcagggugucuagcacagcuccacccacaccuauucagggccucaggcucccagccauuggacagucccauucccuuuucccccagcuucugcuacuucaggggguccagcugcccuccacccccagaauggcuaaguggauauagaacuuuuguuagaagcaucaaagcaguggcccaaguacucuagggaucccacugagauagcgauuccuugcccuuagaucagugggaagaaaaaggaccucacuuaagagagaguggagaagcagagagagcuucuaagggcggagcuuccaggauggaccucagguugucuagccagcugccuuccugccugacagcuagaugucuucgcaguaaccugugccuguuauccccagccccugggaauggaggaggucugcugaggguccagcgggaaaacauaggaaacaccuuaggcuugggguuggcaaguccucuggcauuguggauuggcaggacaggaugggaaggagccaguggcaguucugcaaaggucucaccggacgugccuugccuugagcacaauggcuggccguggacuggggaugagaacagauuugagaacagcuuaaccaucuccuccuuuuccagugauggcuggcugucucgggcuguaaccuuucuagaccggcuauugauguggcuugggguccgcagggccuagcccuccagcccucucgaggucccuucugacuacggacggugcugcucuccccacugcgauuccuuguccugugcaauguaagccugauuuuuuaggcuggugccucagccacccag

SEQ ID NO: 7099 - RNA, 9015 nt, Mus musculus
gccaccauccuacaaccccacccccaccgccgcguccccgccugccacgaaaagaauuucuaccagacuugagagaaaugcuccuaaggaacaauccauguauagguaaggcaggaagugcggcguuagaagccacgugcugaucuaaauucuauggacacccguccagccagacccuggagaggugacucuguccuccgcucugucuucuuccacuuacaucagcauuguuguggguuaaacagaaaccacggguuaugcaacucuccacccugcacauuuuaaucuacaacuuucauacaaaaggaaagguauggcugagguggaaauuccacagcaggccuuuuuuuuccuacgcuuuucuuacagaaccaaggcaccacgcuggcguggacccuccaaaguggaucagccucgccccaaggcuugcaccacaggacagguuacgacccggcggcgucacgcgcccggacucccgcaggcuccgccccgaggcaggcauagccaaugacggggcgggggcgggcccugucggggcuguagccugagaggcuuuaaagccugagcccggcgcuguuccuccagauucucggaccucggcgaccuccggggauccgaguuugcagacuucuugugcgcagcuagccgccucaggugagugacccccgcggguuuaaaggcuucccgagcaagggcagguaggggaaucuagaaugugggaaccauagcaucugcaacccggacuggagacccccggaugggccaggaucucgaggauguguccucggccuccccgaagugauaggcccuuguugucgagcggggucuucaucaggucaugugacuccgggcugccgggacccguagggacagcgggacccccucaagcuggucacgggacccagggcuccuugugccgccauaacauucgcgggcgguggccgcgagcgcggagcggacgcccaucccccucucccccggacgggcccagcuuggccccuaacccgaacugagaucgcauaaggaggcaucgccuugaggcuucaguucgccugaugugcagcugugcguuaaagugugugguggcaacccacccucuggguacuccuguaugcccacuuggggucacuaauacuugucaauaaaugaccuggacccaguuguccucuuaagauucugacgcauacaauaucggaagacuuaagacuaccguggcgcuauaauaagagaaaguggggggggggcugucgagaugguucagcggguaagagcacugaccgcucuuucaaagguccugagugcaaaucucagcaaccacaugguggcucacaaccacccauaaugagaucugacacccucuucugugcgucuaaagucagcuacaguguacuuauguauaauaauaaauccuuaaaaaaaaaaaagcaagagaaaaggguuuaccccuguuccaaugacuacuaggcuguuuuuguuucaguagcuagagucuaggaaccuccaaagauuaauuccugacuuguuuuucuccacucauaaucacauuuguuaacacgugcaaggaugcuucaacucagaacgguuuacugcugggcugguggcucauggaucccuaaacuugagagaugggucauugaaaaaguuuaaagccuaaacuacaugagaaacuguccuuaaaagagaaagcuuccgugggauucucauuuccucuuuuuccuucccuagguguuugaaccaugaaucuuuuacuccuuuuggcuguccucugcuugggaacagccuuagcuacuccaaaauuugaucaaaccuuuagugcagaguggcaccaguggaaguccacacacagaagacuguauggcacgguuuguaguguuuacauugucuagagagaauggucuuccuugcccuuggaaguguuuguuugguugguuggguuuuguuuuuguuuuuccaagucagugcuucucugugugucccuggcuguccuggaacuuguucuguggaccaggcugugaacucagugcuaggauuuaagucaugugccaccacugcccaccucuuucuccccccacaaccccccucucuaacccucagaaguuuauagccagagaguagucucuagaggccagcucuuagcaggaauagcccaaucauacauccauugugagcagaguagagcacauacaucccuuuguguguuuucgggaggaguggugccuuucagaguguguagcuguuccuguuccaguagauccauuuggucagauggauugguuuuuuuauuuaagauuuaguuagugagauauaugucacucgugauauauaccacacuuaugucuggguauuguguacauucuggaacuaguuagaaaguaccauauggccgggcagugguggcacacuugggaggcaggggcaggcagauuucugaguuugaggccagccugagcuauacagaaaagaaacccugucucaaaaaaaguaacauaugugagugcugagaauuaaaccugagucuuccacaaauggucuuaaacacagccaucucuccagcaccaucucugccucuggaauuaaaagccugugccaacaucuggcucccccugucuauuaacaaaaaaugaaaacugccaguucugugcuugcucuagaaugaggaagaguggaggagagcgauaugggagaagaacaugagaaugauccagcuacacaacggggaauacagcaacgggcagcacggcuuuuccauggagaugaacgccuucggugacauggugaguggggacaugaugcgaacucuugaacucuugagcccucuccuccauuuucuuucuacaaaguuaucucaccuuuucuacuuuuuuuuuucucccuucccggaagaccaaugaggaauucaggcagguggugaauggcuaccgccaccagaagcacaagaaggggaggcuuuuucaggaaccgcugaugcuuaagauccccaagucuguggacuggagagaaaaggguugugugacuccugugaagaaccagguaugagggcugggagaagucuugaguuugauccccaggguccacacuuggaagagacucgaggugggggaggggcgggagugcagcaucacuaaagauaaugauuugauuacccucccccagcagccaucaacugguaguaacuccugagaggagccaggccccaugagacucuguccucugugcuuuagccuugaccacaguguuuuguuuugucugcucuuuuggauccugaaugagacaggaucucacaauacuagcccagcccagcccagccuggccucaaacccaggauccucuugccuuaaucucucuaguggauugcaggcauacauugcccuacccagauuccugucuuacuguuuuuuuguuuuguuuuguuuuguuuuuuucgagacaggguuucucuguauagcccuggcuguccuggagcucacuuuguagaccaggcuagccucgaacucagaaauccgccugccucugccucccaaagugcugggauuaaaggugugcgccaccacgcccggcuuguuuuuuuuuuuuaaguaugaauauaucuggggguggggagagauguggcacacacuuuuaaucccaucacuugggaggcagaggcaggaggaucucugaguucaaggcuauacugucuacagggcgauuucuaggccauccagggcuacauagagaccuuguuucaaacaaacaaaaagugugcauguauaaaggcuguugugcuguuucucuuacaagccuuuuucucucuucagggccagugcgggucuuguugggcguuuagcgcaucggguugccuagaaggacagauguuccuuaagaccggcaaacugaucucacugagugaacagaaccuuguggacuguucucacgcucaaggcaaucagggcuguaacggaggccugauggauuuugcuuuccaguacauuaaggaaaauggaggucuggacucggaggagucuuaccccuaugaagcgaagguaauugguuuguuuuauccuggcuuuguuuucagaaaaggaagcauuaccagaugugguuuucagaguucauacuuuaguggguaacucacagcauucuaguucaagggaugguuucugaguauuggccucacacggcgugagcugcaagucacuguuuuguuucuagagcucauguucuaagagguaaacaguugugaucaagucucccccuuaacuuucaaaggacggaucuuguaaauacagagccgaguucgcuguggcuaaugacacaggguucguggauaucccucagcaagagaaagcccucaugaaggcuguggcgacuguggggccuauuucuguugcuauggacgcaagccauccgucucuccaguucuauaguucagguaauggucagaauuagcaccucccugacuuuggcgauuuauguugggggaggggugcgugcagaugcccuugggaguccugaagcaucagacccccuggugcuggacugagguaguuguaugccaucugucuaauauggguucuggaaccaaacucagguucccuguaagagcagggaaugcacuuaacugcugagaccgcucucuccagcacccucugcuuuucaguguuuuaaugcauuggggguggggggagaugauuagaggacaacuugcaggagucauuucuucccgguguguguggcuuccagaaucagacccugagccuuguuaacaaguuccuuucccuguugagccaucucaccaucugaaauauuucuuuuacuauugugacuuacucuauagauagaacauaguuuacauaaaucuucuccaacauauggauuuuuuuccaagagauuuuuuuuuuauugcuauaauuagggccuuaaagaaccugugguucagcuguaaggcugaagggggagggagggaaagagggagagagcuuuucugucuauaaacuuuuucuuuagauuuaagaguagcaaggauuaugguuauuaaucuggcuagaaaauggauccuaccauuauaggcuuuaaaacaauagaauauuuuuuuaauugaggggaguggggauguagcucagguaguuuuuccccagcauucuuuaaacccugguucagucuuggcacuacauaaaccaggcaugguauucauuccuguaaucccaacacuuaggaggcagagacaggagggucaggaguuuaccccauccuuggcuacauagcagguugggagaggagcuuggacuacagaaaacuccaucuuaaauauugugauaggauuucacugucaccuugccuagccuggaacucuguguauggcaggcuggccuugaacucaaagagagcugucuccuccugaguucugagaaugagucauguaccaccacacccagcauagucacuacugguuuuugacuauuaucuucacagcuugggaucugugaagcuacagaauuuugagauacaguccuguugugggggauagaaugggcuucuguccuguggugacagcaaccucuuauuuaguguucauuuuucucugccaggcaucuacuaugaacccaacuguagcagcaagaaccucgaccaugggguucuguuggugggcuauggcuaugaaggaacagauucaaauaagaauaaauauuggcuugucaagaacagguaagagacucuaaauguuauacuuuaauugaaaagaguauucauuggggggaaucaauauguagaugcaaguccacagauguuuaaguuuuaaaauccuggaagcuguucucagucagcgugaaagcccugcauuuaagauucuaaaguaagcuuguuggggagaccuacauguauauguaauggugaauuuccaaacuuggcuccaaaauuucaguaaggcuguaugauuucagcaugcucuuuuuuuuucucuaguuuucaacaaggaauaaccagcagaaaguacagcuugugugccucccugcauuaucugcauuuuguugucauaucucagaaccuuuuaaagccugucaggauuaauuuucacaacuaucuuucauugagauguaaugggaaguggaaacauacucuucuauuaagcucccuaguuugccucauuuuccucuuaaaagagggagcuaagucuauagcauaguuggcaaagugcuugccuacaaugcacaaaacucuggguucaauucccagcacggcauacaaccuggcaugguuaucccaacacuggccuuagugucaugcuuuuagaaaauugguggcauuaaccuugguuacacacaacccugucucaaaauaagugaggggcuugggcaaugacucgguggauaagguacuugccacucagucaugaggaccuauauaugcuuggauuccuaccacucacauaugggcugcauaacacaacuguaaccccaguucugggcacuagggggcugugagcuccagguucagugagccaccccuauaucaaaaaaaguaagagcgugauagaggaggguagcagugucugccuccugcuuccaugcaguugaaugaguugaagacccacaggaaugagugccucuauauauucuauguuuagaucuuagaacccucagagguaagugcacuccuauuuuuuaaguauaaacuauuaauucucucauaucuccuuggaucucuuucagcuggggaagugaaugggguauggaaggcuacaucaaaauagccaaagaccgggacaaccacuguggacuugccaccgcggccagcuauccugucgugaauugauggguagcgguaaugaggacuuauggacacuauguccaaaggaauucagcuuaaaacugaccaaacccuuauugagucaaaccaugguacuugaaucauugaggauccaagucaugauuugaauucuguugccauuuuuacauggguuaaauguuaccacuacuuaaaacuccuguuauaaacagcuuuauaauauugaaaacuuagugcuuaauucugagucuggaauauuuguuuuauauaaagguuguauaaaacuuucuuuaccucuuaaaaauaaauuuuagcucaguguguguguaugugggacuucaguguguaauguguugacaaauguucgggacuaaauacugauucagggugacaugguacagcaagaaaaagguggcaggugcucuggagccuucggauuucaccucagugucccaucagauuagguauguguuagugaaucuagcuugggauaauuguuuucuuuuuguguguguacaugguaaauguguggaguucagagaacaacucaguuccacaguguugguccuaucagguccuagccaucaaaauaagguugucaggcugggccacaggugccuuuuacuacugagcuaucuugccagccccacuaguuuuuaagugacauaauuacguauguuuauacuauaauguguuuuugauaugauguguauacuacaaaaugaucugauagggcuaauaagcuuaccucaaauauuuaauuacuuuguugaacuuuucuagcuguuuuuaaaauacacaguauauuauuguuggaaacuguccuguuauguagaccaggcuggccuuaagcccaugaucucccuuccucagccuucuaagggcuaagauaaacauguaauguuauacccagucucaagucucauaucuggcaaaacuugacaguccagaagaacaugaguaaaucgcucagcacaggagucucaacuuuucuaauucugugaccuuucaauauaguuccuccugugugacucaaaccauaaaauuauuuuuguuacuacuuuauaacuaauauugcuacaguuauaaaucauaauguagauuuuuuuuuuuuuuuuuuuggaaauagagguuugucaaaggagucacagcgcugagaaccacuguucuagaaacuugcagguuuuacauauuaggcugacuggaagaagguugaagugcuaguuucaguagugccuguccacauugccagugaagaccacaauccugcuauguaguucuagaaagggccauacacaggugggcuguaggcugacauuauucccaauuggccugagaaaccccaugcuacccaggaaugacaaaaaaauaaaugaauaaauacauuaagcaguugugauuaacuucccaggugaugacaauacuggagaugggcaugccccugagguagaaugauccaggcaugggcguagccagccuugaaaaugucaaugacuuagcaggguucuuuucaaaacugaauuuuuacaagggaguucauagauggaccuugauggaaacugacuaccagaaaagacucgaucucucugccauguuggggucagcaaacaaauaccacaagauaaaugcacuucagcauuucaauuauaccguuuguaugcccucugccuugcuacuuucacaccagauugucuaaaaugccugacggacgccgcuucaggaaggaaggaaggauucguguuaggucauaguggucagagggguacaggucaugauggugauggggcacgggaggaccagaacaguuuguuucacuggucaggaaggaaggucaggaagcaaggugaaggcugaugcucagcuggcuuuuuuguuuccaaauccuuuuauuaucugagcccugaguauaugcuauggugccauccacaaucaggguagaucuuaccuuagucuucucugaaaaugucccacugaacacacagcaucucuuagauuauuuuuauuuuggguguuggggauggaguauggguauguguuugcauagcacgugugcguguacuuaaaaggucaaaguucgggcuggcgagguggcucaguggguaagagcacccgacugcucuuccaaagguccagaguucaaaucccagcaaccacaugguggcucacaaccaucuguaacaagaacugacucccucuucuggugugucugaagacagcuacaguguacuuacauauaauaaauaaaucuua

SEQ ID NO: 7100 - RNA, 848 nt, Mus musculus
guucuuuuuuuuucuuauuuaguuuuuauucauaaucauaaacuuaacuuugcaauccagcuagacuugaaggggaaugaggaaaauauggaacccaaagaacuucagugagagcagagauuacaggacauugcgagcagaugggguggggugcucuccugagcuacagaaggaaugguuugauggguaaaacguccgcaagucaaaagaaauuagaguuguccacaguuggaaauaguggucuucuugcuggucuugccauuccuggacccaaaacgcuccauggcuuccacaauguucaugccuucuuucuccuucccaaagaccacaugcuugccauccagccauucagucuuggcagugcagauaaaaaacugggaaccguuuguguuugguccagcauuugccauggacaagaugccaggaccuguaugcuucaggaugaaguucucauucucaaauuuuucuccauagauggaccugccgccagugccauuauggcauguaaagucaccacccugacacaugaauccuggaauaauucugugaaaggaggaagccuuauagccaaauccuuucucuccagugcucagggcuugaaaguuuuucugcugucuuuggaacuuugucugcaaacagcucgaaggagacgcggcccaagagcuugucaucagccgugaugucaaagaacacggugggguugaccauggcugcagcaagcgacgaaaagcaacaguggugucugcaaagccaugguuggcaguucuaaggcugccaugugcuuggucugugauguacuugaaauaucguguguucccuucgugcagcauugcuugacuagcuucaug

SEQ ID NO: 7101 - RNA, 1270 nt, Mus musculus
auuagugucugcuuuuaaaagcuuuuagcaacaagucugcugcucauccuggggagagggcuccacugaggaccucucucuccaucaggggaaucuguucucggaugcugggaugggucuugaaguguucuaagacguuuuccugaaugagauuccacauccagacuuugugcugugucuaucucuuggcagccagcuccccacugaccagcauuugaugugucccacgucucagugaugcccucuccacuucuggcagaaaugcgaaucaccuuugaccucuagacuuccaagcgccuacagagcaacuugagugcgcucacauacucugcuuggauccugcgggcuggcacaaccaagucuccaucaaauuuaauuauaacaaccaaaucugccauuucaauuauaccccuuuugauacccugcaguucauccccuccugcuggcggcagcaauaaaagaaacauaucgaccaugucagccacagcaaacuccgacugcccaaacaccgacgguuucaauaagaaugaugucauagcccccuccuucacacaacacaauggcaucauuugugguccuugucacuccuccuagagucccacugguaggagaggagaaugucagcauucauaucucuugacagcucagucauccggguuuuaucacccaccacuggugcaagaagauggauucacaacuagcacagauaaccugugcccuugcucagucagcauuuucccaaaacauccugcuccaggggcccagacaguccuacuugaaaugugacaggguuuccuugguuccgcagcuccugcucccgcuggcgggcuaagacucucugcaggagcaccugagccaagcuccuucuuccuggugugaguugauuccacaagaguuauggccuccgcuaggcaugcucucuguccuugaacuaaacccguguaaagucuauccacaaaucuuuguucuuuaucagaaaguccuucugugugguccuucaagguugccuggacacauaauguucuccugaagccgucagacaguagcacccucuuaguacaaugguguccaaaacaguuuggcagagcaccugggggucccggugcagggggacuugagugaaggagccguggggaaggcacucuugagaggcagguuaguaaauaccaauuaggagaaaguagcagcguggaaauagucauuuugucuguaacccgauacuuucugacuuagugugaguuaugaauggcccuugcgaggccaugcagcc

SEQ ID NO: 7102 - RNA, 552 nt, Mus musculus
aaugcuuuucgccaagauggcgcugaaagcgaagaaggaagcuccugccccucccaaagccgaagccaaagcgaaggccuugaaaguuaagaaggcggugcugaaaggcguccacagccacaaaaagaggaagauccgaacggaacgucacccaccuuccgguggcccaagacccugcggcuccggaggcagccaaaauauccucagaagagugcucccaggagaaacaagcuugaccacuaugcuaucaucaaauucccacugaccacugagucagccaugacgaaaauagaggacaacaacacucuuguguucauuguggauguuaaggucaacaagcaucagaucaagcaggcugucaaggaacucuaugacauugauguggccaaagucaauacccugauaaggcccgacggagagaagaagaaggcauaaguucgcuuggcuccugauuaugaugcccuggauguugccaaaaagauugggaucaucuaaacugaguccagauggcuaauucuaaauauacacuuuuuuuuucaccauaaaaaaaag

SEQ ID NO: 7103 - RNA, 798 nt, Mus musculus
ugcaggccggaaucguacuguauguccgcuauccagaaccuccacucuuucgaccucuuugcagaugcaaguaagggugaugacccguuuccugcuggcacugaggauuauauccauauaagaacucaacagagaaacggcaggaagacccuuaccacuguccaagggaucacugaugauuacgauaaaaagaaaccagugaaggcguuuaagaagaaauuugccugcaaugguacuguaauugagcauccagaauauggagaaguaauucagcuacagggugaccagcacaagaacauaugccaguuccugauagagauugggcuggcuaaggacgaucagcugaaggcucauggguuuuaagugcuuguggcucucugaagcguaagcaagaauuuccuugcacugaguagaauuucccuucugucccuugucacaaguuuaaaaaccucgcagcuuguaugauguaaucauuugggguccacuuuuaacuuggacuaguguaacuccuucaugcaauaaacugaaaagagucaugcuguguagucuugaagucccucauuuaaacagguugagcaguaagcccuggcaguguccacccugguacaaagcaauaacaagguuucagccaagccaagaaccccaagaucacaggaggcucugucugaccaaagguuccuuggggcucccuggacagaggccccugcccuaggagagugucaccacuugaacagcucaauugacugacagaauggguaacacugccccagcuaugucacuagagggagucucugaccc

SEQ ID NO: 7104 - RNA, 1370 nt, Mus musculus
ccaaaaaaaccacauuuuuuuuucauuuaaaaaaguuuuaggucacauaaaacaaggcaacauuuacuccuucucgucuucuggcacugggucugugggcggcuccuccacuguggcgcuguugcucuaugagcccguguuacugucacuggucccuuccaccuccaugcugucaacccccuccugcccacucuccuuguccucaggaguagacgugccuucuucaccauucugcuggcucucugccgugucuucaaggugugucuccucugucuccauugggaugcucuccucauccuucuucuccucggcuuuguucgccacuugcucuuccucgggggcgaugcugcucugagugcgcucagccugcucugcugccuccuucccccucuccuccugccucuugcgggccuguuccuccgccugugcgaucucagccgcaaucuucuccaugucuacuuccaccuucagaccacauaaccuuuuaaguucauuguuaaaggagucugugcuuuccaggaauuuccucuucuuuuccuggugucguuccucuaucugaaggagcucggcuucuaguuuccgcugaugaaccauuaaagacuggaccugucgcuugaggaccugcauucuagcugucgugacaaccgaccgcacaucaggugccacacucucacugaggaucucacugaugagacggugguuucucuggaaacgggcaguggcugugugcuucauugaaaagccaucauuaucaucaucuggauccucagcaggcugaaugcucaaguaagggucuccuuucuccaugcgagacugucucugucgacuuucuuccucuaaugcagcuuccacacgacuuuuugcauuaauauaggcaagguacgcaggggaauuaugguaggccuucauagacucauuguacucuuuucugcuucauauucguuuaaauauucuugcuucucuucaucagugagaucucgccacaugccaccaauaaucuugccaaucucccacaacuuuaggucaggguuggaagccuuuacuuggucccagaccuuucugcuguaacucauguagggcaucagcggcuuaucugguggcuuuggaggcuuuggaaucguaaugccagaggacgccgugacccagcuguuggugcccggauucccucccagccuguaguuguaagcgagaugacuguauggauuguaucccacaaacccuggugugcugggcauuuguguugcaggagcuggggugggagguggggcauaagauggucuuuuugacauuuuggaagauuaaguucucaguuccuuaagaaugaaucugagacaccgcgggccgcagguccgguuucgcuucccuuuucc

SEQ ID NO: 7105 - RNA, 479 nt, Mus musculus
ccggcccggcugucugagcaccauguuagguucuucuagagucgccaccaugaagcaggugguccagcagcucuggcuggaggccaagcucaaccgcgugaagguuucccaggcagcugcagacuugaaacaguucugucugcagaacgcucaacaugacccucugcugacuggagugucuucaaguacaaaucccuucagacaccagaaagucugcuccuuuuuguagucaucuaucuugagguuucucaaaccacuuuucaugaaccagugaauauucaagagagcuaaguuugaagucuguacaaaagcuucucuuuaacacgugccacaauacacuauccucuacuugucaguccuuaacaucuaccucucugaacuucauggauuucugucucacaagguuuaacuauuuuauauacacuggcuguagcauacaauaaagcagcauacaaaccuuaaauaaaaaaaaaaaagag

SEQ ID NO: 7106 - RNA, 1290 nt, Mus musculus
ugcugcaaacugcaagaggacuuuuauucaagagcgcucucgggcccacggucauacaccaugcagggguagaggaccauggcgccccaaguagcuggguaaggggguauuuaaaggaagaaaccacaacucaaggagguggggagggcguuguuggaaaauaccagaauuaccaguuaagagucacaaggaagugcaaagucacaaggaauaccugguaauuguacagguuuauuucucaagacaguuucuaagagccccuaacaauagcacauuugcauaguggguuccagcaauggucagggugggucagggugacuuucuuugaaugaacacuccuugaacccagaaaagcggguggguggaggaauguugcuauugguuuuaugauuagcauaccuuggaacauugagucacagaggucacauucucaaggcugggccuaaaggccuagaauuuugcuuuuauguuauauuuuuucaucuccuggaagaacagcgguggaucugaacuauggagcccucuccccagcccccuuuguccaugaggaccuacucucacuccuggccaucucccugccucauacacucuuggucaucccccugccaaagauucagagaagcugccuucucauccagggaagaggaaggcuguaggggguggguugagggcugagguagaggggaugucauuccugaggaguggacagagggguucagagcgugcagauugcagugacauggucugcgaguccagugcuuggcacccgaccuucccaggucacgcagacucuggguagucgccuccucuugcgaggccucaggccgcucaagccacuuggugucacacccgcggcggcagcggacacagguccgugagagccacacuaggccuguggagccuucgggaguuggggcaucagcucguuggaguuccagcauggcagugggcuugcuagagacgcccgggugggguccgcgggccucagggcacugccuuguccugccaugugccacucggaggacguggggcgcagaggcgagggguggauagggaccccauggggugugcgcacgucugcagggaggaggugcggggacccucugcacacagagagauaugggaccaucaguggggagagaaggccgagggggaaggaagcguggggcugcacagggcuucacucacaguuauccugcugccucaagucagcggggagaaggagaggggaccuucuacgcacacagauaugcaggaccuccaggcggagagaaggccgacagggaagga

SEQ ID NO: 7107 - RNA, 626 nt, Mus musculus
caugggcaaaggagauccuaagaagccgagaggcaaaauggccuccuaugcauucuuugugcaaaccugcagggaggagcacaacaagaagcacccggaugcuucugucaacuucucagaauucuccaagaagugcucagagagguggaagaccauuucugcuuaagaaaagaggaaauuugaagauauggcaaaggcugacaagucuuguuaugaaagaaaaugaaaaccuacauuccccccaaauggggagaccaaaaagaaguucaaggaccccaaugcacccaaaaggccuccuucuucuuguucuguucugaguagcgccccaaaaucaaaggugagcauccuggcuuauccauuggugauguugcaaagaaacuaggagagauguggaacaacacugcgguggaugacaagcagcccuaugggaagaaggcugccaagcugaaggugaaguacaagaaggauauugcugccuacagagcuaaaggaaaaaucugaugcagcgaauaaggggguggucaaggcugaaaagagcaagaaaaagaaggaagaagaagaugagaaggaggaugagggagacgaggaagaagaggaagucaaaguugaagaagaugaugaauaag

SEQ ID NO: 7108 - RNA, 1940 nt, Mus musculus
cagaacggugagggcggcgacccugagcgcucagcaggaucccagcaaaaggcauggccauuuggagagcauaggggucaugcggggucacacccaugucucuguuuucccucaggucuguccugccagugccagggcucuccccucaacacccucccaccucucucuucccccugggucuugggucacacagcugucuugggggcggggcgagggggcagggcuggaggguggccagaguucacccaaggucucguggauggcauggugaucccagucccuggcagcagugaccaauagccaccuaugugaucccuuaccuauacuuggaccccaacuuuagaccugacccugacaucauauguaaaccccaaccuuugaccacaucaugaccucuauauugcccugugaccaggaugacacuguccuauaacccugacaagaccccgacacuguccaccacacuccaaaccagccucugcccugcccacuaugcacuccagguucugaccccuagcccccaccacaugcaucagugauucccuggugacguuggaauuccgcacuucugccccccccccaugucacauggcuaggcccagucuucccggggaaggaggggugucacucaccacucugugucccaucaucaucccaaggccuugcuaagguugggcgcugccuggggcgcagaggagcagcgcaggguuggggugucuuugggucaggagucacacgguggggugucacuguggcacgugguagucaugggugacgggaucagggcaugggggcuauuggugaagguucagccucaguuuuaauugacagcucaagaauggagaggucaugaaaaagaguugaggcuuggcgugaugagagccuaugagaggcuauugguggggccuauuagaagcagaagaccccacuuguuagagaugccaguaccacgguaugaucuccaagaauagcagcaucagugaaguggauccaccugagccuagagugcugcaaagggcagagcuggaaaccugaaaccagccccuuggaggaggccagaagguacugccuuugaacaaccaccacuccaaaauuuuaaagcucauuguaucagagucaaggcuuguaguaaaacuccuucagagggaucaacugauaaaguauccauauaaugaacaauagacacugaaagauucaauguccugacuucuuguaucgaaccagcaacaaaauuuuuuacauaauggaaagcuauuagccauuccuuggggcgaaaguuuccaaugaaguugcuucauggguaccuaaaaggaagugaggaaggggacauaaugaaauggaagguaggaucagguaugggaagagacaagagagaaguacagaggaucaggaaauauaaauacguagcucuagaggauggggaacuggggguagccucucgaaagucccagacaccagggaagugagagguucccaggacccaaggggaaugacauuagccaaaauauucaacagaggggacauagaacguguagaggccacauccaguagauaggcacgggcaccaguugagggauugggccaccauccuucucaaaacuuuuaacccaaaaucauuucugucuaaucacaggcaagaccccgucagaagaguuaggaaaggacucacagaaaugaaggggauugcaaccccauaggaagaacaaaucaacccacuggaccacaaagagcauccagggacuaaaccaccuaccaaagaguaugcauggagagaugcauggcuccagcucuauauguagcagaggauggcuucaucuggcaccagugggagaggaggcccuugguccuguggaggcuugaugccccaguguagggcgaugcuagagcagugugaaucuggaguggguggaggcaaagaggagagggggaugggaugguga

SEQ ID NO: 7109 - RNA, 661 nt, Mus musculus
gauuuuauauauauaaaugcaaacaauuauugugcuucaucuucgggacaagaaugccaagucagccgcuccuuguagaagucaaugacaaccugaggacgcuucauauucgccuccuuuggcagcaccaagccggccccguccgaguccuuccacuucaugagaaacacuaauucuccgcugcuguccguggcaccgaucauucguucagggucaagaccucuggcaaagccccuugguuugucagcagcaucucucuucuucuucgauuugcuaucaucagauucacggucagauaaagauuuccuuucuguaccaucuuuuucuuuaccagcuuuuugagaauuaagaaaugcuucaguuaauucugaacaaucuaaauuuucuucugguucccaaggauuaucagcgucugugaaccccuuccacuucaggaaacacuccaccuucccguucacuagacgguccaguacuuuuucuaccacaaauucuucaggcucugccucuucaacuuuuuuacucuuuccauuuuguuucuuucccauuuuuugcaauguaguuuuauuggaggccauuuuuuaaauuuaaucggagacuugaagaguucaccgcuccgaugcucagggccgcagauccugcagagucucccgccugccccaga

SEQ ID NO: 7110 - RNA, 10779 nt, Mus musculus
ugguucucuguguccugcucugacaucugcuguugggugcauugaggggaccucaggaagcucugagauuuagacauggugagcacaggaucacugcccacaauggguaggggcaggugguugagcagugagagcuggggugguggguccuuucuggggcugcaugaaagcaucacccagaugggaccaccugugaggucucaggcagugaccucugaauaacuuaauuaucauagcugauucugaaucuguccaaaacauuuggaccaguugcuuucuuguagaaacauggguggugucuuugacucugcagcacaaaacgguccaaacacuguugucuuuucuaguagacauugagaagacagauaugaagcuaauaggucugcuuccauacguuacuuguuuuuguuuuguuuagcuuuuaauuucuuucuguugcaguuuuucauauuucuuugcuuuauauguuuagaguuuugacaguuuguggcacaaggacuuuuuugguccaauauguuugcuauuuuggaugcuucuuguacuuuaauagguauuuucuucuucuucuuuuuuuuuuuuaaagauuuauuuauuuauuauauguaaguacacuuuagcuguccucagauacuccagaagagggcaucagauuuuguuacggaugguugggagccaccaugugguugcugggauuugaacucgggaccaucagaagagcagucggugcucuuaaccacugagccaucucaccagcccgguauuuucuucuuuaguuuagaaaauuuucauuuaugauuucacugaaaauauuuucuggaccuuugagcugauauucuucuucuauuucaauaauuucuacuuuucaccuucucauauguugcagaauuccugguuauuuaaugccaggaaacauuuggaauccauauuuuuugagcaauuuaucacuuuuuuguauucaucuuuaaugccugauagucucucuucccuuccuggcccaugggugaaccuugccucuguaguugucaauguacagcaaauucaauggccuucucuuagggacuuagcaaaugcuuaagucguuaccugucuccaucaccugcugcuguugucaggugugcuuuauauacaugaaccaccagcuacagcagcucugugcuuuguucccugucucuguucucugcacaugcuccccccccaacccccauucuauuucccuacccuuggggcugucucucucugcucucugucugugugccugucuaaagcucuuuugugcacagcuauaccuuccccuauguuuucacucuuuucccuucgcccaaacaaccauuuuuccacuguaucuauugcauguuuuaauuucucaggaccugcugugauaggauagcuuagauuucuuggugauauauuuuccuggcuauuauucauuuuauucauuugcuggugucuaggccucuauguuugaggugauuugguuucuggguuugugcuguuuggcuggguguuuuauacccggguuacugguugauauauggauuuauuuauuuauuuuugguuuucugagacaggguuucucuguguagcccuggcuguacuggaauucacucuguagaccaggccuugaacucagaauacugccugccuuugccucccaagugcugggauuaaaggcgugggccaccacgcccagcugauaccuggauuuucacuguguugacugaggguugccucuuugauggaccuguuuggaggguauguucaggagggaaugcucuauguuggaagcuggaaaaagaggcaggcagaaagagaugaucuuagcaacccacaaggagacauagucaggagagagauuaagcugccuuuguucuuugguaaagugcuagggacaacuguguaaauuacaucugggauagcacauagugugguagaucuauggaagcuuacuuuguguccuuucaggcauggcaugagguugagcaguaugugucugcccaagugggggcugagcagaaggaugaggcaggaaaggaaggguagguggggauuaucugugguagcuauaggaggcaugcacagggggagaggaaacuuguacugguauuuuguccagugguaagggcaacugauauuagggucuguaguaacauagugggguaggucuuuggacacauuaccuagucuacuggcaggcacuuauauuagggugugcaguacagauagugagguaggucuuuggucaaauuaccuagucuacuggcaggcacuuauauuagggucugcaguaacagauagugggguagggcuuuggacacauuaccuagucuacuggcaggcacugauauuagggucugcaguaacagauagugagguaggucuuuggucaaauuaccuagucuacuggcaggcauggcuugucgaugaacaggaguauuuuccaauaauaaugggcucaggcacagggugaguuguaaagcucaaccaauugcgguuuuugagagugcacaaagaacacuugagcaaacauccuaugagcagccagugaagguacagcaacagggucaagcuacauauagauaacuaauauccuuugaagggaaaaaauguuagcuuagccaucaugguugucagauaguuuuugccucauguuugguuccugcagauuaugccagauauacaguuuucaaaauauuagguugcugaccuguauggaaauuccccagccuugcuguaacuacaauauauauccagcaccucucucauuuuggacccgaugccagguugacuggugucagaccuuguuacugagcccauaauaaaaaaccuuguguguuugcauugcaauaagauccuugguugucauugagguuccugugacuuggguauaauaucuuggugcguugacugaaacuccaagaccuccaggacucagaacagagguguugaaaagccagcuguuagaaugugucauuguuguucuuuguaucaauggcuugucugucacauuuguguuggugugucuuguuuuuccuauuuuucuugauuauucauggagggagaugacuaaagugaacuuggaaccaugguacagugggugcccuggagaguuguagccacagggccuuggaagauguuccauagucugguauagagauggugcgcccuuggucuaaagugcuuggaggguuagagcagacuugaaacccugcuucaugacucacagcugccauccugucuucaucuucuccucuguacacauguaugaaucugcuggguagccuuuacugacaccuugugacuuucucucaugugugugguacuuuauuauucugugacugagagagaggaaauaagauuuuuuccauuccaauugauuuaguuacuuaaucaucaucugggguuaaauccuucuuccuaagaggaccuacacccacuagauugcccauuauagagagcucuuggagacccaauccagggcaaagucaggcucucccuauccuguuuuacagggugcaaaggacaaagaccucauuuuccuguccugaucaacccuguucccaguucauaugugacucuguuguuuuggacucagaacugucauuagagggaaaguuguucuucauccacugcaacaaaguuaacauaucucauuagaccagcaguauuaauuguaggcauguggugcaaugugcuucucuguucaccuuccagcugcuuuagcuaccucuuugguagcacuagccagggaaugagggguuaaagauaccucacaccagagcagcaaagccucugaacuccucauuccacuguauccugcccugcucuaagccaggugaccuccccauuuuuuccuggcucagccacaacuccaccucucucuuuugguggcaggggcuccuguaauugauaugguuagcacauugguuuugggcuuuuacaauuuccucauuuauuauugucuccaugucauaauugucuucaguucucaaaauuucagagcuacagacauauuaaggaaccucaauugaaggugugcccucaucagaauggcugguugcuaugucugugagagauaguguugaugguauuuugggaaggcuuuucuacugagggaggcaauauucuuaaggaagugggccugggcuggaugagagcuagcugagcauaggacagugaccaaguaagagaacaagccaagaaacaguguuuguucuucauuauuuuuccuucauauucuagcucaguuucuauucuaacuuuccagaaugguggaccgugaucugaccgaaccauguaccacaaccaucuacugccugagaugcuuuugcuugcaggagucuauucagcagcagaguagcaaguuagaacaacaacaacaaaaauugguauauaaaggugauuuugcugcuguacagaaucuauauucucuuuuggaggaauguggaaaauaucaaaaauugagaugucaaaagucauagaaagcuguagauggagcuuaacagugguagucauagaaccugaaagauucgaguguuggcauuaaugcagccagaggaaguagaggucacaguauguccgugggaaaucgacucugugaaaacuuuagcuagaggucauuuguguaacauuuuggccaaaaauauuucuuauucagguuuuucuaugagauauugaguagggaaaaguuuaaaaaauaauugccugauuuguauauuuuuauucuauuuauauguauuuguucacuuuucccauuuauauauguauucaauauacauuccaauugcaacccccuccccuuuccacauuacacagucccucauccuuaacuccuuuucaucuauccagggacauuggggaccaccugaguaucccccaaacaugacaagucaggucucugcuacugaggucagacaaggcagccaaguuagaggaacaggguggacagacagacaacuccuuaagggacauccccccacucuauuuguuccaggacccaugugaagacugaagcacauuuacuacauauacgguggggccuuggcccacccuguguuugcucuuuggcuggugagucacucucugagaaucuccuaguguacagguuaguugacucgcuggaucuucuaauagacuuccuguuccuucgcaggcccucaauccuuucccccaacucuuccaaaagacucccugagcccuguccaaugauaggcugugggucucugcaucuguuucaaucaggugcuggauggagacucucagaggacaguuaugcuaagcuauugucugcaaguauaacaaaggaccgucacuaaugucaggauuggugcuuucccaugggaugggucucaaguuggucagaguaucauuuguccauucccucagucucugcuccaucuuugugccugcauuucuuguagacaggaccaauuuugggagcaaauguauuugguucauucacugugcuuaauucuccacuagagguccuuccugguagcaagauguggccucuugaggguccauaacucuuugccaugcaucucaacuaagaucacccccauauuauccuuggugaccucucauuccuggucucuggcacacccuaaaaauuccccacccuuccauaccgcuccccguuaaggugcagaauucuauucauauuccugacccucugaccaucucuugucucucacaacaccuguuccuggccacucgcccuuccccuuacuuauccacucucccauccaguucucucucucucuuccaucugccuccucugacuguuuuauuccccuuuugaaugagauucaacaaugcucauuagggcuuuucuucuuguuuagcuucuuugauucuauggaauauaguguggauauccuguacuuuaugguuaauguucacuuguaagugaguacauauauucaugucauuuuguuucuggguuaccucacucaggaugauaguuucuaccuguauccauuggucuggaaaauucaugauguccuuguuuuuaauagcuuauuaguauuccauuuuguaaauaaaccacauuuucuguauacguauuucgggugagggacaucuggauuguuugcaguuucuaguuguuacaaauaaaaugggauaugucucuauuugggcaaguuuucauggccauucccucagucucugauccagcuuugccucugcauuucucuuugacaggacaaauauguucuuugugucuacagcguugugguuuaaacugauucauaauuuucauaauucaaauuuuuagcaaaauuuuauuaauguuaugguuuaaacugguguaccucauguuucugcaauugaauacagaacugcaguuaauguauaauucuuuguaggaacuucagugcagaacuauggguucuuucuaucauuuuuguuuccuugggugacauuugaaggggagugagggucuuucuucucaugcacccauacauucaccauuuggucucugucccuaaaucacauaagauacaguagacacauuugcuauucaaugcuaagcuauuuugcaagccuggugguuuuauguuuuuaauuuuauuauuuuggauuuuguuguuugagauaaaauuucucugugaaacccuuucuguccuguuaguagguauagacaccacaucagccaccuaucauguuuuuguacaauaagcauaugcuucugugcaauucuuuauucacaucuucaauuuugaaauuugacaaaaucuauagguuauauucuguuuuccaggaugacauaugcucaugacaccaauacuaccugaggcuucagagucauugaauucuggguauaugaugaucugccuaacucuuuuguuuguucuuugauuuuugaguaaauguaauuauuuuuuugugugcaugaauaugaauaucaugugugcaucauuucuacuguugucaguaggugguaucagaacaccugaucuugaaguaauggguagguaguugcugguccccauguaaaugcuaaauauugaccacaauuauguggaagacaagcaagagcuuucuacagcugagcuaucucuccugcccuauguugcauauuugugaucaacauuuauacuacuaguauuuuaauugguccauuuguaacucuuuaaaaauucauucucuuuuagcaaaauuuuauuaauguuacaauuuaaacugguguacuucauguuuguacaagaugaauacagaacugcaguuaauguauaauucuuuguaggaacuucagugcagaacuauggguucuuucuaucauuucugcuuccuugggugauauuugcagggggagugagagucuuaauauguaacuuuugcuguccuggaaucgguuucauagaugaugcaggccuccagcuugaggaaauacaccuuccugugccucuggauuaaaguccugagcaaauaccuccaucuuguccaauauuuuuguaguuaguaauuguucguacagcuucucagaugugggcuugguacuguugaucuguauccccuugcaaucucccucucaauuggcauuucccuugcaaggcuaucuccuaggcaaaagguucaacagcaacauaggugaacauuauaauucaauuuccuucuaaaaagacauggugauuagaauacaauaucugugucaggaaauaaguagugauguuaguaucaugcuuuguaucauacacauuucugggauauuuuaggaugcagugacuuuugacgaugugcaugugaauuucacuaaagaagaauggaauuugauggauccuucccagaugaaucucuacaaagauguuauguuggagaccuacuggaaccuuacuucuauagguaaggcugugaauuuucuuuugcuuuucaaauuaagggaacaaauguguuuugguuauugaugaucuucuguuauuuaaauugagcacaaguaagauugaggugaauaaaucagguccacagcugugaauauuuacaguaaccucaauuauuccuaauuucuaauaacauaucauucauuuucuguugcuguauuuuaggcuacaaaugggaagaccaucauauugaagaaccaugccaaaguucucgaagacauacaagguaauuuucauguucaagcugauacaaauaugucuguaaggaaauuguaauaaguucuggaaguucuaaagaaaagcaagagugucaaauaucaguccauuaccuguagcuaugauuaugauauucucgcuaguccguguaccuuagagucuauuaucugauuugugguuccaaggcauuccucuaagaauggaaagaaggaaacaaggccuuaagagaucccuuuauuugauuuguagcuccauuaaaccuaugcuauggaacuaucacucuguauagucucauaauauuuaaauguugcacauugaauagugauguuuguguauauauauauauauuaccuucuagaaagcaaauauuccaagguaaaguuggugauacuuauauucuugcagucucauuccuaacuuuauugagaggucaguuuaugagagucaagaauguugaguggagaaaccuuaauccauauauagcaugucuacaaggaacaauaugucaacuguugugaaugcaauguggaaaacuuucauuuguucuucuuuuaauggguauaucaagugacaaauggacaaaaccaugagagucuaugaacauugaaaauagcaacacaccucuuuccaaaacaaugagaagauauguaguuuucugacuuuguuacacuuucugaacaugauaggaguuuuugauuaauugguuuucuuacuuuacugagaauaucuucaaagucacacugaggaaaaaauguggaaauucaucuguuuguccugcuucacagugcuaaugugcugugauucacacuacagggaaauuaugaaugcuaucaguuguaaaaagcucugcauuguuucauuguucuucagguacaggaaauaggucauauaggaaucugauauagaaaaagguuguuauauauauauauaugagccauguuauaacugcucuuaacaucacaucuguuuucaaagaggcaaaacaacccauagugagggagaacaccaugaacaugcaaagugauaaaagcuugagaucugauaauucuuuauuauuagaccaaccuguaaaaguaauuaauauggauaaaacgauugauaaagguaaugaguguguuaaagcuuucacaugugccaauuaucauucuaggcauggaagaauucauagguggaagaaacucuaugaauguaaucaaugugguaaagucuuugcaagaccugcucauauccaaugucauaaaagaacccauacuggagagaaaccuuauaaauguaaucaaugugguaaagccuuuuccucucacaguugucucagauaucacaaaagaaaccauacuggagagaaaccuuaugaauguaaucaaugugguaaagccuuuuccucucacaguaaucucagauaucauaaaagaagccauacuggagaaaaaccuuaugaauguaaucaaugugguaaagccuuugcaacacccagucaucuccaaugucauaaaagaacccauacuggagagaaaccuuaugaauguaaucaaugugguaaagccuuuuccucucacaguaaucucagauaucauaaaagaagccauacuggagaaaaaccuuaugaauguaaucaaugugguaaagccuuugcaacacccagucaucuccaaugucauaaaagaacccauacuggagagaaaccuuuugaauguaaucaaugugguaaagccuuugcaacacccagucaucuccaaugucauaaaagaacccauacuggagagaaaccuuuugaauguaaucaaugugguaaagccuuuuccucucacaguaaucucagauaucauaaaagaacccauacuggagaaaaaccuuaugaauguaaucaaugugguaaagccuuugcuacauccagucaucuccaaugucauaaaagaacccauacuggagagaaaccuuaugaauguaaucaaugugggaaagccuuugcaagacccgcugaucuccaauaucauaaaagaacccauacuggagagaaaccuuaugaauguaaucaaugugguaaagccuuuuccugucacaauagucucagauaucauaaaagaacccauacuggagagaaaccuuaugaauguaaucaaugugggaaagccuuugcaagacccgcugaucuccaauaucauaaaagaacccauacuggagagaaaccuuuugaauguaaucaaugugguaaagccuuuuccugucacaguggucucagaaaucauaaaagaacccauacuggagaaaaaccuuaugaauguaaucgaugugguaaagccuuugcuacauccagucaucuccaaugucauaaaagaacccauacuggagagaaaccuuaugaauguaaucaaugugggaaagccuuugcuacauccagucaucuccaaugucauaaaagaacccauacuggagagaaaccuuaugaauguaaucaaugugggaaagccuuugcuacauccagucaucuccauugucauaaaagaacccauacuggagagaaaccuuaugaauguaaucaaugugguaaagccuuugcaagaccugcucaucuccaaauucauaaaagaacucauacuggagagaaaccuuaugaauguaaucaaugugguaaagccuuuucuacauccacucaucuccaaugucauaaaagaacccauacuggaga

SEQ ID NO: 7111 - RNA, 659 nt, Mus musculus
uuauauauauauaaaugcaaacaauuauugugcuucaucuucgggacaagaaugccaagucagccgcuccuuguagaagucaaugacaaccugaggacgcuucauauucgccuccuuuggcagcaccaagccggccccguccgaguccuuccacuucaugagaaacacuaacucuccacugcuguccguggcaccgaucauucguucagggucaagaccucuggcaaagccccuugguuugucagcagcaucucucuucuucuucgauuugcuaucaucagauucacggucagauaaagauuuccuuucuguaccaucuuuuucuuuaccagcuuuuugagaauuaagaaaugcuucaguuaauucuggacaaucuaaauuuucuucugguucccaaggauuaucagcgucugugaaccccuuccacuucaggaaacacuccaccuucccguucacuagacgguccaguacuuuuucuaccacaaauucuucaggcucugccucuucaacuuuuuuacucuuuccauuuuguuucuuucccauuuuuugcaauguaguuuuauuggaggccauuuuuuaaauuuaaucggagacuugaagaguucaccgcuccgaugcucagggccgcagauccugcagagucucccgccugccccaga

SEQ ID NO: 7112 - RNA, 626 nt, Mus musculus
caugggcaaaggagauccuaagaagccgagaggcaaaauggccuccuaugcauucuuugugcaaaccugcagggaggagcacaagaagaagcacccggaugcuucugucaacuucucagaauucuccaagaagugcucagagagguggaagaccauuucugcuuaagaaaaggggaaauuugaagauauggcaaaggcugacaagucuuguuaugaaagaaaauaaaaaccuacauuccccccaaauggggagaccaaaaagaaguucaaggaccccaaugcacccaaaaggccuccuucuucuuguucuguucugaguagcgccccaaaaucaaaggugaacauccuggcuuauccauuggugauguugcaaagaaacuaggagagauguggaacaacacugugguggaugacaagcagcccuaugggaagaaggcugccaagcugaaggugaaguacaagaaguauauugcugccuacagagcuaaaggaaaaaucugaugcagcgaauaaggggguggucaaggcugaaaagagcaagaaaaagaaggaagaagaagaugagaaggaggaugagggagacgaggaagaagaggaagucaaaguugaagaagaugaugaauaag

SEQ ID NO: 7113 - RNA, 21339 nt, Mus musculus
gaucgcuguggcugugcaggcuugaaugguucucuguguccugcucugagaucugcuguugggugcauugaggggaccucaggaagcucugagauuuagacauggugagcacaggaucacugcccacaauggguaggggcagguuguugagccgugggagauggggugguggguccucucuggggcugcaugggaagcaucauccaaauaugaccaccugugaggucucaggcagugaccucugaauaacuucauuaucauagcugauucugaaucuguccaaaacauuuggaccaguugcuuucuuguagaaacaugggugguuucuuugacucugcagcacaaaacgguccaaacacuguugucuuuucuaguagacauugagaagacagauaugaagcuaauaggucugcuuccauacguuacuuguuuuuguuuuguuuagcuuuuaguuucuuucuguugcaguuuuucauauuucuuugcuuuauauguuuagaguuuugacaguuuguggcacaaagacuuuuuugguccaauauguuugcuauuuuggaugcuaauuuguacuuuaauagguauuuucuucuuuagaaaauuuuucauuuaugauuucacugaaaauauuuucuagaccuuugagcugauauucuucuucuauuccaauaauuucuacuuuucaccuucucauauguugcagaauuccugguuauuuagugccaggaaacaucuggaauccauauuuuuugaccaauuuaucauuguuuucuauucaucuuuaaugccugagagucucucuucccuuccuggcccaugggugaaccuugccucugugguugucaguguacagcaaauucaauggcuuucucuuagggaauuagcaaaugcuuaagucguuaccuuucuccaucaccugcugcuuuugucaggugugcuuuauauacaugaaccacagcuacagcagcucugugcuuuguucccugucucuguucucugcacaugcuugccccucccucuauuucccuacccuuguggcugucucucucugcucugucugugugccuuucuaaagcucuuuugugcacagcuauaccuucccccauguuuucacuccuuucccuucccccaaacaaccauuucuccacuguaucuauugcauguuuuaauuucuagggccugcuguguuaggauagcuuggauuucuuguugauauauuuuccuggcuauuauucauuauauucauuugcuggugucuaggccucuguauuugaggugauuugguuucuggguuugugcuguuugggugguaguuuuauaccuggguuacugguugauauauagauuuauuuauuuauuuauuuuugguuuucagaaacaggguuucucuguguagcccugccuguccuguaauucacucuguaggccagguuggccuugaacucagaauaccgccugccucugccuccuaagugcugggaauaaaugugugugccaccaugcccagcugauacccggauucucacaguguugacugaggguugcuucuuugauggaccuguuuggagguauguucaagggggaaugcuuacuaauguuggaagauggaaaaagaggcaggcagaaagagaugaucuuagcaacccacaaggagacauagucaggagagagauuaagcugccuuugcuguuugguaaagugcuagggacaacugugaaaauuacaucugggauagcacauagugugguagaucuauggaagcuuaccugguguccuuucagacauggcaugugguugaacaguaugugucugcccaagugggggcugagacagaaggaugaggcaggaaaggaaggguagguggggauuauuugugguagcuauaggaggcaugcacagggggagaggaaacuucuacugguauuuuguccagugguaagggcaacugauauuagggucuagaguaacagauagugggguaggucuuuggacaaauuaccuagucuacuggcaggcauggcuugcgguugaacaggaguauuuuccaauaauaaugggcucaggcacaagggugaguuguaaagcucaaccaaaugcguuuuugagagugcacauagaacaccugagcaaacauccuaugaacagccagugacgguagagcagcagggucaagcuacauauagauaacuaauacaacgugcaggggaaaaaaauguuagcuuagccaucaugguugucagauaguuuuugccucauguuugguuccugcagauuaugccagauauacaguuuucaaaauacuagguugcugaccuguauggaaauuccccagccuugcuguaacuacaauauauauccagcaccucuagacuuggucucuuauuuuggaccugauaccagguugacuggugucagacccuguuacugagcccauaauacaaaaccuuguguguuugcauugcaauaagauccuugguugucauugagguuccugugacuuggguauaauaucuuggugcguugacugaaacucaaagaccucuaggacucagaacagagguguugaaaggccagcuguuagaaugugucauuguuguucuuuguaucaauggcuugucugucacauuugcauccgugugucuuguuuuuccuauuuuucuugauuauucuuggagggagaugacuaaagugaacuuggaaccaugguacagugggugcacuggagaguuguagccacagggccuuggaagauguuccauagucugguauagaggauggugugcccuuggucuuaagugcuuggagaguuagagcagacuugaaacccugcuucaugacucacagcugccauccuuucuucaucuuuucuuauguacacauguaugaaucugcuggauagccuuuacugacaccuugugacuuucccucauaugugugguacuuuauuauucugugacugagagagaggaaauaagauuuuuuuccauccuauugauuuagugacuaaaucaucaucugggguuaaauccuucuuccuaagaggaccuacacccacuagauugcccauuauagagagcucuucgagacccaauccagggcaaaaucaggcucucccuauccuguuuuacaggguggaaaggacaaagaccucauuuucccccuccugaucaacccuguucccaguccauauuugacgguaguuuuggacucugaacuguuauuagagggaaaguuguucuucauccauugcaacaaaguuaacauaucucauuagacgagcaguguuauuucuaggcuugugcaaugugcuucucuguucaccuuccagcugcuuuagccaccucuuugguagcacuagccggggaacgcgggguuaaagauaccucacaccagagcagcaaagccucugaacuccucacuccaggguccuucccugcucuaauccauugaccuacccauuuuuccucgcucagccacaacuccaccucugucuuguagugacaggggcuccugaaauugauauggguagcacauuuguuuuggguuuuuacaauuuccucaguuauuauugucuccaugucauaauugucuucgguucucaacauuucagagcuacaaacauaguaaggaaccucaauugaaggugugcccucaucagaauggcugguugcuaugucugugagagauaguguugaugauauuuugggaaggcuuuucuacuuagggaggcaauauucuuaagcaagugggccugggcuggaugagagcuagcugagcaugggacagugaccaaguaagaggacaagccaagaaacaguguucuucauuauuuuccuucauauucuagcuccaguuucuauucuaacuuuccagaaugguggacagugaucugacugaaucacguacaacaaccaucuacugccugagaugcuuuugcuugcaggagucuauucagcagcagaguagcaaguuagaacgacaacaacaaaaauugguauaaaaaggugauuuugcugcuggacagcaucuauguucucuuuuggaggaauguggaaaauaucaaaaauugagaugucaaaagucauagaaagcuguagauggagcuuaacgguuguagucauagaaccugaacgauuccaguguuagcaguaaugcaaccagaggaaguggaggucacagcaugucaguggaaaaucgacucuguaaaaacuuuagcuagaggucauuuguguaacauuuuagccaaaaauauuucuuacuaaguuuuuucuaugagauauugaguagggaaaaguuuaaaaauaauugccugauuuguauauuuuuauucuauuuauauguauuuguucacuuuucccauuuauauauuuauucaaaauacauuccaauugcaacccccuccccuuuccacauuacacagucccucauccuuaacuccuuuucaucuacccagggagaguggggaccaccugaguauccccgcaacaugacaagucaggucucugcuacugaggucagacaaggcagccaaguuagacugaagagacuaacagguuggacagacagacaauaccauaagggacauccccccacucuauuuguuccaggacccaugugaacacugaagcacauuuacuacauauaugguggggccuuggcccacccuguguuugcucuuuggcuggugggucacucucugagaaucuccuaguguaccugauaguugacucgcuggaucuucuaauagacuuccuguuccuuugcaggcccucaauccuuucccccaacucuuccaaaugacucccuaagcccuguccaaugauaggcugugagucucugcaucucucagucaggugcuggauggagacucucagaggacaguuaugcuaagcuacugucugcaaguauaacaaaggaccaucacuaaugucaggauaugagcuugcccaugggaugggucucaaguuggucaggguuaucauuuguccauucccucagucucugcuccaucuuugugccugcauuucuuuagacaggaccaauuuugggagcaaauguauuugguucauauacugugcuuaauucuccacuagggguccuuccugguagcaagaggguccauaacucucugccaugcaucucaacuaagaucacccccauauuauccuugaugaccucucauuccuggucucuggcacaaccuaaagauuccccacccuuccauaccccuccccgucaaggugcagaauuccauucauauuccugacccccugaccaucucuugucucucacaacaccuguuccuggccacucgcccuuccccuuacuuauccacucucccauccaguucucucucuuucuaccaucugccuccuuccccuuuugaaugagauucaacaaugcucauuagggcuuuucuucuuguuuagcuucuuugguucuauggaauauaguguggauauccuguacuuuaugauuaauguucacuuguaagugaguacauauauucaugucauuuuguuucuggguugccucacucaggaugauaguuucuaccuguauccauuggccuggaaaauucaugauguccuuguuuuuaauagcuuauuaguauuccauuuuguaaauaaaccacauuuucuguauacguauuucgguugagggacaucuggauucuuugcaguuucuaguuguuacaaauaaaaugggauaugucucuauuugggcaaguuuucauuggccauucccucagucucugauccagcuuugccucugcauuucucuuugagaggaaaaaugcuguucuuugugucuacagcguugugguuuaaacugauccauaauuuucauaauucaaauuuuuagcaaaauuuuauuaauguuacaguuuaaaccgguguaccucauguuucugcaagaugaauacagaacugcaguuaauguauaauucuuuguaggaacuccagugcagaacuauggguucuuucuaucauuucuguuuccuugggugauauuugcagggggagugagagucuuacuauguaacuuuugcuguccuggaaucgguuucauagaugaugcaggccuccagcuugaggaaauacaccuuccugugccucuggauuaaagucacgagcaaauacccccaucuuguccaauauuuuuguaguuaguaauuguucauacagcuucucagaugugggcuugguacuguugaucuguauccccuugcaaucucccucucaauuggcauuucccuugcaaggcuaucuccuaggcaaaagguucaacagcaacauaugugaacauuauaauucaauuuccuucuaaaaaggcaugguuauuagaguacaacuucuaugucagguaauaacuagugauguuauuaucaugcuuuguguuguacacguuucugggauauuuuaggaugcagugacuuuugacgaugugcaugugaacuucacuaaagaagaauggaauuugcuggauccuucccagaugaaucucuacaaagauguuauguuggacaccuacuggaaccuuacuucuauagguaagacugugaauuuucuuuugcuuuucaaauuaagcgaacaaauguguuuugguuauugaugaucuucuguuauuuaaauugagaacaaguaagauugaauugaauaaaucagguucacagcugugaaaauuuacaguaacuuaaauuauuccuaauuucuaauaauauaucauucauuuucuguugcuguauuuuaggcuacaaaugugaagaccaucauauugaagaaccaugucaaaguucucgaggacauacaagguaauuuucaugugcaagcugauacaaauaugucugugaggaaauuguaguaaguuuuggaaguucuaaagaaaagcaagagugucaaauaucaauccauuaccuguagcuaugauuaugauauucucgaaaguguguguaccucagagucuauuaucugauuugugguuccaaggcauucgucuaagaauggaaacaaggaaacaaugccuucagagaucccuuuauuugauuuguagcuccauuaaaccuaugcuauggaacuacacucuguauagucucauaauauuuaaauguugcacauugaauagugauguguguguauauauauauauuaccuucuaggaagcgaguauuucaagguaaaguuggugauacuuauauucuugcagacucauuccuaacuuuauagaggucaguuuaugagagucaagaaucuugaguggagaaaccuuaauccauauauagcaugucuacaaagaacaaaaugucaacuguugugaauacaauguggaaaacuuucauuuguucuucuuuuaauggguauaucaagggacaaauggacaaaaccaugagagucuaugaacauugaaaauagcaacacaccucuuuccagaacaaugagaagauauguaguuuucugacuuuguuagacuuucugaacgugauaggaguuuuugauuaauugguuuucuuacuuuacugaaaacaucuucaaagucacaccgaggaaaaaauguggaaauucaucuguuuguccugcuucacagugcuaaugugcugugauucacacuacagggaaauuaugaaugcuaucgcuuguaaaaagcucugcauuguuucauuguucuuaagguaugggaaauacgucauauagaaaugucauauagaaaaagguuguuuuauauauauauauauauauauauauauauauauauauauauauauguauauaugagccauuuuauaaaugcucuuaccaucacagcuguuuucaaagaggcaaaacaaccuauagagagggagaacaccaugaacaugcaaagugauaaaaacuuaagaucugauaauucuuuauuauuagaccaaccuguaaaauuaaucaauauagaugaaaugaucgauaaagguaaugaguguguuaaagcuuucacauguaccgauuaucauuccaggcauguaagaagucauaguuggaagaaacucuaugaauguaaucaaugugguaaagccuuuuccucucacaguagucucagauaucauaaaagaacccauacuggagagaaaccucaugaauguaaucauugugguaaagccuuugcaagaccugcucaucuccaaagacauaaaagaacccauacuggagagaaaccuuaugaauguaaucaaugugggaaagccuuuuccucucacaguaaucucagauaucauaaaagaacccauacuggagagaaaccuuaugaauguaaucaaugugguaaagccuuugcaagacccgcugaucuccaaugucauaaaaggacccauacuggagagaaaccuuaugaauguaaucaaugugguaaagccuuuucuugucaggguggucucagaaaucauaaaagaacccauacuggagaaaaaccuuauaaauguaaucauuguaguaaagccuuugcaaggcucagucaucuccaaugucauaaaagaacccauacuggagagaaaccuuaugaauguaaucaauguaguaaagccuuugcaagacccgcucaucuccaacaucauaaaagaacccauacuggagagaaaccuuaugaauguaaucaaugugggaaaggcuuugcaaggcucagucaucuccaaugucauaaaagaacccauaccugagagaaaccuuaugaauguaaucauugugguaaagccuuugcaagaccugcucaucuccaacaucauaaaagaacccauacuagagagaaaccuuaugaauguaaucauuguggggaagccuuuuccugucacaauagucuuagauaucauaaaagaacccauacuggacagaaaccuuaugaauguaaucaaugugguaaagccuuuuccugucacaguggucucagauaucauaaaaguacccauacuggagaaaaaccuuaugaauguaaucagugugguaaagccuuugcuacauccacucaucuccaaugucauaaaagaacccauacuggagaguaaucuuaggauaauuaucaauguggaaagacuauucacaagggagaagucaacaaagacauaaaaaaacacauaguggagagaaaucuuaauguaaccaaugugguaaaagccuuuucacaaaguaauuaucucaaaaagacaaaagaaccaacccauuuuggagaguaaccuuaugaauguaagcaaugugauaaugaagucuuugcaguuuucacuagucuccaaaaaauaaaagauaccauacuggacaaaaaccucaugaauauaaucaaugugggacacacuucagaacuuuguaaucuccauuauuuuaaaaguacacauacaggagagaaaccuuaugaauguagucagcgguguaaagcauuucaagucacagucaucugcaaugacauaagagaucacaugcaagagagaaaccucaugaauguugucaaugcaguaaagccuuugcaugucuuaauucuucacauguauacaaagugaagcacacuggggagaacccucauuauuguaaucacugugguaaaaaccuuggcaauuuacugucaucugcaacuacauaaagaacacauuccaaaaaguaacucuuuccauuuuuucagaguacuaaucccuugugugacacagucaucaucccauacauaaaagaacacauauggcagaaaaccugcaugaauauaaugaauaagguaaacccuuuugaggccacagucaucuccaaacauacaaaaaacugugcaggagagaaaccuuaagaagguaauugaugugagaaaaccuuugcauaucacagucaucuccaaguacauuaaugagcacauaguugagagaagcccugugauuguaaugaauguguuaaagccuuugcaugucauuguacacuccaaacacuuaaaggaacacagguuuuacagacaccuuauaaaugcagugaaugugaaaaagacuaugaauaucacgauaguuuccaaagacguaaaagaacacauaauugauggaaaucuuguguguaggcucucccagccugaagcaggcugauccagacuuugaccuugcugccacugagaauuagaccaccugggguggacccuugcucccuagaucacuauauuguucagccacugccacuguucuucaagacuuugcaaccugcugaaaggccccugagauauuccaaagacuacacccagaccugcaagucaucaccugcagcugguuccaagcaccaagaaugguuugaugggaaugggccucuuccccuuuauaagcacauuugcuauuaaacauuugagcuuugaucagaaaccuugacuuagcuccauuauuucucuugacugucuaguucucucucuuucagcuccagucugccucccagguguaccccguuucuugugagccucaggucggcucccaacacuugugaauguagucaaguuggaaaauccuuuaaaugccacaguagucucugaauacauacaggaacacauacuagagagaaaccuuaucaauauaaccaauaugguaaagccuugcauguccuaaucauauuuaaauguaugaaaguauuuauagaaaauauaaacuguguuaauuugaauaugcuuggccauaagcaguggcacuauuaguaggugugucuugcaggaauagaucuuacuuuuuugaaggaagugaauuacugggguugugguguuuggagcuuugggcaguacaaaacagccccaccuacuguuuggcuggaagauagucucuuccugccugccuucucaugaagaugcagaauucucagcuccuucuuuagcaucauggcugccuucaugcugccaugcuuccugcuauaaugguaauaaauuaaauauuugaaacuguaagccaggcccaauuaaauauuuaccuuuaaacauuuccuuggucacaauuugucuucugagcaauggaaauucuuucuaagacugaaguuaguaccccagaauuaaguauuacuaugauaggccuggccauguuuuuguuuggagcaauguggaauuuuagacuuuggauuuguacauguauuaaguugaauuuaauuggacaugcaaggagaaauguggaacacauagguacuggagagugauuugaacucuguauauguuuuuauaauguuuugcuuaagaauauuuuugcuuuuugaccuugucuuaagagugauguauugacaaagaaguaaaaggaaagccaguauagccuuuguccuguguuuacucucaugaugacuguuuugaucaagcauaaucuuagaauggaaaaauguagaauauaagguucaauaagaaaaggcucgcugggugugguggugcacaccuuuacucccagcacucgggaggcacaggcaagcagauuucuuaguucaaggccagccuggucuacaaagugaguuccaggacagccagggcuauacagauaaacccugucucaaagaaaaaagaaggaaagaaagaaagaaagaaaggaaagaaagaaagaaggaaggaaggaaggaaggaaggaaagaaggaaagaaggaaagaaggaaagaaggaaagaaggaaagaaggaaagaaggaaagaaggaaaggaagaaagacucaccaggauguugaauguaccuaaaucuugugaugaaagauauuacauggcauuaagggaaaggugauguuaaggcaagauuccauccagcuaaacuuauggauuugcaguuuuaggaaggagaacuguaucacauuaggaaugauuguuaccugguuauucuuuucauguggacauaaggagauauaaauauuuuucaaauuaacaagggauggacugugauuccuguucugaguuuucaauuuaacaucuagauggaaauuccuagguucaggcauggugguacaugcuguuaaucccaggagauuagagucaaauagauaucugguucaaggcauccugcugcagaauuuuaggugaagaaaagcuuagguccaggcaugguuuuuccaugcuuuuuaucccagcauucaauaaacagggauacacagaucucugaauucaagguaaaucuacugagcaaguuccaggacagccaagcuuaggcagugugaaguuguugaaaauuugaaagcuggugaucauguaauagaaaggccccaagcagcuuuuuccccguggcucuggcuuuagaggcaaguguagaagggacuacugagacaauugauguugguuagcuguagauaaaaaauuagggguggugaagaagaaaccagcaucacugagguagaaccuucugguaaguguuuucaggaaggacaaagaugcuguguuccagagauacccaaaguuguaccuugugaugcuucuggacuuggucaugugugagaaauacccaggugguguuaguuucaaggcaugaaggggucauguagagcagcuaagacauggcguaaugaagagaguauuugagaggaaagcagugcaccccuguuacagcaggaaaacccagcauauugaaggugucagucccaugggaugagcagaaagaacagcaacagcaguagagugaagucaaccagaaccuagggugcuauagggaaaagagcuggagaagugacccacuuucuuuugaggagugcaaaagaucauguguagaucccagccaguggaacaugaagauguaauauuguaguuaccuuggagaccccaagauuuugagaugcuagagcuaugggauaccugcucaggaaaacugcuuuccugaaauaaguccagccaaagagaaagaauuuugcuggagugaaauaagcucaaagguguugaagaacugaacaucacuugaaaucagacacggauaugcagaauuuggagauuggccuucuuuugguccaguauuuccucacauugcuauuuaggaauaaaaaaguagucggggaguggugauacacaccuuuaaucccagcacuugggaggcaaagacaggcggauuugugaguucgaggccagcuugguuuacagaguuaguuccaugauagccaagguuacagagaaacccugucucgaaaacaaaacaaacaaaaacaaaacaaaacauaaagaauggcaaaguauaucuugugaauuuggagguauacaaugauauaaugugcuauuuguuuuugaaaauguaggggauuacaguuaggugauuggaugaaucucagaugaugaacuuuggacuuuauuagugagacugcuauagaugaugaguccuuuugaaguugaauaucauauauuuuguauuauacuauguuaaagugugguccccauauacccacguuuuugaacaaucaaaugcaggccagcaaguggaauguaguaucuugaauacgguugacccagggaguagcauugucagaagguguggccuuguuguaggaagugcaucacuguuagguuuggcuuugaaguuccauccagcgcugaagagacccuccugugugaucccuagaagacagucucuuccuugcugccuguggaucaaggugcagaacucucagcuccuucuucagcauuauguuuaccugcaugccuaccaugcuuccugcuaugaugaaaauggacuaaaccucuaaaaguguaagccagccccaauuaaguguuugcuuuuacaagaguugccuuggucaugaaauguauuccuagcaauggaaauucuaagacacaaacccugugaguguaguuaauauagugaagccauugcacauuucuguagucuucuucaucauauaagaauuuguacuggcaagaaacuguggaugcauuaguauggugaaacuuuugcacaccucuauaguuuucaucauuauggaacuauuaauacuggagagaaauucuaugaauaucagcaaugugauaaagccuuuaugguauggggugacugagguccaacacaacucaaacacaggacaaugcaaaugauaauaauuuauuauaaucaagucacuacucaucaaucagggccauaaauauacucagaagcuuagcugaaauaccccagcccaaccuugagucagaaaguuauauagcuuccaaaccuucagguuauauaaaacuauauaagcuucagguuugaaaccacaacauccugugccaaguuacaacuacaucccuccccccaccccaaucaugauuuuucucuguuguuacuuuaugucaaaugauacaagauguagauuuuauggucuaccguaucauagccauuuguucuuuugugguuaggaacgggcacuauguuuugaggaauaaaacacaaguaacagaaauuauacuuaggaacagucaucauuuaggugggaacaaaacaugaauagugaaaccuggccggauauuguuaaguacacaggucacuaggacuugggacuugaacuuaguuucaaccucagguuaaauggagagugauaagaaaaaggcaguccuuaggacuaguuucuuuugcucuuuccugacauuuagacaucauaguucucuucaaauacauaacagaauacauauuggagaaaaaucuuuuuuuuuuaaagauuuauuuauuuauuauguguaaguacacuguagcugucuucagaaacaccagaagagggcaucagaucucauuacgggugguugugagccaccaugugguugcugggauuugaacuuuggaccuucggaagagcagucgggugcucuuacccgcugagccaucucaccagccccgggaaaaaucuuaaauguaaucaaugugauuaaaaacuguucacaacacaguuaucuaugaacauaaaagaauacauaguggagagaaaaccuagggauaagcaauguguuaaagccuuuguacauagaaguaagcugagaaaccaugagaaaaagucauaaugcagagaaaacacauaaacgcagucaauauguuaagguuuugcauuuuuugguaucuuuaaacaagaguaaacucuuuaguauauaaucaguauauuaaagcuauuacauaucacaguagucuuagaugaccuuuaauaauaccaaaaguaaucugugacuacaaagaccuugguaagauuuuagccuacacacuuuuauugaguuccucaagauuauuauuugaagaaaauaugacaagcaucaacaaucaauucauacauuaugauaucucuuuauuuuguuugcacuuguaaacucauuugcacauucgaugucuacugcuuuuucuuuuucuuuuuuaguuaauccuguaccccacaaguuugcugaaaguguuugucagcucuaggaauugccugugggaaguuuugguucacuuaugcauacuaucacuucauuuguaaauaaagauaauuuuacuuccuccuuuauaauuuauauuaccuacaucuccuucaguuuuauuacucuagcuaaacuuuuagauaauauuuugaauagauauggagagaauggaccaccuuaacuuuuugggggauuaguggaauuaauuugaaugucucuccauuuaauuuaauguuuucucuaagcuugcuguaagguaacauuauuauguuuagguaugucccuuguauccuuaauaacuccaagaauuuuaucauaaagugauguuggagauugucagagaauuauuuaccaucuagugagauggucacuuuuuuuucacuuuaaguacauuauguugaaacauuccugcaucuauuuaaugaagcauaccucauugaucaugguggauguucuuuugauaauuuuucuauuuucuuucuuuuuuauuuguuuugcuuuauaaaguguuuuugugucagucacuuuaaggaaaguuggucugaaauucucuuuuguugcugagucuuuauugacuggauauuugaguuaacauggguucacaaaauaaaucagccaaaguuucuucucuuucaauauuguugaauacuuugaggaguauccuccuucuccuugaaagucugcuaggauucuaccccaaaacucauggcccugagguauuuuugguggcagauuuguaaugacuucucuuuuucuagguuuuuagguccguuuaaguuacuuaucuuaguuugauuuaauuugauaaguggaaccuauugaguaaauuauccaucucuuagaauuuccaaugcaguggaguacaugcuuuuuaaaacuaugucuuuguccuucucuggaauucuucauugucuuuuauuuuguccccauuuucauuuuagauuucguuaauuuggauauucucuauuuuuuaauguuuuugucuaucuugucuaauaaaaggcucaaaggccaucuccauguuucauuaauucuuuguagucuucucuuuuuauuuuauugauuucauccccaauuugauaauuuccugaugucuacucccuuuuuucauugcuccuucacuucuuucuguucuagacuuuaacgagugcuguuaaauugccaguaugagagcucuccauuuuuuuuucaugcaggcauuuuguucuaugaacguuuaucuuagcaccacuuucauuuucuuuguguuccauaagauugugcauguugcucaauugucguccuuuucauugaauucuacagagucucuaauuuuuccuuuauuucugucuuaacauuucuuucauucaguagugaggugugcagccucccugaguuuguaagcuuuguguucucuuugguuuuuugauaucuaguuguaauccaugguggccugauaagauacaguuguuauuucaguuuucuuguaugccuagagaauugcaaugugucugaauauguggucaguuuauaaauaaguuucaugaggugcugagcagaagguauauuuucuuauauuuuaguugaacauuuucuaaauaucagcugaauucauauucaugucuucagucagcuggaguauuucucuguuuaguuuuggucugaagaauuugucaauugguggaaguuggguauuaaaauuuccuaguauaaauguaugacaguccuuaugugauuuuaacuguuucuuuuacaaagguuggugaucauauguucaaggcauagauguuaaaaauuuaaaugucaucuauggugauuuuuucccauuugaggaauauauaguaucuuucuccaauucuuuugguuacuuuuugguuaaaaucuauuuugcuguauuuguaaauggcuguacgugcuugcuucuuugguccauuuucuuggaaugucuuuuuuccacccuuuaccuugaaguaaugccuauccuugauguugagcuauauuauuuguauacaauagaaggauagauuauguguuagcauccauucuguucgccuguguauuuuauuggugaacugaggucauuguuaucaauaccaaugaggagugauggcuaacuccuuguauguugucauuguucuugcugcugguggucauguugaggugugugugugugcuuucccuuuuuugcagcuaauacaacauuauuuacuauuuauuauuacuuauuuacuaucucuguuuucauguguaucauuaaccuccuugcguuggauucuuccuucuuuucuuuuuuucuuuuuuaaaaaauguuuuuuagauauuuucuuccuuuacauuucaaaugcuauccccuuuccaaguuuccucugagaaaguccccuauacccucccaagcccugcuccccaaaccacccacuccugcuuccuggccuugucauuccccuguacuggggcauauaaucuccgcaagacaaagggccucuccucccaaugauggcugacuaggccaucuucuacuacauaugcagcuagagacacgagcucugggguuacugguuaguggauauuguuguuccuccuauaggguugcagaccccuuuagcuccuuggguaguuucucuagcuucuucauugggggcauguguuccauucaauagaugacugugggcauucacuucuguacuugccaggcacuggcauagccucacaagagacagcuauagccagguucugucagcaaaaucuugcuggcauaugcaguagugucuggguuuggugguuguuuaugggauggaucccuugguggggcagucuuuguaugguccauccuucagucucagcuccaaauuuugucucuguaacuccuuccauuggguauuuucucucccccccccccccgcuuucuuuuuggauaggguuccucuguauagcccuggcuguccuggaacucacaauauagaccaggcuggccucgaaacucagaaauccaccugccucugccucccaagugcuaggauuaaaggcgugcgccaccacugcccugcuuguucccccuucuaagaaggaacaaaguaucuacacuuuggucuaccuucuucuugaguuucauguguuuugcaauuuguaucuuggguguuuaaauuuccaggcuaauauccacuuaucagugagugcauaucauguguguucuuuugugauuggguuaccucacucaggaugauaucauccagauacccaauugccuaagaauuucauaaauucaaucuuuuaauagcugaguaguacuccauuguguaaaaguaccacauuuucuguauccauuccuguauugaggggcaucuggguucuuuccacuucugacuauuauaaguaaggcugcuuaugaacauaguggagcauguguccuuauuacaaguuggaacaucuucuggguauaugcccaggagagguauugcuggaucuucugguaguacuauguccaguuuucuuuggaaccaccagacugacuuccagagugguuauacaagcuugcaaucccaccaguaaaggaggagugcuccucuuucuccacauccuugucagcauaugcugucauuguuuuagcucccuugucaaagaucaagugaccauaggugccuggguuccuuucugggucuucaauucuauuccauuggucuaccugucugucgcuguaccaguaccaugcagguuuuaucacaauugcucuguaguacagcuugaggucaggcauggugauuccaccagagguucuuuuaucauugaaaauagcuuuugcuauccuagguuuuuuuguuauuccagaugaauuugcaaauugccuuuucuaauucgaugaagcauuuaguuggaauuuugauggggauugcaugaaucucagauuaauuuuggcaugguagccauuuuuacuauauugauccugccaguccaugagcaugggagaucuuuccaucuucugagaucuucuuuaauuucugucuucaaagacuuaaaguucuuaucauacagaucuuucacuuucuuaguuagaaucacaccaugguauuucauauuauuugugacuagugugaaguguguuguuucccuaauuucuuucucauccucuuuauccuuuguguagagaaaggccuuggcuucacucaauauacugugaccaggguacaugaguaaaucaacacuuuucucacauguuucuuuugacuauggucaaaaauaccuucaugaaguucuccaggauggcgcccuauauguagacaucauuuucuaaaaauauaauggccaccagaugaaugaagaaaugagacauuaauguucaugucuaaaauaucaaugauuaaacagacuuaccuucauguaugguauacaagaaacucuuuugugauuauaaacuugcauuuaugaucgaacuaccaauagcaccuuugaaaaaaaaaaugucacagagaacguggccaugcuuaaucgagcaaggaaaacacacaugugagguuuuuucccuaacagauuccugaagcuuccuuuuaaguagcuagaaaucagucugacauuaaaauagcagugacuaaggagauuaaaagcucaucacauaacacaguauuauuaaaaugcugucccagggacugauuucugucaaaugccaucuucugcuuucuuuacguaugaaucuuauuuggucuuauuuaacauuguaguuggaauuacauacaccacuguugcacuuaccacaguugccuggccgucgccuuuuuuuuucuuugcuauuuucucuuaauuaccauuaucugaccuucauguucuguuguagucaucagaaaaauauuaauuugauauaauguagacaucuuuccucuuuuuauuaaucauuuuauuuguuuacaauucaaaugauaaccccuuucccucuucccccuccacacaccacccauuccaucccccucucugccuccacccacuccagauucacacugcucuagcaucgcccuacacuggggcaucaagccuccacaggaccaagggccuccccucccacugaugccagaugaagccauccuuugcuacauauagagcuggagccaugcaucucuccauguauacucucugauaggugguuuagucccuggaugcucuuuaugguccaguggguugauauuguucuuccuaugggguugcaauccccuucaguucugucaguccuuuccucuucugauggggucuuuccugucuuuagacagaaaugauucuagguuaaaaguuuugauauggauggguggcucaaucccucaacuggugcccgugccugucuacuggauguggccucuauacguucuguguccccucuguuggauauuuuggcuaaugucauuccccuuggguccugggaaccucucaauucccugguuucuuggacuuucuagagccuacccccaguuccccauccucuagugcuacauauuuauauuuucugauccucuguacuucucucuugucucuucccauaccugauccuacccuccauuucauuauguccccuucuacacucccuuuuagguacccaugaagcaacuucauuggaaacuuugccccaaggaauggcuuauagcuuuccauuauguaaaaaauuuuguugcugcuucgauacaagaagucaggacauugaaucuuucagugucuauuguucauuauauugauauuuuaucagcugaucccucugaaggaguuuuacuacaagccuuggcucugauacaaggagcuuuaaaauuuuggagugguuguuguucaaaggcaguaucuucuggccuccuccaaggggcuggcuucaagucuccagcucugcccucugcagcacucuaggcucagguggauccacuucacugaugcugcuauucuuggagaucauaccaugguacuggcaucucuaacaaguggggucuucugcuucuaauaggccccaccaauagccucucauaggcucucaucaugccaauccucaacucuuuuucaugaccucuccauucuugagcugucaauuaaaacugaggcggaaccuu

SEQ ID NO: 7114 - RNA, 4321 nt, Mus musculus
caugggcgacaagaagagcccgaccaggccaaaaagacaagcgaaaccugccgcagacgaaggcuuuugggauuguagcgucugcaccuuuaggaacagcgccgaagccuuuaaaugcagcaucugcgaugugcugaaaggcaccuccaccaggaaaccucgcaucaauucucaguugguggcacagcagguggcacagcaguacgccacuccaccucccccuaagaaggagaagaaggagaaggucgaaaagccugacaaagaaaagccggagaaagacaaggacauuagccccagugucaccaagaaaaacaccaacaagaaaacaaaaccaaagucugauauucugaaagauccuccuagugaagcuaacagcauacagucugcuaaugcuacaacaaagaccagggaaacaaaccacaccucaaggccccggcugaagaauguggacaggagcaccgcacagcaguuggcaguaacugugggcaacgucaccgucauuaucacagacuuuaaggaaaagacucgcuccuccuccacauccucuuccacagugaccuccagugcagggucagaacagcagaaccagagcagcucgggcucagagagcacagacaaaggcuccucccgcuccuccacgccaaagggcgacaugucagcagugaaugaugaaucuuucugagauugcacauggaauugugaaacuaugaaucaggguaugagauucaaacccuccaccugcccaugcugcuugcacccuggagagucuucuguggacgaccuuguagugacgcuaccaggagagguuccgcuugccgugggcaucuggcuaccaaggaauuucguacccugacaguuacucuugacacuuuuauguauuccauuguuuuauaugauuuuccuaacaaucauuuauaauuggaugugcuccugaaucuacuuuuuauauauauauaaaaaaaaaucugcugugcacaauuuuccauguacauuacaacugguuuuguuucuguuuuguugaagaggguugggaggggggagggaacuuuuauuuauuguguucacagacuccauccugucagcauauccucuuaaauuuaguucuuucuuccagcuauacucuguacuaucaguuuugauauaacuauauauauaaauauaaaauuauauauaaaggguuauuugaaaccaauccauggcaacgcuggugcuugauacacugugaagugaauacaacauugaacaguugacacagaucugggacagucccuucuaugaaagugcugaaauaucauuaaaaucagucuuacaugaaguauguuccaaccugcgugggaacuugacucucucaucugucuuuagaguacuggauaauauaaaaaauauauuuuuuaaacaaugugaucucaaauuuaaagacugcuccagauagccugcauuugcaaugggcuaauugacaaaugacaagugguucaguuggagggcuuugaccauucggaaguaacaagacuagcuccagaaugccaaguauucguguaaauuaugguuacauguuaacauugcuguuuuuauuaagcacucaugaaaauaugguguucuguaucucgaauuccggccuuuuuccagaccucugcucacgccugagguauaucuagcagcugucuuaguucuaggguugcgguagugcaucuuugaauccacaccacccagggaagcagucuacauccccugugguguugcagugguggauuuugugaucauggccuguuuuacuccuccucccguaccccguccuccaaauccucacccuaccaaugcaguuguuagucuuucuucuuaaaaccuacuauggcucauuuuauuaaacaaggguugucaaccucacauccagaccugacacggagaucuuccagucucuggagucaguucuuaguuccuugugugggaaaggaucgcaggggugcaugggcgaguugcagggaaagcucacuucccaggagagugaaugaauaguagguguucuuuguugacugaacucuugaaagcuuuucauuuuuaccauuuuagggguaggagauaaugaaagaccacugauaauaguuuaucaucccaucccaagucucagugacucugcuuugcucuuagguucaggguaucucuccuaucugacuuagcuucauguccaccgaguuuguagugcuuaagucacauuaagcaugugguguuaaccuuccuuuaguucaucacacucaaggacucauaggagagcguguaagggaacaccgagucuuggugguaaaagaaccggguuuguuuaauaaaagaauuucuauguguggaggcaacaaguuaagaacauauuaacuuaacagcuugaauugaguagccaacaggaaugguuccauucacauuuacauuaaaaccagucauuugaugcgccggagucucuccacaaaggcagugcuauuugucaaugggcuccuguucucgaugcauggacaaugcuccccucuuuuuaaaacagugcuugugucugggaugcaagcuguacuuaccuuuuuaaauaccuuuuuaaaguauuuauuaaugaaccaaaggaaaccaggugcuuucuguaagcaucagaauauauaauacauagugauuugacuaugaauuuuaaauccacauuuuaauauuagugggguauugcaaagacauuccuucuaaaguuuuaauauuccuuuuauuaagggucucagggaggguuaauuagucagccauauuuauuuuccagagguguaaggaauugcuaaguuuuuuaauuaacuuuuuuaaaaaaaaauuaaaugccaccaaauucauguggauugcacugcucuuugaaccaauaaguguugguaugcacuuuguucagaaacacuguguacuuuuucaaaacgaguuucauguaaagugauuggacccccuagauuaguggaaaaggcugauuuaccagcuccucauaggcuacuaauucauucaucgcuggugucuuggguuuucaguuuugccuccaugauaaauuaaagaaugaggagaggugaagggagggaaggaccacuucagaacuagugaacuugccuugagguagaaacugcagugguggagucuaagcagucagauguuccuggccgcccugucucggcugucgugggcugcguugggauagagaggugauaggugccacacaaugccauccucaggcaugcauucuggaaauggaauuccuauuagcuuccugcauuuacaguuugcccugcuauaguacuccguagguaaaaacacuaguguagcuuacaaagagacauuaagaggaccagaaauacuugguauucaguggcacagaaagaaagcagauuaaaacaaaaagcacaguguuaaggcuugcaaguuucccgugcguuuaguacaugaucuuucacacucgugugcacacacacagcugagcugacaugcucugcccgagucaugcaguugggaagggggaaaagacaucuugacacccacgagaauauuuuaaucaaaaccuuucaguuuggaucuggauacuucaaaacauuggcagacgcuucugugaguuuagcuccacuaagaugucucgccugccuuauuaagaccauucucagucuacauuuuuaagcugccguaucuuaaauuauugagaauuuauuaauugcugacuauauaauaaccuuugcuuguauguuacggaaaaugguuuaagagccaacauuuagagugugacaauggagcugaacaguuucuaacgcgcaagcaguucuguucuuguguaugacuuguaaccuuaauuuacuguguaaagaugguuacauuauuuccuuagcuuuguuuguuggagacagauagcgaaugcuuguuaaguaugucaacauaaucuccccuugugaacuuuuguuaaugucuuauacgagcucucuuuuccauuugcccagaaagguggcuuguauaacgcuuuggaaguuucugcuccguccgucuuagagcugacagucuguuagguuuguuuucucuucaugcuaaagugucggugguuuugugaacuggucagaaauucacaggucuuaaauguuugggggaaauuuauauuggacacugcucuuugucuagcaaauaaaagauguuaauauauuccuguuauuggcaugugcacgacuguuauuagaagccacuuuaucauuuuccugcuuuaaauagaaaugucuauuuaugaauucugcuuguaguuuuuucacaaauaaaauaguaaaauuuaaaaaaaaaaaaaagauggaaaauauau

SEQ ID NO: 7115 - RNA, 9657 nt, Mus musculus
aguuccauagcauagguuuaauggagcuacaaaucaaauaaagggaacucuuaaggcauuguuuccuugcuuccauucuuagaggaaugccuuggaaccacaaaucagauaauagaaucugagguacacggacuugcaagaauaucauaaucaaaguuacagguaauggacugauauuugacacucuugcuuuucuuuagaacuuccagaacuuauuacaauuuccucacagacauauuuguaucagcuugaacaugaaaauuaccuuguaugucuuugagaacuuugacaugguucuucaauaugauggucuucccauuuguagccuaaaauacagcaaagaaaaugaaugauaucuuauuagaaauuaggaauaauugaaguuacuguaaauuuucacagcugugaaccugauuuauucaccucaauauuacuuguucucaauuuaaauaacagaagaucaucaauaaccaaaacacauuuguucccuuaauuugaaaagcaaaagaaaauucacagucuuaccuauagaaguaagguuccaguaggucuccaacaucacgucuuuguagagauucaucugggaaggauccagcaaauuccauucuucuuuagugaaguucacaugcacaucgucaaaagucacugcauccuaaaauaucccagaaauguguacaauacaaagcaugauacuaacaucacuacuuguuuccugacacagaaguuguauucuaaucaccaugucuuuuuagaaggaaauucaauuauaauguucaccuauguugcuauugaaccuuuugccuaggagauagccuugcaaaggaaaugccaauugagagggagauugcaaggggauacagaugaacaguacaaagcccacaucugagaaacuguaugaacaauuaguaacuacaaaaauauuggacaagauggagguauuugcucaugacuuuaaucagaggcacaggaagguguauuuccucaaucuggaggccugcaucaucuaugcaaccgauuccaggacagcaaaaguuacacauuaagacucucacucccccugcaaaugucacccaaggaaacagaaaugauagaaagaacccauaguucugcacugaaauuccuacaaagaauuauacauuaacugcaguucuguauucaucuuguacaaacaugaaguacaccaguuuaaauugcaacauuaauaaaauuuuucuaaaagagaaugaauuuuuaaagaguuacaaauggaccaauuaaaauacuaguaguauaaauguucaucacaaauaugcaagauagggcaggagaaauagcucaacuguggaaagcucuugcuggucuuccauauaauuguggucaauauuuagcauuuacauggggaccagcaacuaccuagccauuacuucaagaucaggcguucugauaccaccuacugacaacaguaaaaaugaugcacacaugauauucauauucaugcacacagaaaaauaauuacauuuaucaaaaaucaaagaacaaacaaaagaguuaggcagaucaucauauacccagaauucaaugacucugaagccucagguaguauuggugucaugagcauaugucauccuggaaaauagaauauaaccuauagauuuagugaaauuucaaaauugaagauguggauaaagaacugcacagaagcauauguuuauuguacaaaaacaugauagguggcugauguggugucuauaccuacuaacaggacaaaaaggguuucacagagaaauuuuaccucaaacaacaaaauccaaaauaauaaaauuaaaaacauaaaaccaccaggcuugcaaaauagcuuagcauugaauagcaaaugugucuacuguaucguaugugauuuagggacagagaccaaauggugaauguaugggugcaugagaagaaagacccucacuccccuucaaaugucacccaaggaaacagaaaugauagaaagaaccgauaguucugcacugaaguuccuacaaagaauuauacauuaacugaaguucuguauucaucuugcagaaacaugagguacaccaguuuaaacuguaacauuaauaaaauuuugcuaaaauuuugaauuaugaaaauuaugaaucaguuuaaaccacaacgcuguagacacaaagaacagcauuuguccugucaaagagaaaugcagaggcaaagcuggaucagagacugagggaauggccaugaaaacuugcccaaguagagacauaucccauuuuauuuguaacaacuagaaacugcaaacaagccagaugucccucuacugaaauacguauacagaaaaugcgguuuauuuacaaaauggaauacuaauaggcuauuaaaaacaaggacaucaugaauuuuccaggccaauggauacagguagaaacuaucauccugagugagguaacccagaaacaaaaugacaugaauguaugcacucacuuacaagugaacauuaaccauaaaguacaggauauccacacuauauuccauagaaucaaagaagcuaaacaagaagaaaagcccuaaugagcauuguugaaucucguucaaaaggggaauaaaacagucagaggaggcagauggaagaaagagagaacuggaugggagagugaauaaguaaggggaagggugaguguccaggaacagguguugugagagacaagagauggucagagggucaggaauaugaauggaauucugcagcuugagggggagggguauggaaggguggggaaucuuuagguugugccagagaccaggaaugagaggucaccaaggauaauaugggggugaucuuaguugauaugcauggcagagaguuuuggacccucaagaggccacaucuugcuaccaggaaggacccacuagagagaauuaagcacaguaaaugaaccaaauauauuugcucccaaaauugguccugucuacaagaaaugcaggcacaaagauggagcagagacugagggauuggacaaaugauacccugaccaacuugagacccaucccaugggcaagcacguauccugacauuagugaugguccuuuguuauacuugcagacaguagcuuagcauaacucugagaaucuccauccagcaccugacugaaagaugcagagacucacagccuaucauuggacagggcucauggagucuuuuggaaguguugggggaaaggauugagggccugcaaaggaacaggaagucuauuagaagauccagcgagucaacuaucagguacacuaggagauucucagagagugacccaccagccaaagagcaaacacagggugggccaaggccccaccacauauguaguaaaugugcuucagucuucacaugguugcugaaacaaauagaguggggggaugucccuuaagguguugucugucuguccaaccuguuccccuaacuugguugccuugucugaccuuugacuugucuuguuugggggauacucaagugguccccacucccuggguagaugaaaaggaguuaaggaugagggacuguguaauguagaaaggggaggggguugcaguaggaauguauauugaauauauauauuaaugggaaaagugaacaaauacauauaaauagaauaaaaauauacaaaucaggcaauuauuuuuaaacuuuucccuacucaauaucucauagaaaauccugaauaagaaauauuuuuggccaaauguuacacaaaugaccucuagcuaaaguuuucacagagucgauuucccacggacauacugugaacuccacuuccucuggcugcauuacugcuaacacucgaaucuuucagguucuaugacuacaaccguuaagcuccaccuacagauuucuaugacuuuugacaucucaaguuuuaauauuucccacauuccuccaaaagagaacauagauucuguucagcagcaaaaucaccuuuuuauaccaauuuuuguuguuguucuaacuugcuacucugcuguugaauagacuccugcaagcaaaagcaucucaggcaguagaugguugcuguacaugguucagucagaucacuguccaccauucuguaaaguuagaauagaaacuggagcuagaauaugaaggaaaaauaaugaagaacaaacacuguuucuuggcuuguucucuuacuuguucacuguccuaugcuuagcuagcgcucauaaagcccaggcccacuugcuuaagaauauugccucccucaguagaaaagccuucccaaaauaccaucaacacuaucucucacagacauagcaaccagccauucugaugagggcacaccuucaauugagguuccuuccuaugucuguagcucugaaauguugagaaccgaagacaauuaugacauggcgacaauaauaacugaggaaauuguaaaagcccaaaaccaaugugcuaaccauaucaauuacaggaacacauuaaaacaaucauccauccugaccaaguagguuucaucccagggaugcagggaugguuuaauauacggaaauccaucaauguaauccaguauauaaccaaacucaaagacaaaaaccacaugaucaucucguuagaugcucagaaagcauuugacaaaauccaacacccauucaugauaaaagucuuggaaauaucagaaauucaaggcccauaccuaaacaugauaaaagcaaucuacagcaaaccaauagccaacaucaaaguaaauggugagaagcuggaagcaaucccacuaaaaucagggacuagacaaggcuauccacucucgcccuaccuauucaacauuguacuugaaguccuagccagagcaauuagacaacaaaaggagaucaaggggauacaaauuggaaaggaagaagucaaaauaucacuuuuugcagaugauaugauaguauauauaagugacccuaaaaauuccaccagagaacuccuaagcgugauaaacagcuucaaugaaguagcuggauauaaaauuaacucacacaagucaauggccuuucuguauacaaaggauaaacaggcugagaaagaaauuagggaaacaacacccuucucaauagucacaaauaauauaaaauaccuuggcgugacucuaacuaaggaagugaaagaucuguaugauaagaacuucaagucucuaaagaaagaaauuaaagaagaucucagaagauggaaagaucucccaugcucauggauuggcaggaucaacauuguaaaaauggcuaucuugccaaaagcaaucuacagauucaaugcaauccccaucaaaaucccaacucaauucuucaacgaauuagaaagggcaaucggcagauucaucuggaauaacaaaaaaccgaggauagcaaaaacucuucucaaggauaaaagaaccucugauggaaucaccaugccggaccuaaaacuguacuacagagcaauugugaucaaaacugcaugguacugguauagugacagacaaguagaccaauggaacagaauugaagacccagagaugaacccacacaccuauggucacuugaucuuugacaagggagcuaaaaccauccaguggaaaaaagacagcauuuucaacaaauggugcuggcacaacuggcgguuaucauguagaagaaugcgaauugauccauuucuaucuccuuguacuaaggucaaaucuaaguggauuaaggaacuccacauaaaaccagagacacugaaccuuauagaggagaaaguagggaaaagccucgaagauauggguacaggggaaaaauuccugaauagaacagcaauggcuugugcuguaagaucaagaaucgauaaaugggaccucauaaaauugcaaagcuucugcaaagcaaaagauacugucaauaagacaaaaaggccaccaacagauugggaaaggaucuuuaccuaucccaaaucggauaggggacuaauauccaauauauauaaagaacucaagaagguggacuccagaaaaucauauaaccccauuaaaaaauggggcucggagcugaacaaagaauucucaccugaggaauaccgaauggcagagaaacaccugaaaaaaauguucaacauccuuaaucaucagggaaaugcaaaucaaaucaacccugagauuccacuucacuccagucagaauggcuaagaucaaaaacucaggugacagcagauguuggcgaggauguggagaaaggggaacauuccuccauuguuggugggauugcaagcuuguacaaccacucuggaaaucagucuggugguuccucagaaaauuggacauaguacuaccggaggaucccgcaauaccucuccugggcauauauccagaagaugucccaaccgguaagaagaacacaugcuccacuauguucauagcagccuugcuuauaauagccagaagcuggaaagaacccagaugccccucaacagaggaauggauacagaaaaugugguacauuuacacaauggaauacuacucagcuauuaaaaagaaugaauuuaugaaauuccuaggcaaauggaugcaccuggaggguaucauccugagugaaguaacccaaucacaaaggaacucgcacaauauguacucacuuauaaguggauaauagcccagaaacuuaggauacccaaaauauaagauacaaauugccaaacgcaugaaauucaagaagaacgaagaccaaaguguggacacuuuacccuuucuuagaaaugggaacaaaacacccauagaaggaguuacagagacaaaauuuggagcugugaugaaaggauggaccaucuagugacugucauaugcagggauccaucccauaaucagcuuccaaaugcugacaccauugcauacacuagcaagauuucgcugaaaggacccaguuauagaucucucuugugagacuaugccggggccuagcaaacacagaaggggaugaucacagucagcuauuggaugggucacacggccccuaauggaggagcuagagaaauuacccaaggagcuaaagggaacugcaacccuauaggugcaacaauaauaugaacuaaccaguacccgggagcucuugucuuuagcugcauauguaucaaaagauggccuagucggccaucacuggaaagacaggcccauuggacuugcaaacuuuauaugccccaguacaggggaaugccagggccaaaaaggggaaguggguggguaggggauuggggggguggguauuggggaccuuugggauagcauugaaaauguaaaugaggaaaauaccuaauuaaaaaaaaaagacugaaggaaaaaaaaaaagagagagguggaguuguggcugagccaggaaaaaauggggaggucaccuggcuuagagcagggcaggauacacuggaaugaggaguucagaggcuuugcugcucuggugugagguaucuuuaaccccacguucccuggcuagugcuaccaaagagguggcuaaagcagcuggaaggugaacagagaagcacauugcaccacaagccuagaaauaacacugcuggucuaaugagauauguuaacuuuguugcaguggaugaagaacaacuuucccucuaaugacaguucugaguccaaaacuacagagucacauauggacugggaacaggguugaucaggagggggaaaaugaggucuuuguccuuuccacccuguaaaacaggauagggagacccugguuuugcccuggauugggucuccaagagcucucuauaaugggcaaucuaguggguguagguccucuuaggaagaaggauuuaaccccagaugaugauuuagucacuaaaucaauugggaugggaaaaaaaucuuauuuccucucucucagucacagaauaauaaaguaccacacacaugagagaaagucacaaggugucaguaaaggcuacccagcagauucauacauguguacagaggagaagaugaagacaggaugguagcugugagucaugaagcaggguuucaagucugcucuaacccuccaagcacuuuagaccaagggcgcaccauccucuauaccagacuauggaacgucuuccaaggcccuguggcuacaacucuccagugcacccacuuuaccaugguuccaaguucacuuuagucaucucccuccaggaauaaucaagaaaaauaggaaaaccaagauacacagauacaaauguaacagacaagccauugaacaaagaacaucaaugacacaugcuaacagcuggccuuuuaacaucucuguucugauuccuggaagucuuggagugucagucaacacaccaagauauuauacccaagucacagggaccucaauggcaaccaaggaucuuauugaaauucaaacacacaauguuuuuauuaugggcucaguaacaaggucugucuccagucaaccuggcaugagguccaaaaugagagaccaagucuagaggugcuggacauauauuguaguuacagcaaggcuggggaauuuccacacaauagauacaguggaaaaaugguuguuugcaguaagggagaggagugaaaacaugggggaaggaauagcugugcacaagaagaccugcagacaggcacacagagagagaccagagagagacagccacaaguguagggaaauagaauggggguggggggagagcaugugcagagaacagagacagggaacacagcacagagcugcuguaccuguugguccauguauauaaagcacaccugacaacagcaucaggugauggagacagguaacaacuuaagcauuugcuaagucccuaagagaaggccauugaauaugcuguacacugucaaccagagaggcaagguucacccuugguccaggaagggaagagagacuaucaggcauuagagaugaauagaaaaaaauaauaaauuggucaaaaaauauggauuccaaauguuuccuggcacuaaauaaccaggaauucugcaacauaugagaaggugaaaaguagaaauuauuggaauagaagaagaauaucagcucaaaggucuagaaaauauuuucagugaaauuaugaaugaaaaauuuucuaaacuaaagaagaaaauaccuauuaaaguacaagaagcauccaaaauagcaaauagauuggaccaaaaaaguccuuuugccacauaacagucaaaacucuaaacauguaaagcaaagaaauaugaaaaacugcaacagaaaaaauuaaaaacuaaauaaaacaaaaacuaguaacguauggaagcagaccuauuagcuucauaucugucuucucaaugucuacuagaaaagacaucaguguuuggacaguuuugugcugcacagugaaagaaaccacccauguuucuacaagaaagcaacugguccaaauguuuuggagagauucagaaucagcuaugauaaugaaguuauucagaggucacugccugagaccucacacguguucccaucugggugaugcuucccaugcagccccaaaaaggacccacaccccagcucucacugcucaaccaccugccccuaccgauugugggcagugauccugugcucaccaugucuaaaucucagagcuuccugagguccccucaaugcacccaacagcagaucucagagcaggacacagagaaccauucaagccagcacagccacagcaaucua

SEQ ID NO: 7116 - RNA, 745 nt, Mus musculus
ugcuuuuuuuuuugguuuuuuuugguuuuuuuuuuuuuucaauauauaagucuuuuauucucccaaaagagcccaaauuguucuugugaucaggaucucguuucuggggccaggaacugaggccuccucacucgucagccugcugcacaguucccuucucagacacauagaugccauccaaaaacuuccugauauacuuguuuuuaacuguuguggcuugcugaaucagggcagcugaauuugaaacaaguucaaugucauuuccuucacggauuaacucauccuucugggcuugagagacagaacaagccacaccuguccucauccgaacccugcagauguauuuuucacccaagaaauuucggauuucaaccaaagagccauucuccuggaugaggacguugauggggaagugagcguacacagaccgcaucuuguaucggaagcccagugugacaccuuugaucauguucugaacaugacugcagaugguccugacgguggccaguuccuuucuguuaccccaccauuugucaacccggagccuuuucuucuucuucccaagaagacucagcuccacguugaugugauugaagucccuccgcagagucccccuggggcccuucacaaugacugugcgccccuucagagugauuucgacauucucuggaauguccacagucugauugcugagaauggucuucauccucgcaguagauggggcaaaaagcguuauuuuuucuuu

SEQ ID NO: 7117 - RNA, 4805 nt, Mus musculus
gccugcguaggagcccggcguguccucuaggacuuacccagaaggcagcgcuucacucucaggucaaaauggcgggccgaucugcuggugaguaauuacuccuccuuuguggguaucguggagcgguuguauuuucucacgaacuuguucuccuuuugcguuagcuaaauagcuaguuugugauaagagacguggcgacccagcagcucaaaggacagguuucgcugagccaggucgggccugccugaggguuagaacagggaccucugccggaaggagcccagcggggcugaccggguucggccuccuuccccuccgccuugggacagcuuagggaggugaggaggucagcagacgacagccacagcgaguaguggggagcauuuggagucaggcgcaggccacuucagugacagugaucggagcaaacagcgcccgagcccgcaugacgcuccuaagacuugucagaagaauuaaaaggaaguaagauaggguuauagugagguuucagguuaaccuuggcauaucuggacggugagcuggggcugcagggcuguaaggacuuuuguuuaauguaggcacuagaacaaauuugagauagagugccagaauguuuucacaucaaauauuacucacccucuccccuccuauuuuuuuuuaaagcuuaaucuuugcccacugaugguauacguuggaauagucuuuaaaaacaauacugauaaccuucucacagucccuggaaauucugaaggcauuaauuuuacccauuugacacaauuuuaggaaaaguauucuguuuuguugaguuuaauacuuacguaagccagcuuccuuuucugcaacaggcuuuugaucuauaauguggcaaacagaguagugccugacacauuuguuaaguaaauauuaaucgauauuauaaucacugcuguguuaacaauuuaguucuuaugcuuuuuuuuaauauuuuuauuuuuugagccaggguagcccaaguuagcuguguauugaagaaugaccuugaaccucugauucuuuuuuccuccacccuaaaaaugcuggaauugcaggaaugaaucacuaugcauguuuuauguagugcuggaguuggagcccagggcuuugugguguauguuaggcaagcaauauaccaacugagcauuagcccuugacaauuuaaauuucucuuagaaacaauuuuaugcaugacuucuaauuuaaagguuggaggaagccauguaguaaucuguacugaggauuaggaaauuagaaggagauaauaagaagggagccucuuuuuccuucuaugguaagaaaguagccuuaacgcuuagggacugagaauauagcucaguugguaaaaaguuugccuugcaauguaaauacuggccugauuucgguucucagaacccauuuuguuuguugagcuuuuucuuuuuaaauaaacugaguuccauuauaugagacacgucucaguagcccuaauccaugcuuuuaauccuagagcuggagacaaggaaacaagugaucuugggguucacuggccuuuuagccuaauguacuuggcacuuccaagccagugagagaugccaucucaaaaaugaaaaggaugacaacguccucuggcagucacauguucccuccccuaccccucacauuuuaaaaagaaagguuaagcuugcucuaucuucuuucuuguaccacgucuggucaacaucaggcacucuccugcuuccuugccucuucuccuuuaccucucucaggcucagucuucuuccccaaaugguuuaaguuuguuuuugaauagaguuuuuugcaugcuaggcacgaacucuaaggcugaaccauauucccagccccuauuuuaguuuuuguaucucuguuuguuuguuuguuuguuuguuuguuuacacaaggcuugguauucacagucucaacuuccugcaugcugagauuacaggcaugcuuuguuacauuaagagauuuaaauuuaacauugaauguuucuucuuauccauguucaaauacuauuauucccuugacgaacaguuugcuguuugagaaaaggaaaauaggcuucuuuuacuaauauauugguauuuaaauuagcugauaguaugaaaguuuuucuagaaauaauuauaaauuauauuuuauguaaaauuauaauuuuaaggaugauagccaaauaagacaauguaaacuaaaaguuuuggagacuagaggccugccacuuaaccugaaaucuuauagcuccaccuccuuggaaaagaaaaaguuauuuccgcagcuacaaaagacagaagugcuucagauccuuuccugucucugguccuucaguucuuaugguagcaggagaaggguguuggacucugagaacccaaaguggcaggaaguauaccuguggcuauuaggcaccuuuaguuuugaguuuaccauuuguucccacagugucaugagugaaaugauuaucuacauuguauacaaggggauucuuagguuuauaagauaacugguucuuuaccaauuggucuauugcuuuguaaguauauuguagcaacuaacauugugguaauuauaguuucagcaucaagcaaguggcuggaugguuuucgaaagugguauuauaaugcugcaggauucaauaaacugggugaguauccauucugugguccuccuucucuuguucucccugaauucaguacuuuuaaagaauuccuauaguucaaaagagaucauuuguuuuuguguguaucagauuuaaaaauaaacuguuuuugaauuuuugaucuuuaugugguguuugaacuuaguguugucuacuuagcagugaacuucacauuguggucuagaagccgaauggaagcaucagcagaucuuaggguuucuugguauaaauuugaguucuuuaugccuuuaaaaaauuuaucaguugcacauauaccaaggugugcuuguggagguuagaggaagacuucuggaagcuaguucuccuuccuucaugguguccagggaucagacuuuggacuguaaauaguaccuucaccugccuacccaccucccuggucagucccaguuauaucauauaaugaucucagauuagaagaagagaugggguccacaugguuucaaggucaagguacacauuuuacaugcuuucugaacugauucauagugcuuuuaaaaagccuauauauuucuucaagcaguaacuugggccuaaaacacauuugguuucuaucuuucuuuguucauuagaagagaaaaguucuauguggaggagauagcucagugacuccacaggucugaugaucugaguucagaacccacauaaaaguugacacagcgcaagcagugugcuacucugggaaggugggagcagagacaggaaucgcuagacacugggugguuagcuuauauaguagcagcacagggacgaucucaaacaaggugaaaacucaaggacugauaccucagguuuacccuuuggccuccacauguacuggagauacguguguacauguacacauacacacacacacacacacacacacacacacacacacacacacauacaugaaaagcuccuaccagauauggugaguuauguaauuuuauuauuggggaggcagaggcaagaagaugguuguuucgaggcaaaugagucuaaggcugauugggaagaaacaaaugauucucuaugaguucaaugcuagcaauggcuacaaaaugaggcugucugaaaagugcaaaacaaacaaaaaucacuuuuuuuggauuguucuuuaaucugguucuucuguuccuauugcaggguuaaugcgagaugauacacuacaugaaacugaagauguaaaagaagccauaagaaggcuuccugaggaccuuuauaaugacaggauguuucgaauuaagagagcccuggaccugacuaugaggcaucagaucuugccuaaggaucaguggacaaaauaugaggagguagaacagguuugaugugucuagcaguguuagucacucaagaugcaguaucagaaacaggagaaacaugcuuguuuguucaguguuuuaguguucuccacaucaugcuacauaaguagcauuucagcaaccaggugagguuaguagaaagcuguuggcucuauuuuaaauaacaacaaggugagacuuggaggugaagugacuucugacaucacuaagcuagucuuuaguauggaaagccugggcuagaauucagauuuuucugccuuaucagccauauugcuuucccucuacuuugguuccugcucuaugaagaguuuuaguuaugugaagucuauugagugauuuuuguagcucugugcauggacaucuguccucaaaagucaggcaagcuuauaggcauuguacaccuucuccugaccugcucacugcaugaucuuucagagguuuuauauuuaaaaagcacauauuuccuagagguucagauuauauuuucuuagguuauaagcaaagacuaauucauugcaaugaacuucauuggugaucuaaaaccuguuuucuucuuccuucuuuaggacaaauucuaccuugaacccuaucuaaaagagguuauucgggaaagaaaggagagagaagagugggcaaagaagugaucuuuuaguuaagaucugugggugugccuggucucaccauacuuuuacaaaguuauuucaacccaaaucacaauuuaagaauuauuuguucuaccuaugccacacuuuaaauaaaugucuauuauaaccaugguuggauuauuugaauucaauucaaacgccuacugucauaau

SEQ ID NO: 7118 - RNA, 35590 nt, Mus musculus
gucagauuccccuggccuuaauuuauuaauggggccacuagagggacaucaaguaagaauuggauuuuagcugagaagcauggcagaucccaggagucagccacaaagcccagaggccccuggugauaauguguuggcuuucuuugggcagguucugaagacagcccaccgaagcauucaagcaaccacgaaagccauucuuccagaagaaggaaccggcauucuaaguccaaagucacuaauggaguuggaaagaaaugaaggaagcuaguuaaugucagauguuccagagugccuagacccgagaggaaaacagcauauuuggaccuuccuaugcagagaucauaauguacggaaagaaccgagggagcuuaggggaucgugacuugagaguguaagucuugucucccauagaccuggacacacacuaggcugaccauggcucgggguccuuugccaacuggaagagucucuaaacuucagcguauggccugcauucucugguagcaauacagugugcuggaaggacaggauagcuguuuauucccagcugccagcaguggcucucugcuggugugucuuguggauguuguauaaaugucuucauucagauguugacuuaacuaacuggcuaaugaacuggucgcuugguuuuauuuuuaugagucugccuguccauuugauugauuguuuaaguucagagagucugcuuuuacuucauguuuuugaguuaaauagcuucaaagcuuccagaauccacugcugaaauugggggaggguuccuucuagagaaacaaaggguggaaggagcuuuggugucccagcuaagcauacucaguccccagccacauggcagaugaccccagccggagugaagaggcuggcugcuggcacuggagccucggcuucagauuagaacuguuuuguucccuuccagacacuguccagacugagugcacaagaacgaccuugcgagcggaucugggacaguggggcucccugccaggguccuuuuccaugugcuugguuuuuccucugugauguuuugccuacucugucuuucuggcucaugugaggugcuaguggguauuaauuaacuuucaucugugccauguucuacuaaaacauucucccugucuacccuggauccuuguuuuaaauauaucaguucacauuaaacagcucaucaaugaucugucuuuguuagaaugauguuucuuuguaucuuauuagucuuuuaacuacuuggaggcaaguucauauuuugcaguugaccuuaggauaauauguauguauguguguucuauaugguaaagaaagaaaaaagaaaaaauauauuuuaaaggggcuuacacauauauguccuaucugaaccuuccagagugauccacagggaauggaaguguaugcaggggcauugucugucacuauggucuuacuuacuagguuggauuuucuuucucagacaagugggcuguaaaacaaacuugcuacaaacaauccugcugcucacucaccaaagcacgaugauuucuguuucuuugccuccuuaaagggagucuuugaacuauaaaaguuauguuuuauuuugcuuucucucucucuuucugucccucccucccucccucccucccucccucccucccucccucccucccuuccuuccuuucuuuuuugaaaaagaauucccagaugagagauuuaaaucaaucaugaagaaaaacucgacucaccguuauugcucugggugaacacuugaguuaagagccacccacagacuugcuuucucagccagccacacauguccacugguccaccccaagaggcuauggcaggccacagcucuaaacuuugccauaguguuccaugagccuguuuaaaggggaacaaagagguaccuaucauuccucaucccucauuuugcaguucuggaauugaacuuggggccucuuguguacuagacacgggcucugcuacugagauuuggcucucuccucacauuccaucaaacaaaacaggcuuuuuuggggggguuuucaagacaggguuucucuguauagcccuggcuguccuggaacucacuuuguagaccaggcuugccuugaacucagaaauccaccugccucugccucccgagugcugggauuaaaggcaugcgccaccacgcccggccaaaacaggcuuuuaugaauauauuuauaacuuuuaaacauugcuuugcuuugcagauagaagaguguuuuauuucugugcaauuuugauaagccuaaaauuuuguauugcucauauagguuguaugaggguuuccaaguuuguuuuccaggacaguucagggacuggcacugugggacucaucuagcggguaggccaaccccucugaagaggcacaugcccaacuucuauaauuagacagaaagugccuguggagugugcaagaaucaaagcauacaaagcauuauuucucuauggcuuuguaggaaacagcuaggaaaguccuuagauacuuuccaugugcauugaauucaaacuuucauuuucacuuugagaaaguguuuuagcuacggcaaugaggaaaccaacacugugcauaacugugccguuuucccccacaccauaccacugguccuagucuaaguuucugccgacgucuggaaauugacccuagguugauugaaaguagagcguauguuccagagguaucuguuagugaguggugacuauaagucaucucaugacccucuugaaagauugcuggcuuuaaagauaccacaguucaugguguaaagcaggaggagauuuugagugucuuucuugucaaauccucucccuuuuguuauccuugguccuuacaggccucucuccuuucccucaugucccuuucaccuuucaccaagaggcuuugcccacuugcccucccagccaugcuuagauguucacuaccccacugagguuuuagugauacucagcaucucguaaaugccagccuuugcugcaacugccuccuaagugaacuuggaaaucaaggucucacccaggaaaauaaaauuaguucuaucaguuccagcuuucuugguuccuacuuagaaaccacuugcuuuagagcauccuaagaaauaauaccugcuuuguucaauaaggcuuaccuuuugaaauuuagucuagaauguuuggagguaaauggugaauuucccagccuucacagagugaacagaagggagccugggcagaggaaaaaaagguuuaccacuggaugggaaauaagaaacugggccuuuggggauagacugcaguauacccucuaaacacugggugcuuggaacccauucguuguacucggugacugucaugggacuccugggaucaccauauguuuauuaggugagugucacuuaaauaucuagaaauccaacaaguggacacuuguaccuauguauuuuuuauuucuguauggaaaaagaccucuggcuccugcaucccagcaccuaguagaccaucgcuuuuuucuuuuuuuuuuuuuuuuuuuuuuacaaggaugcauguugcuaugauuauauuuaagauuuuguucuuugcaguagauauuggaguggcugauacugaugggucacaguauuacugcucauccagaauuacuagauuuucauaucucccuuuaucaccuuuuauucuaaaccugaugauaagacagucacagguaaagguuauaauauuuuuuuuuagucagacuuuugaaauuugaugcaauaaauaaacauaguagcuuuucaauuuuacuaucuucuguggacuuaaaguaauuuuguuagcauauauugauuguacgaaauaauauguuuccuuuccauucauguaugcauuguacuuagauuauacuucccaucauucccuuuugcuuuuccucuuacccugguggccuccuuucucuucccaaauaauuuaaaggaauaaugacuaaugucuacaaaagaagggacaaauagcuagacuugaauuguuuagcuugaaggccugcuaaauuguaaaagaucuuccuucucucugaugucuccuaaaacuguucuuugguccacuuuaaaauuuucaucugggacuuugucuacccugcuauuacuuucuuugaauguguuggacggauuuaaaagaaaagagaagaaaaugacaaacaacaacaaaacaaaaacacaaggguuuucuauguaucccaggcuggcccugagaucacagaugucuuccuuuuucagccuacugagugcuaugauuccaggccuauagaaacuugaagcuuccugaccucuaaggugauauauuuugccacagucccacacuguucaaagguugcaauagucuaggucccauugaggcuucauauggcucagcuuaguuuauauuucucuauaaucuggaccucauuauucaugcugaaaacuggccuuuauauacagugucccugacucacuagagaagugcaugucaggcuagcuuccuacccacaguccuaggaaagacuuccaggcccccugcaugacugacugcuguuuaaugcacaaaagaggguauuagcacaucucguccaccagcgccuacuaaugacaggaacauuauggagaaaauauaauuugcuagaagacuuugcuugcccagcugagucaaccagcuugagggccuuuucagguaucuggacguaugcuuacauuuuguaguauaacuauauguuacuuacugcauuuucuuugguacuggaauguucugaugacauugaaacugugagggucuguauauugugggcuccaauggccauaguagucaggcauucacguuccaggguagagagcccucuccccuuucuacgugcugaaaagaggacucucugugguuccacaaaccacaacaaaugagauuugccuaucauuaaaagaaagugacuucuccaaaucucauauaaaagaaccaaaagauuguauugguauauguaaaguacaccuaauacccuucauuauagggucaaauuguaggcaggaugacagaaugcucccuuucuagaaguaugaccucugacucggcucacugucauaaccaagggaugcuggucucauugcucuguauaucacaggcugauaagguuuguucuaggcagguacaaccaggaacgaguaaagucucuggcuugccugcuuauuaggaucucguaccuucucuuggaguggaaauacccagaucagcugcaggaggacaaguuuuauauagcaccauagagaacaaguuuucaagacaacagcacuuggaaccucugaaacaacugcauguaguucucagagcccguauauuuccagcagccuccaaaacacaggacuucacuuaugcaccaguugccagaguaauauccuaauuccagaggaaagguugucccagaugcucacaugaauguauguucugugagcccuguaguuugauggccuuuuucuuggauaagaggcaugggacaguuggacccuuguuccugaguacuaggccaagaagaagcuguuaggucaacccaaggcucuuuuucgagucuggacacaaugcuuauguuccuguccuguucuccaccaccugacagagccucugugccuccagccgcagaugacugguggacagucagauuguguacgccucuucuucaaagagacucagguaucagggccucauuuaaggugaccaaacugccacuuuccauauguuggcuacaagucuaguacucgaaauuggggucugucuaaccauuuguguacguggccugaacaggcuaagauuucaucccuagaaacaagauucuaccucucucugggaauccuguccacuucgcucccucugccugcaguaaugugauuuacaaucuggagaagucauagagcuuugcccuucucuucugaaaaaacagaaaguacuggaaagaauguaaauuauacauaacaaauuucuauagucaccaguaaugggauggcugggguggguuauuuuauuauauuuuuaauaaggacugcauguggcuuuaauuucuaaggccccauauuucuaggaagaacagauaacagugaaauguccuucugagauaguggguuuuuuuuuuuuuaauggaaaauacuucuucaugacuuacuaaauacuuugaagugaucauucaacacugaugaagaugggacaguagguggcaguaacauucuaaucuuucuaggauuagccugugucaguccaucccaauacccaguauuuauacuuagccaccucccaaauuucacuucgcaggaguuuuggcuggaguaguuuugaguuuucuuuuuaccucucuugguggaaauucuguucagggaucacacugcuacugcaagcaggaaaaacagccucaaaguuguccuggaucguugugagucugcucuggcuuauuucacaagcuagacagcaguggcccuugaccugccaaggagggaggaagucacugguugcuacauagauuccugcuucuaggauccucagaccacagaggcugggcuggaguugcuuuacugguguugaacauuuucccauuugaccuagccucauuccaguucagagcagugggugaaagcugcaaacacauaaagagcucaaacuuucccaggcuacuguuguaacagccugucugucaaaguaucaaagucaacaugcuucuguuuuucuuggagugacuauacugacaguagagcaguguggugugaauauguugcuuaaaaucacaaacaaaugcuggggccuagaaaacacaguaguggaugcucacagucagcuauuggauggaucacagggcccccaauggaggagcuagagaaaguacccaaggagcuaaagggaucugcaacccuauagguggaacaacauuaugaacuaaccaguacccuggagcucuugacucuagcugcauauguaucaaaagauggccuagucggucauuacuggagagagaggcccauuggacuugcaaacuuuauaugccccaguacaggggaacgccagggccaaaaagugggaguggguggguaggggagugggugggaggguaugggggacuuuugguauagcauuggaaauguaaaugaggaaaauaccuaauuaaaaaaaaucacaaacaaauucaccuacagaauacccucacaaaugcccauucacucauuaguauuuuugacugucauuucuuuaagcaacauuugauucauaaagugucuugguuucacuuuguaagcuaccacauuuaauguguccuggaacccagcauccuacauccugcagggccauuuugcucccuucguuuuccuccuagaguucaaucaaccauggaacuugauagcccuucuuuuacuaaguguuaauuagaaaauaccuuaagcuggcuguaguggcaaaugccuuuaauuccagcacccaagagacugaggcaaguucuaaaccagccaugucuauauaaugagagccuauuuuaacaacagcaaccaaaugaaacaaaaauaccacaaaguaucucuuugaaaauaacugaagacuccuggucaaucuucaggaccuggaguauccauccucucuucccccauacuuguuugaauauuuuuaccagaucacaaaacaggcucugaguuucucccuuacccacugauucauaacaccccaaaagccaggcuuuguggggcaccuacuugggauuuauaagcuugagaucuugucuaugaaaaaaauaauuuaaaaaacucuuaggcauaauguuucacaaaaaguaaugccaugaagccugauuuguuaggcuaucccugaaagccuuggaaaagccccauaccaaaggaagggacuuaaagcauugguuucauuaauuucacagaaaacuuuccucuaccaaccauaauaauucacuucaucugcuuagagaucaaucaagcuacaucuuguauuuucccccauaaauugugcagauuccaagauaccauugauucugcugcccucugagccuucaagccuacccaaauuuucugaagaaauggauauuggaugggauuugcuguuccucaggcccggcaaacugucuagucucaucaacauaguucuacucugaggugcucccauccuuguuggcacagcaggagccaucuacacauggucugcucuucugccuagacgggacugggcucuugaggcucacggagccaacucugucauccaaccacccucuuccuccuugaggaccuuccuugggaucuaaguaacuacccaucauugacaggacuuacccaaauccaagaaaguccuauaaugaauggcugcuuccaaaagaaaaaggaccuucaguuccuuuccucccaguuggccugcagauccaucagcuucucucuucugugcuucuuguuggcaagggguguggcuugcagauaauuuuccagguccccaaagcaaaacugaaauauucuguugcugcagucucccaguucccaauuuuauuguuccuucccauuaagcuggcaggacccaagucaucagaccugacaguuuauacaggaaucucugcuccuguagaugucucuucccuccuaaugggaccaauaaccacucugguuuucaaauggggaucaugguaguguuacugaacuuagcugagcugcaagaucugagaugccaggcaucugcucuaugucuaaggaagaugcucuucaucuugcaaggcugcucauugcuuuaaugagaacauaacucacaagaaaaggcaucuccacuggugguuguacucaaacugaacuaauuaucauccaucuuuguaacucucuugcugggaccaguuuaguuuaaggaacuauuuuuugcuuuuaaacacaaacguguuucuugcauaaguuuaccagacaagcaauaaugagccacugaguuaaauguuuuccuguggggggagaaaaaguuuggguuuuuuuguuugguuuguuggcuuuuguuuuuguuuguuuguuugguugguugguugguuuggguugguuuuuaaacauguuucccagagaaagccacucucgugugcaacauccacguaugagugucuguacuaucugacuaaucugcacuaauuucuuggguaauaaagcaaagacaaaucacucaucuagccucagggagaggccauuacucccaguuccuugugcugauaggaaccagaggauuaggguguauuaaaagaccgcugaggagaugaaacagaaucacacauuuucacucacccaaggaaagucacucccaaauguucagccuguugugcagcuucugguucuaaaagggugaaagaagaggaggaauuagcuuggguagugcaaagcccugcagaaaacacuucacaggaacaaaagaaaaaggagccaauggaaaagucugggagaggaggggacucaugguaggucucugagcgaacuccaacauuugcaagauuuggaggcuuagaaucauuaaaacacuuggccagagcuggcuaugccagagacaggguucucgcccacuccuacuauuuggguuccuaccuugugugugguguucaccuaccguuguaaggaugaccgucuguuccuugugcauugggagucacugucuguucagucagaugccuuucccucuuccucauccugcacaguucucaucuccagggcccagaucuguucccguagggcuucugucaucagggguuccaaacuuugaagguaaugugcagaaagacagaagaauauacagauaaguguacucagguacuuuauucuugcugugaccaaaauccugguaagcaauguaagggaggggauaauuuugacucaguauuugaggauacaguacaccaugacaagaaaaccuauugacuagucauauugugcccucgagaagcagagagaaauuaaugcugguacucaguuuacuuucuccuuuuuauucagucugggacccugcuuguuuaaugguccuacccucauuuaaggcgaggcuuccuucuucaguuaagccuuucuagaaacgaucucauagacauaucuagagguguauuuccaugaugauucuaaaucuggucagauugacaaugagcagugaccaucaaaagaguugcggacauaccuuccaauuaaagcauuguggguggcaguacaugaggugaccugaaguguuuagaaagugcaaagaagguccagcaaguugacucagcagguaagggcacucaccacugagcccaaacuaucugaguuaaguccucaagauaaacaugguagaaggaccgaaccaauucccacaguuguuaucugacuccccccucccaacauauuccaugccauguauggcaugaguaaacacacacacaaacauacacacacaaauccacuaaauaaauacaagaaaaugcuaaggacgggggguggggggaagugcuaaagguaaggcuuucaaaagaugaaaaacaagaagggaaaaugagaaugaguuuccacucucuggggaaagagcucagcuuaaugguccuuccugcuauaaacccuaugauugcacagaccuuugcuuuuuuuucugcacugaggguagaaccagccccacccccacccucuggcuccccaacuaggcuauauauccaaccugcuucauacucuaucaggucuccuaagauaagcucuggccucuguucacuccgguaauuuucucuuuucauuucugcuuccagucauauuguccuguuaucaucaucccgugaaacuauauuagaaccucccucaucauggccuguuccuuucaucacuacuaggcaaguugucaucuuggaggaucuacccuccaugaacagcagagagucucaggaaggaacaguuggcaucagccuugaccaugaaucugucaacuuacacucuuuucauauguucucuuuaacaugagaaagguagaacaaaacugaaacccaagauggccuaaccucauuuuaaauaccacccagaguuccugaggaguaacugucaugaacugcauuucagaagugcuguggagauuaaaccuaaagacacaaggacgggacacaucaucagggguagacguugaagacuagaccaauaaucuuggcaggaaaaccuagagcccucucuaaaaggagaugucuugaaccaucuuuacagggaaaagcaaggaucacugccaucagugcagguucauuaagagcaaagcacgugggcuauggaccuuggcauacuccuguaaugccagaauuugggaggcaggaagaucaugaguugagggccauccugagcuacauagcaaguuugaagcuaaccuaggcuacacaagaucucaaaaaaaaaaaaaaaaaaaacuaguggaaaaaaaaaaaaaccuuaaaagcuaacaugguuaucagguacugagaucaagggaacaaaugaccucaaguuacaaaugaccaaaacccagagcaaaacuuccacaaaaccaaaguugaaauaccugacgacuccaaccccacuaauacucagauauaauaacacagauuugagaagcaguaagcucccguaugucuuugugaugauuaauaacguuuucaacuugacagaaacuaaaauaaccugggaaaugggccucugguucucuuaauuuauucauugaaguagguagacccaccugagucugggauccuggauuguacaaagucaaaaaguaaacugaacaacaggauguauuauucauuauucucuguagaugugacuagcuuugucaagcuccugccaacuuuucuucccuaccaguaacuaggagcuaaaauaaaccuuuucuccaggccagugagggacccuguuucaaaaaaucaagaugccuaagaacaagcaugugcacaaacgcacaugcacuuaagacugccacacaguguagucuaucagcuccaaaaguuuccauccaccccaguagccuugguuacuuuucuacuguugugaaaagaugcccugaccaaggcaacuuauugaagaaaguuuauugggcuuauaguuucagagagugagcccauugccaucaugacagggaacaugguagcaggaaggcaggcaggugugguccuggugcaguagcugagaguuuucuuccuuaccugcaaacugaagccauaaacggauagggaacagcauagacuuuucaaaugugaacaucuauauccagcgacagaccucugccauaccucgaauuuuuucuaaacagcuccacuaacugggggacagauguuaaaauauuugcacuucugggggccauuuucauucaaaccaccauacccauuauguauggauguaugcauguuaauuguuuuauuuugcaauuggagaacaacaauguauaucuccaaugaauuuuaaguauaugcuucaauacuguuaacugugauuauuaugcuguacagcagauuucuagaacuuaccuaccuugcauaacagaagcauauccugaucaauaccuuacuaucccuccuccccaagcuauugacuaucacuuuccuauacucugcuauacucuaugaauuuaaccaaucauuccucuuaaaaugggacccuaugguauuuguucauguuucugagcauaaucucuucuagaucuagccauguuguugaaaaugguauguuuuccuucucuuuuaggguggaauauuguauaaguguccuaauuuguuuacucaccaauagacuuuuagauuguuucauugucuuagcuaauaugauaggcaucugaauacacauaugucuaugauuuugacuucagcuccuuuggguauauaucaauagaugggacuguugaaucauauggaaguucgauguuugauauuuuuaaaggaaacuuuauauuacuuucauaguagacaccauagaaauuuauauucccaguuuguaccaauugcacacuuacugcauucaccuguuaugauuucuuuaaauauccuaauacauauaugcuucuugucuucauuugcauuguccugagaauuagacacaguuaaguaccuuuuacauauauaacaggcauuuguaugucaucuuuggugaaagauaauaucuaucacaucuucugcccacauuuaaaaaucacacuugguuuucauugcuguauuauagucucuuggauuuuuuuuauuuuuuauuuauuuuuauuuuuauuuauuuauuuauuuauuuugauuuuuuugagacaggguuucucuguguaguccuggauguccugaaacucacuuuguagaccaggcuggccucaaacucagaaaucugccugcaucugccucccaagugcugggauuaaaggcaugcaccaccacgccuggcuuggauuuucuuauaugauuuauauuuauuuuccugcucuacagguugcauuguuuccuugcugaauuucuacuuuugugacuucagcugaaauuaccuuuuuucauuuugauguaaucccagugguuuugcucuugcuaucugugcacauucagcuggaaccccccaccuccuguucuccgcuaggauuuuuuuccagguuuaacauuuaauguucucugugguuuugguuuguucugucuuccagccagagccucucugauagcucuuugugccuaaggacaaacacagcagcccuguggcuuacuuuuuuucccacccagcuccaucacccacaggcaggaaccuguagacagguuuaucuccucuagauagagacccauuugcccacauggugaaugcuuggauucagggaaucaggacauacagggaaucagcccuacagccuagccuccuuagcagggcuguauaggaugaauuguucugauccucaggugcaagaaaagccuguuuugagauacaacauuuaaugagcaccuuaauuuuuuaaauuauuuuuaaacuuuuuuuacagucuagucauuauccuucucccagggucuccccuccaacagucccucaucccauuccuccucccccucccccaagaggauguccucacucauccccacccuaccaggccucucuacuaccuggggcuuugccaauagggacccugguccucuaaccccuaugauguuucuguucucccuuccauaaugaagaggucccagaguuugacagugagaaauaaaacagaaaguaaagcaguggucuuuaacuuaaucagcauguauagcguuagcagaauccaaauauaaaccacauuuccucaaaaauauuuccccuuaauucuccaauccacguguauuauaugaaaaaucuaauccauauguuucuuacucauuuacacuuaccucaucaaagcauuuccucuguagaauuauuugauguccaaggagacuuuaaagacuuuuuucuuuuaaugagccuuuguucuuagaaauaaagaaguuugcccaguuguauaggcaaagacuacuugagcuccagagaggucaaauguuucaagaaaguucuauauuuggaagaaacaacuuugagacuguguucuuuuuccauugagagauuucucuuuuuacuuuuuaaaaagagauguucucaauggauuagagauuacuagguaaaucaagucuauuuccuuacagugcucuaaagugauauuuggcuuuaauuagaagagaugggcuccuaauuuuggcuuuugagagcuuguagcuaaaucuuccucaaggaaguugccuccuucuaagaccccaaccugccuaugcuggaaauaccaggguccucagauguuaaaagugucaugaaucuauagaacuggcucaccucucucauucuucucaguucuaaauucugcucuucauuugcugacauuucuaucuuugacucaugucugagcugaacucuacccugcugcuuugggagaauagcauguggugggagaggcugcccuugcucuccaaugauuagugacuuuacugagagauaaagcagucaguguacauucuuggacagucaguauucagaacuucuaggaagggaaggcuggucuaugucuaucagcacauggaaggcuucccagagcaguuugccuggugaucucggaacagcagccuggacacuagcauagcauucuuggacacagguucuugggaugcuaucaauuggauauuucuugagauaauugggauuaacauuuuuguuuggugguguugugcaggaaagacugagagcucaggugaggagagugugcaggaccaaggauggugggguucaaagucuuugauggucuuauuauugugcacuccuuacccagagaaaaccaagcuguguagucagucaaucaguugcaagaacugcauuaggaccaucaacuacuauuccucaaacuacuuaagagucuuacaacccacccaaaauguucuccuuuaaagcaucacagacaaagguagaaggagagggagaggacauugugguccagagaaaacaucagggaaaaugaaaucugugugucaaggaagagcacagguuugaagggaaagacacuguagucgaggcuucuggcucaaucuaaaccagaggucuguccuccuguugaauuguugcaggccaagaugggaccuauggauggauaggucuguuagucaagagagugguacagcacaccaaacaaugacuauuggaaucaccaaguaugucuuuuauaugcauaauugcugcuucucagggagacucugcugcacugaaacuggagcucuggaaaacagagcauugcuuaaucuuaagcaccaguggcaggaaggucaugaccuccaauaaauaagcaggugcaugauaugcuaauagccucaggaugguucuuacacugacauauuacucuauaaucaauuuauuucuuaccccaauugagcauucauuuagguucaaaaaaaaaaaacuauuugaaagucuuugagccucaaaccuaucuuagauauaauuuuuauaauuuuuauauuuuauuccauuuauaucuauacuaauuuucauaauaaaauaagcauauaaauagaaaauucuacuuugauuuauuggaacauauugaaguguuauuuuuagaaaaucacaucucugauggaaauacuauugcuaccaucugagguauuuguuaugugguuaguggugauucccuguacccauucaaucaucuggcuauuuggcguucaugcguuuauguuuaaacauaacuuugaaaugcauuuuuccuuauacaguccuuuccuuuauucuucuuguuagaguaaggauauuggacucuuuguaaaaguuucuaaguguagauaagugauaugauuuaugaaauucacugcaggaggacaguggaguaguuaaaaaugaauucuuaugaaggaggguugggauugauaggguugauaaucagugauauuagccucuuuccauccaauaugaguguaauaugagacaaaaauuuaaauuuaaacuuuaugccauuuugacacaauaaauaauggaauagaauugauuuuaaaagggaaguaagcucugucccgugcuauagcacagaugacuucugccaacauggugcuaaggaaaagaagccagucacaaaaauacaaauaccgugauucuuuuucucugagguaucugcuuaagcacucaagucaguagaaaguggggugguaguggccaggaucuggagaaaagcaagugggaaguuauuauuuaaugagcacagagauacagauuugcaagaugaacuucuguauucucuacaacaauagaacaauauucaacuuaauaauaauaauagccaaaaugacaaaucuuguauucuguguuguuucaaccacaauauaaagauucagaggaaugagugcaauuaaucucaacaacaaauuuuuuuaacuuaauaugcucagaaugcuuucauuuuaauguguaaucaacgaauggaaaauuguugauaagaaauuuuauguuucuucucuuguacaaagccuggaaucugugugcaucuucuagugcauaucggccauuucagucaccuguggccaguagcugcaguauuagauggugacacugguuaguauuaacagaugacauuuccagagcagaccaugggguuuaaacacugcuuagagucaguccauuacacagauugacucuuuaucuucacaagggcacuuugagauaggugccaggaugcugaaccucagagaauucaaggaacauaccugaggucaagaaccaaguggacggcuggauccaugcauucuuaaucaagagcuuagccuucccuaagaugccuuucugacuuuuucauaaaaguuucuuugauugucucagaguagcagagccccagcugggcaagcuuuaggacauuguguaugugugcagcaagcuuacuauucccugcuuuccugugugagguugguagagacacucaagggaguuucugagcaacagaaagaaacuuguguuugguaaacacgcauacacacacacacacacacacacacacacacacacacacacacacgggguggggguggcuguuuuguucucuguuccaugauuccauuaagguaguagugagacugguaaauuaagacaaaacauagcugugacaaaagacucuguccugacauacacaucuaauaaagacuugcuaucaggacuuugcuggugaauugccuacauuccaauaacuuuuucuuuucaguguuccauaaucaagaacgauuucuucauuuccuggggcucucucaagauuauucugggcacaagccccuuccgcuccacucgagcccugagguaccuugccagcggagucucgcccaacacccgcaagggcccacacaggauuccccacgggauccuaagaccucuggugaguggaacacagcuccugccccaauccaaucgcgcggaaccugagacugcgguaaauagggaagcagacuacccgggccugaccuggggcacaagccccuuccgcuccaaucgagccccgggguaccuugccagcagagucgcccgacacccacaagggcccacacaggauuccacacaggauccuaagaccucuagugaguggaacacaacuccugccaggaguccgguucgaacaccagauaucuggguaccuucccugcaagaagagagcuugcgugcagagaauacucugcccacucaaacuaaggagagagcuacccucccaggucugcuuauagagacuaacagagucaccugaagaacaagcucuuaccagagacaaccauaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacaaccaaacagguagaaguccuuaaagaaaaacaggaaaacacauccaaacaggugauggaaaugaacaaaaccauacuagaacuaaaaagggaaguagacacaauaaagaaaacccaaagcgaggcaacgcuggagauagaaacccuaggaaagagaucuggaaccauagaugugagcaucagcaacagaauacaagaaauggaagagagaaccucaggugcagaagauuccauagagaacaucaacacaacagucaaagaaaauacaaaaugcaaaaggauccuaacucaaaacauccaggaaauccaggacacaaugagaaaccaaaccuacggauaauaggaauugaugagaaugaagauuuucaacuuaaagggccagcuaauaucuucaacaaaauaauagaagaaaacuucccaaacauaaagaaagagaugcccaugaucauacaagaagccuacagaacuccaaauagacuggaccagaaaagaaauuccucccgacacauaauaaucagaacaacaaaugcacuaaauaaagagagaauauuaaaagcaguaagggagaaaagucaaguaacauauaaaggaagaccuaucagaauuacaccagacuuuucaccagagacuaugaaagccagaagagccuggacagauguuauacagacacuaagagaacacaaaugccagcccaggcuaauauacccggccaaacucucaauuaccauagauggagaaaucaaaguauuccacaacaaaaccaaauucacacaauaucuuuccacgaauucagcccuucaaaggauaauaacagaaaagaagcaauacaaggacggaaaucacgcccuagaacaaacaagaaaguaauuccucaacaaaccaaaaagaagacagccacaagaacagaaugccaacucuaacaacaaaaauaauaggaagcaacaauuucuuuuccuuaauaucucuuaauaucaauggacucaauuccccaauaaaaagacauagacuaacagacuggcuacacaaacaggacccaacauucugcugcuuacaggaaacccaucucagagaaaaagacagacacuaccucagagugaaaggcuggaaaacaauuuuccaagcaaauggucugaaguaacaggcuggaguagccauucuaauaucggauaaaaucgacuuccaacccaaaguuaucaaaaaagacaaagagggacacuucauacucaucaaagguaaaauccuccaagaggaacucaauucugaauauauaugcuccaaaugcaagggcagccacauucauuaaagacacuuuaguaaagcucaaagcacacauugcaccucacacaauaauagugggagacuucaacacaccacuuucaucaauggacagaucauggaaacagaaacuaaacagggacacagugaaacagaaguuaugaaacaaauggaccugacagauaucuacagaacauuuuauccuaaaacaaaaggauauaccuucuucucagcaccucacgggaccuucuccaaaauugaccauauaauuggucacauaacaggccucaacagauacaaaaauauugaaauugucccauguauccuaucaaaccaccauggccuaagacugaucuucaauaacaacauaaauaauggaaagccaacauucacguggaaacugaacaacacucuucucaaugauaccuuggucaaggaaggaauaaagaaagaaauuaaagacuuuuuagaguuuaaugaaaaugaagccacaacauacccaaaccuaugggacacaaugaaagcauuucuaagagggaaacucauagcucugagugccuccaagaagaaacgggagagagcacauacuagcagcuugacaacacaucuaaaagcucuagaaaaaaaggaagcaaauucacccaagaggaguagacggcaggaaauaaucaaacucaggggugaaaacaagcaaguggaaaaaagaagaacuauucaaagaaucaaccaaacgaggaguugguucuuugagaaaaucaacaagauagauaaacccuuagcuagacucacuagagggcacagggacaaaauccuaauuaacaaaaucagaaaugaaaagggagacauaacaacagauccugaagaaauccaaaacaccaucagaucuucuacaaaaggcuauacucaacaaaacuggaaaaccuggacgaaauggacaaauuucuggacagauaccagguaccaaaguugaaucaggaucaaguugaccaucuaaacagucccauauccccuaaagaaauagaagcaguuauuaauagucucccagccaaaaaaagcccaggaccagacggguuuagugcagaguucuaucagaccuucaaagaagaucuaauuccaguucugcacaaacuauuucacaaaauagaaguagaagguacucuacacaacucauuuuaugaagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagcaaucauccauccugaccaaguagguuuuauuccagggaugcaggggugguuuaauauacgaaaaucuaucaauguaauccauuauauaaacaaacucaaagacaaaaaccacaugauuaucucguuagaugcagaaaaagcauuugacaauauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaaaagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauaaacucaaacaagucaauggccuuucucuacacaaagaauaaacaggcugagaaagaaauuagggaaacaacacccuucucaauagucacaaauaauauaaaauaucucggcgugucucuaacuaaggaagugaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaauguaauccccaucaaaauuccaacucaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaauccauccaguggaagaaagacagcauuuucaacaauuggugcuggcacaacugguuguuaucauguagaagaaugcgaaucaauccauacuugucuccuuguacuaaggucaaaucuaaguggaucaaggaacuucacauaaaaccagagacacugaaacuuauagaggagaaaguggggaaaagccuugaagauaugggcacaggggaaaaguuccugaacagaacagcaauggcuugugcuguaagaucaagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagagcugaacaaagaauucucaccugaggaauaccgaauggcagagaagcaccugaaaaaauguucaacauccuuaaucaucagggaaaugcaaaucaaagcaacccugagauuccaccucacaccagucagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaugccccaaccaguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagacaaauggauggaccuggagggcaucauccugagugagguaacacauucacaaaggaacucacacaauauguacucacugaaaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagaaacugccauauccagggauccaccccauaaucagcauccaaacucugacaccauugcauacacuagcaagauuuuaucgaaaggacccagauguagcucucucuugugagacuaugccggggccuagcaaacacagaaguggaugcucacagucagcuaauggauggaucacaggacucccaauagaggagcuagagaaaguacccaaggagcuaaagggaucugcaacccuauagguggaacaacauuaugaacuaacuaguaccccggagcucuugacucuagcugcauauguaucaaaagauggccuagucagccaucacuggaaagagaggcccauuggacacgcaaacuuuauaugccccaguacaggggaacgccagggccaaaaagggggaguggguggguaggggaguggggguggguggcuaugggggacuuuugguauagcauuggaaauguaaaugagcuaaauaccuaauuaaaaaugggaaaaaaagauuauucugacaauuucccuauuaauuaucaaauuauguucuguugcaaaaugauuacacuugcuuccuaccuaaacacaccuauuuuugaaaagucucauuuaaauuaauaugcuuuaacuugcuuaauuuuaacaccucuuuugaaacucuuuagagcuguuuccuuguugggcuggucucucagcccuuucucuguguucucuguuccaagaccacuuuuguuucuguagaaaagaaaagggcaugucccuggagugaaaugcuugcuugguacuuuuuggagugguggguaaacauaaauaggugacauauaguccaaaccuccugcaaaaguuaaacugcauuccuugcuuuaaaugugaagauugccugagagugggaccacaauaguaaaccauucucccauuuugacugagcagcuuaaugacucagauaauuauacccagauucccuuuacaggagcaucuuaauuauuauuuaauacagagaugauuccaggcuauaauaauauaaccucagagcuagagacaugcuucucucuaguuauuaacuuccucugucagggggaauaagacacuugacaaccucugaguccugccuuauggagaaaagccagugccaagagcuccucucccuggcacugucuuuuuccaaggugucagcugggucacucugcuggaguguugggaaucaggugagucuguuacucugauuaacccugaucucauucuuuuagcauaaucaguagccagagucccuguugcuuuccaaaggguucccacuugugccagcaccccugguaggaagaagggugaugagugcacugagccugcuuggguccuaggagcucacaauacccagggucuccugaaacuuuuaugugggcaucacuauacucucccccauuuuauagaucaggguagucuuggucaaguugacacagaucuauauauaccuucagauaugaaaucucauuugaggaaucaccuccaucagauuggccuguauuauauaagccuggacugcauaagaaagggagcugagcaagccagagaaagagagccaauaaguaugauagucuuugccucaguucuugccucuagauuccugucuagagcuuacguaaugauuggcuguaaccuauaacccaaauaaacucuuucaaacccuaaguagcuuaugguaaguguuuuaucauugcagcugagaaguaaaccaggguaguugcauauaccugaaauccuagcacuuggcaagaggcaggggguagcaguuuguucccuguagaagaggggaaacuaagaguucaaugucauccuuugccauacagcaaguuugagaccagccugagcuaugugaaacccugucucgaaaacaagaaauaaaaucagggaaaugaugauuucagcagcugaacagggaacuaacugguggcagagcagacucaggaugcacaugguaacaguaggugaugagcuugauuguacacagcucugguccagcuuggagcaguuccauuaagcuagcacaguauguucuaacacugugacuaaggguguacugugcagccacccacugcucacagccacagaugugacccaugcauccugaccugugccucauacccuguuuuuccuacuuccagaacuaucaauuacuaacuacuuuuacuuuuuuuguuuuuuguuuuuguuuuuuguuuguuuguuugguugguuuuucggaacaggguuucucuguauagcccuggguguccuggaacucacuuuguagaccaggcuggccucgaacucagaaauccaccugccucugccucccaagugcugggauuaaaggcgugcaccaccacugcccggcucuacuuguacuuuugucuuugaauugccuugccaguuuauaaggacagguuuugacuucuugggagggcauggguaccuuuccacaaaaucuacuuuuuccugcugcuuaguugagccagcuaccuuggcuuacucccuccuggaguggaagagaagaauggcuagcauuaaaaacaaacauaggaccaugcuguggaaaacaggcuccugacaauuuggcugugucuacucaguaaauucuuggggaggaaaggguuuauucagcuuacauuuccacauugcuaaaggaagucgggauuggaacucaagcaggacaaaaagcaggagcugaugcagaggccauggagggauguuauuuacuggcuugcuuccccuggcuugcucagccugcucucuuauagaaccaugacgaccagcccagggauggucccacucacaaggggccuuuccccccucaucacuaauugagaaaaugccccacagcuggaucucauggagucacuucccuaacugacgcuccauucccugugauaacuccagcuugugucaaguugacacacaaaaccagccaguacaauugaccuauguucauagcagccuuauuuauaauagccaggagcuggaaagaagccagaugucccucaacagaggaauggauacagaaaauguuguacauuuacacaauggaguacuacacagcuauuaaaaagaaugaauuuaugaaauuccuaggcaaauggauggaucuggaggguaucauccugagugagauaacccaaucacaaaagaacucacaugauaugaacucacugauaaguggauauuagcccagaaacuuaggauacccaagauacaauuugcaaaacacaugaaacucaagaagaaugaagaccagaguguggacacuucgcccguucuuaaaauugggaacaaaacacccauggaaggaguuacagagacaaaguuuggagcugagaggauaggauggaccauccagagacugccacacccgggcauccauuccauaaucagccaccaaacccagacccuauugcauacgccaggaagauuuugcugaaagaacccugauauagcugucucgugugaggcuaugccagugccuggcaaacacagaaguggaugcucacagucaucuauuggauggaacacagggcccucagugaaggagcuagagaaaguacccaaggagcuaaaggggucuguaauccuauagguggaagaacaauaugaacugaucaguaccucccggagcucgugucucgagcugcauauguagcagaagauggccuagucggccaucauugggaaaagaggccccuuggucuugcaaacuuuauauguuccaguacaggggaacaccaggaccaagaagugggaguggguggagguggggaggggaggguagaggggacuuucgggauagcauuugaaauguaaaugaagaaaauaucuaauaaaaaauuggaaaacaaacaaacaaaaaacagaagcuaauacugaugaagaaauguuuucuaagugacaaaaccagagacaggggaaggggguuguuuuagucgggguuucuauuccuguacaagcaucaugacuaagaagcaaguuggggaggaauggguuuauucagcuuacacuuccacauugcuguucaucaccaaaggaagucaggacuagaagucaagcuggucaggaagcaggagcugaugcagaggccauggggggauuuuacuuacuggcuugcuuccccuggcuugcucagcuuguuuucuuauagaacccaggacuaccagacuagggauggccccacccacaaugaacccuccuacacuugaucacuaauugagaaaauuccuuacaacuggaucucauagaggcauuuccucgagggagucuccuuucucugugauaacuucagccuguaucaaguugacacacaaaaacagagguuauauugaaguaagaaagagaaugaguaagacacauaugcuugucuuucucacuggccaggucagccacucuaucaugagcugcagccucacccuuuucucuacacauauaaaggcugaugaaccguccucauccccuaccaaaagaaacguccuugugauuucugucugccugaagugagaaagaauccugccuacgagcagguggauagcuuacuuguucuuugagauaguuuuucuuuccucucauaaaccugagaagcccaguuuguuugaugacccugaauaauugaaauuuagagguauucagaaagaugaccuccuuuugucuccauaaaguaacuguaccaagacauuuuucaaaucuccaugauacccaguugcaccuuuaugaguccucauuccgcaguuugguuucucugcagguaacucaagcaucccaguaggaauugaagccugaucaugaggacaugcaugccugauaccuagguccauggagaaaucuauuaccaauauucugccaacuguauauguaguuaaauaguuuucuaaauauuuauauuuguacugguauacuaguauaggucucauucuuggucagaauuuucuuuguaaugauuaaaacagggacucauuaacugagaagggaaauucugagaaaagugacuguugcaguuauucuccaacccaaauaugcccuggcaaugaaagcacaacucaauuaauaugaauacaaucugugcaccuagauugggcagaucuaccaccacacuaccaucuuccccaucuaugagaccccuuauaucuugugguuucuccaggcuauguacuucugcucugcuuuccuuccaccuccuccuccaucauccucucucucucccacaccuccuucuucucucucccaacuuucaacuccaccuuuccuuccucugcccaagguugaagaagguuuacaggaaaucaccugagugcugacucauugguuguuggcaguuccccccaggagaacagaauuagcaucaacuuacgaauagccccagggcuaucugcaacaagugacugccaaaugcuaaccuccaaacaggacaucacaucuucuaaggucccugggacaucaagaaagauggauggaggauuguaggaguugaagaaugggagaugcacagucaggcacugaauucuggauaugacaugccccagaaaucacccacacccaugacugugacugagucugcaaaaaagggguggagcaaggugacacaggccuuugauaccagcacuuagaaggaagaggcaggcaguuuccuaugaauugcauauauugauguacauacugagucccugucucuaaaaaggaggaggaagagaaaaaggaagggggaagaaaagaaaggaaggacagaaggaaggaaggaaggaaggaaggaaggaaggaaggaaggaaggaaggaaggaaaagaaaagaaaagaaaagaaaagaaaaaaagaaaagaaaagaaaagaaaagaaaaggaaagaaaagaaagaacaaacgaacaacuuacugguagugaaagacuccgaaaggagccccucgcucaggccucaggacaauagcggggacacccaagaacucacgauagaccgagauuguugcaaaccacaugaggcuuuauucugggaaagccagagcucugggaaugacucauaucccaugcagggguagaggagucaaccucgaggggaaagugaacccaguuuuuauaggcccucaggggggaaaggagaagugggggaguaggggauuuccagaucuaaagaauaucuauucuaaaaugauugauuccucaagaaauggguaugggagggaaacaaggaacgagucuaaugaaggugcagcacuuugauuggccccaacuaugguugcuggggagauuuccugacucuuucccagcaaccaauaucacaaacaccuggcagugaggugcagcaaugggcacacaccuggucaggucagaacauuggcauacacacagguuugaggagcagccagagcauugugcaccucuauuuuucuaaaucaaugaagcuaguucuacuaacaaugaaaucuauuuugccaauuucagggauucugugaccuuuuacauucugucaggaucuuucaguaggaaaggaacuacuuauaacuugauaagaagggggucaguaaggaguguguggguacugagaaacaguaguggcaauuaguaugguuacagugaauugcaugcaugaauuaaacuaucaacacuuuuuaaauucaggcuaggucccaugcucagaaauaaaugggcagccuaaauuggaccccaugaauuuagugacuuacuuuauuuuucauuuugaacagagaaagaaaaugaaauuggguugauagagaaggaguaagaaucugagagaacuuaggagauggaaaaagaacaugauuuaaaaguguacuauaugaaaucuuaaagaauaaaucuuuaagagaaaaaaaauuuaacuaauaaauagaaacacaaacauuuuuauaacugccauacauaaaucuaugagaaauuacaguauucugcuuauuugaaacauuacuaacauugaagauauaaauaacauagugaaauaaacacaggaagcugacauuuaagaaaccauauaagaaacuagucucucaggguuucucuccagcccugaaacaaaauaaguugcacagauugaaaucagacuucccauauauuugaaaccuagguaaacccugucuaaggagauagaauuuaaguaugagggaaauauugaggaaaaucuaaacugaaauaaagauggaaaugaaacugaaaaguaagugggaaacuucaguggaaagucucaccaacagaaugcaccauauggagaagagaacaucagagcacagagacaaagaagaagaauugaauaauuuagucacagagaauaauaaucuuaacuacaugaauagaacaugcaaguugcucuugcccucuugcucucuugcuccucucuugccuuccugaucucacucucuccccauuccccuccccaucuuucuccaaaugcacucucucuuccucucucucucucucucucuuucuuccucucucucucccuuucucugccucuacuacccuguuaacuccacuccccaugcccugaauaaacucuauucuauaugaaagaaggaaagagagaaagagagaaagagagaaagagaaagagaaagaaagaaagaaagaaagaaagaaagaaagaaagaaagaaagaaagaaagaacauaugaguuaucaaaucuauaaauuacaggaauugaugaaagagaauauuacauugcaggaaauauuaaaaaaugaaccagcaggcuuuccacgcuacugccagcaaaugguggaccacauggcuccagccagaugaucucaaaacucuugaacuuuauaauuaaccaaucagauuuauauaucaauaaauucucaauuuacaagaugccaauacaauaauuucaaaaucaauugauaauaguaaaaguuuuaucucaauuaaucuaaccuuaugauaucauaacuacccgugacugguuaaagccaugcugguucacgccugccuccaucuuggccuuauucucucuccccugagaugcucucugucucugcaacucuucacucugccucucuuuucccuguccaauuacaggccuccugcugcacuaauguaauuggagagggaaaauccugugacauuauuccaagacacagaaaauauuuuuaauaaaaagcacagaagaaauuuuucaagcucuaacaaaaggcacauccagguagaagaggucuauagaacacucaaugggaccacaucauauuacaguugagucaccguaugcagaacaaagaacaaaguauugaaacugaaagaaagaaagauaaaaucacauaaaggacagugacauucaauuaacaguuucuguuugcacuggaaacccuaagagccagaaggcaugggaagauguaucucacguucucaaagucuacuaccacuggcaaccagacaacuaugcccuccaaaaucaucuaucaaaauuuaaggaaaaauaauaacaucucauguuaaaaaaauauacuaaagggacuuaugaucacaaagugaguucuacagagauaaacaaugcaaaggaauacuguacacugaagaaagaugaacacaggacaaggcuacagggaaauuguaugcacuaggacucuugugaaguagcagaugacuuagaaaaugaagcacugccuaaagaaagacaagaacugaaauacacaaugacaccucugaauaugaauggucucaagcccuuaaucaaaaguuauaaccuugaaggaugaauuagaaaacaaaaucacaccuuaccaucaaaauacauauuaucuuaaaguggaggaaaagaugaacaaagguauuccaagcccaugaaucaggacauaaugacgaggcaccacuauucuaauaucucacagaaacagacgugaaaguaaaauuucugagacuagauaaagaaggcauuuaacacuaaggaaagauaaaugagggggacacuauacuucuaaacauacacauacugaacacauaaaacaaauacuaccugauauaccuuuuaacaaaccaaguaaaauuaggugacuucaauagccuacucuuacuggagacaggucaucuagacaaaaacacagagagacaucaguguuaaaccacaccacagagcaaaugaacuuaacagacaucuacaaaguauuccacucacugcuucagaauacauauuuaaaaagcaguccaugagaucaucuuaguuacuuuuccuguuauugaaauaaauuauucuaauaaaaucaguuuaaaaagaaaaggacuuauucuggcuaacaauuugagaguauagccuaugaugacagaagcaagagauugaggagcaggacacauuacuauuguguagcaaaguuugcgagauaaaauugcccaucuugaaggauacugaugcucugcagggagguaaaacaucccauccugcagagaaguugguuaagcuuagggaaugacaacucaaaagacaagagauagaacagucccucucuccccaagaauauacaagcaaaaaugccugcuaagagccacucucagacaagccacgcugcuugaaagagcucagaccaacuggacuucucacaaaggaagcuuucccaccuacugaauugguuacaaguuguucagugcacacuaguuuuccauacuucaugagcuguuaugaguguugggguggguuuagauaaugucuuuugaguuauuucugcuccuguaaguagccucucacccagauuccuggugauaacaccagagaaagucaaugauucacaaaguuggacuuugggaccauccucgcuuugauggaccaugagaucccuuaucugggaugaguagacagauauuugcauaccaccagaaauauuguuacccaauagucuaacaauagaaaacaacgaauaccagugcccaacucauauucuccacuuacacaauccauaucucaccucagggacucaugccauccauguugagguugggucuuccgaagcaaguuaaugaagaaaauucaucauaugccugaccacaggguagcauaauucagauuauccuuuauagaggcuuuuucccuaggugauuacagauccuaucauguuaaaaaucaauacuaaucgucacaguaacuuacucuaaaauggcucccaaaugaaagagaaauuaaauuucaacaaauauaagaaaauugaaaaaccuuccugcauucugacucaucacaguggaauaaggcuagacaucaacacaaaaugaaacugcagagaauacauaaacucacacagacaaaccaacacuacugagugaaaacuggguuggugaagaaaucaacaaggaaauaaaaaucuuugaaaacagaaugaaagucaggaugcaacauuucaaaagcuaugggauacagugaaggcguuccugagaggggaaucucauagguuuacaugugcauguuacaaacucagugugauugcauaaauaaauaacccaacgacacaccauaaagccuuggauaaacaagagcaaaugaaauccaagugugguagcugaaaagaaauaauuaaaaucuggguagaauucaauuaaauagaaucacacaauaguagaaacuaacauaaagugaugaaauagaagaguuggcuccucaaaaauauugaaaaaaccuuagccaaauuaaucaaaauauauaaguuuuaaugacaugauauaaaaaagugaagcauugcaguacauaccaauaaaaaccgaggaccauaacaaccuaucuuuuaaaaacaaccuacugucucaguuacuuuucauauuacugcaauaaugugcacaacaagaaaacuaaagggagaaaaccuuuaauuuaguucauaucuccuaggugagugaaaucauagcagcaggaacuggucucguacaucuguagucaagaagggaguuaugaaaguuuaugcucaggccuccuguuccuuuuguauucagucuagguaaaagccuuggauaaacaagagcaaauucuguggcuguccuucucacaucaauuagcaugaucaagauacucccuggcacauucucuaagguuaaccuuagucuagauaauuucucacagguauuucuggaggcuugucacauuguugaguccagagucuguaaauugaugauugauauuaucacaccuauacugauauuaaucaucacaccuauauuucaccaugaugucauuuugucccuagguagaacacaaugcucuacaaaucugcuuuucucaguuugguguucuuugcaacaaagguggguuuucccacuucaaauaacuuaaccgagauacuucaugacaggcacagcaagaagcuuuucugugagauucuaaucuagacccugucagcuggacauuaaccaccucagguacauaaggcagacugagaugcaucaaaggcuuguggcguuauuuauauuugugggauuucucaacaacaacaaaagugcuugcugcucuuaagauauaaacaauaaauaucuaaugaagcuuccauguuauuugagugugaacguuuucucucguaugaauguuuugauaaguuucaaaaguaaaagaccuuuggaaaugugucacauucucgucuuugcgaugacuuuccuccuucucuaguaagcauggcauuguccaacacuaaggaagcuauccggaagagauggcauuucuuuccagagugaaucuuuugauauagaguaaugcuuaaauaaucauuaaaguuuugcccaaauccuuucuuuuuaacguuucucucaauaauuaauucuuugauguugaauaagacuugaacaacugccuagggcacugccucaaucuuugcauuuguacaauuucacucgagcaucagauuuuuaugucuaaugagggcugaauaauuaguaaaguuuuacaacauucucuacaauuguaaaguuuuaaucuaauaugaauucuaugaugucaaauauaagcugaguaaaagauuaauggcuuugcuacaucccuaguaugaguaggguuucccaccagaagccuuaauuuguuaguuuuccaaucaagauguuaacaaucauuuuacauguggcauuaucagaaauugcauauauuaaguugcuggagaaaauaauuuuuucaguuacauuuuuuacuguaacuggaaguugaauuugcuugaacuaaccugcaugaccagagacccaacuauagcaugaagcacaauccucauacug

SEQ ID NO: 7119 - RNA, 21392 nt, Mus musculus
uggcggucgugcggagcaugcgugcugugccgcgcgcgugcgcagugcucccggacugugccugucggaggagaacgggguuccgcgcgggaauucgcgccuggagguauucggcgggggacggcgggagcgacggaagcggugggggagccgggacucgcgccugcgcaguggggaugagccgcugaguuuuccggaccgcggugggguucacggggagcacuugggaggcggaccgcggugggguucacggggagcacuugggaggagucggcuccgccaccuuucccaaaaccucgugagcucgcacgugucacccauugguccugucgagucuguggcagugcuucccgaugaaccuuugaaggguuuguguccuagcuccccagcggauaagccacaagugcuuagaaacuaacuagaguugauucacucaggaaaagauaauuuuauauaggccggcuaccacucagcguuagccacuggauagaauggcggaguguggaaucccagagcccuuuaucuucuuuuucucuugguuaucuccgggguaaggcaugaauuagaaauaccgucucuguguaaaguccauguacgcugacuacugauagaugcaaugaugccaucuuugaugacgaccagugcuuugauuaggaucuagcaggaaacacgaacuccccaguuucacgugaacauuguacaguuacaguuuugguuuuuuaaagauuacuuauuuauuuuauauauaugaguauacuguggcuguacugaugguugugaaccaucaugucguuucugggacuuugaauucagaaccuuuacuugcuccggaggauccugcucgcuccagccuaaagguuuauuuauuauuauauguaaguacacuguagcugucuucagaggcaccagaagagggcgucagaucucauuagggaugguugugagcuaccaugugauugcugggauuugaacucagaaccuugggaagagcagucaguggucucuuaacugcugaguuacaguuuguuuuuguuuuuuguuuuuguuuuuuguuuuuuuuuugcuuuguuuuuaaacggcagaaacaauagccuuuguaagcgacacuguguuugagcauggcuuagccccuucaccauucaggcuuaugauccuaauucagaguacaaaugggcagaaaggcagaucacuccuauaguuaggcacuaaugaaugacagacacuugcaagacccaacaguagcuagaaaucaagaguggguuucacgccaucagggacaauucaaaaacgucacuuuuguauaccuccugucuuaauucucucauacugcgauucguuuaaaaucagugcuaaggaacaaguuuagagaaggcuguuugaaauuauguuuggguguccugcgggcuaccugcuucauuaaacaguguaccccuuucuuccuuuugugguuuuuagucucacuguuagaguugcagcugaugaccugaggugaugagaagguuuuuguuacuuuaugcuacacagcgaggacaggcaaaggccauagcagaagaaauaagugagcaggcugugucacacggguuuuccgcagaucuucacuguaucagugagucagaaaagguaagagcagcuauuccugugcauuuuccuguacuuuguuguggaaugaggcaguauacccauuuuuuguugcaggggguuugcccaagcuagccuugaacucacauuguagcuuuggagaaaugaacuuuggauccuccugccaacuagcugagucuaaacacagaauuauacauuugaauuagguuuaaaaaaaaccucacagccucauugcacugcagcccaucuucacuaggauagcuccuguugcuccucgguucuuucauuguuuuaaaguguguuuguuuauugggacagaacagggcucuuuguagaccaggcuggccuugaacucuagagagccacgggccucuuuuaucuuuguuucugccucaccuugacccuguaaaaccccuuugcucauguuacuuguguguguguguguguguguguguguguguaugugugugugcauauaccuacccauguacugccuugcugcucagcgugucccuugacagauaaugggccuguuuacuucucauguuuuccugaaauacagaauucgauaacagucuggggguagauggggcuuuucuugugugccauguggagggaaaaguguuaaacucuucugaccuccuggugccaucagcgaaagugaacuagccuuugaguuacugggcagcguuauugaggcaucuagucacagcacuguugaccaggauauguuuacgguaacucggccagaagaaaaauuagaaggaagcaugcaagacaggagaguggguucauugccuccaguugcuuugucuugaucuugccagcguguuaaaucacaaaucugcacuacuuacugcauccuuguuuuguaguaugaucugaaaacagaaacuggcccucuggugaugguuguaucuaccacggguacaggagacccaccugacacagcccggaaguuuguuaaagaaauacacaacaagacacuccccacggacuauuuugcucaccugcaauauggauuauuggguaacugacuguuucccuucuacuauaugcaguuacuacuuugauauaugaauauaucuuucaaaaucuugaaauaaaguugcauaggccuuuuuauuuuuauauaacuauuacaucuauguaaaauguagaauugucagucauucuccaauuugucuuaauucucucauacugugauucguuuaaaaucagugccaaggaacaaguuuaccccagagcaaugcucugaucucuccucccucuguccugggugugucugaggggucaaacccagggccuugcagugaggggagcacuuuaccacuuagccacaccccaaacgcuguacagaaccucuccagcagccuuggaacuguuucagaauguuuacuaaugucuaggccucacuccaaaccuucuaaaacagagcagcagucuuugaaggugcagacacuugguauauuucauuguuuaagguaacagcaggucacaaaaccaaguuauguucuucggaaauguucuuaauuacguucucuaagaaccugacuucagccuugcgguuuucagucgcuagcgcauuagaacccgcaagggaguuuuaauaacuccuuuacauugacuugcccugccagcagugacucugauaugaacaggaaggaccuguugucaguaguuagcucagaguguaaugcagcuugccaccaaggcuaaugaccugauuucagucuucaagagccacagaccacagauccugcacuugcccuacguuauaccaugguguacacgcgcgcgcgcgcgcgcguguguguguguguguguguguguguguguguguguguguguauguguguguauuuauauauacagaauagauuuuaaaaaauagagggacuaucauagaaaacuaugauaacuagagaggcagcggggguccauguagucugugugacucauuuuugauaacuaugcuugggagaguauccagcacagauaacugacacugcuuagauucuccauucgaaccccagccacaguuugguguaugucuaaguaguguuucggauguucuucaagcuuucuauaaagaugacauugaagccugacccagccauucuagucagugauguucccauguaugcucccaccucaccuucccuccgaugucaugucacggagacacuuuaaguuuccaauucugaauuuucaaguggaugcgaagcauuagcuuucucagcauacgagacaggcgcaguucuuuaacuguccugacagaggcuuacucagcaucugcuugucuugcuggugugccaaggccugcaggucagaaguggugaauacagcuggaugaagaucaguuuuugaggcuuuguaggucacaugguaucauagcugcuggguauuguuguggcuucggaacagccguggcauguaagcaagcagauguggcuguguuccagagaagccucccucacacacacagacuguguuugguucagagacuguccuuggcagcguguucagaguugggaaagugugcggaacagauacuguguuucaaagccagcguuaccaguuauuucagauuccuguauaguuaaaguaauucauggaaacagaaagauuaaauacguauauuucuuugacccguggccuguauuuguuuugugucuaucuggugcuuucaugauagaaacacauugcauacuuaccacugcugggacaaauaaggaaauguggaccuauacauuauacuugaugacuaucuuaugagugugggguaguauuaagaaauuuugugucacugucugucauaugauugaacccuccuucucccuaaguguguauuuggguucuccaggcuugggugacucagaauacacauacuucugcaauggagggaaaguaauugauaaacgacuucaggagcuuggagcccagcguuucuacgacaccggacaugccgaugacugugucggguaagggcaccgcacgucuaucuuuucaguaaacucugcacaugauggaaguugguuagcuuauaaacacuugcucugguuuagcacugacagucuucuaagagucuuuagcucugggacccaggaaggucugaugacuagaaccugguuggccuguguccuccaucuuccaugucccccuucuagccucccaguaucugcuaauggaauaagagaagccccagcacagcucacaugugucucaguauagauguauguguaagagugaacauuuucuccggccacagugguaucaccucuaugucuucucucugcccuacacacaggggugcuguuugcaucuccuauagugggacaagcccugcaggcugagcaucacugaacauggcuugucuuggcugucucuuuccaucgcaauggcuucacuauuugcccuuuucucauuuucauguuugcagcuugguauuuaaaccugugcacagccuucccaguccuccuaauguguuucucuucaggucuucagcacuguccugucacagucugcugcucagccuuugucauugcuguagccagauaauagcgcacauuuucuuuuugugguuuuguuuugauuagguaaaaaacugagcaacuuuuccgucacugugcuuaguaaaugaccuguuuaugggaauaaugaccucaguguuguccugcuucucgcugaugggggcucucauguuuccucuccuccugccuggugcccaugccuuccauaauuuccuucagcugcagacaauucccacaugcuaccugcucauucugcaccuucauuuugagcuuuuugugaguuauguuuaauuguaggauaaugcuucgauccauuaggcacaucuccuauaguaccgcacauagaugucuucagaggauccugggucacuuguucgaucaaguguuaaacuuccugaguguguuucaguacuguguaccucuuccccgcugagccuaagugcuuuaugugucugaggguaaggugccagugggagacauggcugugugauguucccuuccuccaucccccuaggcugaagcagagagugcguuugcacucacaugccuggguugacaucuuccauccccucuugaugaccaaaccuguggucacucauguuucccuuccugugauagauaauggcaggguguacugagaagcuucagggaguggucaaacagaccagugcuguggccuuuagcauugugcuucuucaggguggcuacugggugggcguuagcucccuucggcaugacugguagcguggucuuacucucucagauacaggagugaugcuuuacacguaacuuacugaugaaccugcauucaugaagacuccccaggauacaugcagggcagaguccauggauuuacaguccuaguccuaggaagaaaaaggucugagaugagccuccugugauagucacguaccguagugauuaggauuugacgugccuuucacuugagauaggaagugaucuuuuuuuuucuucaguguugggacacugucuugcccgagcccucuccuuaaccaccgcuguucacacaucucaggaacauggcggcuguguuagacuuuguuaguccuagcugaacuucugaaugugugauuaauccaacuuuucuuucaaaaauuaacugauuaaaacacguaaaagacacacagauugguagaaaggaaagggaagcuuuuauuuagucaaacauuuacuuuuaaugggggaugaugcuugaaggaagaggaucaauaaguucaguagacaaaauaaguggugccuucagcugauggagugaucauuuauaacaugagucugccugagcucuguuaguggcauccagauugaacacaucuguaaacugccagcucccuggagugcagauggccaaaaaugaguguaguuacauuccuguuaccagggcaaaaacagcuuugcaucucagcucuuuugcuccguaugcaugcucagauuguacagaguguuuguuaaucagcacagugcugugcuuuugaaaauuuauuaguuguauuuuuaguauucucuucaguacuucugacuguugcuuauuguccucugccaauaacacgcacaaacuacugcuguacccuuguuacaugcaaauggacaaccuaggcauuuggguuuucuugcuuuuuauccguaccaguuuagagcuugugguagagccguggauugauggacucugggcugcucucacaaagcacuuuaagucacucggaggacaagaaaacaugagugacacacucucacgagcaucagaugcccccuugagcacugccaugaagccggaguuguugcacauccagucacaaguugaacugcugagauuagaggacaugggggaaagggauucugagcuucgggaacaaaaugagacaaacaggggucagcagggucggaucgaagacuuugacuccucgcuugugcacucgguccccccacucucccagagcucucuaaguauuccugcugugcccccagaguauuuggagguccaucuucaagagucucuuggccaggugagagauuuacuuuaugcucugggcuuccuaugccuuguguucuguuuguuuuucaugucagagguccccagcaucuccuuugcuaugccuccuguuccugcagcagccgugccuguuuuguagugugaugucuguagaagugcucaccagaggucugcaaagaagaaagcauuuacuauccgacccucccagaaaagaugugcccgucucugccucaaauggcuugauguugcagaaguccauuuuuaugucugacaaagccuuucauggcaccacucucucugucuucacuuugaguugcugagucgucagcuugcuuacaucaucucuaaggugcucugagcucaucgaggugcagagccucggcauucaguccuauccaggcucucccagccuuuuguuaggcccuguguccacaggagcccaagaauugcacaacuugcagaagagucuuuucuuuuuucuuucuuucuuuuuuuuuuuuuuuuuuugguuuuuuucaagacaggguuucucuguguagugcuggcuguccuggaacuuacuuuguagaccaggcuggccuugaagaaaucagaaaaucugccugccucuaccucccgagugcugggauuaaaggcgugcgccaccacaccuagccucaaaagagucuuuuuauuguuuugagucuugacuuagaucacaugcccugcacucacaggguaaaugcuggcauucgaugcugaguccggaaagcacuggguuuauauacaguauagucaggaauuccuugaaugcucagggugaaggggaguggagggcuguaaccuuuuggagggacagaacugaagcugggguaggggggugggugagggggggauuaauaggugucuguugugggguuaucaagaacuaauuuuauggcuggccauaacugucugucaccucugauuacuuuuucucuaugauuuaagauggggccuuaaucuucuuugaguuuguuauuucuuuaaggucccaaggacagguaccuggagaacuuggcuguuuagagggugggcuaguagauucuggccucgcagagguggcagggggucgucucaagcuggcaucugacucccucagguguauucuuuaagagugggggugguuuauaggcagugcaauucuaaugccaggcuggguuuucugggaacggccagagagggggagggagggaggccugggcuugcugcagggggaugcagugcagcaaccagcugcguguguacugcacuugccacagaaggggggggguagagcuucugcaggaaaagacacagaggcaaaccaucuguacauaacacuggagucucuuuggugaggcuuccaagaagcagggcaauuaaccgcagaguaauucgggggcuacaacacacuucgaucucguauucccccacccugcacuaacacugcucuuacugcagcuccgccugccuucagugacaguguggagggucucaccgcccagaugcagcccagauccaggcuuccauuuuagcagucuggaugucacugaucccaagagucaaacugugagguguuucucucagcagcuaugccugggcuggagggagaagagcaggauuagacacaaugagaagcugagcuguaauguguucucagcaaaggcuucauucagugucucuugggauucucgaaaacugacugguucuuucuuucauuagucuggaguuggggcacagggccuggguguauagucauuauacucuuuagauucaggcugcucucaacggggagggagguggcugaggcagacugugaccuuggaaugcugagugcuuccugcuguuccagcugagggcugagccuguaaauccugugagggucacauuccagagucaccccacagggccucuagcauccagcucugacuugcucccagacuucccaguugugcaaagcugguugguuggcauuuguuaaaaugauuucuauuuuuaaauguaauaaaaucaagucagaagaggaacuggaagauauaaggaauuagguuucugugcuguuuccuaagaccugugcuguccuuacuggggccacuaauuacgacugccucugaaguaacuaaaauuaagaauucccuucuuacaucaggccugcucaccaguagccuuggcuggauaguuguaagccuagggcuccaucugucucagcaacuucuuaaugugguucugagaguugaacacuggucuuuguggaugcacuuuacugaccaacccaccuucccagcuuggaaauuguguuucauuauauuuuaucccauuuguuucucaaggaggaaaaccaagcaucugugccuucaggggauccaaguuuucaaguuccaauuucaaaagccauucggcugacuacaaaugaugccguaaagagcacucugcuguuggaacuggacauuucaguaaguuguugcugaguuuacucucagcacgguugcccuuucggugcuugcacacccaggaggcgagacgucucuggcaagacgccuggccacuuuguuccugucuaucauuuccuccucgccucguuccucuugagugcagacgcgaggcgugggugcagggacagugcagaaugucgcacugucgccguggucaugagccaugagagacugauggaguccagaccgcauucaccggugucaggcccacagaaggaagcuguccacuuaaggucagccagcgaggcagaaaguugaggcuagacagucaggaaaugcuaacuucuccgggcagguguucugauuauuuggagaaucugaaaagauuucggaaucucuccagaaaagugacaguagggaacauuugccugugggguccgagauuuuacguggucauuugaacucugaccauaagcccgucugcaucugcucacucugugaggguccuucagccaugaauucagccauuugucuugaagaaugucccaagaagugaaaucagagcaugcgaagucuugugugagaguucaguagagcuuccugguaggaaaaagagaugacaggcaucuuaaccuagugguuuugugucuguuagugauggaauccacaugucuauugaaugugcagguaugguguguguguguguguaugugugugugugugugugugugugugugugugugugugccggaugguuauguuagggaucuuccuggaauacucuuccaucucauucuuugagguaaccucucugucaaacucagagcuuuccauaugacugguuucuauaaacggcuugcuguuagaugggcuucacugucuccaccuuccaagacuggauuuacaagugggaacacacccaacuagcaauuauauggauucugagaaucugaacuucagucugcaaacuuacuggcuuuaucuacuccuggcauguauauuuuguauagguuuuuaacgaucaugccucacucacuaaaggcuggucucaguucaagacuucugccagccucuggcucccaagugaugagaucgaaggugugcaccaucacacccaguguguaucauguguauguguacaccacacacaaauacacacccacacacacucauacauuggucuuguuuggaauaacuauugaugaaagaguuuguuugauaaauuggacuuauucauuggguucuuuugguuagaauuaguugugagucccuguacuaagagagccauaauggaaacagcuauuguuacucuauaccucagacuuuucuaaugcauaggauuuuccuuuucuauuucaccuugguccuucucuagaaaauagaguuuucccaucaaccuggagacuccuucaaugugaccuguccaaacagugaucgugagguagaagaacugcuccaaaggcugcagcuggcugauaaacgagcucaccgugucaucuugaaaauuaagacggacacuaagaagaaagguaggacagauggcggacaugcccaacauccugugugcuggcugcguagaugcugcagcucagccauaugccgugccugugcguacacacacacaaaccacacauacacacacaaaccacacauacacacacaaaccacacguacacacacagccacaagcaagcccugugcagauggguucuugccacuguucuuucuuacagugacuaggguggugaugggcuuuacauguuuugagcacuaugggcacaagaggagccugagacuuuauguaaaauuccuaucaaguuuauuucuccuacugauauuuuauuauauaaaaauacuuucuguguuuaaaagaaacuuuauuauuuaaaguauuaauauugcuugcauauaaucuuuaacuuacucaguccuaaaguuccuguuuuucaaaaacaguuguuuuuauuuugucuggugugugugugugugugugugugugugugagagagagagagagagagagagagagagagagagagagagcgagagcgagagcgagcgagcgagcgagcgagagcgcuguguugaggccaggaaaggacuuuggauuccucuggagcuagaguguaaaggcuugugggucuugggaacugggcuccucuagaagagcagcuagcgugcucaguaacugagccaucucuccagccccugaaguuaacuuuaaauggaacaugauuaucuauugccauuuuguuauuuaauuuuaggucguuuuauuuuauuugguacacuuuggauuuaucauucuuuuccuuuuaugaauugcccaccccacccccggcauauuuauuucauccagucgcagcuggaacauugccauaagucaucacacuugguagcauuguagugcagagugcugcagcuagcacuguguggugaaugcacauucuaaaaauguguuuguuguugugccuucucucuggucucuuccugccucaccugcaaggagcugcccugccugcgcaugugccugaggggcguucucuccaguucauccucaccuggugucuugaaauacgagcaguuccuaaaaagguaggucucugugcuugaagauggacagggcucuguuaaggacacucagauaagccugauacuggcccuuagagcuauggacgauagcguguucagaugugucuucacaccuccugcauuaauuacuacccaucugugcagugccacuugguuacugcugcaugggaaaccuuggggaaauggaagggaacguugagguagacugagccacuagagggcaguguuacaccaggaacuguauuucaaaugcuggcggcugacuuuguuucuaaacauuguguaaacuagacauuuucuaaaccgcuuuacuggacuggcgcugucugagcagagagucuguggcaauuaaagacaagcucccacacugcucuguggaggcgccugccgcacggcuggccucgggaagcaaacggaguucauuuggauaagaacgucuuucuguuuuaauuuuaccagcuuuuuacauuuuacaaaguauaggaaaauauauuucuacucugcaaaccaugcuguauaagaaugccuauacggaggugacaugggaaguaacgguugugugcuugcacccucagaguuuaagucuggaaucucaucccucuuccacagcaagacgucuggucuguguguucuggggcaaagacugaggguauuuuuaacgggugcaccauaauuuguuggcuugaucaugaacauacgagcuguucuagauuuuuuucuauggagaaaaauaaugucaaagcagaaguuucuguacugcgauagucuuuguacagguguuuuaaacauuuguauaaaauagucuuuagaguacaacugauaucuuaaaugguuuauacuuuaaaacugugcaguauuuucugcuguuugagcuuguucuuucucauuucuuuggucuuuuauuuauuuguuuguuugauuucuuauuuauuuguuuauuuauuuauuuaucuguuuauuugagacaagcucucacccuguaacuguggcuggccuggaacuuacagggccaaccguaaccccagaguagcccacaacuagccucuuuccucaggccuuuuugcgggcccuugccgagcacaccagcagugccacugaaaagcggaggcugcaggagcugugcaguaaacaaggagccgcugauuacaaccgcuucauccgagaugccagcgucugccugcuggaccuccugcucaccuucccguccugccagccuccgcucagccuacugcugggugagucaccccuuccuuccauggccccaggcaggccuccugcacuuuagugagccucugcauagugaagaaggccggcuauuccugucucacagugaguuccaugcagacacaguguggacauggccaaauggggcugguggguacaagucaggaacccggggcagguuuuauuuucagacuauaguaacaucuuuuuagagauugggucccucuuccacacucugagucuuuuuuuuccuuguuauuuuuuccuucuauuaauuauccaguuguacuuuuuuauacuuagaauuuagcaucuuuucuaguuuauuuucuucagugaugagguaauuuagcugaauuuuccuaacgucaacauugagagggaaaggaugucccucaucgaauccagucggacggacggcauagagcacgugcucugggugaaugcagggacaucucaggcccuguggauucagaagcgcagcuuuccaggacaguugggccuuugucaugcagggacaggccuggggcacggggagccuguaggauccuguagccuuuccuacuuuccugccuuuguuuuguuuuguucuguuuuuuguuuuuguuuuuuucgagacagguuuucucuguguagcccuggcuguccuggaacucacuuuguagaccaggcuggacucgaacucagaaaaccgccugccucugccuccugagugcugggauuaaagguguacaccagcacgcucggccuuuguuuuauccguaauggggcagagccagauguuaccauucacguguacaccaugaaaacauauguaguccucuugguaagccaucaggccuuucaaggccugugcagggaaugacuagucagggauugcuuuuucuucccaugacuucuuaguguucuuuuucuuugacuuccuccuaaaauguuuaaaaagcaaaaacaaaaacaaaaucauuauacgaagcuagucucccgcauucuuucuaagccagcuuggcuggugcuuucuggcuuagugguacaaugggagucguagagguuaguaccuagccaaaacacaaguuaggagccagagggagucauuaggacauacaaaauugaaauuuuccauuucuuuaagaaaaauuaacacaucuaaaacuuaagaugagcacugugccggucuuuguuuuccugcuuuacuaagaccgagcuuagaaggaacuuuuaaaugguuugcccagacaaauuaaaaauaaaacaaauuauucacaaaaauucuaaaauuuguaagcagauauuucaaauauggaccauuuacuguuacuguuacuguuacacaggucgcugugcauucuuaaaccacugggauucugcugaaguugcuuugagaaagucucccaccauacacuuaaguuuuuauuaaguauaugaacacaagaaggaaacguacaucuuacuccuaaguauuuccuaaaauaucugucuuugguaucuuugaggucuugacuuuuuuucaccucugaaagcucugggcugugucucuggagaugacccuuagacaggcgaaagcaaugagccugcugaccucuuccugcucugcccuaacugugcucacccugagaccagcgugggggaagggauccugacuuuaggguugaacagugcauugcugcacuauguacugcaaacuguuauaaacgagaacauauuauuucgaauagucuaaacaaaaaaguuaaauauaggccuggguuuucuuuuguuccugugucaguaggccugagcuaacugcuuguuuuauuuuuagagcaccuuccuaaacuucagccucgaccguacucaugugcaagguacgaauagcauaauauucaccuccaaaaucagggaauccugaauguccagcucucuaguggcugggccacuugcugcaaacuccccugcucuguagagcgcauugcaaucugaagauuccccaggacuucuguguugugggauucacaguuaagguggauggaccaccugguguuccccuguuuaaggcagugggccccagucucacagucccugggcacucccagcuggcaugugccuucagugucagugcagggugagcuggugggagggaguucccugcaucuuacacuguuugcauguaacaaagcguggguagagcuuugugaaagugucuccuggugauucugaacuguauguuuucuucacugacuuucaaauuuguccuuuuaauaaauaauacccaguguaucagucccucauuuacaugguaauaaaauuagucagguaaauacugaguggggagucuugaaggaagagccuuggggcaucucacuuucuacagaccuuacugaaacauuaaagacaaguagauacuacuggaaacucuccugaaauaccucacuaugggguuaagauggcucuuaucuaaagcaguggccaggugaggcccugggcccccagcacugugauaaagugucguucuucccuacuggauaguucagagcuugccugugucuuugcagcuccagcuuacgucacccagacaagcuucacuucguguuuaacaucguggaguucccaccuagcaccacugcagccucccugaggaagggagugugcacgggcuggcuagccacauugguugcuccauuccuucagccaaacacagacguuucgaauguagacaguggugacgcucuggcuccugagguacugaaccggugugaugucagcuuugcuacaguuggggcucacaccugacuagaacgcuucacucacauuguaaacgugaaggugguugucagcuguugcuccuccugucuguagaagauaaugccuuuccugugacugggcuggacugugagggcagugaugaccccaggaugacagguggcagugcagauggagugucuccuaucgcugcuucccagcuaugucucauuuaaagacaguuuuuaaaaugcuuuaaaguauucuuugaauauuuccugcauuguguacaguguacccugaucaccucccugacggcagcuucccccaggaugucccagccgcaucuccgucccucuuuguguccuuauguauucauuccuuuguucagugacuugacuuugcugaguucgugcugucuguaugguugagaguguggugucauccgcuggggcauggggacuuaccaagcggcuacagacucaaaggaaagugacccccuagcagcuguccuaggggaugcuugcacuucccgagccucccuuccucuucauuuauucccugcuuuaugcuuccaguucacauguaagaaaaacuaugcucaggagaaacaccuaugauauagguaaaaaaagaaaguacuugcaaagcaaacgauuccuuccucuguagcaugagauaugcucauggcuuuagcagggagugaugcugcuguuuaaguucauggugcuucccugagggugggauaacacgcuugcaucuucacaagaucauccugguuguguacucucacgugcuugccuucuuuuaaacucacugaagcugcuucgauauuccagauacguaucucuccucgggcaacaaacgcuuuccacuuaccagaggacccgucggcccccaucauaaugguggguccaggaacuggcguagcccccuuuguuggcuuccuccagcacagguacauagccaucacagcugcagaauacaacccuugucaucacaguuggaaacagaauuguccguuuuguucuucaguuuuuuagaauaauugaguauugguuguaaaauuuuuacuuuagaaaguuuuuaccuagcauugguugcuguagugauuugucaccauggggaaucugaagggcugcuuuguaauucagguaggacaucugcuuaguguaaacaagagccuagggucagucuguagugcuguaacaugaaaacccauauaauauccaaauacagcaaaugcugauauuuuaaaugagucacuuggaacuguacaaaaauggauuuuacaggucuguuuguuggugauguuuccugaugaaagauauuuacuugugugcucauuauauccaaaacuuccuuuauacauuagagaaaaacuucaagaacaacacccagaugggaaauuuggagcuauguggcuguucuuuggcugcagacacaaggacagagacuacuuguucagguacagggugcugcguugugauuggacagcuguaacgugcagaccuuggcaucuuuaaaccacugccuuucgcugacugugugguguugugucgcagggaggagcucaggcauuuccucaagacuggggucuugacucaucugaaggucucguucucaagagacgcugccccugacggggaggaggccccagcaaaguaugugcaagacaaccuccagcggcacagccagcagguggccaggacccuccuucaggagaauggcuacguuuacguguguggguauguaacccagcugcugcuacuguagauggauugaggggccgguuagcauuguaacagcuaguccuuuacauacgucacacgugagcacacagugaacagucuagggcacgguuaacagccaggguuucuuuucagaaaagcugugugaauauugacucuugcauugcagaaaucuuugcuuuugggcacauguuuuuaauaucugaucaucugaauguuaaaaccuuaaccgcuuaaacugaugucucaacauggauuuuguugugcugaagaacugauuugcagcacugaaccaguggagagggaaguagagucugacucugagaaugucaccggguuagagucuuguuccucuaggucaggguguggugggcagauaggcagaaggccgagucacuccugcagucacuaagcuuugugugcacucuuccgugugagcuucaaagacagcaccaaguggacaguuacacauuguagaaacucagcucuaaaacuuccaacuagauaaggagauucugaaaugggacauuuucuuuuucuccuaaaucacccggagggagcacuuaccacccuccgucagccaagcccuucugaccuaguaacuguggugcagaagaugaacugcuggcugugccugggugauguggcugcggccacacaggacugauggaauggcacuugcuugucacaugcugccugccuuugauucuugacgguguuuauagcuugagcuguccaaaggcugauuuugacugucuggaugauguuguggcccucguggauucuggcucccacaugcagagauucacacacugugugaguuuauguucucauuuagauuuuguggacguccuugaccugcguguuugugauggcaucuuggucacauuaaagcugagugucagauuucuaaauagcaggugcagccaaucacacagaugugcugggaacuggugacugagaacauggagacaucacagauaccuccagacucuuaaauucuccccugacauagccccuccacgucacugagucuuaaguuuccuaggaguggcaguggcaaggucagagauaaaggcucagagucaccucacaagucacacguggagugggcggacaggugcagagacagugaaggagggaacccauccaaaacugaggggaucuuccugaguguggggcacucagcugaagaaucgagugagaugaaggcagagaggaccuguagguuugcagaggguaggccuguggggagagaugcucugggugggugaggaaaagaugaggaaggacacagaugcucuggcuccuuagacaccucucaaggguaaacuguggcaucugaagguacugucuuacaguuucuucauccagaugucaggauguagaaggagacaugagguccacucccugaacucagacagucuuaacauggaauuagcaaggggcagugacauagcugugugugaugccucaccugccuucaagagcuaaguucuguccucagugaagggaccugucacuucaugugcaugaagguuugggacuaugagagcaugggggucuaccguucgcuucgagggagagggaaggcaggggcuugugcuagagcccagcucccuccagcaguaaaacugaagacuguucaaggacacuggagccuagggguggauuguaagccauggaaccauguggucagcucuauuagagcggccaccaugugugaagguuuggccugcgguaagugaagcuggaugccuggaaaacauucugagaagugaggagaaaacaaagauugcgggaucagagagaauuagggaugugguuaagaggguuugguuaagggaaguuccugcuuuauaaagugugccauuuugucucuagagacgccaagaauauggccaaggacgugaacgacacccucauaggaaucauaagcaaugaagcugguguugacaaacuagaagcaaugaagacgcuggcaacguuaaagcaagagaaacgauaucugcaggacaucugguccuaaacuggaacagagacgcuuggaauuuguuuuuguuuuuguuuguuuguuuguuuuuucuugaagugccaaaggucaauuuuacagaagaugaguuuaaaaauguuuggacauuucuuggagguggcuguguggggaacggcuugcuuacagguacagcagguacaaccgccugacagucucacagguuguaucccacuccuuaccuguggccccacccagcacaucacuacguggaggggaaagaggcagcucccaccuggcacccauugcacauaggcuccccaggaggacagaucaucauccacggcucaccugugccugggcacaucuuggagagcuuguggacauacuaucuuucaaugaaguauauucaaaggauauuuauauuggugauauuuaaauuaacacagacaugcaaagcauucuuuugcaugucuuuauuuaauugugguuuuauuaucaaaauuauauuucugauaaaauauuuuaauuuugagguaauccuuacaaaaugaagguuuucaugcaacuagaaauauauuuugaaauauauuugauauaguacucugccauuuucaucauguuaacuuucagugucaccaucuuacagcuuaggggcauuugcauuccccugacaaagguaucauguguacagcucaguagugugcccuguccuucucauggacuccauucaugucugcuccucacuaacagacuuggguuuucccaauaccugacuauacuuuugugauucaguucagcuuaaagaacgccaguuaggccgggcgugguggcgcacgucuuuaaucccagcacuugggaggcaggcagagauaggcggauuucugaguuugaggccagccuggucuacagagugaguucgaggacaaccagggcuacacagagaaacccugucucgaaaaccaaaaacaaaaaaaaagaacuccaguuaagacuucuaauaccaaauucucuugcaaguuaugaaaauaaaguauauaaaaggauccugugcuauugugugcgugguugcugagacaaaaacugggacaaagcaacuuacagaggguauuuuagcucaguucaggugugggguccacagugcugaggaaaucauaguggcagaaggaggaggugacugguuacaucccguccagucaggaaggaaaagaaaaggaaaagugccucgcuggcuuccuccuuuucacacacuccaauacuuuaaugcauggaacaggucugccuauguguaguguggguguccacuucagccuaguguagaggaccucucgaagacaugcccagggguuuuuuuccagugagguuguagacccugcaaaccuaacuguaacauagccuucacaagcaugauaaacccucccuguuguguauaguaacggucucauuuuauaguccaccuuuaaaacacaucucuaccuggugaaaagucaucacaagacuccuaggucauuauaagaauuaaagauuugaaagaguaauauaauauca

SEQ ID NO: 7120 - RNA, 10893 nt, Mus musculus
cuaaaaagcauacuuuuauuagcagauaacucuuaaaaacaagacggacaauuaacauuuacuuguuacauugcuuuauugcauuugaauaauccugcucgaugcggugaaggcaucuaagauacuagcauuaaauuaauuccaaauuuaccaccaauacacauauacaugguauaagaaaaaccgcagacccuuuucagaucccaagucuguaaacauaauuuccauagaguggcuaauucacagauuaaacugucucucuuacaaauaucaucuuuuucaccgagaauccugaagccaguuuccucuauuaccaguggacagcggagcuuugagaaaacagcuuccuuuguaaauaguccaccaacucaagucuugauguaagcagcuccagcucaugauagggaagcuguggaagaaaaacuaccauuaaaacuccuggugacucugcugccccucgaccucagcucuuacauccuccuccaccagaggaaggacaaaggucauaccugacgucugccccuggaguucccagcaccuagagcaaggcuggccccgacgcgagagaggaugugaaggcuaaguucccacagaguuuaguaccgaggggagucugagaagugagccugagcuggaggccaaggaaccacuagaguuuacauaaagccagacacagccccagcuacggaaacaccaagggcagagggagaaaguggagagaaguggagggcuugagguggguuaguggagagguguuggaacuaaaaggggcuggggaaggaggaagggagggaggauagcccacgucuggccagaguuccuccucugcucugggcaggcugacaugggagggcugccagauguuuuccacuuggccggggguggggguugagggggcgguuacuucgacaggagccaggguuccaggagacaugagagaacuccuuccuucccaaguaggugaauuaucaccauugggucccgggguuuagaccucagcuggacuggagaccagacugucuguguauaguccaaugccccacagagagggauggggcagggaaagagaacagacagggauggggaaagagggaguuaggagggguggggagggaccagagcugggagcaugcacuagguggcugagcauguguaggaaggguacacgaacacauuguaacugugugcagacugggugaugcaugguccugagcaggccauguaccuaugggguuuaugugugcugacuggauaaugcaaggccccaggcacuaagacacggagucucugguuuaggcugcgagugauaaagaagcaauggcuucugagcauacacuacacggcuagcuucuagaacaugaaugugguaaugagcaggacaccauaagccaccagaaagguagagaggaguuaguaagacuaaacagaacuggaacauguauccaugguuacuacaaccccacagcagaccuuacaaagucccaauugaaaacauaauguuaaaaagaccaaggguagaugaagacccucaaaccacuugcuaaaucuaccgauaaaucagacagaaacugaagcaaaagcuauuccaguaacaggaauucugaaggcagaguuaagcaugcugaaaagugguguguaccacuuuaagaaacaccaaacuuugaaaauucuaacuagaaaaugugaguuaaauaauuuaaacugaaccaacaaauuccuaagauauaaacuagacagaacauucguggucugcuggaguagaggcugggccuguaaaauccaugagcacacaaugucagggagggcuugggaacuaaccccauucuugcuuagauuauagaugcaaucaacacccagcuuggggcuuuucuuguacauggagucgacagaacagaacuuaagcuagcaaugcacaagugaaacuaggggcauuccuacaagaccucagacagacaacaggaaggccgucugucgucaauggaccauccuagccccaccucucuucugcuuugcauggcugcaguucauuccaguaaagucuucagaguuggacuguguguauugguaauggacacuacauuuugaaggagaaacaaaagcagggacagugguacuauaccugaacaaccugguaaccaaguaaccgcaggugucucugcuuaguagccucuuuuccaaguaaguguuuacuguccaagcaaaaucgcuguggcccaucaauacacagcgccacccugagaaagcaaagguaacugucauuuaugaaacgauucaaaguacaccuuacuagcucuaugugucaguuauuugcaaaggaaucaugaauagauugcccuuuaguuuguugaaaagacauuuacauguauuauugcuuacuaaacaaaaggauuuuucccaaacugauagguucagcauuuauuuucacucguuuucccuuuuacugaaaauagauuccuuucucuuaacagucccccugauguuucccucucccccaguccuuccagguccucuucaccucuccucucuuccagauccacucccuuucugucucauuagaaaagaacaggcuucuaagagauaacaaccaaagaugacaaaauaugaugaagccuaucaaagucggacacaguaacccagcaggagaaaaagagucccaagagcaggcaagagucagagacucacuuguccucacagcuaggaaucccacaaaaauacuaagcuaaaagcuguaacauacaugcagggaucuggugcagagcuaaaagcuguaauauauacauugggggccugaugcagagcuaggagcccuaacauauaugcagagaccuggugcagacccacgcaggcucugugcugcugcuccagucuccaugaagcccaguaucuuaaguuccagaaucaucaguuugccagcuuaagucuuuagcuuucaacccacaacuuuccuuaccuuuuguggauauccucauccacuguacacggcaauacaaauccaucuucaucuaauuuaacuucaacaucuggcaaaagaaaggaaaaaucccucaacaacacuaucuuccuguguuccucgugcugguucauuucuuccacaaugccuuuaucagagggccgaggcugcaaaguaauggccacaaccaacagugagaaugguuauuuaacuggcccuacagaccaucuuuggacuaaaaagucucaauuacucugaaacagugguguuucaagcaaucuacagaaugcuaagaacauguacucucucugcuuccuugugcaaaaaggggccugaguccuucaauacagaguaaagaaaacccucaaaucuaagcugacaucaaggcaguugcagaccucaccccugcuuacaggucugcucgcuucccaugugucuuagucaggguuucuauuguugugacaaaacaccauaaccaaaaaagcaaguuggggaggaaaggguuuacucagcuuacacuuccacauuacuguucaucaccaaaggacauugggacaggaauuuagaaauggcaggaacuuggaggcaggggcugaugcagagggcauggagagguacuacuuaguggcuugauucccauggcuugcucagucucuucuuacagaacccaggcagggcuaucaacacacuacccacaaugggcugggcccuccuuaacugaucacuuaagaaagugccuuacagcuagaucucauggagauauuuccucaacugaggcucuuccucucugaugacucuagcuuaugucaugcugacacacaaaaucaaccaauauagccuauaaagagagcacuccacaucucacaugccucauuagcaugccacauccacuuccuucccucacagacacuaccauccacuuuguaaaaagagccccaucaaagagagaaguaagauguguccuacacuuaucuuuugugauuacucucuuuaaugcagcaaccugagagaacaguuagggcagagggacuaaugggaagaaauggccuccuucauuagugcuguacgacaggccucugcagcagaugaggaucuguucuggggccgucuaauucaaucauguaaugagccucgugugucuacugagguguggcuaaaucacuauugugaugaggaacugaauuuacaacucgucaaacguguacuuagguaacuccguaugcugauggugccacagagaacacaggccuggauuacacagcagccaggaugccacugagcacuuaggauucuacuuacuccaucagccuugaggucacuguucgagcagaaaaagguuaagguggucugcccaggacaacuuacuaccauguggcuaaugugugaaacucaaccucggaguccuagcucuacugcaaugcugcugaccuuuccugcucaccuucaggugagggaagguucucuucugcaucucccagaugucuggcuacuaaguccacauagaguucaacauggacagaaugcuucugacacaacaagccccuuagcuacuuaccuauaguguaguaauagggcgucaacaccuuugaagcaaaauacagucuugauccuaaaagaucaaucaguccaaucaccacagacuuauacagauggagauccaggggcgucucuaaggagcagcauggagugagaaaugacuucacuugauauuuaggaagaaguuuggggcccuagaauccauacaugcaagcauaaagaagaaaaagauauaaggccacagaguaaguugaaggcuacuagaacaaaaaacugacccaacauuacuuuauauacauggaauguuucuaagacaugggcacaucauuuucucaaaaugacaauacacgagauggcugcuaaagcucacauuuuuuaaaacgaguaaaacacacacgggaacacucagguuaaggagucuuuggaauccuccaaggucaugaucacucucaacuacaguuucuguuugguucucgaacaaggacuguccuggucucgacagaccugccugccucucucuccugagugcugggacuacagauguguguggccaccagcacuuggcucucaaaugaagcuuucagcaguagugcccuagcuugcuuuucuuuggcugugauaaacaccguguccaaaagcauggagaggaaagggcuucacuucuaggucccagcccauuauucagagaagucaggguagaaagcucaagcaagaacucaaacaagcaccaagaaaugcuuccagcuggcuccuguucggccagcucuuacacagcccugccuagaaauggagcuaccuacaguaagccaccccucccaaaucaaucaagacaauguagcacagguauggccaaucauauugaggcaauucuucagcugugguuaccucuucccagguugugucaaacugauaaaaacuaaccaugguaaucggagaaugugguaaaagugacauuucaauuucuaaagaaaagggagugggauaaaacaaagggguuaacaagcuggcuagucaucuggaaaacaagauaaccuuuaccacccacggcagacuacaagucccagcugguaaagaugacuaguuaacccaugcauccuguguacccucuucaauguaaacaccacacauacaugcacacaggagacugugagauaagcauguugacacacauugugcaguggccaaauaugcagauuccuacacaaauaacauaauuuuuuaaauuacacaaacaaaucccuaaguuguaaguauguuaagauaggaaaugucguuuuaaaagcugauucaaauguguggcaaaacagaaaugagauguuacugagauaggaaacucagaagcuacagagaucugucuguaaguuuuuaaagcuucugcauagcaaaaucaccaauauugcuuuaaaaaauaaaaauuaaagaaaacauguauaacaguucuguuaacccuugucucauacugaauuaaagcuguagaaagacgauuuguaggaaaucuaaauuaacgauaaacaucugaaagcgugaucaaggccauuacugcucauucaaauauaauuugaacauguggcagggcagacccucucaggagagaaaugacaagguuucaaaggaccaagcacacuacagcugaggcguggaagucauggcuguccccuucaccuacugcugggcacagaugauguguaucccugcuagggggaaacgucugccugcauccacaauucauucaggaacccccgccccaccucaacccacccauuuaagaaucuaguccacggguuuuuaaagagacucucggauagugaguggaaagucagaacaaugccacagaauucacagccauggccuaggcucccuaucuggcacucgggcauggccacugcuagcuggacagaaacaaacugcgccuccuuugucagcccuaccugcggcuucaaaugggaaagcagcacacagggagcgcacaugguuucccuaaaucuggguggagaaacggcuguuuuagucuuucgaggguguaggguaggcagacaucagagcagcccaggcagcuguaaagacuaguucuguuucuuauucauggauguuacucuucaaucagauacugagugagcacagaggggcaggggugugagccagcccugggggaugccaauucuaacucuacaggagcuuugugaguuaggagaacaggccguguggaaaaggcaagcgccagcugaacuagggcaaccugcugggcguggcuaaggagacacucagcagucacucugccucuguccagucuagaguaacacagcagugacgugaaugcgagagccugcugggaaaucugucauagugaaucucucuugucugaugaagucuaaggaacuacacggccagaaacccaucuucuaggacaagaaugaggaaagggaacgggggugggugggaggaaacaggacaaaagaugucugggaccaauccagccuaugagaaagcucugcucuuugggaccaacaucaaaggaaauugaagauguuuagugcacaaaagaugagcauccuggggacauaagucacaccacucguguuucuguucucaccuuauagaacggacacucuaggacggagguuaggaaaaguugggucagcugugccaggcucaaucuguccaaauaugacucuuuaccuggggaaaaaaaaaacaacuauuggcuuggaauguuggcauguaaaugagggauuauaauuauaaaaccacccagcuacuuccggagcaagcagucugaaacgacacuggagcucucaguguaagcagugccugaccacaucccaaguuauacaucacuucuuaaccgccucaccuugcagccgcugaaggaaaaaggggcugaauaguuuugacaugaaguugacgggaugucgcucaaucagcgcacaugaaugaaggagccucaguagcaucuuuggugggaagugauguaaacgggcacagagcacauuuucuaccuuccuaaacagggcaggggcguuugguggcacguaauugagcuuuccaaauggcucaauuagcucggcaaucugacuaggugaaagucugucccacuggcaaacaacgaucucugagacuacgucgaagaugggcuuggagagaauccguuuccugcugcaguaccccaucacggagcuggccacagcgggguccagggagaagcacagggcggacacauguugcucuaaggccucugugaagaaccugucacuguguccgaaauagacaaacgccuccaagaccuuccugagcucuucguugguaaaacgggggauguaucucacaacguacuugcccagcuuuauaagcagugggagugcgugagucugguccagggccacuaaggcggugaggacauggcuaauggauuuagggcucagguagggaacuacugaaauggagaaguuguuuaauguguuuaagaacaucugguguuugucuacuucuucaggacacaccugcagaauccuauaaacggacgugaucuccucuggagcaaauguuuccacacuuuuacuuugaaguugacggacaaccagcuucagggucucacaacucgcaccuugaagcauggccagacuuuccccaaggacacaaagaugguggacuucgagguugccucuuuggagacgacguuggcauucugccaccaggcucagcaucaggcuacuuugaggaucugcaggcaacaacguaagcagagauugcaaagcugucaccaaaccagcauuggucaggugugaggggucucgcucacaccggaggcaaagagccuggaaggcacgguucuccagcacuccuucuggcagccuuugcucaccaucccuccucccuaucucacagauccugaguagagcugccauugccagagggacaggcaggguguccagggcacuuaugaaacucagcacuuccucaaaggaagugaaguagcuuagucuccugaaaagcaucucuucauccucguuuugaagacucuguccuggcugguuccauuccugcgccugggaggaccauggcucgcccacgggaugaaagucauuucccuuuucugaguggaaguuuuuacaguaugcgugauggaaucugacccugaacagcucagguuguagggagcagaagcacacacucaggcgaucugugacugccuuuggggcaugacuggcagggugaauuuucagagcaaccacagcuccagguauccaaagaauggacuuaugacaaaaggcccuccgcagggugaugaacgccaugccauagaauucacaacaugugacuuagcauaagaaaaacaaaaacaaaaaccauggucaaaugcugagaaagacaacaccaacgcuacgaaacuaagaaugaguaucccaugacaaagauuaaaaaaaaaaaagaaccuugcaaaaauauuuuaaaaaccaagguuuacuuuucccaccgagccaggaaacaagagaaagccugggaaggggguccccacucuccugguccugauugccacacccaauuggcugacacccaacaguugcaccauaacuagacaaggcaccgguagaagacaugcacaccccuuucuaggcagugucacuagguuuuuuuuuuuaaaugaacuaugccuuauaucuaaacuccuugaguccuauguguauguaaggaucucagauuaauguuuuaccacaacguaauuccucuucaaaggccauguucuauggacaaagugaagggugugcaccaaggcaugucuccuuuaauauguuuaaaguuggcugcugauuaaauagccccccaaaccccauaauccuauacauaaguuacuacucaggcuuucaggcuuacgcgucucuucaguuuucaaaaaaggcuauuuuuugaguaaucagaacucauugaccuugcugcgcucuggcucauucugaaauuucuuuucaguggcccuugaacaccuuaguguugucggguagacugaagcaucauagggcugacuuccuguggcuucacugugucugggcgagaugcuggcuccuaacccuaacugcgaucgcugcccagcccuuacuuuaaguccugccuaugggcuagguuacuguaauucaguucgucugguugacgcuuuucccgcuaaggacccugcagcccaaggaaaccaccucuguguacagugaagcugggcgcgaagaggaagagcuggaauucagauucuaccuccaaaucucgacacucacgugauggggaaagggaacgucaauguugauaauugcgagagaggaggagcagccgacaagauucaaacuccggguaugagccgggcaaagcaugguaauucgcgcugagaagcugggcuggggcucacgcacaaucacagaaaagcaagcggagcagggcaacggcggaggcaggcgccgcgcgaccggaccggagcccacggagcacgaguggggaagcccggggguccuaaucccgagacacuuaccgagcggcuccaagccgcacccgggacaggacagacacggagcuuccgagcccugggagcguccguacacggacgcugccccuuaccuggagaacauuccggcgcgugcgcggcacuaaggccacccacccacccacauccggcgaucagcgauuggcccagguccgcccgcaugucuguuggcggucgugcggagcaugcgugcugugccgcgcgcgugcgcagugcucccggacugugccugucggaggagaacgggguuccgcgcgggaauucgcgccuggagguauucggcgggggacggcgggagcgacggaagcggugggggagccgggacucgcgccugcgcaguggggaugagccgcugaguuuuccggaccgcggugggguucacggggagcacuugggaggcggaccgcggugggguucacggggagcacuugggaggagucggcuccgccaccuuucccaaaaccucgugagcucgcacgugucacccauugguccugucgagucuguggcagugcuucccgaugaaccuuugaaggguuuguguccuagcuccccagcggauaagccacaagugcuuagaaacuaacuagaguugauucacucaggaaaagauaauuuuauauaggccggcuaccacucagcguuagccacuggauagaauggcggaguguggaaucccagagcccuuuaucuucuuuuucucuugguuaucuccgggguaaggcaugaauuagaaauaccgucucuguguaaaguccauguacgcugacuacugauagaugcaaugaugccaucuuugaugacgaccagugcuuugauuaggaucuagcaggaaacacgaacuccccaguuucacgugaacauuguacaguuacaguuuugguuuuuuaaa

SEQ ID NO: 7121 - RNA, 1080 nt, Mus musculus
cccccgggagaaucugcguuaaagaacagagcauuuagcuccucugucagaaugaaugggaaccagaaauuggauguuuauaaccaagaaaagcagaauuucauccagcacuucucccagaucgucaaggugcugacugagaaggagcugggacacccagacauaggggaugcuauugccuggcucaaggagguccuagaguacaaugacuuaggaggcaagugcaaccgggguuugaccgugguacaagccuuccaggagcugguggagucgaagaaacaggaugcugagagucuucagcgggcccugaugugggcugguguguagaacuguuccaggcuuucuuccucgugucagaugacaucauggacucuucccucacuugccgggacagauuggcugauaucagaagccaggcauaggcuuggaugccaucaacgacgcucugcuucuggaagccuccaucuauuguuugcugaaguucuacugcagggagcagcccuacuaccugaacuugcuggagcucuuucugcagaguuccuaucagacugagaucgggcagacucuagaccucaugacagcaccucagggccauauggaucuugguagauacacugaaaagagguacaaaucgauugucaaguacaagacggccauguacauggcaggcauugauggggaaaaggaacaugccaaugccugaagauccugauggagaugggcaaguucuuccagguccaggacaaguugcccuugaucucuuuggagaccccagugugacgggaaaggucggcacugacauccagggcaacaaaggcagcuggcuggugguucagugucugcuacgagccuguccucaacagcgccagaucuuagaggagaauuaugggcagaaggacccagaaaaaguggcucggugaaaagcaauguaugaggcacuggaucugcagucuguuuucuucaaguaugaggaagacaguuacaaccgccucaagagucucacagagcagugcucugcgucccugcccccauccaucuucauggaacuugcaaacaagaucuacaagcagagaaaaugac

SEQ ID NO: 7122 - RNA, 449 nt, Mus musculus
auuggacacaauaccaauauuuguaaacacugguacucacaacaaaggacagcaacccuaucgacuccacagcucacaaacuuaccaucgcucuagaugcauugccuguagcuucuccagguccguuggugggaacaugguaggucggauuuguguaugccugcccuggggaaccucaugccagucugcaaaccacugcccgucucuagucaugaccuguccaaagggaggagcagcagcaccucagugaggagcacaccggugcucagggcaaggcggcggauacacauccaccccaaguccaggagcaaugccaucacucccacggacucgguuuucauuuuguuuuuaaaacaaaucucagacgauuuuguguggggaagucaaggggaaacuauuucuauuuauaaaccaaaguugaacugcaaaccacacacauuaaaaaaaau

SEQ ID NO: 7123 - RNA, 825 nt, Mus musculus
gguggugcacgccuuuuuuuuuuuuuuuuuuuuucaauauauaagucuuuuauucucccaaaagagcccaaauuguucuugugaucaggaucucguuucuggggccaggaacugaggccuccucacucgucagccugcugcacaguucccuucucagacacauagaugccguccaaaaacuuccugauauccuuguuuuuaacuguuguggcuugcugaaucagggcagcugaauuugaaacaaguucaaugucauuuccuucaaggauuaacucauccuucugggcuugagagacagaacaagccacaccuguccucauccgaacccugcggauguauuuuucacccaagaaauuucggauuucaaccaaagagccauucuccuggaugacgacguugauggggaagugagcguacacagaccgcaucuuguaucggaagcccagcgugacacccuugaucauauucugaacaugacugcagaugguccugacgguggccaguuccuuucuguuaccccaccauuugucaacccggagccuuuucuucuucuucccaagaagacucagcuccacguugaugugauugaagucccuccgcagagucccccuggggcccuucacaaugacugugcgccccuucagagugauuucgacauucucuggaauguccacagucugauugcugagaauggucuucauccucgcaguagauggggcaaaaagcggugcacgccuuuaaucccagcacuugggaggcagagacaggcggauuucugaguucaaggccagccuggucuacaaagugaguuccaggacagccaag

SEQ ID NO: 7124 - RNA, 336 nt, Mus musculus
gaaacuuuuuuuuuuaauauaaaugcuuuauuuaacaguugcagaucauuucgugggcuaaguaguggauauccagaaccccaccagcuucaagauuaacgcaaccuucgagcuucucuuucugacuccaauagggugagcaugucacccucucgaacggggccuuugacauuucggaugauagagcggcuggugucauccaugaauuccacucgcaccugcgugcacugucccugcgaaccgguccugcccagcacuuugguuacccuagccagcuugaugggcugcacgcgacucguguccaugauggcggcgaucuggcggagaggagccaaa

SEQ ID NO: 7125 - RNA, 1198 nt, Mus musculus
ccagaguguaagaacagucaugacaaauauuuuuaauugguauccaaaagacauuucuauguaaacaagguuuuccuugaguaaagacugggauaguugcuacacaagaacaucguuuguucuuaaauugggauuguugcacaccccacaagagcuuuuuggcucaggcagccucuuaaagcacuuacaaucugcugcauaugguaacaaauggcagaggcaggaguuucucuccaaguuucaggucaaccaggguuaccgagccagacuuugucucaagagauaaagcuggcucuguauuccugcuucauacacagcuacuguaacaauccuucuccaucggcagcucuggucugauuagaugugaaggaauugggcuaugauguggggaaagggggguucaacaaagcccuaaggcccauggaucuuacagaaugcuuaauguuuauuuuucucugauaaggugaaaugaauuuuccauggacacugcuugaagacaagggcuacauuugucgcuguuuaugcuugggguuggucuuacagaggauaaaccagcgcccacgccucuucaccuuguagcagucuuuacagcgcuucuugaugacaccuuugguuuugaagcccagcgagggcagcagggucggcaagggacggccacagagaacugagcgcaccucugcgcaggguuuggcgcguggcaauguccccagcaggaacgaggagaagacucggggcuucaccgcgaggcgacucaggugcaggaacggguccaccaccgaagccaccacgcuccguacaagcagugcggccaugccgagcccagaccugggggaagagaagcguggucauccugugcugcacgucugccagucccuaggcccuccccuaucaagguuacuuggcaucagaggucagagcacacaugccaggguugcacucugggcuccgcgucuccaugugcccaggccugcgcacuccggagaagccgcagauuccggaggcucacucacgccggccagggaccccgcccgcacucccggccagcagcucuggcaccaccucugccugcccccaugaaaccugggacccacaccugggaaggggugccaccggcggagaaguccuuaaucaacuucgggcgccgguuagcgaagcuuccgcgucugcgcaguggagugggacgccaccgccaggaaga

SEQ ID NO: 7126 - RNA, 2722 nt, Mus musculus
ucggaagagcagauuuauuuauuuauuuuauaauaaaugaguacaauguagcuaucuucagacacaccagaagacgguaugggagcccguuacagaugguugugagccgccauguggcugcuaagaauugaucucugguccucuggaagaucagucaguguucuuaacugcugagccucucuccagauccucacuuuuccuuuuaauuugaguggccauuuuaaacaaaaauuggccauuuaaguaaauagucucucuugucugaagcugacagccucacaguucgaggguuguuguucuuaaauguuuuaaugucccuucuagcccaccacaccagagguagugggaaggaaagauuaauagggcaaagaagaaccuguuuagaaauaguucuuuggagcaaauccaaucugcauugucaggacaucagcaguacagcucacaggaaucggcagcucaauccaaucuuucaaucaggcaucuuucaaauggucuuguaucuccguguggguugcccauccucuggacuagagaaaccaaggagaccagacaguagacucuaaccagugcaaauucugcaaagaggaacacagauggacggacauguucccuuaucuuuaaagaagcagcaugguuaaucagagccugacucauccuagcagagggcuuaacugguaaaggaaagacugaaggaagcauagcuccucccaauuccaaacaaccccuggggacaauaucuucaagucuucuuaaacacccagcaguaaaguauagcaauaaaauacaaaauaaaaacuaaacuaaacuucaaaagagacaauaauuuaggacacguacaggccuuccuauuaaauccuguguauggucuacugacacacaagauaggacaaacacaaccacuccagguauaauacaaagauagguucuauuuaucuuuacauuugccuacagauauggcaguaugucaugugagggcaaugcccuuggaggccagaagagggugccagaucccuggaacuggaguucgagaugguuaugagcugccacguggguacugaacuaagcccugguccuuuggaagugcuccuaaccacugaacgaucucucuagccaccccucaagauaggcuuuacuuauauaagccuauugauguagauuuaucuaaaucgguaacaauaaccuuacuuaauucugucuuucucacgacuuuuucaucugacauuuucaguauucagugguuaaaaucuuauccuaucuuccuuuuaaucugcucugucaucgguaugauuuuguuguugcuuuacaauccaagggaucagaccuugaagaggaaucuccuggaacaaauauggcccugguucuccugacuuucgcccucucugggaccaucaacaguuagaaccuuguuauucucacuuuaaacucuguguuucgaucuuguaaagucuguaucuucuagaauauguaacacccuauuuguugcuucuugcuaccaaaauuauagucuauccugugcagauagcuccuuugagcuugauacaauauguaggacuccauuuucuuagguggguuucuucucugcccgaucuggggaacccgaccucugacccacaaucuucuaccugaagaaugucacauaguccucccucccccacccuugccccaaccccaaacuugcccugcacauaucuggaauuccuggaaugccuuuccacacaaaggagacauucacaguacuuuaaacuccaaugaaacuuaacccuaagaagaaccccuucccacuauccagggguguaugcaugcaaacccaccccaaauaaaggaauacucacaaacuaagauugucuaagagagcuguuccauuaaaauccggggagaugucucccuuugugauuucuuuuuguuucuacuuccauuuuuagauccuggaugguuuuguuuaauuccuucaucuguucaguuguguuuuccugaaauucuuuaagggauuuuuguuuccucuuuaaagcuucuauuuguuuacuuguguucuccuguacuucuuuaagggaguuauuuauguccuucuuaaaauccucuaucagcauaaugagaugugauuuuuaaauccauaucuugcuuuuccgguguguugagguauccaggacuugcugugaugggagaacuggggucugaugccaaguagccuugguuucuguugguaagguucuugcgcuugccuuuugccaucugguuauuucugguguuggucuuucugucucuggcuggagcuugucccuccugugggccugcaagcccugucagcacuccugggagaccagcucucucuggcggaaccuguguagagagggcuguggaacagccuuagcuccaggcucagauggcgaccagaaggauucuguccaagagggguguuggggggggggagaaccagaaaaggggauaacauuugaaauguaaauaaagaaaauaucuaauaaaaucccuggagaagcccccucucggcccccauucccaccccggcucugccccagcucuuucccuacagaccucaccucuucuggccucugcuuccuuccagccugguguguagcagugccuagacaccaugagggaagaaauagaguacacauaccacaccuauuacauggggauuccagucgaucccugcuguugaaaauccaacuacuccuccccaaccacugaagguaaucugugaucc

SEQ ID NO: 7127 - RNA, 2722 nt, Mus musculus
ggaucacagauuaccuucagugguuggggaggaguaguuggauuuucaacagcagggaucgacuggaauccccauguaauaggugugguauguguacucuauuucuucccucauggugucuaggcacugcuacacaccaggcuggaaggaagcagaggccagaagaggugaggucuguagggaaagagcuggggcagagccggggugggaaugggggccgagagggggcuucuccagggauuuuauuagauauuuucuuuauuuacauuucaaauguuauccccuuuucugguucuccccccccccaacaccccucuuggacagaauccuucuggucgccaucugagccuggagcuaaggcuguuccacagcccucucuacacagguuccgccagagagagcuggucucccaggagugcugacagggcuugcaggcccacaggagggacaagcuccagccagagacagaaagaccaacaccagaaauaaccagauggcaaaaggcaagcgcaagaaccuuaccaacagaaaccaaggcuacuuggcaucagaccccaguucucccaucacagcaaguccuggauaccucaacacaccggaaaagcaagauauggauuuaaaaaucacaucucauuaugcugauagaggauuuuaagaaggacauaaauaacucccuuaaagaaguacaggagaacacaaguaaacaaauagaagcuuuaaagaggaaacaaaaaucccuuaaagaauuucaggaaaacacaacugaacagaugaaggaauuaaacaaaaccauccaggaucuaaaaauggaaguagaaacaaaaagaaaucacaaagggagacaucuccccggauuuuaauggaacagcucucuuagacaaucuuaguuugugaguauuccuuuauuugggguggguuugcaugcauacaccccuggauagugggaagggguucuucuuaggguuaaguuucauuggaguuuaaaguacugugaaugucuccuuuguguggaaaggcauuccaggaauuccagauaugugcagggcaaguuugggguuggggcaagggugggggagggaggacuaugugacauucuucagguagaagauugugggucagaggucggguuccccagaucgggcagagaagaaacccaccuaagaaaauggaguccuacauauuguaucaagcucaaaggagcuaucugcacaggauagacuauaauuuugguagcaagaagcaacaaauaggguguuacauauucuagaagauacagacuuuacaagaucgaaacacagaguuuaaagugagaauaacaagguucuaacuguugauggucccagagagggcgaaagucaggagaaccagggccauauuuguuccaggagauuccucuucaaggucugaucccuuggauuguaaagcaacaacaaaaucauaccgaugacagagcagauuaaaaggaagauaggauaagauuuuaaccacugaauacugaaaaugucagaugaaaaagucgugagaaagacagaauuaaguaagguuauuguuaccgauuuagauaaaucuacaucaauaggcuuauauaaguaaagccuaucuugagggguggcuagagagaucguucagugguuaggagcacuuccaaaggaccagggcuuaguucaguacccacguggcagcucauaaccaucucgaacuccaguuccagggaucuggcacccucuucuggccuccaagggcauugcccucacaugacauacugccauaucuguaggcaaauguaaagauaaauagaaccuaucuuuguauuauaccuggagugguuguguuuguccuaucuugugugucaguagaccauacacaggauuuaauaggaaggccuguacguguccuaaauuauugucucuuuugaaguuuaguuuaguuuuuauuuuguauuuuauugcuauacuuuacugcuggguguuuaagaagacuugaagauauuguccccagggguuguuuggaauugggaggagcuaugcuuccuucagucuuuccuuuaccaguuaagcccucugcuaggaugagucaggcucugauuaaccaugcugcuucuuuaaagauaagggaacauguccguccaucuguguuccucuuugcagaauuugcacugguuagagucuacugucuggucuccuugguuucucuaguccagaggaugggcaacccacacggagauacaagaccauuugaaagaugccugauugaaagauuggauugagcugccgauuccugugagcuguacugcugauguccugacaaugcagauuggauuugcuccaaagaacuauuucuaaacagguucuucuuugcccuauuaaucuuuccuucccacuaccucugguguggugggcuagaagggacauuaaaacauuuaagaacaacaacccucgaacugugaggcugucagcuucagacaagagagacuauuuacuuaaauggccaauuuuuguuuaaaauggccacucaaauuaaaaggaaaagugaggaucuggagagaggcucagcaguuaagaacacugacugaucuuccagaggaccagagaucaauucuuagcagccacauggcggcucacaaccaucuguaacgggcucccauaccgucuucuggugugucugaagauagcuacauuguacucauuuauuauaaaauaaauaaauaaaucugcucuuccga

SEQ ID NO: 7128 - RNA, 22935 nt, Mus musculus
cguucccagccucaucuuuuucgucguggacucucaguggccuggguccuggcuguuuucuaagcacacccuugcaucuugguucccgcacgugggaggcccaucccggccuugagcacaaugacccgcgcuccucguugccccgcggugcgcucucugcugcgcagccgauaccgggagguguggccgcuggcaaccuuugugcggcgccuggggcccgagggcaggcggcuugugcaacccggggacccgaagaucuaccgcacuuugguugcccaaugccuagugugcaugcacuggggcucacagccuccaccugccgaccuuuccuuccaccaggugggccuccaggcgggauccccaugggucaggggcggaaagccgggaggacgugggauagugcgucuagcucaugugucaagacccucuucuccuuaccaggugucaucccugaaagagcugguggccaggguugugcagagacucugcgagcgcaacgagagaaacgugcuggcuuuuggcuuugagcugcuuaacgaggccagaggcgggccucccauggccuucacuaguagcgugcguagcuacuugcccaacacuguuauugagacccugcgugucaguggugcauggaugcuacuguugagccgagugggcgacgaccugcuggucuaccugcuggcacacugugcucuuuaucuucuggugccccccagcugugccuaccaggugugugggucuccccuguaccaaauuugugccaccacggauaucuggcccucuguguccgcuaguuacaggcccacccgacccgugggcaggaauuucacuaaccuuagguucuuacaacagaucaagagcaguagucgccaggaagcaccgaaaccccuggccuugccaucucgagguacaaagaggcaucugagucucaccaguacaagugugccuucagcuaagaaggccagaugcuauccugucccgagaguggaggagggaccccacaggcaggugcuaccaaccccaucaggcaaaucaugggugccaaguccugcucggucccccgaggugccuacugcagagaaagauuugucuucuaaaggaaaggugucugaccugagucucucugggucggugugcuguaaacacaagcccagcuccacaucucugcugucaccaccccgccaaaaugccuuucagcucaggccauuuauugagaccagacauuuccuuuacuccaggggagauggccaagagcgucuaaaccccucauuccuacucagcaaccuccagccuaacuugacuggggccaggagacugguggagaucaucuuucugggcucaaggccuaggacaucaggaccacucugcaggacacaccgucuaucgcgucgauacuggcagaugcggccccuguuccaacagcugcuggugaaccaugcagagugccaauaugucagacuccucaggucacauugcagguuucgaacagcaaaccaacaggugacagaugccuugaacaccagcccaccgcaccucauggauuugcuccgccugcacagcagucccuggcagguauaugguuuucuucgggccugucucugcaagguggugucugcuagucucugggguaccaggcacaaugagcgccgcuucuuuaagaacuuaaagaaguucaucucguuggggaaauacggcaagcuaucacugcaggaacugauguggaagaugaaaguagaggauugccacuggcuccgcagcagcccgggugagcauggcuggucuccagcugaaugcauuaggggcccagaaaagggagacaauggguggcaguaacccagguccccaguggugugguggcuuuaugcaguccgugguuggaugaguuccaucuuauggucucugacuccaagcucccuccagcucgccuugcacaaacuaagauucuuguccaagcccugggcagguucucagggcuggggacauuguggugaacagauaagcagacggggagcaugguggauaggaguucuggcacagugcaccagagagagucuggaagcgcuagugagagcuaauguaagggcccgugguucgccaaagaaugauaaccccggacucaaauaguaugccaaagcaaggagcauuucauucugcagaaaucaagcaugcaggugggggggggggguugcucucauuccaagauggagagacaaccaaguauagauuuuaaggggaucgggggccuuuaucuuacuccaucucuaggggcauuccauuacuggggcaugggguuggagguuggaaacuguuaauggggaggucuggaaacuugcugccccauuguccuugcuucaggcuagguagcugaguagcuucuaauggcaggauaguuucugacuagcugucuaaagucugggguguuuguuuuuuuguuuuuucuaguaacuuacuugccugaacuugcucaguuuuuaggccuggucuccuggacugccaauuugaagccuauuaaggagucagccugucucacuacuccagguuaucuauaaucccccuguagaacgguaccucacugauaacaaugacagaccaacauaggaacccacuauccuuguggugcaugaguuucaaagguucuucugguccucccagugugcagauccaugcuuaagcuaugguccucccagugugcagauccgugcuuaagcuauggucuugcagcugcucgaucuacaaaggguagggugaacgaaggaaagauaaaugaaaaaaaaaaaacuguuuccuacagugaagaucgcugccccaucuuagcuaugagaagggacuggggaguggagccuggugcauaaaagaggauuguguuacuuggaaggcugcagagccuggacuccugugcccuccuugccugguuuucuggguuuaauguugagguuggcccucuguagucacuaccugaccccuucccuuucagccaacccuccgguuacacccugugcauguauggaaggggccaaacgcccuauccugcucucccuuccccaaaauucuuaggauauuaacaacuuauggggaaaagaugguagagcuauguuuacccaccauguacuugggaagcuccgaaguaagcuuuuaaaaguacaugucuggcagaguauuguggcagacaccuaacccucccagcacucggaagcagaggcagguggaucacugaguucaaggacaccuggccuaccaaguccaggccagccaggggucugcuaaauagagaaacccugucucgaaaacaaacaagcaaaaaacauaccugcccugggggugauaggguacaccuuuaauccaagcacucagguggcagaggcaggcggaucucuagaguuuggggcuagccuagucuacagagugaauucuaaggcaacaauggcuacacuccgaaaccuuauccuaaaacaaaccuuauccuaaaacaaacagaacauuccugacucuccagcugcagcacagagccuguguggccaaugcaagucuucccaccugcugagugcugacaucucauuccuucaagucucucugucucccuuacccacagcugucaguaucaguugcccaggguuacggagauagcccuagaggaaaggagauacugcagccccucagcauccugucuccucagguagcagcucuccuuauucuggacacaggcuccuuccugcuuagacuggacuuugccuguccuugcaguuuacauccaguuuuaugauugccuuuccagacuuguuggaacaugucucuuuucugcuccaagaaccccuuugaccuucaguuugucuguaaaaacuuaagcaugcucucuguuagaguuuuccuuggaauuuuauuccugucucuucagguucauucuggcucaccaccaccaccaccccccccccaacauuauacaucauagguauuuggcuacacguuuccuucuggauacugccuuagcuacaccgagugcuucuguacguggccauuuugauaucagugauuuuuuuugauuuuuguuuuggagacaucgauauauuccaaaugugugaaauauuuugaauuuuccuuggaaauugauccucaauucuguguagaagucugcauaauaccaguuauucaaaggugcugcaaacuuguaccucugcacaggcaguuuuucuaaauguucacuguauuucugaauccugagauuuuuuuuuguguccacuaugucaaauauauacaggaaaaguccacgucccuucuggucaugaaauaagaagagggcuacuuugguuucucgcuagucggcugggcuuauuucuucuuacucuggugguauuuacaugcaaugcuguuaaguguacguacuaguuacagauuuuuauucauuuuauguuuauuuguuugagacaagauuuuagcgccaggcagugguggcacacgcuuuuaaucccggcacuugggaggcagaggcaggcgaauuucugaauucaaggccagccuggucuacaaagugaguuccaggacagccagggcuacacagagaaaccugucuugaaaaaaagaaaaaaaaaagauuuuacuaagcaguccuaacuggccagugacuuguuuguagauaugacugaccuugaacucgcugagaguugcuugcccaugccucccaagugcugagauuuaagauaugagcuaccacacccagcuggaguuuuaucuuucugauuagagaaucuuugauugccaggguauuaauuaugcaauuuuuugaacguaaaagagguuuuuguuguuguuuagguuugguuucuuucuaaauaucucaagcugcccucaaauuugcaaccaacccauuccucucagcuucuggggaagcggggacuacaggaguguaagccugccguuucuccucuacucaaacugaaccgggcuggcuuugcugauucccugcuaugaauuuuuuuucuuuucccuuuaaguuuugcuuuuaagauuucugaauucuggagcugaagagaugacucaguggguaagaacacugacuguucuaccagagguccugaguccaauucccagccaccacaugguggcucacagccaucuguaaaaugggaucugaugcccucuucuggugugucugaagacagcuacaguguacucauaugcauaaauaaguauuuuuuuuuaauuuuuuuaaaauuuucugaauucauagaauuuagaugugucuuuucacaguaugcaggugaauuuuuuuauagacugucgugccaguuugacagucgucacuuagcugggaagcuuagcuucucucucucucucucucucucucucucucucucucccucucuccuucccucccucccucccucccucccuccuucccuaagaaugugugaaugugcugcuucuguuauuuccaguuugcuuuuguuaguuuuaugcguauguguuuugcuugcauguauaugccugugcuccucuugcaugcuuaguagcugcagaagccagacagagcaucagaucucccugagcuggccuggccuuacagaugcuugagagccaccacguggaugggaugcugggaaucgaaccccaguccccugaaagaagcagccaguaucuuagcagcugagccauuucuuuagccgguuugcucuuuguuguuuguuuguuuguuuguuuguuuuuugagacaggguuucucuguauagcccuggcuguccuggaacucacuuuguagaccaggcuggccucaaacucagaacuccgccugccucugccucccaagugcugggauuaaaggcaugcgccaccacugcccggcagccggucucuugcugugccuuuggugucuugcuaucugaguaacuugcugcacauguuuucauucugucuaccuuccagcaguaagaacuuaugugcgcuguucucugccagcaaucaacugacacucgagccuuagcguacuuggaacucugaucagcuucucugcuagcuccuaccccucugcugauuuaggucuggcuucagccucucuauucccaaacuaaacaucauucuugguuuuuuuuuuuuuuuuaaggucacugcuuguuuauaaaguuuuaaccuuccacaccauuuccuccauauauugacuuauuuuuaaucaucauuuuauguguaugaauguuuugccuggauauauguauguacaccaugacaugccuggugcuggagcugaccagacuggagcuagaguuacaggagguuguaagcuaccacauggaccucugcgacagcagccagugcucuugaccacugagccagcucuucagcccugugucguccuuucuuuguuuauucugucuucugacuuguacguacguccuccugggaucccccuucuccuucccaaguucccaucauauucaucacuucugguaaccccaccuuucccuagauaaagaggccccugugguaucuggagauacacagaguguauacagcuguuauggugcacggaacucacauguccagcauggcaguaggagcagccuguucucuacuuuguucuagacaucucugaacugcacugcucaguagcaaugaguguguguagucagugacccgguaguauaguaccagccgccacugagguuugccuguguaugugugcggaggucugagguugacacuccgugucuucuuuaauccccuggagcuugcugauucaguuagaguucaucugucuuugccuccauaguauuggaacugcaggcacaugucaccacuccuggcuuuuaaaacauggguucugacaacugaacucgguuuucaugccccuccagcaagcacuuuaccaacugagccauguccuuauccccuaucugaagauauaauuugauuuagagcugauagaagcuaggguuugcuaagucaaucuagccuacaaggaucaccgguucgucacaguggagcuacaucagauacagagguugguagugagaggcugcuacugggggaugaaggaugccucaagaacauuucccugucagucagcagcauuucaucuguagucagucggccugcaggauccagacauggcuuugucagggaacuuuaguuuacagcauaaagaaagcacacacacaaagguuaaacuagcuuauuaauuuggggaccuauggcuuccaugcuagacauuguggaucugaggugagucacggaauguugaguaucuacuacuuucagggaaggaccguguccccgcugcagagcaccgucugagggagaggauccuggcuacguuccuguucuggcugauggacacauacgugguacagcugcuuaggucauucuuuuacaucacagagagcacauuccagaagaacaggcucuucuucuaccguaagaguguguggagcaagcugcagagcauuggagucagguaccacacagcaucccucagguaucagugucuccugugugcauacgcagaggcaccggugcacaguguguggcaccugcuagccugggcauggaccuugagggcauagauucccuguagccauggaauggagucccugcuuuauugccugugaaaucauaaauuggaucuguaccaucuauaagauccuuaagguaggagagcuuuuuuaucaaacgggagcggaacugauggauuccaccucaugucuaccccugaaggaaaggaagugucuccucacugggaaaccacaaggguccacccugagaaguggcagggcucugaguggcugagguucugugcugauugagcuagaguuuuguugucucagcagaaggccaagcugagagggcaguggagcagcuaggcaaggccugcaaagagcagacuaccauguuaacuuucuauuuuuguuuguuuguuuguuuuguuuuguuuuuauuuuucaagacaggguuucuuugugugguccuggcuguccugaaacuaguucccuagaccaggcuggcuucaaacucacagagagccaccugccucugccuccugggugcugggauuaaaagugugcgccaccaccacccagcuccauguuagcuuucuugagguccagccuuagcuauggaucauauaucacccacccauugugcuuaugggauccuuagcaaccagcacagggcuuccugagggcaggcagggacacuuuuugcuuucauaccugugucuaagccaagauauccauaagagucagcggauugcuucaaaaauauccuggccaaugggacccccaagaaggaaacaccaaggacagacuacgggaccagaugucccaggugccgacccaggcuucgugucaugaacccuguccagacaggucuaugggguguguggguuguguggguuguucugguccuagauguagccccauagcauggucgggugucaagugcuccaaguucccaaccacccugaugggacaugucucaugaacucccugcaugcuccugucauaacuccacggugcgcuccguaacaggcaacaccuugagagagugcggcuacgggagcugucacaagaggaggucaggcaucaccaggacaccuggcuagccaugcccaucugcagacugcgcuucauccccaagcccaacggccugcggcccauugugaacaugaguuauagcauggguaccagagcuuugggcagaaggaagcaggugaccggacuuggccccuguacugaugguugagucuauacucugacuuaaguaagggcucaugaaguucugagggaggcuaaguaaccuguuguuccuaagucuaaaaacccagcauguggaaagggcuuagagaugggagauggucccaagacccagagagcuugggacacaaacccuggagaucccucagggacccugccagguagggucggcacuauauggccucuaugcugggggggggggggcaaaguaaccaggggggggggcaaaguaaccugacucuaccaccagggccuggaugcuucagcaucuggguuagccaggggcccuuguaggccucgagggucuucaaggcuuuccuuguccuaggguacucaaucuggggcaaugggauagcgagaggacuauaggcccaccaugccccagggucuuuugucuggaacgugggaugggaaugugcgguaguggaguggagaagcguggaguauccuccugcaucuagaguaucuccugacucuagcccagugggcauguucuagaaggcacuaccccuggaagaggaugagaacagguugaggcagguuggaugaaggccccacauacagucaauugacuuagugagauagauccucuaagacucuggcucuagaggagcucuggcugagcuauaggagucuauucugagaaaucgggguggucagggaacagucugccaggucccuuucuaauguguccucuauggcccuggcacaggcccagcauuucacccagcgucucaagacucucuucagcaugcucaacuaugagcggacaaaacauccucaccuuauggggucuucuguacuggguaugaaugacaucuacaggaccuggcgggccuuugugcugcgugugcgugcucuggaccagacacccaggauguacuuuguuaagguggucauuuggacuccugucuaucacauuugcucucauggucugggcucuagggaccuccuugaaauaagcaaugcugggugacccuguugcagccucuuguuggugauugggaguguuagccugcuacccuauacaggccaaaaauauuauggcccccaguucucucaagaucagaaagaccccauggugggggagggguugauaacuagcucccaggacagucuugagcucuauauggguucccuugacaguacauuccaaccucucuggucuccgcucugugcgagacccuuuggauucuggguccucuucagagaaguaaagccugacucuaccaccagggccuggaugcuucagcaucuggguuagccaggggcccuuguaggccucgagggucuucaaggcuuuccuuguccuaggguacucaaucuggggcaaugggauagcgagaggacuauaggcccaccaugccccagggucuuuugucuggaacgugggaugggaaugugcgguaguggaguggagaagcguggaguauccuccugcaucucuaucuccugcagguuugcugugggcagguuggaacccaggcaccaaggacagagccagcaggaccccugucccuggauccagccaugcuuaaugguacucacauguaucguacaggcagaugugaccggggccuaugaugccaucccccaggguaagcugguggagguuguugccaauaugaucaggcacucggagagcacguacuguauccgccaguaugcagugguccggagagauagccaaggccaaguccacaaguccuuuaggagacagguaagaccauaguggacucucgucgagacugugagcauguuggugacccgggccuguucacgucguggauaucuaguaucugucagugacacugguguggcugugauagguccacacuuguguccauggugccaaugaucauuugucugacccagccugccuccaucuaugggaacucccaauggagagccguccccuuccaggagauaaccugcaacuauucucagucucuggggccacuucaugauuuaugcauccagugaccucuucaauaggcagauggggucugcagguuuaaaaauggaaaaguuugcacuuaggccugggagcggcacaaagugacuuccuuugcuucucccugagguaggacauacaaggcucacaggcaaaccucaugcaugugugugcaguggccacgugccuucugugccaagggcauauccauaaucacugcacccaggagauuccuucccugguucggccagagcaaccaccaugcaccugugaggacagcauggcacgaguuaguuuucuccauccaccacguggauucugggaauugaacuaagucauuagguuuggccguggaugucuuuacuuguugagccuuugaugugccagccuuagguaaacaccugaaguuacacauuucucuuuaagagcucucagucgugccaugcacauucuggcauguugccaguucuuuaucauccuguucaaaaaucuuuguuuauuuauuuuaauuucuuuuuuugguuuuuuuuuugggggggggggguuuggguuuuuuuuuuuuuuuuuuuuuuuuuuuuuuuuuugguuuuucgagacaggguuucucuguauagucuuggcuguccuggaacucacuuuguagaccaggcuggccucgaacucagaaauccgccugucucugccucccaagugcuggaauuaaaggugugugccaccaccgcccggcuauuuauuuuaauuucugauaaccucuuaguuauuuugagagugcaggcauuguguauauaucuugcaucucuuuucuagguuaauucuugugcuauaacuccucugacuuuacuccugacacuacagaaaacccacuuggcacaugggauauuuguuuauuuugugcuaucacauguuaaugguacauaaguuucaguaugauagcuucauaagugugcauaaugcauuuugaccauauucacacauggagacuaacauaggaaauuuuuuaaaguucaaggccaaugugugauuucaaccuuugagagaaugaagcagaaggauuuguaaguuugaggccagccagggccacauagagacugcaguguucacgccucuaaauaccucacaccuagcguacuuggccuuguuccugugcuguaucaguagaugcugcuauauuccuucuggugacauccugucuugcagacacaggucuugguggccacucugauaaaagucaggccuccuagagaguccguugcagaagaugaacgagccaucuccucccuaccccugucagcucuuccuccuggccacacauagucucugaagaaaucagggugaugcuuguguugcgauuauugguaaccacaauuaaggagaugccuggccugaggaaagcugacuguggcgccuccugcuggggugcuggagucucucuuucccacacgagacucugcaauggcguggucccacgguguucuguuguugggcugugccuggccuggccaaaaaaccaugugccccucugguuccccucaagcauucaccucuucuuugcuacaggucaccacccucucugaccuccagccauacaugggccaguuccuuaagcaucugcaggauucagaugccagugcacugaggaacuccguugucaucgagcagguccuugggcuuccuauuaaugggccacaccuggggggagcuuuccaccuuuacuuggcuauuugcuuagugcaggaaugugaccaacaugcuccuugguagugggacccaugaacaagaguagcaggacugguagcagcccucaugacauaaccagaacccugccacuuaggugggcaugcuaaggguugcuuggaagugcccucuugucucccauaccuaagcugaacugguaaagauaucuccuuccucaguuuugaccucacgauccagggacaguucaccugcucuuggaggacaaguuggacaaguugaucugugauccccaucuuggcccauuaugucagaagcuguguuuccauaagccacacacagaucuccccaugcaaaagucagugguucuauagaaccuucuuugauacauauucuaccuuugggauggccauacucacugagacuuuuagacgauugccauuuggcucguugggguacugugugagcgucaagguuccagaccuagugcugugggaacagaaaaggucacaucacugcuuuguaaguuacauacccugucaccuugagucaaauucagccuagccauucagugacacuugacccuagcuccaccccaacuuuaucauaaauacuugggcuuaagugggcaucugguggcggccugggugcagcauugagcauccucaugccugucugucuacaugcuuuucuagagcaucucuaugaaugagagcagcagcagccuguuugacuucuuccugcacuuccugcgucacagugucguaaagauuggugacaggugggcacaggcauggggcaagugugcagagggugggcagaggcaggacaggugcagguagguagaggcuauccuggcugcugagcaaggugccugcugacuggcuacagcacuuagaacuccgagugucugucuccuccucauucuucccucccugcuccuccucauagaauugucuuggccuucugcuugcuggcuuuuaggccacagagcugucuacccauggggcuuuaggagccccuggauaagcauggcuccagugaaguuaaugauuuugugugccucgagcucauguuaccacuuugucaaggcggcaccucacccgugcagccgggcauggggcacacgaagcaccaaagaagagaguacagugcccguggcugaaucugcccaagacuaccaugagucacaagccaggcuaggcacucuuuuuuuuuuaauuacagaugcacagaaugguuugacguguguaguucuauaaacacauuuacugacacaaaugcugcuccuaaagauaaaaaaaaaaaaaaaggcccauuggacacacaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaucacaugaucaucucaauagauucaguaaaggcuuuugacaauagaacucagaggcuguguaacuugacauuugcuaaauauguaacacacuguaaaauaauucaguuuauaacccauuuucaaggagaaaaaaaaaaaucaacaaacagguacucuuuaaaaagcacugcuguggugaagagagcccagacuggcucuaugcuggagcagcccaccagccugcaaaggccuguuuugugugucuggauccgauguaagguugagugcuuaagcauuugguuggaccuucuguacccaaaguccccaccugugagacugguacaacaguacuuggcuccuuuuugcugaacuguuaggagcgccaauacugaacagaauuccaggguuauuagaggugaagucaggcaugacaaggaauaccugauuaucuaaauucacaauauguauuagaauguaauuggaaauguuagaugggcauacugggacaccacaagcuacaagugugcaacugagugucuucucacaaacacagccaagggugggccugacuccugaaagcacugagcacagacucaugagucuauguccauguggcaggaaacuuaaccuacucacgugguucugcuugacgcacuuaaaagucaaauccaagugcacagugccucugagcuuccugccuguuacucuaguggagaagaucuuagcaaaugugaggggugccugggugaccuccuuguccugaccaucuggugacacccaccccugccagcaccugcgugucugcaccugcauguauguuugguuccauuguguucucugagaaggcacucacuuuuuucacacggcugucaccaagaaugucccuucacuaauaaagcugcuaugaauugucccagauaaauauucaggaggcugauugcuuguuauucauaggauagccuuggagucgguggacagggauguggucugcaccaccccagguuguagcaagaguggggaauggaagagauaaggguaguacuuaacuuguuaucuucuuaggucuuagcagcugacaaugguagauaccacuguuuguguauguggccugugagcagguucacugaaggugucuguuuauucaugcacacauggggagggaugucagauacaagugugaaacccaucacggcugcugcuucugaccauauccaucaccaccaccaggugcuauacgcagugccagggcaucccccagggcuccagccuauccacccugcucugcagucuguguuucggagacauggagaacaagcuguuugcugaggugcagcgggauggguaaauguuuuuuccuuuuacugcucccaggggcugggucacugagugugugucacagcugguuuauguucgagacacaaaggccauugccuucgcuucaugaaaagcugugaagcaucccagagccauucuuguuaggacaguaaaacuguuguucucuuuuuuugaagaaccacuuuguuuuuucuaugugcaucccuauacuuagaguguuacaaguuggcucacuuaaagguagaugcucugugagaccucuugaugugucuuuuauuuagguugcuuuuacguuuuguugaugacuuucuguuggugacgccucacuuggaccaagcaaaaaccuuccucagguaaggaccaucaugccuggguuucuacuguauuaucaagggguguguguguguguguguguguguguguguguguguguguguguguguguuuacaucuguauaagauauaaaaugugcuaaggcagcauauuuaacugguuaguaauuuugcaugccuggggcucauauggucaccaagaccaaguggcagaggcaccucaccugugcauccaggcaugggacgccuguagcaccaaggaagagagucugauacucauagcugauccagcuuggucucaccgagcaugcagugagagaccaggucagugucaguauuuaaagaaucuccaaguaggacagcaggcauuaacucccaucccucccagcugaguccacagaagggcuauuugccaaggccugaggcacagagcccuccugggagauguguugucccugagaacauuccugacaacuuggacacuucacaucacaccacgaacaagcacugggugaacagguucuguggagucgcuuuucuuuaugggauuguuaggaagagacuagagaauuuggauuuacuaaacauugguguauugaggcacugcuauugcacgaggagugaucacuucucuuacauaauauucauacuaguggguuauaguguguauucuagacuguguuuauaguauauacagguuaggccagggauuugggcacaucugguuguaaaguuaauuucuguggcucaaacuagaaucagguacuacagccuagcuucagagcagcaaccauacauugagguuccuuaggcacugcagaguuugagguuucuucagaucagcuauuacagaagaggcucccuccagguacugugaaguuuguaggcuucuuuuuaggauaauugacaagagacgagaaaccugaaagugguuaaugaaauugagcccuaagaaguugucaccacugagauacugguguuuccagugcucugugcagacugccuauacuuguagcacagaaucucagagcccaauaggccuugcuucucaaggucaguaaaccagccccaaugaaggccccaccacaucuguagcacuuaggagcuaagugucccauaggcugcugccacuggggacagaggacacugcugcuguugaggaaauuuccagaagucaguuuugccccuaagaccuugucagggcaaugucaggaugcccugggugaaugccagggcaaccacgaggggcugcuaggugggcuuguccauggacaccuguaaggaaaaacuuacugcaggggcugaccagucacaaggauguagagcucacaggcaauggaugacaucaaguagacacacucaugguacaggaaccagacugcugcugugaguucaccuugggggauuguggagggggcuacaccucugccuucaacuuauuggaaaaucuauccauaggcaaacagucuuaucguuuagcauuugcugauaggggaagcaaugcacaucuacaagcaucucaaagaaacuacaagaaaauaggcuuugggggucauaggaagaggauuccuggcuacauagaugcuaagauuugacccacagagucaugugaaacuuuccacuugucugaggccugggcagaggaccuuacugauccauugcuuacacagaagacgggagcuaggcuacaguccagagcaagagugccugguguuccaucaggauacccacaaaccucuguucucucuggucccagaacaccucugagaacuuguguggcacaugcugggugcuuccaggcucccauaacauguuccuucucuuuuauucagcacccugguccauggcguuccugaguaugggugcaugauaaacuugcagaagacaguggugaacuucccuguggagccugguacccuggguggugcagcuccauaccagcugccugcucacugccuguuucccugguguggcuugcugcuggacacucagacuuuggagguguucugugacuacucaggguaagcacacugaggagccaugaggucaugggagcagauggugcuguggguacuauauucuguuuccuacuucuagacacaagugaccgugaggccugacgugauaggucaaaagguguucccuuucuucauggagaugggcaugggcaauaugagagcauccucagccuugucccaagucuccugcagaccauggagccaaggcugcccucuguaugagacugggaagggaugggaguuggucucuaccuaccaagaacucacagcccagaugucucaguguugauaggacagaugugaguuaggcacaggugaaaagagcuggaccguuucuuuuuaugagcgaaaaguaugaauauuaugacuuuccgguaggagacugauaaccugccguguugacagcugucuguucugagcucagauccaaacucugggucuccauugugcucuuuggagggucacauuguaagggaaaaguugggugcagauaagccauuuguacagugcccucacaggccugggcuccucagccucccugccuuuguaugcugaguccauccaggcccugggauugagcucaaacuucuugacuuccccucugccucccaggcccacuuuugcugccccagcccccagcucagugcugagcacaccaacuuaccugcuccagccccuggcacucuucagugucauggagucauggguaaaucagucaaagaagaauuuccccuuugagcguacugcuagagccugaaaacguacccuuaggaagccagccuggccuuggacaagggccaugagagaccauauguagaccauaagguuccugcuuccagaguccaugucaagaguggcugugagcucacccucugaggcuucgguguggaugcaucagcucagcucuuccuucugccugagccagggacagcgugucuggaggucagccggagugacuagcaacauccuaaagggaaaacauagugaacauaagaauuucuuuuuucuccucacauacaaaaugugaugagaagugacagaauaccgcagaguaucgugaagcauggcaccccuuccucuggccuccacccacacucaccggcaugcauucacacacauauaaaaauaagaaaccugacagagguaauuguaccugucgcuuguauucaucuuugaggaucaugcaaagucacuggaugacaagaaggcaacaccccuucauccuguccuggacaugucccaucuguugucccaaagugaccaagaugcauccugcagucugcaggugguuggacaccacuguaggcaaucccuuacuguuugcugucaccaaacucugacuggagauaauaugcuccaaucacagucuuguguugggaaggugcucugucaggcugcagucacacuuaaagaagcacacacaggguugugacuuccuauagauuuacaauuccuucugaacugaauuuucacagcucuuauuugccaccgaugagcaaagaugucugguaaucccaugcccggauaagauguauguuguucacuacaucugguuggguuuggcuguccagggcucuggcggugcuguaagcgagucccaagagccggaauggguuccaugugugaagguccaaccgcaucuaagccugccuuguguggcagagagggacaagagguggaagggcacugaugucggucucucaggagcuuagugugggaaucacacagaauaccuuugugcugcaguuaugcccagaccucaauuaagacgagccucaccuuccagagugucuucaaagcugggaagaccaugcggaacaagcuccugucggucuugcgguugaagugucacggucuauuucuagacuugcaggugagcaaacaggcagcuaccucaccuguuggaucuuaggauagauccuguucucugggggggcagggguguucauggauaugcacauguguguacaggugcaagccguguaugugaggaacauguagaaaaguggauguguacugaggaucccugagcauucacccugcucauccccaucacuuuccaauccugacauucgcucccacagagagaaagguucccuggauccugaccuuggcgguugacucuuaggccaugacugcugaggucucuguccagcaggggccacugugguaggcuuuggccucagcucucuccugcuuccuccccaugagggccuggcaugauuuuggugggggaguuuccccacaaguggcuuucucauccuauuugacaacaacacagaaaguguucauuugugaucucagggacauugcugaugguucucuuucucuugggacuccaggugaacagccuccagacagucugcaucaauauauacaagaucuuccugcuucaggccuacaggugagucaugggcugugccaccacuagagggaggcacagaccagaaaugccggccuugcugucggcugggguucugaagcucaaggcggagcugcucuuggcucccccugguuggguggccacugaaaugcagucaggaaaaggcagcauuuaguugagucuccacacaaccccauauuuguaagguaagacccucuucuggucucccugugcugagagagcacauguaaccuuaugugcuaaccagagcccguggucuugagacaggaggggaugcuggcauaaggagccccccaagaaagcaccgcagaaggaaucagaugagaaagggaagcagggggacccagagccccagaaagcagagaaccagagcuauugcugauagugucaccagucuugcaccagaaggcacaacaagcacccagcugaaaguauccuggccaccaaugugcccuacacauuggcuuaugccucuggaacauuuuuguccucgguucuaugcaucugaagucaggugcacuaggccagacccaugucauucauucauuacacagucacuacucuacaugaccauaggcacacagcauacguaggcccuuucuucugagguuuccuguagggguggaauugguuucccuugauucgugaaaggagagcugcccugcagagcuguagcagagggcaccauucugcugagaguuggcagauggucauaccaaccacaggucagauuuaugccacuguggaucuggcugccucuaaguaaccuccuggucacuggggcuggguguggggaagagcuugugcuauagaggacacaauuucagugucaggcagucuacccccgauaugacaugacguagcaggugcacaggguaccugggaagggacuaguuucaugacauuauauaggaaugaagacaugugugcgcgcacacacacacaugcuuguguguucacuuguaguuguaauuccauuuguacacgcaaauaugugaugcacaugaaucucuguuuauaauucacauguaugcauagacgagagcuugcacuuguguguaugcacacuuaccagggccucuuccucuccacuguggcucccgcccagguuccaugcaugugugauucagcuucccuuugaccagcguguuaggaagaaccucacauucuuucugggcaucaucuccagccaagcauccugcugcuaugcuauccugaaggucaagaauccaggugcguagacggccaagggccagcauucucacggugggcggggucucauggugggcgggcgggggggcgggggcaggggggcaucaugcacucacucaggagcuaguguaaccaaccauccuuccugggccucagcccuagcagguuagggagguguugagagaucaugagggucuguggccagcuggguucuucagccucugucugaucccccaggaaugacacuaaaggccucuggcuccuuuccuccugaagccgcacauuggcucugcuaccaggccuuccugcucaagcuggcugcucauucugucaucuacaaaugucuccugggaccucugaggacaggugagugagcuccuuccccucaaacagugagugccuaggugaacccaaagcuagaugguagauuccaugcccaucuccuggagaggggcccacucaggcagcccccaggugaguggagcuaguauucuagaccauagcuuccuucuccuccuucuugcucccucuguucugacucuuaugucagaagaggcccauggggugacaugugucacucaagaucccugccuggucccuucacaccucugcuuggccgcuuccuagaugcaggggaugaggguggggguccucagguuccugucuugcuucuguuuccagauugucaagcuugaggucuuuguguguccaagguggugguggugguggugguggugguguguuccugggugggacuccugcuuacgccuggccuacacauggccaggacuugacccaagcaggcuaaggaacuaccucaccccuuuggaaugaaaguugaguacaucuuguguugcagcccaaaaacugcugugccggaagcucccagaggcgacaaugaccauccuuaaagcugcagcugacccagcccuaagcacagacuuucagaccauuuuggacuaacccugucuccuuccgcuagaugaacaugggcauuguagccucagcacuccuggauccacgucacaagagggacuggucaguugugaggcuaggucauccuccaaaccucugugucaugggugguaugggagauugucccagugccuuguuuccuguaacaggcuugauuucuuuccugaugcccucagggaggcagauccuaucccuuuuaguggcagggauccacuagcaccagcacaugaggagugcacccagugcacaugggcacugggacaguggacaggugugagauuccugggcccuggagucuuuucacaccuaaccauggagccugucccaguacaucagagugccucggagaugaaaaaggacaucgagccagugaccuaaauuacagccugaauauacucugaauucaugugacugccuuagcuacuucucuacugcuguguaguaaaacaccaagccaacuuauaaaagcaggauuuuccuacuggagcagcagcugagaguuuacaucuugauccauaagcacaaaagcacaagacagagagagagagagagagagagagagagagagagagagagagagagagagagagagagagucagucagucagucuaacaaauaacuaagaaaggugaagggugaugaaguccacagggaucacgcuagggauguuccaugccuucucugaagcuaagauuccuuggcagcguuugacaguaaccauaguggguaccuacugagaucacuauaaagauaaaauagggggaagcguauuuguacugaacuggaaaaacauacaaauaaagaguaaaucauggaau

SEQ ID NO: 7129 - RNA, 23087 nt, Mus musculus
ggcgguggcgaaggcgcuacuuccgacuggcgcaggucgagcuaccggcagccgcuucucaccggaucccgugcuaucucagccaugggcaaaaagcacaagaagcacaaggcggaauggcgcucguccuacgaaggugcggaucccacgggcggggucuagguugccgauacgggcaggggaaggcguuccaggggaagggcguggucugugcugggcggggucccgugagaaggaggagcuuagagccagguaguggacaaucguaggaggggcgggguuagagcugaaaaagggaaucugcugcgaagaggcuauaggcuucuuuuuuggguccuguagccacuauguaccuccucucugacaccaggaagacccgcagcaaaaagagggcuuccgugaaggaauugggguccugggucucaggucggguuguuguacccucggaauauccucaguggugauuuugugguuugaaagagaggauugaacaccaaucugucaguuugagauuacauagucugugguuuugacaacuccuugcugucuagauucacacccacaggggugcaguauuucuacucaguauuuugcaagcuugaccuacguacggucugugugcagauuauacagacacgccacuggagaagccucugaagcuggugcucaaggugggaggaagugaagugacagagcucucaggaucuggccacgacuccagcuacuacgacgaucgcucagaccacgaacgggagagacacagagaaaagaagaaaaagaagaagaaaaagucagagaaggagaagcaccucgaugaggaggagaggaggaagcggaagguaaagguucaauggccuaagaugggucccuaaucacgccuggcuauaccguugcugcaguucugggcuuccagggcaucuucaggugaugccugucaggugucaggaguggcucuucuucccagucuggggaaugcgcagacgugugcggagccugcauuaccagucuaaaaggguucuggcuguucugugcccucuauucuuccauacuuacaggaagagaagaaacggaaacgggagaaggaacacugcgacucagagggggaggcugaugcuuucgacccuggaaagaagguggagguggagccacccccagaccgaccagugagagccugccgaacacagccaggcaagacccuguccccaaacaugaguuuccuaccuugucuauagcgugguuaucuaguuguuggggacauuucacaagcuaaaaaugaguaaauucucuugaagacugguaaaacagacacauggaugccagagaccaaccauauguguccuacaaaaccuacuauauuuuuauuugguugguuaguuguuuuguuuuguuuguuuuucugguuuuuuguucugguuuuucgagacaggguuucucuguauagcccugacuguauaguacucacucuguagaccaggcugaccuugaauucagaaauccuccugcaucugccugccgagugcuuugauuaaaggcgugugccaccacgcccagcgaaacagggcuuuuuacuguagcccucucuguccuggaccuuacucuguagaugagcuguccuugaacucagagaucugccugccucuggcuccugagugugggauuaaaauggugcacaaccacugcccaguuuaucuacaguauuuuaaucugguuaaaguuuaucguuuuuuaguguagaaguuuagcauuaucuguuuuacuauuccaaacagcaccaucagguuaauguugcuauaucacucauauaagaaaagcauauaucguggaaauauggguaaucucccgugggaagaagagaccccaauacaggcucuccugguaggucuggguuucuuaaagugaccucaagauugcauguuggaagcuugaggucuuugguaaguuucugacuugggcagccccugucagggaugacauuucaccuggaaucucagucuuggcucuuggauucccugcccccccccccagccuucuaguauagaaagaauguuuaggcaagagggucucuucccucauggagagaaacugaggaggcugaguguuggaacaucgauuaucaggaaacuaauacuagaaucaguuaccaugugauugucuggggagugauuuuucucuuuugaaugucauccuuuggcuguggauucgaccaccccugaacuggaaaagcccugaacuggaaaagguuuugagauaugcugugucucccuuugccaaccugccuguguugggagcugugcccaaguucucaauucuuguuugggcuucaaaugcugugaaguugcacacccugaugaauauggagcuuucuaaugcaggaaaugaagucuugcuguuugauuugauucccuugcuuucuccuuauaaacccagcugagaacgagagcacaccuauccagaggcuucuggaacacuuccuccgccagcuacagagguaacccguguccccccugucauccccguguccccccugucaucuagcagggugugggcagccugggugcaggucacaacuuuaagggccagggagcucguaugcugcauuccuucuucuccuccuuucccaucugaaguuaguguugugcugccuccagagcacugccugucauggguagagcugggauagugucauuuuuauugaauguaaaauauauguuaauccacugaacuuucaagaagcaaguuugcuaguuauauaaaucuuuggauuguaaaaauuuuuaugucacuuaaaaauuuagacuuuagaauuuuuucacuucaaagcuauuuuugcuuucagaaaagauccucauggauuuuuugcuuuuccuguuacggaugcaauugcuccuggguauucaaugauaauaaaacauccuauggacuuuggcacgaugaaagacaagauuguagcuaaugaauauaaaucagucacagaauuuaagguaaaugaguguuacuuuccgaaacaauguuuguaaaacugugggugcaugcauggucgugccugugggugugcucgugcucaagucauuuuuauuugauuuuuauaauucuuacagauguacuuauuuuguuuugccugcauguguguaugcguacuacauguggucuuggugccuuuggaggucagaagaagacacugaaucuccuggaacuguaguuacauauaacugugagccacugugucagugcuguggaaccaaacccgaguccucugcaagagcaacgagaguucuuaacugcugagcuaugucucuaccucccucagguaguuuuuaguugcagguguuugcagaggacuauuuuggguaggugacuguuugcuaguguugagggaaacaggggcuugucagcagagaacuagaagccagauugggugcugugggcugcuaugaauguauuccuuucuucuguugaagcuucuguccuggcauagacaggacguuucugugggcaacagcguguccaauuugacuuaguuugaaaguggcuguuuuuagaagcauguuuuuuuguuugguuuuuuuuuuuuccuaauucuuaguuuuucuuguacuaauuguguacuuucacuuuuuguuacuuuuagaauguuugcaucucuugggugcuuugcuuuuaggccuuugcuucuugauuuuggcucugugaguuacaaaugacuuaguagcuuggcaggcaggaacaaugaguguaugaugauaggguaguguuuuggaaggaacaucacauuuuuuccuuaguguuggaaaaguuuaauuuucuguuuuucaugcaagaugguuaugaccauguagcaagaugguugcuacaagauaggaaggaagaagggaucuuaaaauauuuguacauucucucucguaaaaucuacauauuaauauacgaaaggaaauggaagaccuugaccagcuuuucacugggaaauuucucaugcacauaaaaauucauggagcauuaugaaaaucccucuugaguuauugagucuucccaaguacguuuuuugcugaauuucauuccuucucuuuggccucauuugacaaggauggagaacuuugcuauuaauuauguggcaaauuacuuguuucuuuuucuuaggcagauuucaaauuaaugugugauaaugcgaugacguacaauagaccagacaccguguacuacaaauuagccaagaagauccugcacgcgggcuuuaagaugaugagcaaaguaagaaacccacuagagcaauggcacugagcugaagucuucuaacucucugugccuaacaggcucacaaugaaugacacgcuucauccauccgccacacccaggugccgaccccugcucuagacugcccuauccuccaggcacugccucugucugcaccuucacacagcuuagaggugccguuauauggggcugaugaaaaguugugaauauagggucagucuugcuggaucacagccagccuugugguuuuugcuuuguggggcagccucacugacccucagcacuacaagcuuauccuuuggccauuccaaguggcuucuuagaucuauacuguaagccaggcuguaugagccacauauuggcaagggauacuugcugggcuccaccauucccucaccaccaucucugggccaaaccuugaaugcugagcccucgcaaccauucccgcugcagcgucugggaagguggcgauuaggccaggugaggccguggccaucccaugccaucccaucgucacggcuccguggcugagggagagguaaaguccugcugcucuguccuuucugauucuaggagcggcuguuagcuuugaagcgcagcaugucguuuaugcaggacauggauuucucucagcaggcagcucucuugggcagugaagacccagcagcugaggaaccuguucccgagguugucccagugcaaguagaaacuaccaagaaauccaaaaagccgaguagagaaguuaucagguaaggcucuguaguagguguuugcuuguggagcugcuggcuacaagcgggacugcaaugcuuugcccaagcaagggcaaagggagccuguggagcaucucagccuggauggaggagcaggaucucuaaggauucuuagguuccagcagccccuugguguagcccaggggccuugaacuggaugccguccuggcacuggaacucaagagggaaguggccacccuguucugcuugccuuaagaaugaagugauuguaucacauaggugauauagccuaucaccuggguauguuugcggacucuggagccugcagggcaguucugcgugguaagauagccacccaucacaugcucuaaugcuacuaucauaacaacucacgcuguugauaaaugugagaugcaaggggacugagaccacccucccgugugccagccacaugcccugggauccacaggcccaugaaguuaucccugcagugcauuuugcuagcuugucauuacugaaugaaguagucaucccuuuaguaaaugcccucuaugcauaccaccugguaaugaccuauguucuuaccugugcagagcacaauugcaguaaguccacucuagucaccagcacucaucgugagaugcugucuguaagcugacuucuguagugcuauagggagacagguagccugauguuuuucaucaggaagguuagggugcuucagacauagcucccugaagcuuuguuccuguccaucaggccacagcuaauuaaggcaccuucagaggccguaucuauauccuacaccagagggguuacagagugccccuuugucucauggaugcugagcacugagaccgaauugauguuaccccuucaguagcagaccccaaggagcauuuaagcaaucauaggaaguuggaguccugcgugguuucuuuccugucacuauccagcauguggcugcccugacugugguuugaacucugucgggugacucaccugaguagcucagaaugaaaugaugaguaccauacaagugaaggaugggaggucucaguuguauuugugccauaugccucucuuugggucuguaaccaaccuguggccuggcauccugugaggcugagagaaagccacauuuucccaaggcaggcgcccucucagcagacagcuuucuaaugcacugcccauuguccucucuaggggcaccugcugccgucuguucccuuaguucaggcccuacaaguugucuuggauuucccgaguuucuagcuaguagccuugccacuaaaauucugcccccaucugggcucuauggcuuuuagauagaguggauaguugugcaguuuuuucugaauucccagacuucaaaguccaugaaaugcuacagaucacgugcaccugucagugcuguugcuguggaacucuggugagggacaccuuuauccucugcuggacuuucagggaacagcuguggcuguuaaagggucauccucuuguugcagcaucucuuaugccagggcagagaggagcauguaugccuguuucuacugucugcaggggaaggcuacccccacagugccugaacugaggagcccagggcuuccugcagcucacccuuacugccaaugugacacucugcacagaggggacugagugauguuuccuuucauaccuaugcaauuucugccacuuuuuauuuuucuguuuguaagaagacguaaguguuucucugagaagggguucuguuuggcuugcacuuuuuuacuucagguagagaucaugaucagagcauguagggaugcuaugggacguggagggacuagacgucacccagugcugccucugcaagggaacuguugauaaaagcuacugcuguugggaaucaaugggcugggccuggggugacacuuguuucucaugccuuacagcugcauguuugagccugaagggaaugccugcagccugacagacagcacggcagaggagcaugugcuagcccugguagagcacgcagcugaugaggcucgggacaggauuaaccgguuucucccggguggcaagguaguaucugcggcccuccccugaaggccaugccacuuggccucaaacacugaagucuuugcaaacagguaucuccaucaaaauugggaguauuagggucuggccugaacuuggaauauggcauguccccacuauauccggcuuggguuggggccacuucugacugacccuauugcuuuagaaggcccugauagccaggauucccuaaaaguaaagccuacuucauaauaaguauucacaggggugauguuagcauuccaccucuuuguucaccuguggaucucuccuuuuugugagccauucauggauuauugcugcauguguuaauguagcugucuacagucucagcuauggcagagggauccaccccucuagagccugcuucucuguagagcaaggugucaccacucuccaggcaccuuuucuaguacaaguugaugugguuaaaaugagccuccacuggaccugacaugaucuaaaucuuacaaucuccauguaagguccaucuuaacaguaacuaagacuuuacuuuucuucucauaccaagucuucaaaaugugcauuacguuuuaaauacugaauauugaaauggcaacauuuuggacccuucaguugcaggaucugccaccuuucuggccucuacccuacuuaacuugcucucugacagucucccaggggccuccgcaaucacaagaccucacucuuccugcauauggccaguguucugaacaccucaucugcacaugugcaccuuccacacccugacauacuguccuugcauaagacugcaaauagucaggccuuuuguguuagguuuuuaguggagucaugcuucugguugccuuagagauggaggcauagaccacuguagagugguaugaugcuuuuacccagcuggcauucguuaucucauuuuguucuggcuuaugaaugguuuuaaauauuugcuucugggucaaggcuuuuauuucagaaacucuuuggucaugugccucagcagugcuuugaccauauauguguguguguccuuggucauaaucagauauauuuaaucaugaacaauuggccucagucacaagcagggcaaucuuuaauccuugggcgugcgagagggagucucugguccuuucuccuggagaaacugguggagaugugacuaguaugucacgugucucuaguagacguaacuacugggggauaacacuugggugcugcuuccuugcagaugggguaccugaagaagcuuggagauggaagucugcucuacagcguggugaacgcaccugagccugaugcugauggugggugcucugugcggggccucaaugcuugcacguuguccucugagcucuguacaugcucugagaugcagaguauguaucacacagucacgucaccacuacugguaaugagacugcagagcaguugccuggcuuccaugugcacaguggagccuguguuaugcaaggagcuaggaugccaucaggccuuuauuggguuucucagcauggugauacauucuuaagagcuggaugucacugaugauguaggaagguuucaugucuugaguucuuccagcacuccuuccucaugggccauaugcugaccugcaugcuugugaaguucagaaauauucugaaaggaagguuggaugaugaugucagggcaugucuuaguuggaaacauaaaugccaucagugcaccagccuggaaggguauuucaugcauugaaacgucuugagaagguagcaguugugucuaugaaugacuuugggauugcagcaugccuacagacacacuuggagagggugggacaugguggaugccucuuuuccugcuuugccugagucucuccugcacaggcagacaucucccucagcucuucagcuucuaaauagucuuguacagagcacucugucgucaggguuguuucaucuguuccaguguguacaggguagacacuuggguuuuaacuguuaauggaaacacguuuuguggucuuuaggagaaacuacaugggcuugcccauacuuagacuagaaauucagugcggaaaguucaaguuccugucagggguggagaaaugugugcaugggaaaaccagucagcaguuguggagccugaggaacguguggaggaucaggauggccagcaagugugaaccuuagcacgcagugcugagugagcacuuugcaaaggugaaggcaagauagccccagacaugaugugugugugugugugugugugugugugugugugugugugugugugugugugugcaugugcguguacccacacacacccauuuagagccagagggacaacauuuguuaaguaucaucuccuuguuauuuuuuugagaaaaggucucucauggucuggaacucgcccaguaggguaggcaggcugauggcgaggcucagcaaccuucuuauuucuguuuccccaacacugggauuagaaucaugcgccauucugucugauuguuauuuauuuauuuuuaaauagaaauuugggggauugaccucagcagcucaugcuuucaaggcaaacacuuugccaauugaaucaucugucugucuagcuccagacauuuuuuuuucaugguaucgaugucaaggcaauuacugaaucaaauugaaaugguguuagcuuuaagaauuauuucuugcuuuugccaaaucaguuuuaaaugaaucuuguagcauaaccaugcuccaccucgccaugucuaaagaacuauagagaaguugcucaucacugagaagcugagcuguggccaagcccuccugauguuucccuccugugucuucugcagaggaggagacacacccuguggaccugaguucacugucuagcaaguugcucccagguuuuacaacauuggguuucaaagaugaaagaagaaauaaagguaagcacagugacugauaggagcucuccagcugaggguggcugggcucaguggggaugugacacuguccucuuccgugauuuucuucaugguuuuguuccugggucuagagucaguuuaguuaguuaaucaauuaauuaauuaacauuccagaugcuacccccuccugcccgacccucacagggucccuccauaccuccccuuugccucugagaggguacccccucuccagguguccucccaucuggguacaucaagucugcaggauucagauuuuuaagacaaaugaagcuuagcuccauuaaaguagguggauuaaagucauaguuggaguugaguuccugcuuugcagucuucuccccacugaaggugaguucgacugcgcucacaagcuucuucucacaggcuuccauucccucccuccacaggagucucgguucaggauccugcugguucugauagagagcuucauuucuuaugccaggcuuaaucuuaaccauuuacagggugaugcugcugccuagcagcugagagaccuagacagggugguuguggguggcagcauggccugagagaggcagguacauuuguauuuguggggggucuccauuuauaaugggucuuguaguguguuuggaaugugugguuguacauaugugguaauaugugugcuugugugcuuauagggcuugcuuugacuuguucauguguuucaggacauauguguguccuaaggcuugcuuuggugugugcacagguaugcauuggagaugggagaacacucaaaagcugaugcuucuuuguggagcugaaagaaauaacacuuccuucccuuggagacacaguagccauccuggucugaaccuagaugugcuuugaugacauuucuucugccuuuaaucaacuauaggcaauacaaugagacgcccauuccaagaguaacgugcuuagaauugguguuucacugccugucugcagcuauucugucuugaguggugggaaugggcgggguggacgugggcuuguccuuuucugugucauugcuucuuuucuucuuugucgcauccuguguuccucaccuuuacuguggcucuggagaaccagcucaaggucaccucugcaccauaagcuuugaccauguuuccuuaccuucagucaugcacaacaucugcuuuuuugauauuuccucuuguuacaggggggcuuggcacagccucacuagagggcauuuucuuucuggaaugauauuuucuacaucuccgaguauuagagacuguccugguugguuuugugugucaacuugacacaaguuagagucaucagaaaggaaggagccucaacugaagaaaugccuccaugagauccagcuguaaggcauuuucucggugaucacuggguagagaccagcccauuuuggguggugccaucccugaacugguguuccuggguuuuguaaaaagcaagcugagcaagcccuggugaagcacgccaguaagcagcacucuuccauggucucugcaucaguuucugccuccagguuccugcccugcuugaggucuuguucugacuucuuccauaauggccuaugaucuaauaauaagcuaaaaacaaacaaacaaacaaacaaaaaaccucuuuucucuccaacuugcuuuuuggucaugguguuucaucacagcauuagaaacccaaacuaaggcagagaccagccugcauucagaccaucugugaugugagaucuacccacaccuucccucaccucaaccccucccuugauaguguucacacuucauuuuugagauguugcuuguguuuggcucucagcucagcaguuuuguccccaagaagcauugcagaggagugauugcagcauaagacauggcaugccugccaccauaguggaugucaguagagguuaggaagcauugagucauguagacauaaccugguuuauuguuagaacccugggcaagaguguauccagugugggcccaguuccugguucuacugagggaguucaugaauuggcuggucccaacaaccacuucugcuuguccaaguucaucucuacucagucuuugcuuuguagcccuuggcccacaggugugaaauggggugcugaguagguacugcaauuacccauagauaguuucugcugcugugugugugcucaaacagaaaggaauaaggaagagccaggcauggacucagguuguggccaccuggagggaacaauggcuguggccaugcugggugugcccugagcaugacucugaccuggccucugcuuccuucucuuuagucacauuccucuccagugccagcacugcacuuucaaugcagaacaacucuguguuuggggaccugaagucagaugagauggagcuucuguauuccgccuauggagaugagacuggugugcagugugcacugagguaagccggcucacacacuuaugcaagcagcuuggcccugcugagagcucugggaaguacagcccugucgguaaguaagguggugccagcacaagcuccgguacuauuugccauuguccacaucucugccauagaccugccuugcaguucagcacaauuugaagaaggcagugauccagacuauagcauaaauaaauauaugugugcuuagcaaaugggguauacuuacaaggaguccuuuuucacagugguuuugagguacauuuccuagugacuguuacucagcuggagccacaguaaucaguuuccaacgccaaggccucacugugcugaaaacuggcagucugaggcccgguuuuggcaauguugguuuaaugcagacacuaucuucucuccugucuccgcacagccuuuccucuauccugaucuccuccucuuauauauaacacuagugaaauuggaugagcaacucuccuacugaccucuuuucaccuuagucacuucucacaagucuacaaacacagucacauucucaggugcugagguggggacugagacugacgcgcucggguggagugagguaggauggcggaggcaaaauucaugacagccuggaauguagcauuacaacuacaauugugaagcuagagagguggccaccgagguccgcugucuguacacauugucagagaucccagaugauggccuguauuuuaucagcgacucgguuuaucuaggauuagcucugggccagcagccuugcuugucucucugaaggaucuucagggucuaggagccuuaggcuauccuugauggcuuauucuaugggguuuuuguucucuggcuacauuuuaaauuuuauuuauuuuuaaccuaauauauucauaugguucagaaaucaaaguauaccaaaaggugugcccugagucuuacccuaccacuccauaugugcccacuuaccacaucuacauuuccugcugcuauacuucuaaaugucagacuggcagauguagacagccuuuccuuagagauuaaugagugugucuuaugacuuuauauggauuugugugccugccuuuuguuuuuucuugauuuuccuggagauuuaauuauuuuuauuauuauaauuauauuguaauuauuuuuauuauuuuuaugccaugaacuacuuuaaaauuguuagcgagccauuagucuagugccccauacauauaugggaagcuccagagacugucuggagucagagucauugucacuguuggagucagucuugaaauuggagcgugaugcuuuuucagcaccuuccaucacacaguucccuucuagccugcaggaauucgugaaggaugcuggaagcuauagcaagaagaugguagaugaccuccuggaccaaaucacagguggugaucacucaaggaugaucuuccagcugaagcaggugggauuugcaguugaugagcccuuuuaggcauaggcucuugucuuaguuaggguuucuauuccugcacaaacaucaugaccaagaagcaguuggggaggaaaagguuuauucagcuuacacuuuccacauugcuguucaucacuaaaggaagucaggacuggaacucaagcaggucaggaagcaggagcugaugcagaggccacggagggauguucuuuacuggcuugcuuccccuggcuugcucagccugcucucuuauagaaccaagacuaccagcccagagauggcaccacccacaaggggccuuucccccuugaucacuaauugagaaaaugcccuauagcaggaucucguggaagcauuuccccaacugaagcuccuuucucugugauaacuccagccgugucaaguugacacaaaaccagccaguacagcucugguucuaugcuuggggcugcuccugugcagagaguccauucaacccacuagaguccaaggagacaggcucuugaggucauugcuggcuguucuuggcucauugagcuuuaaaaguucuguuuuuaagagcugucuuuaaauacguuuggcaguugcuugucaugucuucuguaaccagugcccauguuccucucacugacaucaccauuccuccuggggaaugugcugaaggccgagcucuucucagcucuugcaugucuuugccuuugaaacuuguuuucucuugacgcagucuagauggacuuuucuuucuacucuaacaaagacuaacauuaguuguuuucuuuucuuuaaagauuuguuuauuuuauauaugaguacacuguagcugucuucagacacaucaaaagagggcaucggaccccauuacagaaucccaugguugugagccaccaagugguugcugggaauugaacucaggaccucuggaagagcagucggugcucuuaaccgcugagccaucucuccagcccacauuaguuguuucuaaagaaacaucuguggcccuuugugucuuuacuuucuguuugugaugucugucagaguugacacuagacuugacgacacacuguagccuggggccaguucagaccuacacuauguauauucacaagccagagauguguuuauguucuaauuagacaggcugguaggaugauuuuuccaguacuagggauugaauacaggacuuuuuacauucuagaucaguguucuaccauggaggcacaccccaguccaaagaugaguaaauuuuauuuguguguguguguguguguguguguguguguguguguguagugcauauggauaccagaagucaguugcaaauauuguuccucagauaagggucucacugaucuggagcuagcugggugggcuaggcugacugacuccaucuucccagugcuagaacuacaacuguauaucauauccagcauuuauguagguguucuagggauccagaucagguccucauaccugugaggcagguacuuuaccaaaugggcuauuucucaacuucuagagauuuuauuuucuucauuugaagagcauugaucuucauuuuggaaugaaguuguuacuugugaucuaguacggccauuaucccaaggcugugugaccauaaugcaaaagaguaguauugcugggucucuucucauggccaaaguuuucuagauggucucuguucuggcuagguagaguuaaaaaaaaaaaucuguccauacuagcucugagacuauuuuggcccauggcuuccaugucucuuggucuggccugguagccuccucuuugucuaacgagauggacagaauucuugugccucauggagaauucagcccuaccagccaugugcuuggcuccuguucugguugccaucuuuuuguuguguuucuuuucaggccauuuauuuaaagccuuuuucuuacuacuuuguagaugugcaaugccuggugcacauaaaaagaaaagaggaaaaauuuugagaauccauucucccacuguggguuccugggcugagcucaaguuguuagacuugagcagcaagugcuuuuaucugaugagguaucuugcuggccuagcauaugccaauuuuacucauacuuugucugguaugggcaagaaacuacucccuguggcccugaagugagguugugcuguuggugauuucugaauucauugucuaagggugaauucuguauuaggguugaauaauuuuauguauagcaguuaaaaauggcacugaguacucaagauauaaugcuagaggaaccaucugcaagggacagaugguaaaauaaaggccauguuucuaauuaaaaguuggugaaaauaauugcauaacugaaucucagaaacacuaggaccaaauucauggguguagaaguacauacugaaugacccuuuuugaggauugugacaaaaggcuguuuuuaaggucaugcucuugcgagugcacaggaugaagguacauggaguugaucccacuucagcaguagaguggcugucacuccugccucugucauaccucauccugucucaggucaugcuccaggcuaaacaaccaggccuguuuuucucaggcugcccauuuugguuuguuuuaagcauucacuuugauguaaauuuggggaucuucuuacccauguccucucucccaaccccagcaugauaucugagcacuuggcugauauagaguaaguugaccagucauggucugucuugacugcuaccugcaaagaaucuuguaaaaacucgugcuucagccauggauuuagucaggcuuuagugagcaggauccuagacagugaaaaagccacuauuaguguaauguggaugaauuacucuguaguauaaaauuacauuggaaaaacuuguuuccugucuuguuacuuuucagaggaggagcauccccaugagaccugcagaugagaugaagguggguuucccaagcaugugaauagcagcccagcuuugagguuuguguggugguagccauuagccauugcagugaguggcugggcagccuccugucucuguucuggcugcuuauuuuauugugggacuucaguggcacuuucuucccucguuuacguuuauguuggugaccugaacaaagggcuggaaucuucaaagcuaggcacuguccucaaggaggguggggaccccuuucccuugugacucgacaugguuggcagcacugugggcuugugcuguaacguuuucccacuggacagcagugaccuguauacccgaggugaccaaucaugcuguugagucucagguuacagggaauauuguaaggccucaguaugggaacaugagcagaagcgggcaacaagaacuccaggggccuggggaacuguaguaucacacuuucugagagagaaagcuuugguuuugaaaucugcuguguugucccuacagaugugguggugggcccuugaguuccaugugucuacuuggccuccuuguggccuaccucccauauucucacagugcuauuuauaccccuaagaauuuagcaaaaaguguuccuaguugagaagaaagcugucagagguauauugaucugaguaggucucuggacauggauuuguacuucuauuaauaagaguagaucccauguuccuuggggugcagccacuagaacaguguucauccaugucacuuacugagagauggccucaacuuuagcacauccuauugacuuacauagcuggcauuagcugacauuugugcugucuguuaguugauguuuuucucaucuucugcagguuggggauccacugggagagagugguggcccuguucuggacuucaugucaaugaaacaguauccugaugucucccuggauguguccaugcucagcucucucggugaggcauccagggcacgguuguauguggcuucucacguggccuccaucucucccugugaugugugaugucguaagaaagcaucauuugguuucucuguguuucgugggcugcccuggcaaacaacacaaccaaggagaaccugucgggacucaaaacuuagcacuagucagaacaggaaacacccuggggcugugguuagggccuaacuguacugucaacauaugggaucagaugcugucuccaggggacaaugucagagcuagaggaagaggacucccaguugauaucugcugguugcccugugaguuaaaaacccaauugagccugucagaaguguuaugcaacuuaguggugaagggcuugcuuaguuaguauaaacagugcccuagguuccaucccuuuuaucaaaaauaccaaaacuauuaaaaccccaaacuaaacaaaacaccaacaaaagcacugguuuguaagagaccaggaaauaaaaauguauguguguuuucuucaaagauucccuuggucagacuaucacauuuggaugaagugacuucugucacucacugaucucagacaggucuuguugcaugucacucugaacagcagcuccaaauagcccugacugugugccccugugccuuucugacuugaagcuguuccuguuugguagcugagaugcuuggcugcugaucuuauacauagugugucagccauguaucagcaugcucgcguccugaagaugaacccugucucugguaggaaaugcugucuuccaugagguguauagugucuucugucacauaaaauugaugacagcuaggagccuugacaaugucuuguguuguaucccuuccuuucuucuuuuguauauaccuuauuugccuuaugguccuccccuggagcagugcccauggacauuugaaauuauugcauggaggaggcacaucuuauagugaagauggucccagagucagcagugucaggcugagaaaguaggcauuucuuuuuuuuuuuuuucuuuuuuuuuuuuuucuuuuuuuuuuuuugcgaacauuauaaagguaacagcaaagugugucuggccucacacugccauugguuggaguauuuuuuagguaauuuguguuuaauacaauuaaagggauuggguucagaucugucaucaucuuauucauugucuuucauuagcucuguuuuaguccucaagacaccccagaugccagaccccaggauagggucuuuuaggacaaaaaccagaacagucucuggagagagaaggcacagugggaaaguccagagggaaccagauacaagccccaugaguuacaaggaacauguuucagucuuuuaaugaguugugacaacauacucgauggguccuuagcaccuggguucugauuggguuggggcuguuuaggggccacuauguguacccuuccagguuuggccuauguugguuccaggccccacaggaguagauacgguucauacucugcauauacacaguaucaguuaguggugggguucccugccuuccugcaaugcaaaccugaauacuagccuuccuaguaacaguggcccaggcugcucagucagacagacuaccuuugucuuugcacuuguaaaauuuuucuuuuuacaacuuuuuagaaguuucugauauuauuaggagacacaaucucccagcaaacucugugauccucuggcucuuacacucuuuccaccuccucuucccuaauguuccugaagccacucuuagcucuuggcagaggugagcucuuggcuccucgggcuaagcuguguccuuuucacaguccaggguagugcuuugcugagacaagucaacacuggggccuagcuccuagguagggagcugcauggagacccagcucagugagcuuauuugcauauucuguccguguucucugcacuaggccagcaucagacacauacuuucuguugacaaaguuguccguaguguugguugcauugggugaugagacucaguguagcauucugcuugaauaaaagacacugggucugguuccuucccuacugucagcccugaccugucauuaaauuauguucccucugcuaugaacuccaccagcagugaccuuucaguugugcugugugucuagucagugcugacuauguuugccuguguuccauccuuuuugucacauagggaaaguaaagaaggagcuggaccaugaagauagccacuugaacuuggaugagacagccaggcuccugcaggacuuacacgaagcacaagcagagcgaggaggcucucggccauccuccaaccuuagcucucuguccacugccucugagagggagcauccuccuccagguaagggccucauacagguuaguaguggggauccgcacuggguggaggaucaggcccacagggccaaggugguggcuuuggcacagagguuuauucugggagguuucuauacccuugugcaucccugggggccagaacauuuguuuggguuauagauuuguugacacaugcuuuuugcuauuccauauuuuauuacuuggauauaugaaccaaugaaguguucauuuucuaucaugagaacauuaaccaucccuggcaagggguuuccauguuuaaggagagaugagccacaccacugacacucugacugacaucccagccacguguagggucucagaugcugucucuguagcuccuuacaaaacacuugaguuugcugaaugaaucagugccguuuccccagacacagcacugacaacaguucuaccugaguguagcuuagugacccagugaguuuaugggaguaauuuauaggagcauaguuaaguuguuccucugucucuuuccaugauguuccuuaagccuuggaguaagugauaugauuauuuuccucuaucugugacugagcaugggaccaccaugacacaucaacaguccuuuauucuuaagaacugaggcuggcaguggugcucugugggcauaaacacaaauaucucaaaggcagauugauaggcaucucauaugcauuuaacaaaacaguaguaguuacuucccuacugaggccuguggccucccaagcccccgcuuuuucccuggauuacagugcuguauguaaauuucuuccuguguuaauucaaucaaaaaguggguuguuggacauaaaagcccacuauucuaucacuggguccaccuugcauggggucuuaguuacuguuguauugaugugaggagauaccaugaccaaggcaacuuauaaaaugaagcauuuaaaguaccaggcaugguaguauacccuuuuaauuccagcacucaggaggcagaggcaaguggaucucuguguguucaaggcuaucauggucuacauagugaguuccaggauagccagaacuacaucagagacccugucucaaaagcauuuaauuggggucuugcaguuucagaggguuacacucaucauguagggagucugguggugguagacagucaugacacuggaucaguagcuaagaacuucacccacaggcagcaggcuggaagacaaagaaacugggccuagcaugggcuuuuaaaaccucaaccccuagugacauaccuccuccaacagggccacacuuccuaguccuuugcaaacaguuccacugacugaggagcaaauauccaauauaugagccuauagguaccauucucauuuacacuacauacacucuuaguguguaugguacugacaggguccauaaucaagcagccaagcagaacuguggauggcaaaauguauacagcaaacucugugguuguuguugguggugguggugguggugagaagauaucuguagauaauuacucaccucuacaacaaguuuaauuuuuuccuuugaaguuauaucacuuacaucuucuguaaacuguugcuuagcuuuaaagccuuccagcagcucacuaacauagcauuugacuuucuguuaguuuuuuuuuuccccuugugaacucuggcuugacacaaaucacaaaucuuacccuauuugucuuugagugaccuggacagacucuuuuguuugcuuuuccuuuucuaucaccucuugauugcuuuugcacuuuaaaauuuacaugcugacauaagucauuuacaucuagcagagccuccucuuccauauggguccuggcucaucaugggacucagcaaauccauuacagccccucaccaguccuaagaucucugcucaaccaaccucuuggcauuccugugaacaccuuacuauuuacuuagucugugacugagucaaacacugccucuuucauccuaguuucuucaguaaugacugucuuuucucuguggucuuccagucccugauauuugagggaaccucagcucaagauaaccaagucugccuacuaccuagaaugagccaggccuuuaggagcugcuuccccucgccuccacugccuucaggaacuacuuccccuagccugguugcagcugccagaagaaaaacaagaguuuuuaugaucaccuuguguaucaugcaaaguagagcccaaggagauuguagacaucccugauucagauuggggugugaauguaccucugucuggugccggggaggacauuggucuuauuagauagcaguacagauguugguuucaugagcuuugcaguuacguuugguaugcuuaaaugccaucuucuuucaaacuuacaggaaguccuucucgccuuaguguuggggagcagccggaugucgcccacgacccuuaugaauuccuucagucuccagaaccugcagcuccugccaagaacuaacuugugguguucccagaugguuuauuuuauuuuucuacauuuuauuugauacaguuuuugucacaagacagaaacuuuugucucauccucucuggcaaguagcagccugaggaagaugcuggcuugucuguaccgucacgucugcagcagaggcccaguagcaccgaaugguguccaauaagcucugagcaguggcaauagaaugucaacggauugcaaucagauggcucaacucugugucuccugagcaccagcagccaagccuguucaugaugaugugcacacagucauucuacaggagcuuugcacagccuuccugcaguucucaaaggggagccugcagacuaggccuucagaggguuccuucuguuuccuauuugggcacugagccagaggauggaguugucucccugacaaauaaugaaccaccccaccuuuuagaaugaaguauaaaugaagucauaaaauguuucaauguuuugcugaguaccuguuuguauuuauaaaaaacaugaacacagguccuaauaaagagaugccuaaggcgguaacucugau

SEQ ID NO: 7130 - RNA, 4430 nt, Mus musculus
guuuagccacacuccuauuuuauuagcauuucauuacaguaguacuuuggcaaagcaaauacuggaaauaaagucuaaacgagucuuucuuacgugaugauuuguuucucaaaggaguugcaaagggccaggccucagccauucugaggaggagcagugauucgugugccuuauagauauguuaacauuuacaaagcucauucuugaaaacugagucacgaguuucaaaaaaaucaucucagugucuucaguaaguuuccaacuuuguaaugcgcuacguucauagcuauccucugucacaugugacugcauagacuguucagguuagacaugccugucuuacagucugaacucuaagcagaaagcagaucagaguaugccaagaaacacugggcauauuucagugacuagauguccucagucaccaaaagacgauaaaaaucugcugcagguggaaacaaagcccaaacagccaccgauagaaaacugaucaucaccccaucccccacauuucuguguagccgaugucaucugguaaaauacacagcagauagaacauaacuaaacugcuagcucaggggucugguucauuuuuauuuucaaugucuuuuuuuuguuuguuuguuuuuuguuuuugguuuuccucaagacaggguuucucuguguagcccuggcuguccuagaacucacuuuguagaccaggcuggccucaaacucagaaauccaccugccccugccucccgagugcugggauuaaaggcgugcgcgaccacguccggcucagugucuauuuuuuaugagcugcuguuucuauacauuuugauauacauguggugaauuuucucauuucuuccccucacagcaucagagcuaaguaguugacccuguucccacuacauccugcccuggugaccacauucuccaccuucugucuugguguaagguggcuucuccucugcuuuaagaucuugcugugcuaacacacaggagcaccucaugucucauuuauguaucuggcuuccucuuagagcacguaacgaguacgccugcaguuuucucugaggaaaucuuguggcaguguugcugcuggugacaaaugguugagccugaucaucugguccaggacugaccucagggcacuagaaaugcacagccucuuacagcacgauuccaggaccuacuccauuuguucuagugcucuggaaaaguuuuccaaagcaguuuugaaagcuugcagcaaaaaaguaccaaguucauugcugguuucaugaaugucuggaucaaaacuuccaaaaagugggguggagaccuggauguccucccgguuagcucgaagcaguacugcucgaagauccucugcaaucacgucguauuucuguuggucgaauuuggacacugacaguucauccugaggguagauggcacccucgggguagcaguccuuugguacugggaacucaauauggcgaagccuagggaguucgcagagugcagcaaaaaggcgccggagagcacugccugagagcggguuuccaagaaacuugaacugcuggagcuggcugcaagggcuaaggcccagaaucaucauguuaacauggcugucugugauguugcacuccucgagggugagcacucucaguguuugggcagccuggcucagcagccugaagaagguagaaggguacagguguaccagguuguguccacugagguccagcaccuccaagugggcagugugguuacagucugcuaagaaggauaugucuucaugauuaagggcacaguuggcuagguccaacacucuuaguggggucuucaaggggcugugagguaggcaaaacaucacaaauguuaugagggucucaggugagcuggaguuuugguggaggugaauaaucuaaccacuuuucuaucuuagagaucacugacugcagccugccagaaacuccagcugacuucauuucacguuagcauaugaguuaagaaugauauuuuuaagcaaaauuuaaagagucaaaauaauuggugaaaugugaaagucacauuucuucuagaagucuacagcugcugggccuguugagcagucaguaauugaaccuaaaauggaccaacaccaccuuucaaguuagguagagaaguuaugcaccugaucucagaaccaucagaauauugacugugagaacagcaaaggauagaauuagcuugaaagagagugcugccacucugaugacaauaggaccaguaaugguuuucagggcugagaaggaaguccagcagccugaauguggccuccauaacccugaauucacuauucagccaguauccucuguggggaggugugucugaaauaacuucuccacccaggggucaugagaauauacauuuucuggcacccuggaccuuucugggaacacacccuucacugcccuuauuaaacaagacaguaugugguggggucuuguucugucccuacuuacuaacuuguucuugcugccucuccacuacuugcccauaaaugauaaccuauuauugggacaguacucuccacaugaaacuacccugacuucagaacuaacuggcagcuacccuacuacccuucuucauaguacaguugcuaaggaggagauugcaguaccaggauuucagguguggcaauccagcuaaacugcugacaagguucucacuaugcuaaacuaccuucccauuccuauccugggaaaauguuuuaagacacuaaauauuggguaauucguuauacaacacuagucaguagaagaucugguugugacuuuuguguuguuuacuuucuaguuccucuuucucaugucuucuuccuucuaccuccuccucccucccucucugaugcugagaacuaaaacuaggguccugcucguugguaucaggaaccagcuugccagauugccucugaacccagugaugucacccauagggaacagagacaugcacaucuguuaccauggcaaucacauucccagaguccauuucccacccuuaccugugagccuaaauaaaagguagacccuuccugaccuuuggcccuucuuucucucuuuucucccuuugucucuguccaccccaacccaccccaauaaaccucugccacauggaacugcauuggccugguguggucugucuggaugagagcugccauuccagcacaacccugcuagugcuuuaucacucaacuacccuauacccucagcucuuguguuuguuuuuguuuguugaaauaagccucucuuuguagcugaccucaagcacugggauuaugggcaagccccauggccgaguuuuuguucauugaaaggcgucuuccaaacuggaucaguguucugauucuuuccuaauggcucuuaacucuugcuggucugaccaacacauucccagagaacauuguguaaacagauccuaucccuguuccucagugacuccagaauacuuuaccaggcccuguacccaauucucugagacuuaccuaagcaauguuuggaucuucccagugaguguagagaaagccacacuuagcucagugagcugguucaucuggcugagcucccaggcaauagagguaaggagaagauccucgcccucuggaucuggggcacaaguugggggagcaucgaaggccuuggugggcaaggugagugaggucagcugagggaagcccaccugggucagcagcugcugcacauggccagcaugcagccggacauuguguacuaccuccaacuuucuaagguugccuggcccagccaggccaagaacuuguaggagcugcccagggcucaggcugucugcccggagugaagggcaacagaccugcagaggugcugggccuaauggcuucagggccugcaccaccaugucaaaguugccuucugugacaaagaggucagcaaagacuucaauggggugcccagcugaacagggcuguccuuggagcuggcagcagguccuggccagcaccuugguacggccccaccuuccuagugcccucccacaaggacauugcugcaccuguacguccuggaugccggugaaaucagcuacccgaaggcgguugcucccacuuuucagcacauggucagcuaugcccugcauacaggccuccaggcaggccuugcaggcacgaucacgcaggucuucaggguggucaguguuuggccucaguagcacagccagccggaacuccuccaguggccagugacucagcagagcacggguuacaucugccugcucuagcagguaacuggccuugaacagaaguggguagagguuguaggcuauauuguccagguucuccuggaccagcugggagugggacacuaacgcuucagcagaaaugaaacgaagcgaccucaucgugccccuggucagaguggcgcuguccccgauguucuucccaaagu

SEQ ID NO: 7131 - RNA, 4430 nt, Mus musculus
acuuugggaagaacaucggggacagcgccacucugaccaggggcacgaugaggucgcuucguuucauuucugcugaagcguuagugucccacucccagcugguccaggagaaccuggacaauauagccuacaaccucuacccacuucuguucaaggccaguuaccugcuagagcaggcagauguaacccgugcucugcugagucacuggccacuggaggaguuccggcuggcugugcuacugaggccaaacacugaccacccugaagaccugcgugaucgugccugcaaggccugccuggaggccuguaugcagggcauagcugaccaugugcugaaaagugggagcaaccgccuucggguagcugauuucaccggcauccaggacguacaggugcagcaauguccuugugggagggcacuaggaagguggggccguaccaaggugcuggccaggaccugcugccagcuccaaggacagcccuguucagcugggcaccccauugaagucuuugcugaccucuuugucacagaaggcaacuuugacaugguggugcaggcccugaagccauuaggcccagcaccucugcaggucuguugcccuucacuccgggcagacagccugagcccugggcagcuccuacaaguucuuggccuggcugggccaggcaaccuuagaaaguuggagguaguacacaauguccggcugcaugcuggccaugugcagcagcugcugacccaggugggcuucccucagcugaccucacucaccuugcccaccaaggccuucgaugcucccccaacuugugccccagauccagagggcgaggaucuucuccuuaccucuauugccugggagcucagccagaugaaccagcucacugagcuaaguguggcuuucucuacacucacugggaagauccaaacauugcuuagguaagucucagagaauuggguacagggccugguaaaguauucuggagucacugaggaacagggauaggaucuguuuacacaauguucucugggaauguguuggucagaccagcaagaguuaagagccauuaggaaagaaucagaacacugauccaguuuggaagacgccuuucaaugaacaaaaacucggccauggggcuugcccauaaucccagugcuugaggucagcuacaaagagaggcuuauuucaacaaacaaaaacaaacacaagagcugaggguauaggguaguugagugauaaagcacuagcaggguugugcuggaauggcagcucucauccagacagaccacaccaggccaaugcaguuccauguggcagagguuuauugggguggguugggguggacagagacaaagggagaaaagagagaaagaagggccaaaggucaggaagggucuaccuuuuauuuaggcucacagguaagggugggaaauggacucugggaaugugauugccaugguaacagaugugcaugucucuguucccuaugggugacaucacuggguucagaggcaaucuggcaagcugguuccugauaccaacgagcaggacccuaguuuuaguucucagcaucagagagggagggaggaggagguagaaggaagaagacaugagaaagaggaacuagaaaguaaacaacacaaaagucacaaccagaucuucuacugacuaguguuguauaacgaauuacccaauauuuagugucuuaaaacauuuucccaggauaggaaugggaagguaguuuagcauagugagaaccuugucagcaguuuagcuggauugccacaccugaaauccugguacugcaaucuccuccuuagcaacuguacuaugaagaaggguaguaggguagcugccaguuaguucugaagucaggguaguuucauguggagaguacugucccaauaauagguuaucauuuaugggcaaguaguggagaggcagcaagaacaaguuaguaaguagggacagaacaagaccccaccacauacugucuuguuuaauaagggcagugaaggguguguucccagaaagguccagggugccagaaaauguauauucucaugaccccuggguggagaaguuauuucagacacaccuccccacagaggauacuggcugaauagugaauucaggguuauggaggccacauucaggcugcuggacuuccuucucagcccugaaaaccauuacugguccuauugucaucagaguggcagcacucucuuucaagcuaauucuauccuuugcuguucucacagucaauauucugaugguucugagaucaggugcauaacuucucuaccuaacuugaaaggugguguugguccauuuuagguucaauuacugacugcucaacaggcccagcagcuguagacuucuagaagaaaugugacuuucacauuucaccaauuauuuugacucuuuaaauuuugcuuaaaaauaucauucuuaacucauaugcuaacgugaaaugaagucagcuggaguuucuggcaggcugcagucagugaucucuaagauagaaaagugguuagauuauucaccuccaccaaaacuccagcucaccugagacccucauaacauuugugauguuuugccuaccucacagccccuugaagaccccacuaagaguguuggaccuagccaacugugcccuuaaucaugaagacauauccuucuuagcagacuguaaccacacugcccacuuggaggugcuggaccucaguggacacaaccugguacaccuguacccuucuaccuucuucaggcugcugagccaggcugcccaaacacugagagugcucacccucgaggagugcaacaucacagacagccauguuaacaugaugauucugggccuuagcccuugcagccagcuccagcaguucaaguuucuuggaaacccgcucucaggcagugcucuccggcgccuuuuugcugcacucugcgaacucccuaggcuucgccauauugaguucccaguaccaaaggacugcuaccccgagggugccaucuacccucaggaugaacugucaguguccaaauucgaccaacagaaauacgacgugauugcagaggaucuucgagcaguacugcuucgagcuaaccgggaggacauccaggucuccaccccacuuuuuggaaguuuugauccagacauucaugaaaccagcaaugaacuugguacuuuuuugcugcaagcuuucaaaacugcuuuggaaaacuuuuccagagcacuagaacaaauggaguagguccuggaaucgugcuguaagaggcugugcauuucuagugcccugaggucaguccuggaccagaugaucaggcucaaccauuugucaccagcagcaacacugccacaagauuuccucagagaaaacugcaggcguacucguuacgugcucuaagaggaagccagauacauaaaugagacaugaggugcuccuguguguuagcacagcaagaucuuaaagcagaggagaagccaccuuacaccaagacagaagguggagaauguggucaccagggcaggauguagugggaacagggucaacuacuuagcucugaugcugugaggggaagaaaugagaaaauucaccacauguauaucaaaauguauagaaacagcagcucauaaaaaauagacacugagccggacguggucgcgcacgccuuuaaucccagcacucgggaggcaggggcagguggauuucugaguuugaggccagccuggucuacaaagugaguucuaggacagccagggcuacacagagaaacccugucuugaggaaaaccaaaaacaaaaaacaaacaaacaaaaaaaagacauugaaaauaaaaaugaaccagaccccugagcuagcaguuuaguuauguucuaucugcuguguauuuuaccagaugacaucggcuacacagaaaugugggggauggggugaugaucaguuuucuaucgguggcuguuugggcuuuguuuccaccugcagcagauuuuuaucgucuuuuggugacugaggacaucuagucacugaaauaugcccaguguuucuuggcauacucugaucugcuuucugcuuagaguucagacuguaagacaggcaugucuaaccugaacagucuaugcagucacaugugacagaggauagcuaugaacguagcgcauuacaaaguuggaaacuuacugaagacacugagaugauuuuuuugaaacucgugacucaguuuucaagaaugagcuuuguaaauguuaacauaucuauaaggcacacgaaucacugcuccuccucagaauggcugaggccuggcccuuugcaacuccuuugagaaacaaaucaucacguaagaaagacucguuuagacuuuauuuccaguauuugcuuugccaaaguacuacuguaaugaaaugcuaauaaaauaggaguguggcuaaac

SEQ ID NO: 7132 - RNA, 450 nt, Mus musculus
cuuuuuuuuuuuuucacuuuuuuccauucuccuuuauuccauaaacaccuaguuacaaguugcacaaaucauuaauuuuuauaaaggcagagaaggguaaaggaaaguguuucugugaugggugggggaagggacaaagaauuggaacuaguccacuuucuccacggcccuuauaggaccauggcauuugcaguggggcucugaggaagaagugggcaagggucaggggagcugagggacagagaucccuaaacccagagcuuucccccaaacccuucgaugcguggcaggggcucgggaagaugaggcgguuuggagauggagcagcaacaugagaacucaagguaauggauacaggaugggugggacacgcggugaggggugaagauggaaacguagguaaagggggcaguagaaggcucucccugagacccagggagaggcggggcc

SEQ ID NO: 7133 - RNA, 1529 nt, Mus musculus
cauuuuuaaaaauuuuuuuuccauuuuuauuagguauuuaccuuauuuacauuucuaaugcuauaccaaaaguuccccauacccaccccaccccacuccccuacccacccacucccccuuuuuggcccuggcauuccccuguacuggggcauauaaaguuugcaaguccaaugggccucucuuugcagugauggccaacuaggccaucuuuugauacauaugcagcuagagacaagagcuccuggguacugcuuaguucauauuguuguuccaccuauaggguugcaguucccuuuaguuucuugggugcuuucucuaguuccuccauugggggcucugugguccauucaauaucugacugugagcauccacuucuguguuugcuaggcccuggcauagucucacaagagacagcuauaucaggguccuuucagcaaaaucuugcuaguguaugcaauggugucagcguuuggaucucuggauauggcaaucacuagaugguccauccuuucgucacacuuccaaauuuugucucuguaacuccuuccauggguguuuuguuuccuauucuaagaaggggcaaaguguccacacuuuggucuucuuucucuugaguuuaauguguuuagcaaauuguaucuuauaucuuguguauccuaaauuucugggcuaauauccacuuaucagugaguacauauugugaaaguuccuuugugauuggucuauaccccauuuuuugauucugguuuuuuuuuuuuuuguuuuguuuuguuuuguuuuuguuuuuuuuuuaaagugguuagcuuccugaguuauacuuugauauaaugauuuuuaaaaaguuaaaaauugagacacagggcacagcacagcacagcacaaucuuaauggcccagguacagguguguucucaucuugaaaacaauguaauaacuguacaaugguaguuccagauuaauacuugaacuaaaaagaaugcuugaagaauuauuagaaaaugaauuaaagccaacauugggaaauaaagaaaggaaaaaaaaacuauugaucuuaugaaauaaguuuuauacagcauuuaagagugguuccuggagaagcaaguauagaguauguaaaaccuuguacuaguaaaacuaagucaaaacacugggacacuuaagagaguuauuguguacaaugagcagaagugggacuacugaguuaaggguuaacuugauucuuucuggccacugccuggcagcuuugcccuugucuuuuauccuaggaguuucaaaaaaaaaaaaaucaaagaagcuggccucugagcucugacauauaauaagucaaaaguuaaaguuuaaauaaugauaaguuuauuauuauuauuuuggcuacaugcgugggaauagggaaagcuugaaacuuuggggaacaauuguaaauuuugauuuucugugggaugugguuauucuuucaaauuugauuugacaaugaauauauaauaguuuuuuuucuaccaguuuuuggaguaucaauaaacgacugggaca

SEQ ID NO: 7134 - RNA, 413 nt, Mus musculus
uuuccugcaauauuuuuuuuuuuuuuuuuuuuuuuacguaaauaacccguuuauugcaggcuaggcaagucucagacagcagggcuucuacuggucuuucaguuccuucagucuucugauggcagacuucacugugacugcagaggugguguuguagguccaggccccgccggccacuguuuucaugcaggaaccacagugccagaugccgacggcucgucucuucaucuuggucuugccacagaaggagcaaguguacuuggcgugcuggcugauuucaauuuucuucaccauuuuccggagggaggcaccauagcgggucccguacuugccgacgaugccgaccuucuuggugcguuuagccaugucgccggaacccaagcccaaguccgaagagcuccugcaauauuuuu

SEQ ID NO: 7135 - RNA, 9553 nt, Mus musculus
gcuaccugccgaauguggauaggaccgagaagugagcagacagaaguuggcccccuaaauccccauccuuuccucuggugccugauccuccuugaggcuggagaaggcccugggauccggcucacugucuucauucgcuugacuuaccuccaacguggaagucgaucuuagccgaagacaacugguucugugcaguguuucuacccugucuauucgcaggguuuggucucccuguuucuugaaaguuacauuauguacccuuuacugaauacuguuaaaauaguuggggguucacuugggagggcaagcaggcagcugaagacggcggcuuuugcaugcauucagaaugggacauuccugauuuucaauuaauugaacuuuucuccuucaguuuuaauuaaaaauggcuucuguuuuuguuuuuuuuguuuuuuguuuuuuuucugcuaugcauuacugagacgcuaucauuccuauaacgguaugcaucagcuuuagauacacguuuuauguuguggaaaucauugauuagaaucagguacacuuucaguaaggaauguucugacuuuacuaugaacucacugcgaauaguucaggauaauuuuggguggggauuuggaguuacccagaggaguuguaaagagaaauugcuuuugacaaaugucuaguucgaggaaagaugcucauuuauucaaagacgcaaaaaguguuacucuuucuugaccaaugcaguuuccucgggggaguucacucauccucuuauuauuuguugaucaccuuuucccauuucuccaaaucagucaaucucaaaagacgucuagaguguaccauaaauuaaaauauaauauuaggacuagagagaugguacacugauuaagagcucucugcucuuccagaggucacuaauucaauucccagcacccacauggcagcucacaacuaucuguaacucuaguaacaugagauucagugaccucuucgggugugcagguauacaugcagaugaaacaccauguacauaaaauauaugcauaaacaaaucuuuuuaaaaagaaaaaugucauauauucaauuaaagggaccugaagcaucagacaagcgccccuuugccuuuugagaguaaaacuauauuuagaaaagcauguugaucuuuuuaacugccuguuugauuaaucacugaacuuuuauaguuucugaaugaugcaaauauugucaccuuaugauuuuuuuaacuuauaucuuaaacaguuauaaauacuuucagggagauuuuauguucgucacgcauagcaacuagcuuuaaaaaaaaaagcacuguucuuauuugugccuuggauucauauagcacuucaugaaugcucacaggugucucugccuucugccuagcaguuuauauucacuauuuaauguuuacaaaagaaaaauccugucucuuugcauacauuuuauagugcaacugagaggucguaacauauacguauaaaauugucaugacugagauuccagucuuccugauucuggaacuuagcucuuuacuguauuuaccuaucauggugacaugugauuguaauuccaguguuugggaaaugggacauugggaguucuuuuuuucuuuuuuacacuccauauuuuauuccucccuugcccaauccacccuccgacuguuccacaucucauaucuccucuccacccccugucuccucguggaugccuccagcccccaccccaccugaccccuaaacucccuggggccuccagucucaggaggguuagguguaucaucucuaaaugaucacauacucggaaguccucuacuguauguguguugggggucucauaucagcugguguaugcugucuguuuggugguucaguguuuugagagaucucagggguccagguuaauugagacugcugguccuccugcaggaucgccuuucucagcuuucagccuucccuaauucaaaaacaggguucagcugcuucuauccauuuguuggguacaaauaucugcaucugacucuuucagcugcuuguuggaucuuucaggggucugucaugauaggucccuuuuuaagaguacuccauauccucaguaauagugucaggccuugggaccuccccuugagcuggaucccacuuugggccuguugcuggaucuucauuuccucaggcuccucuccauuuccaucccuguaauucuuucaaacaggaacaauuauggaucagaguagugacugugggauggcaacccaauaccuaacuugaugaccugucuuccugauggaggugggcuuucuaaguucccucucccuacugucuggcauuuuaucccuuugaguccugagagucucucaucucucaagucucuggugcauucuggaggggccccucaaccuccuauuuccugaaauugccuguuuccauucuuuuacuggcccucagggcuucaguccuuuucccucacccaauaccagaucauguucccugcuacccccauuuuccccucauuuauuuucccucccaggucccucgcucccuuuccacuugggauugcuuucuucucucaccuaagugagacugagguguccucacauggguacuucagcuuguugacuuuuuugaguucuguggacuguaucuuggauaaucuguacuuuugugggggggggggcggggaggguuaauauccacuuauuagugaguacauaccaugcacauccuuuggggucuaaguuaccucacucaggauaauauuuucuaguuccauucauuugcuugcaaaacucaggauguccucguucuuaauagcugaguaguacuccauuguguaaaugaaccacauuuucuguacccauucuucugucaugggacaucuagguuguuuccagcuucuggcuaucacaaacaaggcuacuaugagcauaguggaacucgugccccuguggcaugguggggcaacuuuugggucuauucccaagagugguauaacuggaucuucagguagaucuauuuccaauuuucugagugcggcaaaaagcuuuauugcuuacuucucaggaggaagaccccgaacccggaaaauggagcugcuuauauagccugcagcgugacauuucagcaccugauguggcgugacagcaccugauuaguugcucgcccaucaccccauuacuaugccccgagaugggcagugacuaggcgugaguuuacucuugcacuugugcauaaggcuuguuuacuaguuaggcgcaguggaagacagcgccaucuuauaauggggauugcucacggcauggcucuccacaucugaggaauuucgagauugauuuccagagugguuguaccaguuugcaaucccaccagcaauggaagaguguuccucuuucucugcauccucuccaauguguguugucacuugagguuuugaucuuagccauucugauugguauaagguggacucuuaggguuguuuugauuugcauuucucugaucacuaaggacuucuaacaugucuuuaggugcuucucagccauuugagauucuucaguugugaauucuugguuuaguucuauacccuauuuuuuugauuggagaguuuguuugguuuuuuggugguuaacuucuugaguucuuuauauauuuuggauauuagcccucuaucagaugugggguuagugaagauuuuuuccaaaucuguagguugccgauuugccuuacagaaauuuuccaguuucaugaggucccauuuaucaacucuugaucuuagagcaugagccauuagaguucuguuuaggaaauuucccccugugccaaugaguucaaggcucuuucccacuuucucuucuauuagauucaguguaucugguuuuauguugagguccuugauacacuuggacuugagcuuuguauaaggugacaaauauggguguauuuucauuuuuguacauacagacagccaguuagaccagcacuauuuauugaagaugcuuucuuuuuuccauuguauauuuuuggcaucuugucaaagaucaagugaccauaagugugugguuuuauuucugugucuucaguucuaguccauugaucagucuuugucagucucuguaccaacaccaugcagcuuuuauuacuauuacucuguaguaaagcuugagaucagggauggugacucccccaccuuuucuuuuauuguuaagaauuguuuucucuauucaaguuuuuuugccuuuccaggugaauuugagaauugcucuuuccaugucuuugaagaauuguguugggauuugauggggauggcauugaaucucuagauugccuuugguaggauggccauuuucacuauguuauguaugcucugagagcaguggauccucaacugcugugaguucaaaggguccuccacugcucugcugcucggagugcagugggucuucuaggauagauauggauauggagucuucaugggagcagagcaacuaggagucuucccccccacaccccuuuuucaaauaagcuucuacacaaguagucaggguaccuuugugagcuuuugcuuccauaugguggauccacaggaauacuacaaaaaucauuccagaugguguaucuaaaggcucacuuuuccugacucacaauuaacauucaaacaacagagauuuuuguauucucccuuagucuuuuagggauuuaagauuaaugcagguacuggagagauggcucuuguagagggucugggcuugguuuucagcacccucauugugguuuagaauaaauuguaacacauucaagggggauuccacauccauuucugagcucugcuggcaucaggcacuccugugacucacauacaugcaugcaaacaaagcacuccauauacauaucauacagaauguacucaaagucuuuaaaagaauauugauggagauaacugcauuaucaauuagauaaggaugaagaaucucuuuccuuauacuuuacucugaagugaaguuauacauagaaauagcuauuacagguaccauuuacaaacauugcuauugaaaagcauggcaguagcaugcagaguaaagcauuugcuuucuggauacagaugaagaaaguccuggugaagaaagauaaggaggagugugggcuuagugagaauucuacaaggugauaaaaggaaagaguggacaaaagagaacagucacaaaucaguuggaugcauagggcaaugaaggcuaguggaagcuaaggugcaguuggaguugaagaucagcuguagacacaguguaugcguguuuaaagacauuaggcuuuucacucugugcacugauuugugugugugaccacagacuguacaggguugaguugucacuuauuuuucuuuguucuuuuuccuucuuucuugaagguugauuucucacagaaauauuugcauauacaaauaacccaaaaagaaggaaaugaaaaccugcucauuaaccccacucagagauaccuacucaucaugucuucuacaguguuucagguuuaugugugggcgcuuuagaaagaaaaguauuuagcauucaacaguuucucuugugaccuacuuguuucccuaguccaugaaucucccuauguuaacaaugaugagcuuuagggccugcauagcacuuagucucaggaguguguagucacuuuuauagagauaaccuacugcaaaaugauagugaaauaaauauuuugaagugcaaaaaaaauguuuuguaauaaaaccuuuugacuuuuguaucuacucacuuguaacaaauuaaauaaaaggaaaagaugacaccggucauguauaaauauaguaugacucauauaguaaauaguaucagauuauucauuuuuacuaguuauauuuaaauuuuaaaagucagacauuuuaaagggauuuguaguaagauguuaacaucuuuccauuccccucauacuuaauuuuauauaauuagauuugauuauauuuaaacuuaaaaaaucagaagauauaaaggguaauauauuagucucuuuauaauuuucuuacccucccuaaaaaaaucaaccuaaauaaauaauaccuuguaugaauggaaaaagcacauugcgugcauaauacaauuuuaauagaaauaaaaauagaacacccucauagaagcagggggaggaggaaugggauagggaguuucugggagugggggaacuggguaaggggauaacacuugaaauguaaauaaauaaguaaauauguaaauaaauaaauaaauaaauaaaugcaaccaaaaaaauaacuacaaaauguucaggcauguggacuauggagggaaaauuuugaaaauguagaacucuguggcuuuacaccuugcuuuccagaaaaggcuucuugguuuuuuccuaccuggcccacagcaguuugugguugugacaagugcucuccuggaagcuuucauuauucaaaagaauucuucccucacucuggccucugggugucagagacucuguagauaugcuuauuucucaccuucugcaacuuccaccugagucuuccuguuuuucucucugggaggcacagcuaaucuaacaauguaaaucuggaguuuaccuaauuccaaaugaugggcuuuaggaagauuucagacuuguuaugcuaaggccuaaauuuucaguaauuuggguuuuuugauugguauggaaugguauuuauuuuguaauuauauuauguuaugacauuucuuuaccuauuuuucuugcuuuuauccuuaguucaucauacauuuucacuuucagaauacaagguuuguuuaaucucauaauaauacauuccuuuaaauauuguauauguauauauguuguucuuucuguaguauguauucuuucauguuuguccucagauagauccacgagggaugccauuguugcuuaaagugagcuaaucuguucucugcagugugggaaaggguucugauguggguugguugugcaggggcuccucaaugcucgguuccugcagugcccuggccucccugguaugcugguguucauucuucugauuugcauugcuugauccuguccuucugcgacuuugucaguuguuaaucuagcacaacuuagguauugguaguaggggucacuuaugcucaagaauuacugaaaaccuucagagaauguuuuuuguuguuuuauuuuuuguuacuuucuuuucuuuucuuuuuuugguaguuauucagauauggcuguaagaguguagguaaggaugucgagggugucuguaaggguuucucuaagguuauuugucuguuuguauggugcaccagugcauguggauguggcugcacauuuggaguucacaggccaauucuaguccuuuucaguuuuucuguggccuuucuuccccagauaggccugcacacugaaucuggcacuuacugaauucgcuaaccugauuggccugcaagcuguaggcaucugcuugucucugccucuccagcacugggguugcagaacugugcccucccuguucuguucaccuggggagaucucaggcccucauacucuuguaacagacucuucuauuuccccaguccuguugugcuuugagacaaggucucccucguagugcaagugggccuuggauuuuuuuaaacucuuguguugaccuccagaaccugucuuuuugaauuucuuuuuuguuacugaacuuuauccacauauuuaucauaauauaaauuaaaauuaaauauuuauaaaaaacauuuucaguaccacaucauuaauauaauacccugcaccaaaauuuagcaaauaagcgguagcuucuuaguauagcauauggagacacgucagcuuacagcuucccacugcugcuggaaacuccuugcucugucuuaugcuuugacugaccauuuuagagacauaugauucuguuccauaaagaagugacuugggggggaguaaucuuuuuuuggugagauauacugcucuuccaaaucuuaauucauuucaucaggaacaucuugaaauacauacuuuccagaaaucgaacuuuuuguuuguaaguucaaaugauauuuuugauaacaaauauugccugauguuuuccuugaagcauauuucacaaauugauagcccaaucuguuuaauuuugagaaaccuuguacaauauacaaaggcuuaauuaauaaaauuacuaauucuuacugauacaucaaggauuuuauuaaacaaucuugucauuaguauuuauuccaaauguggugcugaagaaacaaauccuggaaagcaggguaggauucuuccuggaaucugggaauacuuuaugguauauggcaaagagaaauucaaguucaagugaaauuaaaguugcccaucauuuucccuuacaauggauauuuucugggcuaucuagguaagcucaaugcagugguaaagcuuuuuauaaguacgacaacugacagaagaagaauucugagugagcaaugugccaaagguggaggagguggaccacagccaaggagugacguccaccucuuacuguccuauuucuguaguuaaaacagguuauguauucacuucugaagauuuggaacgaggggcuuccagugagagagaaugcaaaguuugucuuucugggucuggauugccuuauuaaauauggucuuuucuaguuccacccaauuaccugggaaguucaugguuucauuuuucuuuauagcuguauaguauuccacaguguaccugcaccauuguuugauuauccauuugucuguuguuggacauuuagguuuucacuuuuuucacuguaaugcauauaguagcaaugaacguggcugagcaaguguuuguagacuaguauguuguucuuuugggcacauguguagcuggguagcugggucauauggcagguuuauguuuaucuuuuugaguauucuuccuucuaugcauagauuuucagaauggcugcaucaguuugcaauuccuccaacagugaaugaaaggcauccuguucuguugugugugugugugcacacguguaugccuuuguguguuuguggguauauauguguauuuguguguauguuuaugugugugugcaugugugugugccucccaugccacacccucuccagcauuuauugucaguuccuuuguugaucuuugcuauucugacuagauuaaaaugaaaucuuaguuguuuugguuuguauuucccuaauuucuaggcacaaugcccccccuccuuccuccuccuccuuccuccuccuccuccuccuccuccuccuccuccucuucuucuucuucuucuuuuucuucuucuucuucuucuucuucuucuucuucuucuucuucuucuucuucuucuucuucuucuucuuuuucuuucuccuucuccuccuccuucuucuuccucuucuccuccuccuccucccccucuuccuccucuuucuccuccucccucuucuucgacuccuucaccuucuccucuuccucuucuucuugucccucccuccaugcccuucuccuuccuucuuucucuuuuuucucuuccuccuccuccuuugauaacucuu

SEQ ID NO: 7136 - RNA, 464210 nt, Mus musculus
uagcucuugcuccugcuccuucgccugcuugcugcgugagacugaguaacugcuagauccuuggacuuccauucacagcugugacugaacgauuguugggaauugagcugccgacuguaagucaucaauaaauuccuuuauuaucuagagacuauccauaaguucugugacucuagagaacccugacuaauacaccggguaacucuaguugugucaaguugacaaaaacuaaccagcguagaagacauauaacaggaaucauucucuagggagaaaagucaggcucgguuaaugugugacccauacaauauggcagcaaucagucucccuuuugucucugguggcagagggguuagauauguuccuuagcagcccucccugcuuaggauacuuuaaaggccuggguucuucuacuucuuauucaaguaaaagaaauaaaauauacauaccugauauuuugcaauuaauaucaauuaauauauuacccuuugcaaagucaguucaggccuuuguucucaaauucuggagguaauguaggucauaucugauaauaacuucaucugugauggagagagucacguagaaagggcaacuugcaaauucaucuggaauaacaaaaguccuaggacagcaaaaacuauucucaacaauaaacgaaccucugguggaaucaccaugccugaccucaagcuguacuacagaacaauugugauaaaaacugcaugguauuaguacaaagcaaggcagguagaucaauggaauagaauugaagacccagaaaugaacccacacaccuauggucacuugaucuuugacaagggagcuaaaaucauccauuggaaaaaagacagcauuuucaacaaauggugcuggcacaacuagcgguuaucacauagaagaaugagaauugauccauucuuaucuccuuguacuaaggucaagucuauguggaucaaggaacuccacauaaaaccagagacacugaaaauuauagaggagaaaguggggaaaagccucgaagauaugggcacagggcaaaaguuccugaacagaacagcaauggcuugugcuguaagauugaaaauugacaaaugagaccucauaaaauugcaaagcuucuauaaggcaaaauacacugucaauaagacaaaaaggccaacaacagauugggaaagaaucuuuaccaauccuaaaucagacagaggacuaauauccaauuuauauaaagaacucaagaagauguacuccagaaaaucaaauacuccuauuaaaaaaugggguacagagcuaaacaaagaauucucaacugaagaauaccaaguaacugagaagcaccugaaaaaauggucaacauccuuaaucaucagggaaaugcaaaucaaaacuaccuuuagauuccaccucacaccagucagaauggcuaagaucaaaaauucaggcaacagcagaugcuggugaggauguggagaaagagggacacuucucuauuguuggugggauugcaaggugguacaaccacucaggaaaucagucuggugguuucucagaaaguuggacauaguaguacuggaagauccaacaauuccucuucugggcauauacccagaagcuauuccaacuuauauuuaggagaaaugcuccacuaugcucauagcagccuuaguuauaauagccauaagcuggaaagaacccagaugucccucagcagagguauggauacagaaauuuugguacauuuacacaauggaguacuacucagcaauuaaaaacaaugauuuaugaaauucuuaggcaaauggaugcaucuggaggauaucauccugagugaggaaacccaaucacaaaagaagucacuugauaugcacucacugauaaguggauauuagcccagaaacuuagaguauccaagauacaauuggcaaaacacaagaaaaucaagaggaaggaagacuaaagugugaauacuucauuccuccuuagaauaggaaacaaaauacccauggaaggaguuacagagacaaaguuuggagcugagaugaaacgauggaccauccagagacugcccuaccccaugauccaucccauaaucagguaccaaaugcagacacuauugcauaugccaggaagauuuugcugaaaggacccugauauagcugucuugugugaggcuauugccagugccuggcaaauacagaaguugauacucauagucaucuauuggauggaacacagggcccacaauggaggagcuagagaaaguaccuaaggagcuaaaguggucugcaacccuauaggugaaacaaaaauaugaaguaaccaguacccccagagcucuugucucuagcugcauauguagcagaagauggccuaguuggccaucauuaggaagagagggcccuuggucuugcaaacuuuauaugccccaauacaggggaaugccagggccuagaagugggaguggguggguaggggagcaggguggaaggaggguauaggggaauuuugggauagcauuugaaauauaaaugaagaaaauaucuaauaaaaaauugaaaaaaaaguaaaagaaccucugguggaucaccaugccucaccucaagcaguacaacagaacauuugugauaaaaacugcaugguacugguacaaugacagacauguagaucaauggaacagaaaugaagacccagaaaugaacccacacaccucuggucacuugauuuuugacaaaggaucuaaaaccauccaguggaaaaaagacagcaucuucaaaaauggugcuggcucaacuggugguuaacauguagaaugcauagugauccauucuuaucuccuuuuuccaagcucaggucuaaguagaucaacgaacuccauauaaaaucagagacacugaaacuuauagaggaaaaaguggggaagagccucuaagauaugggcacaggggaaagauuccuaaacagaucagcaauggcuugugcuguaagaucaaggaucgacaaaugcgaucucauaaaacugcaaagcuucuguaaggcaaaggacacuguuaauaagacaaacagcaaccaacacauugggaaaagaucuuuuccaaucuuaaauccgauaaggggcuaauauccaauauauauuaaaaaaacucaagaauuuagacuucagaaaacuaaauaaaccuauuaaagaugggguacagagcuaaaaaaggauucucaacugagggaaacugaauggcuuagaagcgucuuaaaaaauguucaacauccuuaaucaucagggaaaugcaaaucaaaacaacccugagauuccauuucacaccagccugaauggcuaagaucgaaaacucagguaauagcagaugcuggcgaggauguggagaaagaggaacacuccuccauugcuuguuaaauugcaagcugguacauccacucuggaaaucaguguggcuguuccucagacaauugaacauaguucuacuggaagauccagcaauaccacuccugggcauauaccuagaagaugcuucaacuuguaauaaggacacauacuccacuauguucauagcagccuuauuuauaauagccagaagcuggaaagaacccagaugucccucaacagaggcauggguacagaaaaugugguacauuuccacaauggaguaugacugagcuauuaaaaacaaugaguuuaucuaauucuuagacaaauggaugaaucucgaggugagguaacacaaucacaaaagaucacacaugauaugcccucacugauaaguggauauuagcccagaagcucagaauccuucuuagaagggagaauaaaauaccaauggaacgaguuauagagacaaaguucagagcauagucugaaggaucgaccaucuagagacugcccuacuugggaauccaucccauaaacaaccaccaaacccagacacuauggcagaugcccacaagaucuugcugacagaagccugauauagcugucuccugaggggcucugccagugccuggcaaauacagaagugaaugcucgaagugauccauuggacagagcacugguccccagugaaggagcuagagaaaaguacucaaggagcugaaggggguugcagcuccauaugaggaacaucaauaugaacuaaccgguacccccagagcuucauggucuaaacuaccaaacaaagaaaacacauugugggacuaauggcuauugcugcauauguagcugaggauggccuaguaggucaucaaugggaggagaggcccuagguccuguggagguuuuaugccccaguauaggggaaugccagggccaggaaugggaguggguggguuggggagcuggguuaggagguaagggguaggguguuuucaguggggaaacuagcaaaggggcuaacauuugaaauguaaauaaagaaaauaccuaauaaaaaugugagaaaaauaaauaaauaaaaaaguagagaaacuagaagcaauccuacuaaaaucagggggcaagacaauguugcccacucuuucccuaucuauucaauacaguauuugaaguucuagcuagagcaauuagacaacaaguggagauaaaagggauacaaauuggaaagaaagaagucaacguaucauuauuugcagaugauaugauaguauucauaagcaacccccaaaauuccaccagauaccuccuacaacugacaagcaacuucaacaagguggaaggauauaaaauuaacucaaaaauaucaguagcuuuccuuuauauaaaugauaaaaaugcuuauaagaaauuugggaaacaacacauuacacaauagccauaaaucauauaaaauaucgugguguaacuuuuacuaagcaagugaaagaucuauaugacaagaacuucaaauuccuuaagaaagcaaccaaagaagacuuagaagauggaaagaucuccuaugcucauggauugguuugaugaacauaguaaaaauggccaucuuaccaaaagcaaucuacagauuuaaugcaauucucaccacaauuucaacaccauucuucacagacauggagacagcaauuaucaacuucauauggacaaacaaaaacuucaggauagccaaaacacuucucaacaauaaaauaucuuauggggaauugccaucccugauuucaagcuguaaauaguuucaauguaugcuuuauugugacauugacugaagaagcaguaguuacauauuuuguccaauguuucuccucaagguuagacaaggauuauccauuuauaggagguuugauuuuuguauguauuugugugugccugugugagcuuauguuagccacuuguguauauaacucaccaaaggccagagggcauuggauucucuggaacugaaguuguaggcauuuguugagcccagcccagguucucuggaagaacaguaagugcucuuaacaugugaacucucccuugagcccccucagguuuauuuuuaaugagcuuguuuauuuuggucauucuaucaaaaugaaaauguuauguugcuuuucaugauuuaaaaaacccuguuugaaacacaaaauucaaguugcuuacuguaaucaaagcuuuucuucaguuguaaguucuacccuacaagccacuugagcugcagccugaaaugaaacccuaaacuuuguaauguuaugggcuccacccaggcauucuuggcuuauuucaguaaguuauguuuuuccucaggaacacccuguuacauuuuucuccauccauacauguccuuacugcccucaugacuucccauuaaguuucuccaaauagugcaaugaauagauauuaauuuauucaaaugauguuuauuguauauuuugugacaggcaucuuguccugguugaggauacuuaaaaggcaagauaaaaucacuguuuucauccaguugacauuuuaguggguaagagcacacugccaauaaauugcaucacucuuuguucugaaggaagcaggaguugaguuuaagagauacaaauuaugggagugagguacaauauacuuucaagaauucuggaacucccugucugguaauauaacaaauauagguuugcuagcuaccagccuuuccucacaguuaccgaggugucagucauagcuucgugucuuuaguaaaugcuuugaccuuaauuggcaaaauaaugguuuugggauuaaaaaacagagaaaacaucagaauaccauauaaaauauuaaaaucauuugugucuauugcucaccacuauucuacccuaaagagaaggauuuuuagaccuuuuuuggauaaacagaacaccaacauacuucucauuugaguuagcucucaauaggauauuaggguuaacuuccugucuuaauuuugugauaaauacaauuuuucaaacauaggucucaacuugaauaucaaggguggggugaauuuacaugaaccauggacggacauggggaauucgcuuaaggccagcaucacagagaauauugaaauuccucuuucagaacgaggcuuuaggauaguuuagaauagcagcguacgacagggacaugccacaacaacgcacaccacacacacacugcccucugagccucaggaacagauguagagguucgcuccgcccauuuccggguucuuggcgccgcggccgucgcaugcguaaugacguuuaaauucccugcagacccggaagugcaaucgaacuuggucggggcgcggaucuugagagagaaaguccgagccagggcgcaagggaguucgcccagagaucuggaaggccacgccuccucgcaccuacccucucagcauugcagcuggggacagagcucagguaggacugcgcuggccaccucugccagccgccgcaggggcgagaccccgaggggcuggccuggaugggacucgggcgggaugcuggcgccgggauccugacugucagaagccacgcguccucucugggucacuucucuuaccuaugugcaagaucuugcaaaagggcugccucaccugccuuguccacucuccaggcaggaggaacacgugugaccugggguggcuagccugagucugagucccugaagcucugguuuucaccagauaccuuagauagaggaagagacccuccacuuacaguauugcaguugucugguugaaguuguuuuuaguuguuuguuuucaugcaaagauugucaaccaccaaagcuguggcaugcauuaauagcaaacauugaagugugcuuauaaaaugcccucaaaaacuuguaucauguguaguuaguaggauguguacauuugucuguaaguuucuuauuucugaaguagaccacaucacgugcuucucauuuucccaaagugucugucuuuggagucaaguaacuucugccuaagaguguuugggcuauauuuaagagacaauucguacuguccauucuccccaaauucucaaaaaagcugcauugaaaaaguucuguggccuggaccaguuacugccuuguuuugaaauagcuccauugugguggugcucuuaaagcucaugguuggucuugucuuaaagcacugucaaaguauucuguuucuccuuauucuuuuuccuuucuugugagggacagauaccccuuuucauucucagacuaagucagagcaggcuaaauucggguuucaaugucauugcacugguaugcacugguauggugcauuuuguaagcuuuccuacuuuuaaacucggagucuggucccuuaaccugucaaagagaugagaaccgaagggcugccuggaauggcuuuuuggccgagacuacagcugcacuuguacauagagaacagaauccaggccaggagggaaauagaauuuauaaagcuucgagcauugaucuagucauucaucuauuuguauugacuagccgcuaacaguaugucugauaaugugcuguguucggcgaagauaguagugaacaauacagaaaguucuggacuggugguggguggagaucaauccucaugcagaugcauaaacaggagugagaaagguagcgaggaaaaaacgaagcaaguggaggagagaaggggcuguugaguacagauccaaauuaagugaggaacuggauuccacaguuaugggggguaugguguaguugaguacaaaggcucuaagguugaaauacauuuguuaucacuggaguaauaaagauauagggcuuaguagucuggagaaggcguauucagugacuuguuacauuuaugauaguuugugcuuauugaucaccaacuuaguuagcuuugggaggagaaucuagggucaguacacauguaaagguacuuccaugcucaauaaagagcaacauuuagucaguuaaugucauguauguugcccuuuguuuuuguuagauuggauuugcccaauagugucaguauuuagugaauaugucucuccucuguaccaaauuuacuuuucauuuucuuuaucauuauaguaaaauguaccuaauaaaauauuuuaguugggcaguaggaggcaucucugacaacaacaacaacaacaacaacaagaaaaacaacaacaauuucaagacuucaguaaugcaaaugauguucauguuguugaauagcuaucauugcuguuugucuucaguacuuucucauuuuccuggaugaacucuguaacauauuaaauacuaucuccucauugcuaacucucuuaagccccuggcaacaauggagcuucuuucugugucuaugacucugacuauuguggacauaucauaugaguguacucacacagcauucguucuuuugugacuggcuuauuuaacuuaggacaaugucccuacguuucaauuguuaucgcauaugucagaaugcccuuccuuuaaaagcugaauauaauaaucacuguauaaauguaucaguuuuuauguauuuguuuaccuguggaugcuugaauuguuuacuuuuuuggcuacuacuguaaaugauacagcugugugcacaaacaucuguuuaccuuacuuucauuucucuugguuauauauccuuaaaugaagcugauuaaaugaaaauuuggaauaguuuacaucuugaaugcucaucuuuuaugguuacguccucagagaagugcuacggggaagaaucaggucgugcucagagguuuccauucggucuugcuuacagguuuucaucaucgaaggcaugcccuugaggaggguagugggaccuuagccccuuccuccucucuuuguuucugcuucuuggcuagaagugagcccuuugcuuugccaugugcuccuuucugcuccuaccauagugugcuccuuccacaaguacacaagcaauagggccaacuaaagacauacugaacccucuaaaauuguuggccauagugaaccuuuucucuuuauaugcuaacuaccuuaguguuuguuauaauaacagaaagcugacuaaugugauuccauguuuaaguuuuuaaggaauugucacacugugcaccacaaugacuaaccaauuuuucuuucccaccagccaugcacaggguuguaauuuccuuacaauguugugaacuuuuguccagaucuucaugaaacuuuuauuuauuuauuuacuuuuuuggguuuuucgagacaggguuucucuguguagcccuggcuauccuggaacucacuuuguagaccaggcuggccuugaacucagaaauuugccugccucugccuccggagugcugggauuaaaggugugugccaccacacccagcucaugaaaccuuuaaaagaaggguaauugccauagucauauaacuguguagagcugugguuuugguucacaguccuauaauauuaguaauguuaaauacuuuuuacucugcuuuuuggucacugacauaucuacuuuggaguuuuuaaaauaguuuuuguaguccagucuggcuucaaacucaugaugcuucugccacauccacgcacauaguaagauuaaauaggcuuacagguguaacagccagucccagcucuuuggguuguguguuguacuagggauugaaccaggggcuuaugcauacuggacaagugcuauagcaccgagcuauaucucaagcuuguuaauuuaagaccugauuucaguaaaacuuuuaaagauuuauuugugauauuuuaaguauuggguugccuuuuaagauggcaaacaccauguguuuucuugcuuuuuaaccuuaaaguucuauaauaauaaaagcccucaaaugccuauaggcuaggugucuauaccccauacuuagaaauuaaacaaaaacaaaaacagaacucuaaagucuccuuuguacagugaacaaaacuuucagugucacauuguggugagaacagcucagagaaaccaaagaucucuguuuugcuuuguuguuuucuucuuuaauugaaaggaaaaagguauauugauuggcuggcuguaccugugaaguggaccaccuuuguuugcuagcugagaagagaaggacacugaaggaaauugaugaagagaaaagauaugcugggcagcaauaaagcagucaguggcuagaugggcagugacaaaggagaucaguaauaauaauagacagggagcgccaugacugacaacacagagacggcccaacaagcaaguaaugagcacuauagauucacagcuuggaaugguaugggggagaggucaagagagugcaaaucccucauaacuucucagcaugugguucugaagcaaaacacugggcccucagaauccaggggaccugcuccauaucaaguaauauguuuccauuucugugguucaguagccguuguuggaagguaugagcuguguguaguucugcagaauaagcguaaauccuugagaauguguaccacaugauuuuaguuccuaugacagagauuuaguugaauacaaccucccuccccuccccccaacucuacccagacaggcucuuacuauguaacuuuggcuggucuagaacuugucauguagacuaaggcuggucucaaacucagagauccaccugcuucugccucucaaaaucugggauuaaaggcaggaacuaccauguuagucauuaaaauauuuuuauauuuaauguuuaaaauagaaggaaguaucuuacugaaggaugccugacuauccacuagguuagaguaacugaguaacuuuggacauaugcuuauaaacucaguuauaaagcucauuuaagucaaccauucuucuguaguuuaaauaaugaaugaagaaaauuaugccauaaagucccuuaucauuuuuuggcuaacugaaauuuaugaauuugcuagauauggggugacagaugacugacuugcucaaggcuuugcagcuaaguuacgugcgaguuagagauggcagcacugcauugccuucucuacaucauuauccuccaguauuuggacacacuuugguuugcaauguauauaauaauuuuuguuucugagaaaauauuacuguuaggacagaucagcagagcauuuacuguaugcauacuuuuuuguaacaugcacccuccucuucuucucugagaugguggaggcccccugccugguuucccuccacccuggcauaucaagucucugugaggguagguguaucuucucccgcuaagaccagaaaaggcagcccagccagaagaacaacauaucccauaugcaggcaacagcuuuuaggauagcuucuucuccauuuguccuggacccacaugaagacgaagcugcacaucugcugcaucuuugugaggaggcagggccagcccauguauguuugguugauuucagucucugagacccucaaggguccaaguuaguugacucugcuggucuuccuguggaguuucuuucccuuuaggugcccuuaauccuuccuccuacucuuccauaagaguccccaagcuccaucuaauauuuggcuguggaugucugcaucuguccgagucagcucuuggguggaggcucucagaggacagccaugccagacuccugucugaaagcauaacagaauaucauuaauagugucagggauuggugcuugcacaugggauggguccaaagcugggccagucauugguuggccucucccucagucucuguuccauccccuguccaugcaucuccuguagauaggauuaaaccuugggucaaaauuucuauggaugggcugguguucccauccuuccauuggauuuugugccugcuacggguggcuuccacagguucuauauccccacacagcuaaggacacccucacugauucuugggcaccucccaagaaucucuuccuggagaugcccccccaucucuacaucucagucagcugaagaucuagccacucuucccaucccuccccacaccugauuuagacccccaucccauucucccuccccuuccccucucccacccaguucccucccuccagcugccucuuacgacuauuuuauucacucuucuaagugagauucaagccuucuuguuuagcuucuuugggucuguggaguguagcauggguaccuuuauuuuaugcuaauauccacuuauaagugaguauguagcauacucgucucuuugggacuggguuaccucacucaggaugauauucuccauauccguccauuugccugcaaaauuuaugaugucuuuguccuuaauagcugauuauuauuccauuguauagauguaugacauuuuuuaaauccauucuucaguugagggacauguagauuguuuccaguuucuggcuauuaugaaagaagccuaugaauaugaacaagugucuuuguggguuuguggaucaucuuuuggauauaugccagaagaggucuauaggugggucuugagguaguacuauuuccaguuuuuugacaaacugccaaauguuuuccaaagcuguacaaguuugaagucccaccaguaaugggggaguguucauaaccauucugucugguguaaaacggaaucucagacucgauuugauuugcauuucccugaugaguaaggacuuugaacauuuauuuaggugcuucuuggccauucaagauuccucuguugagaauucuguuuagugcuguuccccauuuuuaaauuggguuauuugggcugaugguauuuaaauucuugaguuccauauaaauuuuggauauuagcccucuguccuguguaugguuggugaaaauccuuuaccaaucuguagggugucguuuugucuuuuuuuguuuguuugguuuuuuuuuuguuuuuuucgagacaggguuucucuguguagcccuggcuguccuggaacucacuuuguagaccaggcuggccucgaacucagaaauccgccugccucugccucccaagugcugggauuaaaggcaugccccaccaccaccuggcucguuuugucuuaguaacagcauccuuugcaguuucacaaaaucgcauuuaccaauuauugaucuuagaaucauugguguucuuuucaggaaauugccuccuguaccaaugcauucauuaaaggguauuuucuacuuucccuuccaugagauuuaguguuuuuauguuguuuuauguugagguccuugaacuuguguuuugugcagggugauaaauacaaucuauucccauuccuccccauguagacauccaguuagaccagcauuauuuguugaagaugcuuuuaauuuuucuguaguaugguuuuggcuucuuuaucaaaagcuguguccauagacuugugguuuuauuugugggucuucaauucgauuccauugaucagcgugucgguuucuguaccaauaccaugcaguuuuuaucacuguugcucuguaguacagcuugaggucagggaugaugauucccccagaaguucuuuuauuguucaggauuguuuuggcuaucuuggguuuauuuucucauacgauauugagaguuuuucuuugaaauuguguuggaauuuugaugggguuugcauugaaucuguagauugcuuuugguaagauggccauuuucacucuguuaauccuauuuacccaugagcuugggagauagaucuuuccaucuucugauaucuucuucaguuuuauucuucauggacuugaaguucuugucauauagaucuuucacuugcuugguuaguuacaacaggguauuucauauuauuugugacuauugugaaggguguuguuucuuuaauuuauuucucagccuguuuuucauuuauauaaaggaagguuacugauuuguuugaguuaauuuuauauccagccacuuugcugaaguuguuuaucagcugcaguaguucucugguggauucuggggguugcuuuuauauacuauacuaucaucugcaaauagcgauacuugacuucucugucaauuuguauccccuuagucuuuguugucuaauugcucuggcuagaacuuugaguacaauacugaauagauaaggagagagugggcagccugucuuuucccugauguuagcgggauugcuucaaguuucuuuccauuuaguuugauguuggcucuugguuugcuguuguugaugggaauuuugggaucacuuauguauacuaucauaucaucugcgaauagugauauuuugauuucuucuauaauuuguauccauuugaucuccuuuaguugucuuauuggucuggcuagaacuucgcauacuauauugaagaggagagagugggcagcuuugucuuaucucugacuuuaguagaauuaauuuaaguuuuucuccauuuagcuugaugguggcuauuggcuugcuguauauugcuucaauuauguuuagauaugugccuuuuauccuugaugucucuaauacucuuaauaugaagggguguugaauuuugucgaagacuuuuucagcaucuaaugagaugaucauaugauuauuuuucauuuaguuuauuuauauuguggaugacauugauggauuuuuguaaauugaaccaucacuuuauccacaugaugaagccuauuuuaugauggauuauguuuuugauguguuccuggauuugguuugagaguauuuuauugaguauuuuuguaucaguguuaauagagaaaucagucuaaaacucuuuaucuuuguuuagucuuugugugguugagguaucagggugacuguggcuucauagaaugaguuuggcaguguuccuuuuguuucuauuuugugaaauaguuugaggaguauuguacuagcucuaguuugaaagugugguagaauucuguccuaaagccaucugucccugggcuuuuuuuucccguuuguuugcucaugagccuuuuaaugacugcuucuauuucuugagggguuauagggcuguuuaaauaguuuaacugaucuugauuuaacuuuaauagcaucuguuuagaaaauuguccauuucauuaacauuuuccaauuuugaauacaggcuuuugaagaaagaccuaaugauucuuugaauuuccucaguguuuguugcuaugucucccuuuucacuucugcuuuuguuuauuuggauacugucucuuucuuuugguuaguuuggcuauggguuugucuauauuacugauuuuuuucaaagaaccaguuugugguuucauugauucuuuguauucuuuuguuucuaacugauugauuuuaaccccaacuuugauuauuuuccgccuucugcuauuuuuggugugcuugcuucuucuuuuucuuucuuucuuuuuuuuuuucuagagcauucaaguguacuuuuaaauugcugguauugagaacucucuaauuucuuuauggaggcacuuagugcuaugaaauuuccccuuaacgcugcuuucauuguuucccauaaauuuggguauguuaugcuuucauuuucauugaauucuagaaagucuuuuauuccuucccugacagagaucauggaguagagaguugucaauuuccaugagacuuucugauuuuucuguuguuguugaaguuuaguuuuaauccaugauggucugauaagauucaagguguuauuucaguuuuucugugucuguugagucuuguuuucugacugacuguguggucaauuuuggagaaggauccaugaaguggugagaaaaaaaguauauucuuuuguguuuaggugaaauauucuauagaugucuguuagguccauuucauucauaauguauguuguuuuauuauuucucuguuaguuuuugacuggaugaccugucaauuggucagagugggauguugaaaucucccauuauuauguuguuuucaaugugcaauuuaagcuucagcaauguuucuuuuauaaauguagaugcccuuguuguuuagggcauagauaaucagaauugagacaucaucucgguaaaucuuuuucuuugaugaguaugaaguauucuucccgucucuuugauuaauuuugguugauuuuuaaauuuuauuuuauucuuauuuuuauuuuauuauauauauuauauauuuuguauacauucauacauuauauauuuauauuauuguauuauucauauuguauuaucuaauauauaauuuuauuagauguuaggaugacuugcuucuugagucuguuugcuuggaaaaauuuuucccccuuuuauucugcgacuaauauuuauauuuauugcugagguguguuucuuguaugcagcagauuaauggauucuguuuucacacccguuuuguuagccaauuguuuuuuccuguuauuuugauggugguggugguggugguggugguggaggagagagagagagagagagagagagagagagagagagagagaaauaucccuccuccccuuuuuuuucuggcaugaaauuguuuccuguguuuucuuggauauaguuauccuuuggauugaaguuuucccucaaguauuuuuugcauggaugaauuuguggauuaauaguuauuguuugaauuugcauuugucuugaaaugccuuguuuucuccaucuaugguguuugagaguuuugcuggguauagugguuuagguuggcauuugugauuuuuuuuuuuaguccaggcccuuccagcuuuuagagucuauguugagaaguuggguguauuuuugauaggucuaccucagcauuuuaucuguccuuuuucccuugcuccuuuuaauauuuuuucuuuguuuuguagacuuguguuuugauuauuguguggugagaggauuuucuuuucuagucaagucuacuugguguucuauaagcuucuuguauguuuauagguaucucuuucuuuagauuggaaaagguuucuucuacaguuugcuugaaaauugauucuggcccuuggagcuggaauucuucaucuucuauuacuguuauucuuaggauaggucuuuuuauggugucccagauuuccuggguguuuugugccaggaauguuuuagauuuaauauuuucuuugacugguguaucauuuuuuucuauugcaacuucuaugccugagauucucucuuccaucuccuguauccauccuguuggugauggucaugucugcuauucgcguucucuucucuaggcuuuccaucuccaggauucccucaguuuguguuuucuuuauugcuucaauuucuacuuucagguccuguauauuuuauuuaauuccuccaccugcuuaauuguauuuuccuguaaaucuuuaaaggauuuguuuuuuccucuuuaaagaccucuaccuguuugauuguauuuucuuguauuucuuuaagggauguauucauuuccucuuuaacagccucuaucaucucuauaagacuggauuuaaggucauuuucuugugcuuugguuguguuauccagggcuugcuauaguaggauaguuguacauugaaggucccauuuugcccuggcuuuuguugauuguguuuugagggccuuuagccaucuggauggcuuuggucccaugaugucccugaaugguucaggcccagcaggucugauugggaugauuuuucuuaagugguaauauuuagaaauuuguguggauuaaaaggaugagaucagucagauugaagagcuucagauagaaaagaaaggagaucuaucaugcaaggauugguugaacaggguuauggcuugucucaaaagagaagaacagggcaggcuuaugaccugagccccagagcucaugguggaaggugaguauugauuccccugaauuaucuucugaccaccauguuugauccagaauauguguuccuaugcacacacauuuguauacauuuauauaugcacagagagacugauaaauaauaauacgucuagcauacuagguucagauaaagcuuaagacauagaggagcugaaguugagggaccaaaccaugaaaacagaaaggugacuguuuuuccugucaguaaagguagacacccuuagucauaaaguggucugcacgccacacuugaggaucucaugugcuagguuggacaucuacagucaugacaggacuuuguuaaaauaguuuacauuuuaacaaagucuuguauaggaugugauagcaaguauaaagucuuuaugauuuaacuuggcuuuuaagaaaaaaaggauugcuuauuuaagaaacucagaaaggaucauuuaaaaaauacugaauagauacuugauuaccucuaugccaguugacauugggggaaauuuguagugagagaugaaguugaaguaggagauaagagccauggacuuuguagugcaugugugcaaauggugugggaaaugaacagucaugcggauugaucaggaacuuccauuagcuucugaggucaaugaaguacugagcuucugagcauguuaucuagcuuucuauauuagcaaucaaauuacaauugcaaucaaauugucauucaaauuacaaagagaaaaugauuauuuuggggcuggagaaauggcucagugguuaagagcagugacugcucuuccaaagguccugaguucaaaucccaguaaccacaugguggcucacaaccauccguaaugagaucugauacccucuucuggagugucugaagacagcuacaguguacuuacauauaauaaauaaauaaaucuuuaaaaaaagauuauuuugguccauaacuugaguuuuucagccauacuugauugaucugauugccuucuguggcaaggcagcagcauaccaagguggggagcauagccuuguuuuccauguuguuuucccucccugccucccucccucccucuccuuuccccucccccuccccaccccauucccucccauacuuccuucuuuucuugucagggaucaguuauuagccagagcuguccuggaacaugcuauguagccuugacuaggagcucaggagaaugaauauauuuuuacugugaggcaagguuuccuguagcgcagccuacccuuaaucugaacucacuguguagcugaggaugaguuuaacaucugauccuccugcuccuaccccuugguuuuaugcuggccauacccagaguuucuugacuaucaggcaagcacucuaccaacugaacuauuccagucccuaccauuggauuuaaaaaaaaauuuaauuuauucuucuuucauauuuuacacucugaccauaguuuccccuccuuccucucaguucuaccucccaccucuccucucuucaacuuccacuucucuguuucucuucagaaaauggcaggccucucagggauaucaaccuggacaaaguaacccaggagaacgaaaaggguccuaccauuagguuucccacaaggacacuccuaccauuguauuuguaaaguauauaacuuauuggcucucauagguucacugaugcagaggaacuauuuuuuuuaagggcaaauuguaccucaugucucacccauaucugauuuagauguuuuuagcuauaucuuuggacauuacauuuuaacauugauugugaaauaagguaagacuuuuggguguauuagaaucacauuauuguguuuugugauuugggugauaaggaugugauuugaggaagccacagacagaauugugugaauucaguuuucuccucccacccaguccauauguggaacuuccaaucccaaauagcauauuugcaaaagguuaacugagagaauaggagugggacccugauuuuacaggguuagugucauugugaagagacuccagagucuuuuucagcaagaauguaauuguuugcaaggaaaauagccuucagcauagacucaaucuuguuggacauucuaauacuuuggaaauucacugucguuaaaacacuguggguuuugcuauaucagucuaagcauaauaaaguacuaaugaauggguagucuugugugcuugugcaugugcaugcaugugugugugugcucaggcaugcauguguauguguguuuugugcaugugccuguguguuuguuauaugugcgugugugugugugugccucugugugugauuagauuucauguggucuaaaaguaucaucugaaauuauucaaacacgugaaacaagaaauagaggaggaaggguucagugaggacuuguagauuauaucauguaaaguggcugaguaagaaacaaagguaacggaaaaggaacgaagauccagcaauacuauaucugugcagcgcacuaggaacuaaguccagagcaauuuuuuuuucuacacuugaaaauaauuuaauugaacauguuuauauuacaguaagauauaucacacauuuaaagaacuaugcuguuuagaauauuuuacuuuuauauuuuauaguuuuaauuuuauuuuugcuucuguauugggugagugucugugcgaggauaugcugcaugugaagaguccaacuagaagaggauguuggauuccaauggaacuggagugacaggcagcucuaaguaccuggcauaggugcuggaaacccaacucagguuuucaggcagagaagcaaaugcuauucaucauugagcugucuagcuuuagaauagccuuaaaauauagauuuaccuuuuaccugauguauaaaguuauauuuaugcuuaguauuuuaggagguaaguaauauuaaggagcuaaguaauauuagagcuacuaauacgauucauaccaauauggaccuuuuacuccaggaucagaacaugcugaaaaccuauuuacuacucuuauagggcuauugaauagucuuuuaaauagaugggugauuuauuaagucaguguguacugauguguuucuugguaguuuugaucagaguauuauuuagaucuaggaauucauucuuuugagacugugaaugauagcaauaguuaaaauuuuaugugcaugaguaauacuucaagaacuaaaaaaacuggguauuucaguguuaucauugaaaauaaacuguuuaaaacaaguuuauuuauucugaauauuuuucuuaacaagaaacuuguauaauuauuuuuaugaaaacaagcauauguguuuguguuuuuuaaguguuuuaauuaaaaacucaaguuuucuuccucccauuuucauucuguuucuucuaaauucuaaaaggaauaaagauuuucaacuagcuuaacucauuauugaaaaauaccaaauuuuacaccaauguuuuauuguuuguuuugaaaucgaaaguauguuaaagacaccacucauguuucagcaaaucuacaggaagcuccuuucucacguggaauauaaauuacugcugaauuggaaaaucacuaggcaauccagugcugacgagaacuaaggagucuggaagccuaagcggcauucacuaguuuauuaaggauuuaaauauauguugccuauugcuguguaauaaauuaccuccaaauuuagcagcuuaaagcaaaauccuuuaucaucucaaacagcuucacagugucagagauuuaggagccuuuuaucugggaugcucugagauuaagaugucagccggggcuacuuuugucuguaauuuggcucuguaggaucuacuccaagcucuuggcaggaagccuccuuuaaaaauguagagcucuugauaggacugaucauaacaugacuguuccaaaccucgucaacugagaaagagaagacaggaagaaguuggggggagagagggagagagagagggagagggagaaaggaggaagaagaggaggaagaggaagaagaggaggaagaggaagaagaggaagaagaggaagaagaggaggaaggggaggaggaugagggagaagaggaggaggaaugcuccaaauaaacaccacaauccuuuguaacauauaucaaagaugagaugaccaccaagagcagcagcagcaguggaguacaggcaucuggagccuagaggacgacgccugugcuacaaagggcauggcuggagaagugacccaaggcccuuggaggagcccagaagaucgugaguuggaucccagacauuggacgguuggagauugacuuuugcuuuugauugugacugugcucugauauuuucccucuugaaggaagaaacuguuuuaguggagcccacaguuaagagacuuuuaauuguaaaaagacuuugaauuuuaaaagagauguauauuauaaagagauugaaauuuuaagaauauguaaagacugugggacuuuuaaaguuauuuagaucuaccguauugguuaccaaagccagcucuuauaugguguuguguugggagccgcgcccacauucgccguuacaagauggcgcugacagcuguguucuaagugguaaacaaauaaucugcgcaugugccgagggugguucuucacuccaugugcucugccuuccucgugacgucaacucggccgaugggcugcagccaaucagggagugacacguccuaggcgaaggaaaauucuccuuaauagggacgggguuucguuuucucucucucuugcuucuugcacucugacuccugaagauguaagcaauaaaguuuugccgcagaagauucuggucugugguguucuuccuggccggucgugagaacgcgucuaauaacaguguuggagguuaugacucuuuggaguuaguuaggucucacuggggaacauuuuggagauuaccguaucccugaucauccauguccuuccuguauacacauaugauucuuccaucaccucuauagucucaugaaauaagucaaauccugguaugaaugaggccaguuggaauuaguuccuuaaguacaacuuucugauuauaauucuuuuucacuuguuuuucuguauuucuaauugguaauaugcaaaguucagucaacacauuguaagaggaguuuaaugcugcccaaaguuccuccaagaaaugagaggcauagauccccaugcaugguuacaagacaaauacuagguuuuggucuccaggcagaugcaggcguaaaguuuuaagaaccacaucuguuauuggguagccucuggcaagacaaggcaggacagucuaaacugcuaaggaguguuaagucugaauaauucuggugggcuuuggaauauaggagugaucuauagguaacaauauauccugugugagugagugaaugugugugugagugagugaaugugugugugugucugucugucugucuguaagagacuaggcauuuguagguaaguagcuucuuacucugugucauguuaauauuuuggaggguccaaaguucuuuucaugaaauuauauuuucucuuuuaaguaucaaauaucuggugaauucuauuaagagaaauugcuuuagauagaaguuacaugugagcaauuuauagaaauaaaucaucugcauguugggcucuugcuaagaaccaugaacuuaaaaguucuagaaguaacguuguagaugcaucugguguaugugcuuguguguuuucauguuuauugugugugggcccauaccugugugcagguacaugagcauguggaaguaagaggcagcacacugucuuacuugaacccagagcucacugguacagcuaguuuagcuagccagccuugcuccaacaaugcccugccucuacaacuugaguacugggauuagaggcaggcugccagccugacuagaacuuucaugggugcuugggaacccaccucugguccuuuugugugcauggcaagugccuugccuacugagccaucucccuaacucuugggccuugcuuuugaaggaugacucccauucuagagugcuuuguacauguguaucacuuauugauguccacacauuugggguuauauuuuaguacauguauuuggaaggacuuaucuuacguccuuuuguuugacuaguauuauaagauacaccuuuguuguuauugcuacaauuuuuuauuuaguuuaaaaauaugcaugacucacugauaaguggguauuagcccagaaacucagaauacccaagauacaauuugcaaaacgcaugaaacccaagaagaaagaagaccaaaguguggauacuucaucccuccuuagaauggggaacaaaauacccauggaaggaguuacagagacaaaguuuggagcugagacgaaaggauggaccauccagagacugccccacccggggauccaucccauaaucagccaccaaauguagacacuauuacauaugccagcaagauuuugcugacaugacccugauauagcugucucuugugaggguaugccaaugccuggcaaauacagaaguggaugcucacagucaucuauuggauggaacacagggcccccaauggaggagcuagagaaaguaccaaaggagcugaagggguuugcaacccuauagguugaacaacaauaugaacuaaccaguacccccagagcucaugucucuagcugcauauguagcagaagauggccugcauauguagcagaaguuggccaucauuggaaaaagaggccccuuggucuugcaaacuuuauaugccucaguacaggggacugccagggccaagaagugggaguggguggauaggggagcaggguggugguggggggguauaggggacuuucgggauagcauuugaaauguaaaugaagaaaauaucuaauaaaaauugaaaaaaaaaagaaaaaauaugcauguauguaaguauaucauguguuaguguggaugcauguuugccucaguauacuugcaguuuguauggaggucagaaggcaacuuucagaaauguguucuugcuuuucauguuuuuauuguugguuugguuuucuaagacaguguuugacuguguagcuuugaauauucuggaacucuguaggccaggcuagccucaaacucagagaucagccugccucugccucugaguggugggguuaaaggcgugccuacuacauacucuaggccaauugguucugguccugggcaguuuuccugucuugaucuacauaaugguaagacguggcugauggaagcuaucacaucuaacaaaacguuuuagaguuauauuauuagccucaucuuugggucauauguuuuugguaauaucuaagauuucauuuccucaaaaguuauuuauuaaauuuagcucaguuucuuucauggagaaaauuuuaguacauuuuauuuuguaaauuguuuuagguccacagcacaucgagguggaaaauauagagagcucuugccucucuagccucccugcgcauguacaauguccccuuugucagcacucuuugucucacccaccuaggcauaaaauccccuauuaagagagcugcuugaaccaaaugguaauuugucacaaucaguguaucuucaguggccauaccaucaccaugucuguaguuuacacugcuguauacucucauugcauucuuagguuaucauuuacuuaauggguaauagcccuuucuaagugaauacauaucauacaucauucuguuuggguuaucucacucaggaugauuuuucuaauucuauucauuugucuacaaauuuuaugauguuacuuuuuuaaauagcugaguaauuucuguuguguaaauguaccacauuuuauucauccauucuucuguugagggucaucuagguuguucccagguuauggauauuaugaauaaagccacauugaacauaguugagcaaguguccuuauaguaggauggaauguccuuuggguauauagucaagaaguauagcugggucuugagguagagugacuucauaguuucugaggaacugacauacugauuuccauaguggcuauaugaguuugcauucacaccagcaagggggagugcuccccuugcucuauauccgcaguagcauaagcugucauuuugcuacugaucuuagccauucugacaaacguaagauggaaucucgaaguaauuuugauuuucauucccgaugguuaggcauguugaacguuuaaguguuucucagcuauuugacauuucucuauuaagaauucuuuguuuagauuuguauccuuuuuuuuuuuuugguguauuuuaugucugcuuucuugaguucuuuauguauuuuagauauuaguccuauuggauauggaguugguaaaaaucuuuucccauucugaaggcugcuauuuuuucugguugacaguguccuuuaccuacagagguuuucaguuucaugaggucacauuuauuaauuguugaucuuagcaccugcacuaucaguuucuguucaggaagucuucuccugugucaaugcauucaaugcuauuucccacuuucucuucuaccagguucauuguguucaguuuuauguugaagucuuugauccacuuggacuugaguuuugugcagggugauaaauauggaucuauucguaaccuuccucuuguagacauccaauuuguugaagaugcugucuuuuuuccaguguguauuuaugaauuauuuauaaaaaaaucagguaugcgugucuaaguuuucaguuugauucucuugaucaaugugucuguuuuuaugccaagacugugcaguuuuuauuauuauagcucuguaguacaacuugaaaucagggaugauaggacauccagcaguacuuuuauuguacaggaugguuuuagcucuccuggguguuuuguuuuuccauaugaaauuuagaauuguccuuucacguuuuguaaagaauaguauuggauuuuugcuggggauuguguugaaucuguagaccccuuuugguaggauaucugcuuuuacuguguuaauccuaacucaugggcguggacgaucuuucuauuuuuggacaucuucuucaauuucuuucuucaaagacuugaaguuuuugucaugcagguuuuucauuugcuuaucccaagauauuuuauauuauuugagucuguagugaaagguguuguuucccugauuucauucuccguucauuugucauuuguauauaggaggguacugauuuuuuuuucuuuucuuuucagcuacucuuguaucuaguuacuuugcucacaguguuuagcagcuguaagaauuuucugauauaauuucagggucacuuauacauaccaucauauuaucuucaaauaaugauacuuuuaaaaaaauuuuuuuucuucuccaguuuguauccccuuaaucuaauucaguugucuuauugcucuagcuaagacuucaaguacuguauugacuagguauggagagaguagacaaccuugucuuguuccuguuuuaguggggucacuuugaguuuuuuuccauuuaauuuuauguuggcuauaggcuugcuauaaauuguuuuuauuuuaggauguuuuucaugaagggguguuggauuuugucagaguccuuuucugcaucuaaugagaugaucauuuuuuucuuucaguuuguguaguagacuacauuuacugauuuucauauguugaaccaucugugcaucccugggauacagccuacuugauuaacuugaucaugguggcugaucuuuuugauguguucuuggauuucauuugcaaguauuuuuauugaguauuuuugcauguauguucauaagggaaauuggccuguaauaaucuuucuuuguagggucuuccugugguuuagauaacaggguauauguggcaucauaaaaagaaucaggcagucuucuuuccauuaauauuuuggggaauaauuuuaggaguauugacauuaauucuucuuugaauaucugguagaauuugccacuaaaaucaucuggccugggcuuguuuuuguuuggagucuuuuaaucacugcuuuuauuucacuaaguguuauaagccuauucaauguguuuauauaaucuugauuuaacuuugguaagugguaccuauauagaaaguuucuucuagauuuuccaauuuguucaguagcagguuuuaaaaaaguauauccuuaagauuuuguagauuuccuuaguaucuguuauuucuuagaaucuuuuucucugcuaagaagaagaggugcugagaagaagauauauuuuuuuguguuugagugaaauguucuguaaauauguuaggcccauuuguuuaauaacaucuguuaccuccaguuuuuuccuguugaguuuuugucuguaugaccugcccauuggugagagugauauauugaaaucccucacuauccauguuugaagaucaguaaaugauuuaagauauacuaguauuuguuuuacaaaugugggcacccuuguguuugggaggcauagauauuaugaacugaaaugucaucuugguagauauuuccuuugaaaaguauguaguuuucuucccuaugucuugugauugguuuuugcuugaagucuauuuugauauuaaaauggcuauaccagucuuuuuauuagguccauuuguuuggaauacguuuuucuaaccugucauucugagcuaauaacuauccuugaugcugagauguguuucuuugauaugguagagggauggauuauguuuucccaucuauauguuuuuuuuuuuaauuuauauuuuuacuggaaaauugagaccauugaucuugaaagauaucaauuaccaaugauuauugauuccuguuguuuguuguuguuguuguuguuguuguuggugcugguggugguagugguauacuguguauuuccccuuuuuugaauuugcuggagugagaugauauuuucuguguuuucauguacauauuuauccuuuuuagguuagaguuuuccaucuagcaccuucuguaggucgagauuugcuuaaauuuggcuuuaucauggaaucuuauuuucucuauuuauggaauugaaauuuuugcuggcuuuaguaaucugggcugguuccuaugguuucuuaguacccgaagcacauuucuccagguccuucuggcuuuuaaagucucaauuguuuaggucuguguugacucugaagauggcuuuuaauauugcagucauugcauaauagcaacccuggugauccacagcaugugaagacuuucuguuuucuagugucuucucuuuugugagucuuuaaauauuucauuauagaguuguuuuaccuauuugcucauauucuauuacaguaauuguugugaaugggaguuuucuccccaaauauuuucggagggaguguccaguauugguaaugaccagguugugaaauaugacccugcaucaugcuacugugcugaaaguguuuguuagaacuaugaguuucugauagucuuuaguaucuuuuaacuauaauuugauagcuuccuuuccuauugguauuccuuuuguuuauuucucuuuuucucaccuuagugcccuaccuaauacuuuaagcacuguauugaaaagucuagaaaauauugucugaggucuagagcaaaauuaaugcauaagauuccuaaugaacaaaguguauagccuauuaauaucaagaucaagaucuagaacucuauacuaagaccaagacuggugcguauucuuugucaguacaaguggcuauauaauuuuauuacuggcauuuuaugggccaaagaagggcaguugagucuacaugugauuuucaguguuuggagguguaacucucauaaggagaaagugguauugucagcauuugucaguucaacaaauagaaauuaguuuaauaaaaugccauguucacauaaagcacugauuacaauguuugcuuauuuuaguuucauucugauaucaaguuuucccucuagcagcucucuuccagaauuucccccuuucauuuuguauaaaaaaacaagcaaaguuacuuuuaauuuuucucaggauaaaagccgauuuucauaucaugucuguugauagacuuucuggugguuuuccauggaaauggucucuugugaguagauuacccauccuuuaacagccagcagaacacauuacucuauaccauucauucaccaguugcugagaacuguuccugaucccaggcauuuguguauuuucaaagguagacuuuguuuauuuuauguauguaaacaugauagaagaauacaaucaaagaaaaacagaaccauagaugaaaguuaauauuucuagaaguauauauauuuuuaaaaugcuuuauuauaagcuuuuaauuuuaauuaaaauuuuaagaaauacuuaaacuuuuuuuuuuuuuacuagcuacuagaaacuucugagguaauacauuuuuguagaaaguaucucuauuucuguucagguaaugaaucuguugcauuucaguaauaauaauuuagucauauauggcuacuaugaaguuuucuuaauauuugaauucuuuuuaacuuuguguacuagagguaucuccagcaggauccucagauuucugacuaaauaaauuauacuggacuugcaauauuauucuuaagcaaaaaaacacucaaaagaguaaguaaaugaugcuauuauuucuauguuaguguuuuucuauacagaaauauauuguuauguuaggcauauagcucagugauauuguguuuauauaguauguuugaggaccugguucauuucccaguaauauauacacacacucauguacacgugcacgcaugcgcgagcacacacacacacacacacacacacacacaaacacacacacacacacacacacacacaaaaucuuucuaucuaccuaucuaucuauccaucugcauacacauaauguuauauguaaucauaaucauuguguguugcuauguaggaauuauauuccaauaaacaaaucacuuuucauauguaauguuuaugcauaaaaauauaauuagccuuuauauauuugcuaucuguguuggauagucuuaugucaacuugauacagucuagacucaucuggaggagagaaucccaauaagaaaaugccuauauagaagcagggggagggggaaugggauagggaguuuccaguggggguagcgggacugggaaaggggauaacauuugaaauguaaauaaagaaacuauccaauuaaaaaaaaaaagaucuggcuguaggcaggcuuguaagacauuuuuaaaauuagugacuggugggacagggcccaauccauugugggugguguuaucccuggagcugguaguccuggauucuguaagaaagcagaaugagcuagccaugaagagcaagccaguaagcagcaugaccucugcauggaggucuccugccuucagaucucugcccuauuugaguucuuauucugauuuccuucagugaugaacagugacauggaauuagaagucaaauuaaccuauuccuccuuaacuuuuuuuuuuuuuuugucaugguguuuugcuucugcaauagaaacccuaaggaagauacuacuuuauuccauacucaaaauauuguuaauaaucuguaguacuuaugugcucugccuaauuuuuuaaaagauagaaauauuuccuucacccaggggcccaucucauaaucagccaccaaacgcagacacuauugcauaugccagcaagauuuugcugaaaggacccugauauagcugucuccuaugaggcugugccagugccuggcaaauacagaaguggaugcucacagucaucuauaggauggaacacagggcccccaauggaggagcuagagaaaguuccaaaggagcugaaggagucugcaacccuauagguugaacaacaauaugaacuaaccaguacccccagagcucaugucucaacuccuugauucucuugcccuuagucuuuuuugccccucuaccacgaugcucccuaagcuuuuguugugggagguuuuguagacuguccauugggaauuaagacugugcucuacacucugaaacucugcauuuugaucucuuaggauuuuuuuuuuauuugucaaagacaaggcuuucuagaaacagaugugaagaaagaauguggggcagaaaauguguauuaauuaucauaauugggauuaagguucuauuauugcuguuuaguucuuauuaaacauacauuaggccccuagaaugcuaguauuugugaaagaaaggaggauuuugguuugagauaagaguuuaauuugcacggagaacugauaaaacuucugccaaguucuggaacaaauguuguucauuagaguugccuaagagcaaaauggcuuggcuuucuuauuggcaucaauuuagucaccaaaugaggggcaaggccugauguugagugagguugugcccugcaccgaggucaacucuaugagguaagugacuuggauggcuauacacuuggaaucugugcagcagauuccccuuaaaacacaauuugauaauuuauuuagugauugcuguguucauaacaugguuuauaauguaaguugaagaucaaauucaucaaguuuagccgugaacauacuuaugggguuaaaauaugugauauagacccuuuggcugucaguaaugcuauuuaaugggauugccaguuuacaaucugaggauuuuuuaugacuuuaauuuagacugaaguuauauguuuauguuauuauuuguacuuuauuguuuauaccugacauauugauacguauauuagacccaugucaaagugacauauuuggguuuuccacaauguugaagaugguauacucccucugagauuuacuuuguacuuauccauagcucuccauuugugugaaaaaugugaaaaauugcuaccaaauuguuuuaggugagacuucaaaauugagaaucgucuuagcuuuuguuuacuuuuuaaacuuaagauuuagcauuuuuauguugaaaucuguaguuuucuauuuuuguugaguuuuccuccuuugguagauaaauuguauacaguaccaggcuacuucuaauuuugugaccuaugauaaagauacuaccaagaaauauuauuuucuuuuaaaaucauuuuuguuugauauuucuaaacuuguagcuuuuuuuucuaauuugucaaaucauugugaggugccgagugacuuagugcaccgaagaaaaugaguuauaguugaaugaaacuuuagguaauuaccuucaacuuccucaaacucugaauuuuaguauauccuagugauagaaaugaguguauuaaccucuauaaaggauuuugaaacuuuuggugaaguaccuaagcuuauaagauugguagaauagaccacaggcacauauuacaagaguuagaauaccaacuacuguuuaauaucuagaauucuuuugucugguuaguuuaauuccuaaugucaagaauuucugauaucuaugucuucugauaccucaacuuugucugccugccauuugcaacgcuaauggguauaagaggaucacagauaauggugcccugugaucauuuugugaaucuuuggccaaaacuguaaauaaagguuaaauaauagagguccuuacguagcuacacauauuaauaauaugauuguuuuugucaggaguuacuuagggaaaagugauggucaauugaagaauugcucuauuggauuugccuuuggucaugucuguggggguauuuuagugauuaaugauugauguaagagggccucuaccccacugggaaguacuaccucugggcagguggauguagguuguauaaaaaugcaagccaccucuuccacaggguucucugugcugcuaugggaggaauuugauggagauuccuucggggccugaguauucuaagaucuuucacucucuucauauugucuggcaguggaacucaguauuaguuccuaucugcugcaggagggcuucccugaugauggucaagcaagacacuuagcuaugaguauagaagaaugucauuaagagucauuuaauugcuauaaucuuuuagcaggaaaguauuugguuucacucuagaucucugggguaucuagucucagguuugugaucaccuaaacaguaucagguauggauuucaucucauuggaaugggccuucugucaaaucagauauugguagguuguucccacaagcuuuguauccccauugcacuagcguaucucacaggcaguacagcauuguagaucaaggguuuuuaguuguguuggugcauauauuucuccuuugcuagcaugcagaguacuuucaaguaccaagaacacuagccuauaaaucuagguaggccccaacuugacuucugcauguuuaaugaguuguauagaugcuggauucaguaauauugucuugcucuuacauuguggagagcacccuauaaccagaaggauggaggacaccaaggaaacaaggccuucuaaacacagcaggucugacacauuauaugaacucacagagacugggguagcaugcacaggaccagaugggguggagagaaguggacacaagccacaucccuagccuggaagcagucuugaaaugauaaccauuugcaaaugaaacuguaguuuccuccaagggaguuucacuggagaaacaagccagucuuaaggguaggcugcaugcccagcaguaaauggccaccagaaaaucaacucaacagcucccuuggaugcuuuuuguuucauaaugucaugucagggcuuuucuuuuuucucucucucuuucuuucuuucuuucuuucuuucuuucuuucuuucuuucuuucuuucuuucuuucuuucuuucuuucuuuuucagcugugagcacaucuaucuuauuuuauuuguacuggaaaggaauugcagagacagugguugcgagauagaccugagugcacuguaaacucuaugauucucuugaagcugucagggugacaucagcaucuuauuucuacugcagaggacuccauagugguccuuagccaagugccagagauaaguaccaagaguauugacucaguacugagggugcuggagcuaaguacuuggggugcugguuucuugguauguaggguacuaugcucagaggacuccacagugguccuuagccaagugccagagauaaguaccaagaguauugacucaguacugagggugcuggagcuaaguacuuggggugcugguuucuugguauguaggguacuaugcucuauguccuuuuccucuccuguauauguuacccuucuuguuggcuucccucugguggaaccucuccaugguggcucuguccugguggccucccuccuauccucuauccucucuccauccaggacccaucacugggacuugugugugcugcucucucauuuuuauauuuuauuuuucaauuauuucuuuuucuuucucuuugcccuacacauccauugcauauauauuaugccuuccaguuuuauauuuuuuaugggguucuugugugugcuaaaaaguggaugucugauucuacauaugguucuucuaccuguuuuggggcuccuuuucuucuacuuauuugucuuguacuauucuguuguguuuguuuuuguuuuaucauauuuuauuaauuauauuuuguuccccuacuaacuuguuuauuuucuaaugauagguaaaaggggguggaucuagauaagagaggaaguggggaggaauugggaggaauggaagaagggaagugauaaucagaauauauuauaugaggaaaauauguuuccaauaauaauaauaauaacaacaacaacaauaauaauaaugguagcaguaugcagcauuccuccauggucuuugcuucacuuucuacuucuaggcuccugccaugaguucuugaccugacuuuccuuggugcugauuggacuugaaagaugaaauaaacccuuucuauccuaauucaguuuuggucaguauuuuaucacaauaacaagaaguuaacuaauacaaagauuugauaggauuauaaaauaaaugcauuuauuuuguuuguauuuuaucaugacuauuuuucauuauaaucuuagaaagucaggucagcacagcagcuucuuggggugcuuuauuuuuuguucauggugugcauguaagugauacauauuaccuucgcauuugcacaguggaucacuuuuaguauccuagaguucugaguacaaguugcugggcaccccauuauuucugauuuucuuuuucaaauauagucuuaauauguaccucaguuggccuugaucuagugguccuccucugucagcuucccacguucuaggacuacacacaugucaccccacugagcaccaguguuuuggauguacauaaugcacauaccuauacucaggcacacccacacauaaaauaaguaaguacauauauauauaguuuuaaaaugugaaucuuaaauguaaccuucacaucaaaauauucauuauuaauacagauauaauaaaauucuuauauacauuguucaguuuaugaaucagauaauuuggggauaaugaaaagugacuuaauggcuauacuggauaauuugauguaaguuugacacaagcuagagucaucugagaggagggaacccaaucaagaaaugucuuuauuagaucugacuggaggaaagccuguaaggcauuuucuuaauuagugauugauguggcggauaugucuaaguuauuauucuguugcugugaagagacauuauggccaaggcaaaaaaaaagaaagcauuuaauuaggggcuugcuuauaguuuuagaggauuagugcaugaucaucauggcaggaagcaaauaggcaugguacugaaguaguuaaucugcagggagaaaggaaaagagagggagaggaccaaaggaagauggggagagagagagagggaacaccuggccugggauuuuugaagccuccagucauauaccuuucccaacaagucuauacuuccuaauccuuccccaacaguuucacucauuggauaucaaacauucaaacauuugaggucauggguuauucccauugauaccagcacagaggacccaguccauugagauugaggccacucccaggcuggugguucuggguucuauaagaaagcagacugggcaaaccacgaggaauggaccauuaagcagcaccuuuccauggccccugaauuagcaccugcuucuggaugccugcccugucuuccuuugaugaugaaaaaugacugauauggacucauaaauaaaguaagcccuuucucuccaacuugcuuuggucaugcuggcucaccauagcaugcaacccuaacaaagauagugguuuauauuagaagacauucugcauugccagagaaaugcauaaugugcaggcuguaagaaacucuguagguagccaaaaauacuuauaaagguguuaggagagggcacucuaggaucucucauuaacaacguuugucuuuaauuucuccuauggauuuguguuuaauaagugauugauggugacacuuguacauagacuugggggauuugucugaucuuauuaauuccugaauaugauaauaucccuugcaaguauugcuuugauauaauaauaacugucagucuaaaccuacaguguucuguuaugaucacuuuuaguuugauucuaccuaguaaguaagcccuaggaaggcaaugacuguaucuggcuuauucaccauugcagcauguugucuagccuauugauuaggauguuucuucaaggaauacuuccacauuuuauuuuuacuuaauuuauauaacuuaagaguuacccauucacaggaaaaaaauagcuauuuucauacuaagugaaauaauauagccuaguuuggaggcuuuagaauaggaucuauugacuccauugcuuugaaacuucuggcaagacugagagcaucaugguggagaguauaagguuacucaccucauggaggccuagaagcaaagacagagauaguaauaaucuagggugcuaauauauuuucaaguucacaccccaagugaucgaacucccuuccacugcuacccccaaaggcucuucuaucuuuuacuaaugcucccaauugcagcugaacccuuaauauuaaugcguuaucuuuaagggacccuucagauguaaacuguaaaccagaguguaccagcuugcaaucccaccagcaauggaggaguguuucucuuucuccacauccuugacagcaucugcugucaccugagcuuuugaucuuagccauucugacuggugugagguggaaucucaggguuguuuugauuugcauuucccugaugacuaaggauguugagcauuucuuuaugugcuucucagccauucuauauuccucuguugagaauucuuuguuuagcucuguaccccacuuuuuaauaggguuauuugguuuucuggagucuaacuucuugaguucuuuguauauauuggauauuagcccucuguuggauguaagguuaguaaaaauuuuuuucccaaucuguugguugcaguuuuguccuauugacaguguguaagaugucauuugauuguaguuauaaauccuuuuaggagauuaaauuacauugggugcuacugauacuguuaguuauaggaauaagugacugucuuaguuaggguuuuacugcuguaaacagacaccaugaccaaggcaacauuuaauuggugaugacuuacugguucagauuuuuaguccauuaucaucaaggcaggagcgugauauugugcaggcaggcacgauucaggaggagcugaaggcugcuaggagaagacuaaacgcggguauuuaaaaagccucuacacacagugacacaccucuuccaacaaggccacaccucuaauagugccacucccugggccaaacauauacaaaccaucacacuggcuauaaacaucuauggugcuuaauuuucaacaacuccuauuugagguaguagccaaauuuuaaaugggaaaagugaagguuuuggauauuaaguggccuguuuauggccacagagcucuuauuaauugggaagauagccucauuuauaauaguuaaaaaguauaagcuacuauauauauggaacaguuaauuauagagcaggcacuguacuaaguguuccauauuuaauuucacuauaagagaagcaugauugucauuuccauuguacaaacauggaaagcgacacaggcuccugugacauuuguggaggaacuagucuccauucucuuacaucgccuauaguagaguugagaugugagcacuacugguuaugaccuuugcagcauucacaaguuugaaauauuucauuucauaauuaggccuuaaaauuguuuaccuacucccugaguaggcaugucauaaaguauuucugcuuuauuauuggugugcucuucccugaagacuguuucucccacucugcuuaguuggcuguaguucuuuguguccacuugaggccacauagcuuuuuuguccacuuuuguaugucuaugacaacaucaaauaugcuuuagaaugggaacugaaauuugcauaugaguaacacaucaguuguguuucugagucauaagauauucaauuuugcuuuauuaguguuaccaguguagguuuuccuucuugcuguucacucuuaguuuuugacauggagucuugcuuugcaguucaggcuggccucaaaccuguaauucaacauucucaguguaauuguuaaaauuaugggcaugcacuaccaugccuggcuuugauguauauuauuuuauguauggcccaaguuuaaguauuuccauaguacaugcuacagcuuuuuuuuuuuuuucaaacuuugggauagguuguuuucauuauugcucauggucagcuuauaaaaggccaacuauaguuuuaaugccuuuggucagaguagagcaaaaucauaauuuuauaguguacaauuuauugaagugccauuuauagaccauagcuuucagacagugaagaaagcauaguuuuuuuuaaagcuucuaauuguuuuccauaaaguuauauuuuuaauuaaacuuuaggccauuugcaguuacuuuuauauuuauguauuuuccccuuaauaauaacucucugcauguuagaggagaacacugaccuucuaauuggcgugugcuuacaguuuauuucaacuuccacacuuucaaaauuaucugacgauuuaaaauaugagaugaucauaacugaggaaaaaggaucauguggcccaggcuagccugggcuacauugacaaaguguacacacauguaaauaaccauugguugauaaggagcuaagugcaguugaucaaucuuccagguuaucuaaagauuuaagauuuaguguugaugucuauucuauaacaacaacagaaacuuguaagcucuuaacugaaucagaugacaaauacuguccuuugaaacaagaaauaguaacuuuuauggugugggucuccacaagauagagucgcaagucaagguaggaaguuccccuccucccgugggaauuaggaagcguucauagaauaaguaggauuuggguagagcuuaauuuauugcuuucauucauucuagacugucuucugaagaucgaugucuauuuccuugagcucuuuaauuuucuugccaauuuggauaaacauggcacaaaugcagcagggagguucaaaugaaacagaacagacugcagcauugaaagguacacacuuacauuacuuauucaggaaacuuucacugugcauagugagaguuuaggaauauuuagauacucuuuguucacuucaguugucaaauaaggauguuaguaccuaagcuauuugcaaguauuuauauugccuauagcaaccauuacaguggcugaaaugaaucauaaacucaagaguuacagaugaaagacuucuuaguguucuuucuggucaaggucaucacuuaaugguaaaacaaacacuuguaagacuuuuaaauaaagauccauaucuuuacuguauuauguugaguuggguguuguauaaucuggcuuuuaucuuaugcuauuauguuaacuggaacuuggggauacuuuguguaagccccuccaauuaauaccucagaagcaauuugccuuagauaauguugggaaauucugaguucuagacuuuuuguguguuucgguucugguauuuaauauaauuuuaucuguagaggacauaaacuagcauuuaacuggauaauaaaaaaaugaaucaauaauuuguacuucuucuauuauacuuaaaauuugaaaugucuaccacagucugccuugcuguuauaaaggcuuuggagccuuaggaagcaguggucuaguggaaggggucuuaaagggcugcaaggcacuucuggcucugguguguucuuuuaccaaauuugucugcuauauaaucgccuacucucacuguggacugagccauuccauaccucugugccuucgccacugugaugggcugaaauccccuacaguugugagccaaagcauuaaauuuugcagagguuguuuuuaucuggcauuuuggucauaggaaguacagcuaccuaggccuaucuuuuacuaagacaauguuaggcacauauggagugaaacagcaaguuuucuuuuuuuuuuuuuuuucccauuuuuuauuagguauuucgcucauuuacauuugcaaugcuauacuaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucaagcuccuucauugggggccaugugauccauccaauagccgacugugagcauccacuucuauauuugcuaggcccaggcauacucugacaagagacagcuauaucaggguccuuucagcauaaucuugcuaguguaugcaauggugucagcauuuggaagcugauuaugggauggauccccggauaugguagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacaauauccaguuuucugaggaaccgccagacugauuuccauagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugagcauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagagcaagccauugcuguucuguucaggaauuuuuccccuguacccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuuaagaagaguuuuugcuauccuagguuuuuuguuauuccagauggauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuuuacuuccuuaguuagagucacgccuagauauuuuauauuauuugugacuauugagaaggguguuguuucccuaauuucuuucucagccuguuuauucuuuguguagagaaaggccauugacuuguuugaguuaauuuuauauccagcuacuucaccaaaguuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauaacagcaaguuuucuagcucaauucacaucaccugaucuuucauuuagaggugauguccaaagaaauaguggaaguagugaucaccugcagaaaaccaugaccaaggcuauuguuggcuuugaauuucagucuucucacagccagaaagagggugauggcuugauuuagguugguaaaugucucacgaggaaguaauucacugaugcauugaacaaucugcaggcauauguagacauaaaaucguaaguauagaaaugauauuuaauguuguaguccuaguugagaugaccugacgauggaaaagauaguuuuaaggacuuagcugaggaagcuuaaccuuuagagucacacagaccagaauuagugacagagacuagaaagauaaaggcacuuucugacauuuauuuucuuuauaacaacaugaaacaugaauacaucuguuaccuagauugaugugcaggguuucugucuaaauagauuuuguuccuauuuuaacgugaugugaaaauuugauuucucaaguuguggcucuaaguuauaauccuacgggcauuauaugagcucagauugauuugaggggaauuuuaaagguaguaucacaauguuaaaggaguagagguagaccaucgagacagaacugucuggauucaaauucagauuuuucauuuugccaaauguaaguuucccaacuacucuuaucuuucucuuaauaauaggaauaauaacaccuauuuuuauauaggauugcacagauuagugacagcuuuauauugguuauacacuugaucuuuggacaacaugguuuugaaacucacugaccuauuuaugugucauauuuuuggucuuuauuuuguuauuugagaccauuaaaaaacucuuucagguaauacacacucacacacacaugguagaaacacacacuuuuuauaaaguuagguauaucauaauugcauagaauauauuuuguuuauagacuacuuuauaauuuaauuccauaaaauauauccagauaucuuauaaaaauguuaaaauuugucauaccuuagccacauaagcacagggcacacacaguaccaguguguaucucaaaaauacaaacaaauacauauaugaaauuuuaaaucauaaugccauaacauuaacuauuguuccacacuguacuaucacaaaguuuuuguuucuaccgaacuguaccuauugugaugaauucaaguguuucaagugucuacuuacaaugccauaugauauuaaccaccucuccuuuggguuucuuggucuuuugggcuucaguauauuuuguaaggcuuuaggagugacugccaguguuuacugaacaguuuucaaugcauuuaaugcauaaaacacauauaauauaggugcccaccauggacaguggcacagggagcaguagcccaggcugcucaccuuucacauugccugcauuuggaucaagguuacaaaaagagaaaguuuuugacuguaaaaauggcucaguguaagaaacccuuauguuucaauagaaagagugacaucaaaaagauauauucgugcaucauguuguuauaaagaagauaaaugucagaaaguaccuuuacaauguaugcaauggagagagugugauguuauuaaaaaaaaauauagaggcuacagauguuaccuguucugauggaauuccaguguagggcaguaaauaaauaauaggcuguaaccacuggagaugugcugugcagucuaccacuuaggaaccaucuuuagaguuaucagaaugagaacuuggaagagaaagggagccaagaauguccuagaggcucauuucaugcuugcucacucucaggcaagcaugccaucuuauaacaucaaaaucaucauagugucacuuuaagccauguggaguguggauuuauauguauguucauguuuguguaugcauauguggaggccaagguugucagugaguguucucuacaauuauucuacaucuuauuguuugagacaauguccuugacugaacuuggaaccuuuugauuuaacuggcaaacgaacugaauggaucuguaugucucuguccccuggugcugcaguuauuaauaugugccuguguccuuagcucuuauguggaugauagauuuccagagugguuauaccagcuugcaaucccaccagcaauagaggaguguuccucuuucuccacauccucaccagcaucugcugucaccugaauuuaugaucuuagccauuaugacuggugugagauggaaucucaggguuguuugauuugcauuuuccugaugacuaaggauguugaacauuccuuuaggugcuucuccgccauaugguauuccucaggugagaauucuuuguuuagcucugugcccuauuuuuaauagagagcaagguagggccaagcaaccucucuuauagugggcuguguuaucuugcuguugguagguaacugggaggagucuagccugaaggacagacgcuuggaaaauuguguacaugacuaaaagccacacuucuccuguggggguugugggggcaguaacuucgacagggguccaggagacaugaggaaacgccuuuugucccauguagguggauuaccaccacugggguucuacuucagcucgacuggagaccagacugucuguacauagcccauugccccacaggaccaucccuucauacuugggaugaagccuacuugaccaugauggaugaucguuuugauauguucuuggauucuguuuuugauaauuuuauugaauauuuuugcaucaauauucauaagggaaauuggucugaaguucucuuucuuuguugggucuuugugugguuuagcuaucagaguaauuguggcuuuauagaaugaauuggguaguguuccuucuauuucuacucuguggauuaauuugaagaguauuguuuuuuguuuguuuguuuguuuuucgagacaggguuucucuguguagcccuggcucuccuggaacucacucuguaaaccaggcuggccucgaacucagaaaucugccugccucugccucuuaagugcugggauuaaaggugugcgccaccacacccggcccaaggguauugguuuuaaguuuucuuagaaggucugauagaacucugcacuaaacccauauaucugguccugggcuuuuuugguugggagacuaauaaugacuguuucuuuuucuuuagagguuaugggauuguuuagaucauuuaucugauccugauuuaaguuugguaccugguaucugucuagaaaauguacauuucauccagauuuuucaguuuuguugaguauauaggcuuuuguaguaggaucugauugaugauuuuuuuggauuuccucaguuucuauuguuaugucucccauuucauuucugauuuuguuaauuugaauacugucucuguauccucugguuauucuggcaaaggguuuaucuauuuuguuggauuuucuuaaagaaccagcuccugguuucguugauucuuuguauaguucuuuuuguuuccacuugguugauuucagcccugaguuagauuauuuuuuggugucuauucuucuuguauacacacacacacacacacacacacacacacacacauuuauaugcuggaugguugucagguugugagaaacugcaggacccugcucuggggaugggaaguacagucugaguucucuggguaucuucuggaauuggcucaggguucccgggccuuaguggagggaacuggccuuggcucagggcggcuguaaaagagggggaggagagcuccagcugguucccacagggagaguguccuuggguggguggcuugguuugguggagacuauggcugacagugcagggagaccucucacuggagauuagaugugguaauuagaugcagcaauuuagaggaagacuugcuccaguguuccccacaguggcucuugaugagaagagguagucuuaaguuuuuuucuuucuuucuuuuuuuuuuuuuuaauauagaauuucaguuaggcuguccuuaaacuuguucuguagccaaggaaauccuugauacuauacuugaucuuauauaagaggcugagaaacaauucaagauuauccaugauaccaaccucuauuuuccaaguauuaguauuauaggagguguguaccaccaugcacaguuacaguuaugguggguacuguuuuauuuuguguuuuauuuugauacaggucuuguuaaguugcccagguauaguuugaaugcaauauguaugccugaauauccuagaacuuggcauugauccuucugccuuccauugacugcugggauuauagaucugugucaucucccuggcaaagaacuuccuuuuuaguuacuuaugacauuaugcaauuugauauuuuucaaaaaagcaaaccaauaguaauuucccauuaacaaagucuaaauaauaauaaaaauaauaaugauaauuaguaacaauaacaauaacaauaacaauaacaauaauaaucuuuucuacugggcuggcaagacaguuccucaaagacucauguggucaaggcacaacugaauuagaaaauaaauuauauuuuagagcaaacuuagaagccucaaaucauuuauguccuuaaacuauaaggaaauuuaucuucgaguuucuccacuauugggcuaugcuauaucaacagugaacgauggccacugauuuguuucguguaguauaggaaacuuauguggcaaugaugaacaugugaagauaguuuaauuucucaugaauggaagauacuugagaauauggaguuccuugaguauucuauaguauauccaacaaaauauauacacuccaacuuucacuucaaauuccuauauacucuuccccaaaacucuccuuccuaacuuccucucuucaucuuuguuuuauuuaugacaacccauuaaauccaauaaaugcuacccuuucauacacaggugugagaccaaguaaccaaauccucaaagaagagcgauccucccucccuucuaaauaacugucgucauccauccaaugaggggcagaaccuggggucaucuucuccgucuguucaggagguuggcuggguugguuucucauaggucuuguucagguaaucauagcugguguugaguccaugaggaugauaagcaugccaccucaaaguacuccucagucuuccagccccugcaucguucagcuuauucuucugagaaauuccuagaacuuuagugggagguggauguuuguugaagauacucuggauaacaguguaaauguuuagaaaaauucaacagagucuaugccugggaugaaaaguggcagagaaaucuccagauguggcaaaauacucuggaaggaauacuuuuaacuuaggucugagacaugguucacugggcagaaguggcuggcuuucugucaaggcucauggcaugacuucaacuccugcaucucuuaugguagaagcagagaaguucugaaugcuguccucucaccuacacacauucauuguagcaugucaugcccaccauguauguaugcaugugaguacacacaugcagacauauacacacacaacaaaaaugugauauguguguaaaaaguuuaacaauuuaucauaauguuggugauaaugaagauggugaggauagcgauuucugucauuaaaagaaggcuuuuuccauaucacauagcugguauuugcauagggaugacaaugaagguagccuuguagugaaugucucacuuaaagcugcuuuaauugcaguuccaaggaauucaacauccucucuuaagcauccaaaugcuuguguacaaacacacaugcaaacacacacauauccaauaauauaguuuuuaaauccuuuaacauauauauauauauauauauauauauauuuuuuuuuuuuuuuuuugguuuuuuugagacaggguuucucuguuucucugugcagcccuggcuguccuggaacucacuuuguagaccaggcuggccucgaauucagaaauccuccugccuuugccucccaugugcuggaaucaaaggugugcgccacugccaccucacuuaaaagauuacuucucaugaugggcagugguggcgcacgccuuuaaucccagcacuugggaggcagaggcagguggauuucugaguucgaggccagccuggucuuucuuccuuuuugccaguuugauaggauaauaguuuguucacuguugcuuugccaagcucguguucccuugccuuguggaagggugcucugucacugauccuucuugauuuuauuaaucacuucugguuuacucauccuaccgauccuccacuccuccugucacaaugccugcauuuuguugugaugccuucugugcauaggugagcuuaguguucauuuauugucauuguuuauaauagccuugguuauaacucaguacaucuguccucugcuauuuccagucuuauugaugaaggguuagaccaagacauuuuugucugccacuucuccuccuuccauuucuucccucuaucugcuccuaagaacaccaccugugcaccaccaaauuaucaaauucauagccuaauuuuuaauuguuguuuuacacacacacacacacacacacacacacacacacacacacacacccuaaauacauaaauacagacuguucagucugugucauguuaccuguguguaugaaaucccagggcugaucacuaccaaugcuacuacaucuauugcacauucuugcaugcaagacucagggaucauugcagaagucgaggcaaagagauuguaagagccacaggaaguuugcuguaagauugugucuccuagaaaugucagagagaaugcauccaugagugcucagccacauaacuaccuaaacaagacauggacuagaaggacaccaagggauaugcugucuugaaagaagggaaguuccuagagccucaagucuacacaagaacugagggaaaacagggaaugcugagugugggaagggcccugacuauuauccugucagcuguuuuuaaugggaaccugcacauuauggaucugaguugagcauauugugcuaguuuggguuuggacuuuuuuuuccccaaagcccaugcaucaaaggccuggcuuccagcuuuacauuauuagaaucagaauauggaaauauuaauaagaggaagauccuggaggacagucuuaaucauugcgauaucuuuucagaaggaaagugaaagacuugagacuucuuugcuuccugccuacucugagaaaaacaacuuuuucugcuuuaugaucauaauguacgauaacaugccccugaugcauugggcugacauugucaacuaaacauuuaaaauuugaaaaaacaaccuuuuucucuuuuaaagauauuucagguauuuuguuuuaucaucagagcccuaacuacuguagcauuuugcccuguguuuaugugaucugccuugcauguugauaucaucaugaauagauauacccuaguuagucacuaguuugaaguggauaagcaccauucuggagcugacuuaaauuuugaaguucagguuucaggaaugauacucagugauuuuuagaugucaagccaaccuuguuuuccugugacaaguaccacuugggcaugccuuaucauccuuuuacacacuauagauucuguuuucuuaauuuguauugaugaguuuuauaacuuucuucauaaaguuggcaacugguuuugacaugauauaauggacuagggaguguuuccugcuguucuuuguggaaauaauuggauugguucuuuguuaacuguaaggugaaaaucaucagcgaaagaguuuuuuuuguuuuguuucuuuguuguuguuguuuuguuuuuuggaguguuuugaaauaucuugagugagcuuugucaaauuggauuguuuaauaagaaaauuauucauuuuuacuacauugguaaguuaauuaacauucauaacguauguccccuggaaguaguaguuugcuuguuuguuuguuuuucuuauuccugauacucucuuuagugguuuauaauauuuauaaugauauuauuuguuuugacaagccuuagauuuuuacugaauuuucuuuuaacuuauuuuuuauguuuucugggauuauuauucuguuucucacugaaauuuauuuuuguuucauguuucuucagaugcuuagguaaugucuuaguuauauuuccacuugcuaugaagacaccaugaccaaaacaacuuguagaagaaaacauuuaauuugggacucauaguuuuugagaauuaggguguaagaucaucaucacaaggcucaugucaacaggcaggcauggugcugaagugugggagcuuuagucagagaggacuaacugggaggaguguuggguuuugaaaccuuaaagcccacccccaggugacacagcuucucuaacaaggccacaccuccuucaguacaggguuuggcuccacauuacauauccuagugguguacuccuuaaacaaaacagaguugauauuaggcuauaucuuaggguuauuauugcuaugaagagacacuaugaccacagcagguuuuauaaaggaaaacauaauugagucagcuuuacaguuucagagguuuauuacauuauagucaugcuggagagcauaguggcacacuggcagacauggugcuggagagguagcugagaguucaacaucuggaucuacaggucugaggaagaaagccacucugcuuagcuugaacuuuugaaacuuuaaaguccauguccaaugacacacauucuccagaauggcugcaccuacuccagcaaggccauauguccuguccuuucacauagugccacucccuaugagcauauggcauuuuaauucaaacguaaaaucacaucugcuaagaaaauuaguccaaaacuucucaguuuagccucugguagauucuuaggacaaagacaaaaagcagccacauucuuuaccaaaauaucacaagcaggguaucuaagcccaguugcuaauauuguaccccucugacaacucuuuuuagcuggaucucuguagucuccauuguucuuagcacuauugccuucuaagcuccuucuggaauggcccuuuaagccuaacuuacaauguucagccauuuucuuaguucagagucucaaagucuuccauaugcaucccaaaauaaaccuaguauggccauaucuguuacaguaauagccaacuucuuaguucugaauucugacuuaguuauuuuucuuuuugaaagcauuaaagcuuuugagaauaauuuauguucuucuuuuccaacuccucacucaaaccccugucauacacuucucccuguugcucuugagauuuaugcugcuccuuuucaccaacugugugugucugcgugugucugcaugugucugcgugugucugcgugugugucuguguguguccugugcggcgguucauacguuacuuguauguaugauuuuggcauuuuguuacuuuucuacuggugugacaaaacacccugacuaaugcagcuuauagaagaaaaauugagggaucaugauuucaagggguuggaguccauaaccaucauggauggggguaugacaaagcaggcaggcaugacacuagagaaguaacugagagcuuacaucuggaucuacaaucacaagacaguaagagcuaccugggaaggguguuggccuuugaaaccuuaaagcccacuuccgugauacaucuuccagcaagaccacaccuuuuaagccuuuccaaacaguuucuccaguugaggaccaaguauuuaaacaugcaaaccuacgagggacauucucguucaaacaauugcaagcaacuuauugaagacuucuuacuuuggaagacagguaguaccugacauugcacucugaauucuaaagcucuaugauuauccaaaagcaguaugaauuuauagaagagucacucagaaauuuaaauuuugauuauuucucuagcuaguugcaauauauuauguuaauaacugucauuuauugcuuagacuucuugaaaggagacuaugggaguaaagagggcuuucuuguuccagacuguagcauguuuauuucaagagugcuccaaaauuuccugacgcagggaaagcugacucccagcucuguaauagggagaaaaguauccugcauacugcugaagguauuuaaaacacuuccuaccuucagaaaagcuagaagguaaccauuuucaaccuagaauucuaucguuuaucuaguaccauaaaauuguccguagugggaagcuugcucucucucagcaacagggacacuuuggcauaacugccucuuucccaguggauuucuccuguguuguaaaugcgauuugcugaugucuuugcugguguuuuuuaaaguugaauauaguuccuugucaaugagauuuuccuuuuccgaguuagcauaccuauuaauaauaucaccguucggucuugcuuauugggguaucaugugugaacuucuauaauuucuagaaaacauaguguuauagcagucuuucugguccucuggcucuuagaauauuuuugcccccuuuucuggauauucccugugccuuagauacaggaguuguguuguaggucuauauauugaaguugggcuccacgugaucccaugaucugccuuagggccuauuaugguuuucugaaaagaaaagcuucuuugaugagaauugagaacuacacuuaucuguggguauuaggauaagguuuaaugcaguugggaauuauugcgggucuaggaaaguggugguaguagguucuuaucgaagauccaugaccucacuugccccaaguaguuggcuaaauuaucagugacugcugauagagggagaauuagcguuuccuagagaugaauggcuaucuaauucaaaugguuagccaugaagucauauacacacacaagugacacuaaguagcucagcagguuguauuuauauauguacaacaauaauaaaaaagagggugagugagggagugacagggaaaggggacauagaaaggguuagagggaggauaugaaaagguagaauugaugugauuauauuguaauuuaaaauguaauaaaaauaaaaauuaaauaccagaaguauaaaaugauguuaaauggcuauuuaguggguuauguaaauguaaauuaguuugaauugauacauaaagcuuuuuaugcccuuaucugguuccuguguucuugcucuauuaauuaauauggaaagguauugaaaugucuagucuuaauuauggccuacuuuucuuuuuaguuauguucuuuguuauuuuccucagcgucuucucuugguacagacaccuuuaagauugcuauacuccucuggagauuuaccuuucaucauuaugacauucaugucucuaaucucuuacguaguuuccuuuuuaccuccuuuuucuaauaguaauauggcaacuacagaguacauuuugauucgugucuaugucaugguuuugacuacuuuuaugauuauugugcagccugaguuggccuugaacucaugauucuucuuccucaaaguccugaggcaguacacccuuuuugccuagaaccaguauaucauuaaauagucugugaguagaauauuucaggacuggaggagagaagacacaguauuucauggcaugugugguaacacuaaaaaagcaagaagaucucaaaaccuuuaaaauggaaaggaugaaaauuaugucaaaggggcacaagagauaaccaaaagaauguauuauuuaagaagcaauauaaaugcuguaguguuggguuguuagucagaguauauacuaaacauccuuugauauuuagguccauugauauuuaaaaaguuggaauaauuaugaaaagguagaaagugaugcaaacuuccacacugaagaaugaccaguaauguaugccaguauggaagaacgaccaguaaugugggccaauguuucuuacuuugggagauagagcauaacuucuuugcuuucaccuaaaaguuggugggacucagucacuucuaaauguaggucaguuaaagggaaacacugaugugguggagcugccugccagucaccaccucagccagcuguugaagcacugcaucaucagugauguucugagcuuguuauauucuacuugacaugugguaaggacuguaaccaucucugugauaguccuucagaagacuaugauacuggaggagguagccagacaugauccuuuuagagaaaauaguugauauacccaaaccaaagguaguucugauaaaagacuuggauaguuuuugugcaggguccuaaguggacggauacacuguggugauguaauuugguggcauuaggggaaauugggcuaagggauccaggcacccuuuagcaucuuucaacuuuuccaucaauauaaaauuauucacgaaacaaaauuuaaauuuuugcuuauuuaauaagcagcuuacuggccuuuuguuauuguuuuguuuugagacaaaguuucucugugucuucuuggcuggccuggaacccgcuauguagaccaggcuggcuuuaaacucccuaguuagugccuuccuacugcugggauuaaaaccugacuggccuuucuugauaugugaaauucaguauugugagaaauagaaacuguuuuaguauuaaucagacauuucuagucaacaugucuuauuuuaauauuucacauaaaauggguuaauaauaucacuuuugcauuuacaaugaguuuuuguauuuauaaaccauaacucauuuauguauaaaauuuaguggucuuugaaaugucauauuaauaccugcagcuuuagauuaagguuaaugagggagaaacaaauagcuguuuugaaagagaagguuaaucauuuaaguaguuuaguuugaaaauuugaguugugauuguuugggggauuaugauuuggaaaggacuuauguugaugcuguauuagaucaaaauagugaauuaaaaauccauuuuuagaaccauuuaauaccauuaucaguuaaaacaacagaugaaauuaaucuacuagaauaaaagaauaaagucuucacuuguauuaacuaugaacaaugaucaguuucauaucaacccauaugacuucuuuucuagauuugcugucuaggaucgauuuggaugaacucaugaaaaaggacgaaccaccuuuugauuuuccagauacacuggaaggcuuugaauaugcuuuuaaugaaaguaaguggauacauuagauacacauauaugaguauguguaguuugcuuaccaggauuuauagaacuguaggaaauguauuagcuacauucacaagucuaacuagaauauuuuuuaguguuuuugagagaugaugacuuaucuuugcccagugaaauccuccacgcaaaugaaaguaucaacaaggaacaaguuuccauaguuggcaagucacauaaacugaaggacaugaauuugagcauucacuuugaucuaacuggagacuccuaauuaaauauagaaaggucuauucuuuaagcugcuacuuaaaugaggugacuggcaguacccuuaauuuuaauaccauccagacacugccccaccuggggauccauccgagaaacaaccaccaaacccagacacuauugcagagcaagagcuugcugacaggagccugauauugcugucuccugugaggcucugccagugccugacaaauacagaaguggaugcucacagccauccaucggacuguucaccggguccccaaugaaggagcuagagaauguacccaaggagcugaagggguuugcagaaccauaggaggaacaucaauaugaacuaacuaguaaguccagagcucccugggacuaaaccaccaaccaaaguaaacacauggugggacucauggccuauguagcagagaauggacuaguccaucaucaaugggaggggaggccuuugguccugugaagguucugugccccaguauagggaaauaggagggccaggaagcuggaguggguggguuggugagcagggggaaggggaaagggguuaggggacaguuggaggggaaacuagaaaaggggauaacauuugaaauguaaauaaagaaaauaucuaauaaaaaauaauggguuccauuauuuuucaggaaccuauuuguuuaaaucuuuuuaaaguuuggaauaaaauaaccuuuaugcaggaguuguugaaaaaggcauaccuccagcauacacuauuacguuugauggcuguugcugauaugggcagguagcaugaugucaucauuuccaucuguugcuuuauagcuacugaauugcugauggcuccugucacauauagauguacuugaacacucagugaauuuauagagaaaauaguagaaacuuuggucguuuuagauaucuuuuaaaaagaauauuuuauaauaaaacauguauaaauaguaauauuuuauugccuguuggggaggaaggguuaaagcaauuugcugaguauuguucucuucugauuacuagaaucuuccuggcgaaagaaacagggcagauggucugucuuuuuucauuguaaauagguugauaauuaaaccuuuuguaaauagacacuaauguuugccaugaggagagucuuuaugggauacuaugaccuagaugguuaauuuagcauuguucaugguaaguaaacuuacuuuuugguauaugaggcauguuuccaugaagaauaauagcacacagcgcuauuauucaugaucauauaaaauucauuaugaccaaaauguuuacugguauguaaagcacccugcaugccuuauuugcaccauccuugcucugggucagaaaauccaaccccauaaguuagaaauaugagaauagcuagggcaucuugguaucaauugcagcuugauugccaggucgguccugaaauuguuaggaaagcuuauugucauugaaacucugugauguggugaggugauuggauaguuuaaagguguuagcuuccuccucuugagucuccauugauaccuuauuucaggugucaauguuaucucagguagaaaacaguuacucaaacuuccgaucccucuucuuccaucuagguagccccacaguguguucuuauguuuccacaucauucuugaccccacugucuuuauacaucaugauggcagcuuuccacugcugauuguagucaauucuugucuaacguucugaaaaauugcuuagaguuucaacaauuguggucccagguagcccuacuggggccacucucauggcauuaucugguaggaguucuuuuuccuacuggccuuagaguaguuucaguuuacuuuaaaauauugagaugaacaccaaggguagcuuauaaauuccuagggaccagucuuuuauauccuuacuucguuuauugacauuugaagacaaaguauuagaaaaaaaaagcaaauacuuaagaaaguuauaauuuuuauaggacauuauuuauuagaacaugaauauuaaaaauauauccuaaaucauuggaauauugcuuguugucuuuuagaggggcaguuaagacacauaaaaacuggggaaccauuuguuuuuaacuaccgagaagacuuacacagguggaaccagaaaagauaugaagcucugggcgagguaugucaaguauauugcuuuacugcauucauuuuucaauuggaagugugaaguaugccauggauaauguuugacugaauuuucuaguuugaagaagcaggaguaaugguuuggaagguauaguaguucacauaguccuuuuaugaaaggugauuuuuaaaugcuuuuucuucuuuguauuugguaauuuucugucuuuuccuagaaacauauuuaauuugaaaccuuuuaugccaacauggccuucauaugacuuuccagugagucguuuacauggaaaaacaaauucacaccaacuuuuaaccuuuuuuuuguguaguauuauuaaaagguugaaucuucuucugugucagacaugaguauuauuuuuagguuuucauuuauaugaagaaugcuauugguaugaugagguugacucucucuuacugucuuuguuuggccuucuacacuuagggcucguaucugguauccacagaggaaaccuuugaaugcucucugucauucuggugcauguugaucagagcuaaagcucucccuuauucagaaucauagauucuuaguaaaacauauauggacacguuuguuuaauauguuaccaagcaacuacuuuuuuuccuaagaaaaagcagaaauuucuuuauauuguauuuuuaacaaaugcauuauuuggguaacauggagaacauuugacgacaugaagaauucaaauggauucagacaguuuuucugugucucuggcauuuuuacaugucugaacaaagguuuugacuuuuugcucugcauucucuuuacaggaacaaauggcuuuaaggguggagaggguggugcccuuucccaggcacuaugcagauuuauguccuagucaagauaauaaagacagucgcuuuucucuucagggguggccacagugacaggcuuacuaguggaccuuuaugaguccagguuugcuaagcauagguuuucuuagaugacacaauuaccaugugugauaggcauucagcugugcaggcuguguuagaccuucaguaguccucuuuccccacuagcuuauucagguuguuuagauuuugagaagauaaaauugaaucaauucccccucuccuuuccucccuacagacucucucacauauccucccuugcucuuuuucacauucuuggcuucuuuuucuuuuuuuguuauuacauauauuuuugaauauuuuuuuaguauuuguaacuuaaauguauuaagugaccagaauaguuucugcuuauguuaaagugcuuucucucucucucucucucucucucucucucucucucucucucucucucucucuuucaagacaggguuucucuguguagcccuggaacucuguagaccaggcuggccucaaacucagaaauccaucugccucuuccucccaagugcugggauuaaaggugugcgccaccacugccuggugcuugcccauuuucacuguacuauauacugcaaagugaugguauuuucauuauacaauaauaguauuagagaaguacuuguguguguguguuuaaauagugcuuacauuuuacuucuuucuguaauccagguucaccagcuccuuaagacauauuauucuacaaacauaccuuguguguuuuuucgcauuuguuuguguucuuuuaagacaauauagaucuuacugaguagucuaggcugaccucccaguguagcccacacugcccuugaacuuggaaucuucugccucagccuuccuagcauuuguuuuacagguaugccguaccauacuuggcacagaccuauauuuuauguuaucagccauauuaaaaugaaccuacuaggcuggaaagauuagcagguuaaggcauuuguugucaagucugauuaucugaguuugauucucagaauccacaugauggagagaacugaguccuucaaguuguccucugaucuccaaacacucuuguagauacacacacacacacacacacacacacacacacaauaaauagauauaagacaaaaugccacuauuauagcuuuuuuuuccuaaauucucacaaaacucaguauuucauuuuuaauacauuucuuuaaaaaguuuuuaaauuaaaaucaaucacaguuguugcuauagugaaugaauuuguuuggaguaauuguagaaucaaauguaucuguagaccugucuuucacuaauugauuccuguuuuugagucaggacuucauauucaguguaaucaucuuacuguuuuccauucucaccuuguucuuguuucuuaagauguuuugaaaaguucuucuucucuaucauaagaccccguugcugauguaggauguuguccgccaucucuucugcagagucucucuuucuuuuuguuauuucaucugauucuucuuguccucgugucuuguccuauguaaaaguaaccuaagguaacuuuauagugaaagguaaaaauacacuguucagcacaauuucaaccaaaauaaaaguagagaaaggaccaucagcauaguuguguuggugacaugcuuccugugaaacugacucccuggucggaggagagaacuaacuccaccaaguuccuucucacacagugcuuacuacucaucagcuuacucaucucacuuauuucauuauuuguuugaagacuuacuuguuguaguuacauguguauggguguuucaccuauauggauacaugucuaccaucugcaugcagugucugcagaggcuagaugaugucuugaauccguuugaaauggaguugccaacaguugcgagguuucauguaagugcaaaugcuacugaccaucucuccaagcuccuguuuauuuuguguguauuuuaaacauuuuauacaaauugugucuucauauuuaucaaugaauaaauuaguacuaugaaaauacauaaauugucuaguauauuuugcaguguauggauuuugugaaauuucuuauguuaggaauuuaauacagagaaaugaaguuaauuuuucugaaugucuuuuuuuucuuagauauuuucuuuauuuacauuucaaauguuauccccuuuccuaguuuccccucugaaaaacccuaccucucccccuucccccugcuucucaacccauccauucccauuuccuggccuuggcauuccccuauacuggggcauagaaccuucacaggaccaagggcuucuccucccauugaugacugacuaggccauccucugcuacauaugcagcuggagccaugagucccaccaugugcuuucuuugguuggugguuuagucccagggagcucuggacuuacuaguuaaguucauauuguuguuccuccuuuggggcugcaaaccccuucagcuccuugaguacuuucucuaucuccuucauuggggacccugugcuccaucuaauggaugacugcgagcauccacuucuguauuugucaggcacugguagagucucucaggagacagcuauaucaggcuccugucagcaagcucuuuuuggcaucugcaauagugucuggguuuggugguuuuucuguaguuucuaaagcuaaaguuugaaacagugcauuuguuuuaguuuccauuaaauauuaucauucaaaauucucuguagcuuaagcuuacuugaaacccaaaaggguuuaccuucgccuuccugcaccagcuucagacguuuauuauguuagaaggugacgucacuggacaacuguagacuguucaaguaucguuuucuguguaaguacuagaagcaguuagugcuuuauguuggucaagaucuccagugccaugaagagcacccgugcagagcauccuagccagagcugguuagcagaguccuggcaguccucucaccucagcaggagguguggggagguuuaagagcuacugcacucccaguguugccuucauaaguagcuuugguaagauugauguuuugagggaacagaguuuuccaacaauguaaaagaaaucccuuauauuuuugacucuuuccuuacugaauaccaagcuucauugucaguugggagcucauguguauguguuuuaguuuaugucuccucucuuaaggagauuaucacaccugcuucugacauagucuaucauuuccauguaaaucaaacuuaauuauguaaguaaaauaaacugaaacaucagauuguuuucugagccuagugccacaauauauaaaagaaugcuuuauauucauaguuacauuguuguagacaaacagaugccuauguggugcacauguggcuuaaacaauugauagccuuuaauacuuucuuuuaaaagacuguaggcaguuggaucuuacagguuuuuuauuuuuauuuuuauuuuuuuauuuuauuuuuauuuuugagacaggguuucucuguguagcccuggcuguccuggaacucacuuuguagacaaggcuagccuugaacucagaaauccaccugccucugccucccaagugcugggaguaaaggugugcgcugccacugccuggcucuuacagggguuuuuaauggcuauacugguguacauaauaaacaucuuaaagucaagagcaauaccaauuauuaauuucaaucaucaaauauuugaauauaaucccgauaaguauaaauucgacaauaugaauuaguauuguucugaggaaucaguagcuuccuugauaacuguuuauauuuuuuucaguuuguuaugcacuuuuuuggaacauggaagaaaaagaagcuacauuauuuaaggauauuuugaaauuagcuuuaaacuuuacuuaucauaguaguuuaauuccauacuguucuuugucugcugucuccuuaugauuauacauuauacauuauagcucgguaguagaaauaaucuuguucccagaagugaugaacagucuccucugacuucaccucacucugaccuucauuuguucaaguaggaugcuguaucuagaaugacauugguaaauagacauuuuugaauagaauaucugcacugaaauaauuuucuguuuuuuaaaaguaauccaccagugacauaagagcagacauauagagcagcuaaauuggcuacaaaguccagaaauaaaggaaaaguacaaauacuuuuggagauaucauuugucacuugcgaucauaaagcacuagagaaaaaugacauuuugcuucaguagauagucauccauaguauauauaaccagacucuuuauuccaaugucuaccagaaugaauuucacaugaauuaaaaacuuagacaaaauguaccaggugcauagcaccaaugcuagucuugaaacagcauccuagaauggugugccuuaaaauacucuuuccuuuaaaguauugguucucacgcuguggcuuaugaccccuuagugacaggggucccauaucagacauauuaagauucauaacaguagcaaaauuauaguugugaaguagcaaugagaauaguuuuauguugggcuucgcuacaacaugaggacuauauugaaaaguggugggauugggaagguugagaacaacugcuuuaaaacacccugaguucuuuagagacaugucuaauuguagcuugaagcaagaaaugaguguugucagcuuagaauauuuuguuaaucagauaacaagaaagcuucaaagugcuuguucuuugaaagcuuuagaagaguaagauaaaaauaacagugaaauaaaggccaacauaggaaaaagaaaaaaaauuaguuccaaugcccauucucccacaugcucucaaacucagcaguggauaaaggucauauauaagcaauucauagagaaaaauaugaaaauaauuuuaaacaugugaaguuauguuuacccugacuuauaauauugauaaggcuuuacagaagcaggcuuuucauuuacuuuugguaggaauauagaugaguaugucucaauagaguguuaauugcuaauaucuuaccagaacuauuaaaugugcauuuuuccuuugguaugagaacaggggaaacaaauagauucauuauguuuuuauuucaaagcaaagaaaaggucuuccaguuucugucucugccuguagcagauccucugccacaugucucuauacugaaauagcaccaggagggagugagccccccaggaguauggacaggucugugagugcagauaggaccuccacugcuauucagaggaacccucccagaacccucaggacacaggaaccaaggggcuaccugggacaggagucuuccagucucuaucauuacucagagcugauccugugccacagaacuacguacacaaaaccaccaggagagagcugguuucccaggagugucuacacaccucaucucuucaaauuccuggcccaagaggaacccucacagagccaucaggauacaggaaucaaggaucagguggggacaggauccuucugaucucugucuguaccccagagcuaacccuguaucacagccuucugguuuccaucucugccuguagcagauccucugcuacagggcuucauaaccaaauuccucccagagagaacugguuuucgaugaguacugacacgcaggcuuggaggagggagaaucaaaguuagagacagcaagaccagcuaacaccaaagauaaccagauggugaaagacugugcaagaacauaagcaacagaaaccaagacuacuugauaucaucagaacccaguucuccaacuacagugaaaccuuguuacugcaacacaccagaaaaguaagacacugauuuaaaaucacaugucaugaugaugauagaggaauuuaagaaggacauaaauuacucccuuaaagaaauaaaagagaacauagguaaacagguagaagcccuuaaagaggaaacuccuuaaaaauaccuuaaagaauuauaagaaaauacaaccaaacaaguaaaagaacugaacaaaaucacccaggaacuaaaaauggaaauagaaacaauaaagaaaucacaaagggagacaguccuggagauagaaaacccaagaaagagaccaggaguuauagaugcaaacaucaccaacagaauacaagagauagaagagagaaucacaggugcagaagauaccauagaaagcauugacacaauagucaaagaaaugcaaaaugcaaaaaagcuccuaauccaaaacauccagaaaauccaggacacaaugauaagaucaaaccuaaggauaacaaguauagaggagaguaaaguucccaacuuaaagggccaguaaauaucuucaacaaaguuauagaagaaaacuucucuaaccuaaagaaagggaugccuaugaacauacaagaagccgacagaacuccaaauagacucgaccagaaaagaaauuccucucaucauauaauaaucaaaacacuaaaugcacuaaacaaagaaagaauauuaaaagcacuaagggaaaaaggucaaguaucauauaaaggcacuucuaucagaauuacagcagacuucccaccagagacuaugaaagcuagaagaucuugggcacaugucauacagacccuaagagaacacaaauaccaacccagacuauuauacccagcaaaacucucaauuacaagauggagaaaccaagauauuccauaacauaaccaaauuuaaacaucuuuucacaaauccaucccuacaaaugauaauagauagaaaacagcaacacaaggagggaaaauacacccuagaaaaagcaagaaaguaaucuuuuucaacaaacccaauagaugcaaaucaaaacaauccugagauucuaccucacaccagucagaauggcuaagaucaaaaacccaggugacagcagaugcuggcgaugauguggagaaagaggaacauuccucuauuguuggugaguuugcaagcugguacaaccacucuggaaaucagucuggugguuccucagaaaagugggcauaguacuacuugagaaccaagcaauuccacuccugggcauauacccagaagauguuccaacuuguaauaaggacacaugcuccacuauguucauagcagccuuauuuauaauagccagaagcuggaaagaagccagauguaccucagcagaggaauggauacagaaauugugcuacauuuacacaauggaguacuacucagauauuaaaaacaaugaauuuaugaaauucuuaggcaaaugguuagaacuauaaaauaucuucuugagugaaguaacacaaucacaaaagaacucauauguuuaugcacucacugauaagugaauauuagcccaugcccaagauacaauucacagaucacaugaagcucaagaaguaggaagaccacagugucgauacuuacguccuucuuagaauggggaacaaaauauccauaggaggaguuacagggacaaaguguggaacagagacuaaaagaaaggccauccagagacugccccuccugagcauccaucguauauacagucacuaaacccagacaguauuuuggcugccaacaagugcuugcugacaggagccugacauagcugucuccugaggggcuuuucuauugccugacaaauacagagguggaugcucucagccaaccuuuggacugagcacaggguccucaauggaggaauuugagaaaggacccaaggagcugaauguguuugcagccccauaugaggaacaacaauaugaacuaaccaguacccccagagcucccugggacgaaaccaccaaccaaagaauacacguggagggacccauggcucuagcugcauauguaggagaggauguccauguuggucaucagugggaagagaggcccuugguccugugaaggcuccauuccaaucuguaagggaaugccagggccaaggaagcuugaguggguggguuggggagcagagguaggggauauggcgugggggauuuccagaggggaaaucaggaauggggauaacauuuuaaauguaaauaaagaaaauaucuaauuaaaaaaaccaacaaacugaaaaccaacaaaauacaaaucaaacaaaaacauaaucuggagaguaaacuucucauagaggaacccaaauacauuacaagcaugagaaguauucccuauucuauugcugggucggagcugcaggaggcccagugcaaggaccuguaaggcauuucuuaacuaggguuggucuccaccugacagcaaccaagaaguguuucucaguccugacacuucaauaaauagguuuuaccaaucuuuuugaaguagguuuuuuuaacagucuccaauuaagagucuagcugacagacaacuugcuucugaaucccauuguagaaagacuaauagaucccaacagucuucuaauuguuccagugccucucucucucucucucucucucucucucucucuuucucucucucucucucucucucucucucucucuuucucucucucucucucucucuuucucucucucuuucucucucucaguguguguacaucugcuuuuagaugcaucugaacaugcuugugaaggcuggaggucagcauuagaugucuuucuuaauugcuguccaccugaauauugagacaggaucuuucauugaacccagaucuaacugauucaguuaaaauugauuuuuguaagguaaucaauuauuauuaauuccuuuaggugaaaggaugugagguaauuuguauaguaauaaguaaaguaucauuuuauagaucucuugcaauuauaagaggaaaaauauuucccuugaaaaguucuagcugucaauuuuucugaagaaaauaaaguuaagaaccacuaguguauugcauauaaacacaaauauuuacaaauccugggagccucuuggcucaaaaacuaauacuauaaaguuuuaaagcagauacuuuguagggacaucuggggaagauuguuaauuuucuuuagugagauaaagacauuaugguaaugcagaagaauguucuuauucuuaggagauaauguguaaacuguuuagggauaaagucaugauacaugaaagcuauuuuaaaugcuucuuuaaaaagagagaaaaauacaaaaauaaaaagaagccuaacuguauuuggaacagcacuuggaaggcugagaccacagucuugagacuuuaagggcagccuaaacuacauuuggaaaccuuguucaaaaaauauaagucagugguuggugguucugagcuuugucucugaacugaguguucggagcuguuguuaggcuuuuccaaccuugacuuuaugaacuuccauuauuguuacugucccuuugagugguguuccucuuugagagaaaggagaucugagguucuuguuugauauuuuaugcaugagguuuguaaggaaggagauaacugucaauauucucaugaccucucugacaguccaugugcuguagugugcaaguauuuucaaagaggguacuguguuuguggagaccacugcagagaugaacacagcaagccacugaaacaggaagaagugacugcuacugaucugagugcaaaaccaucccaugcuacuuccucaagucucucuucugguguuggaucacuugcugaaaugaauccaggcgaaguugagucaugaaacucaaacuuuccaguuguaggaguagcuguagaggauugggugaaugccauugaguuuguaccagggcagcccuacuguggcuguaguaaguauugugaggacccucuaaacugcaaucaaagggcuaaaugacaggccacagugaacucagagucaucuuuucuguuuccaguauuugagauuaaccuagugucaacacguuagauuggguuaacuaagauuuaaagaugaaguaaaagaaauuuuuugaacuacaauaaaaugaauuccuauuuaagaacuucacauaaaaccagagacacugaaacuuauagaggagaaaguggggaaaagccuugaagauaugggcacaggggaaaaauuccugaacagaacagcaauggcaugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauagggggcuaauauccaacauauauaaagaacacaagaagguggacuucagaaaaucgaacaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaagacuccuccauuguuggugggauugcaggcuuguacaaccacucuggaaaucagucuggcgguuccucagaaaauuggacauaguacuaccggaggauccagcaauaccucuccucggcauuuauccagaagaugccccaacugguaagaaggacacaugcuccacuauguucauagcagccuuauuuauaauagucagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccccaaaccuaggauucccaagauauaagguacaauuugcuaaacacaugaaacucaagaagaaugaagacugaaguguggacacuaugccccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacccuagcaagauuuuauugaaaggacccagauguagcuaucucuucugagacuaugcuggggccuagcaaacacagaaguggaugcucacagucagcuaauggauggaucacagggcucccaauggaggagcuagagaacgaacccaaggagcuaaagggaucugcaacccuauagguggaacaacauuaugaacuaaccaguaccccggagcucuugacucuagcugcauauguaucaaaagauggccuaaucggccaucacuggaaagagaggcccauuggacacguaaacuuuguaugccccaguacaggggaacgccagggccaaaaagggggaguggguguguaggggaguggggguggguggguaugggggacuuuucguauagcauuggaaauguaaaugagcuaaauaccuaauaaaaaauagaaaaaaaagaaaacaacaacaacaacuacaacaacaacaaaagaacaaacaaaaaaaauugaaaaaaaaaaaaagaaaaacaaauaaacaaaaaaauaucccaugaauuuaagaaagccuuucugguaaaauauuaacaguuuuucaaucagaauaaaaagugguacauaucaaguuaguacuauuguuguaaucgauauuuaaaauccuggcccuggguuucuuccccuaccuuuauuauugaguuccuggaugaaaacucacucucucucucucucuccccucucucucccucccccccucucucacacacacacacacauacacacauacacacacacacacacacacacacacacacacacacagagccuuuauauauucaauaagccuuaagcagcacaagagcuggacagcugccuacccuccaugcuuggucuucauaggaaguugaaacccauccuaggcuauaaugagaucccaucucaaaaauccaucacuaucaccaccaucaccuccauacaacacaacaaaauacuaggccugcuauuuccuugaaccguuugccagaguuauauuuguaaaugaagauucuugagauacaaagagcaggcuugcuuucuauuuacugucauuuggaagaguccaaaacuuuguauucuuguuuuagcuucucucuugauuaguuacauugccccuauagaaguuaggggcuagggaaccaaugcugauaggcuguuauuaugcuaugauuaauaaguuaccuucauugucuuugaccuauaaguuuuguucucuugugaguuuccacaaaacaguaauaaacugauuagcuuuuaaguaggagauagauaauuagacccuuuagugaugguugagucuuuauuaagagaucaucauuuuuauuuuuaucuuauuuuuauuuuauuuuuauuuuauuaagagaucaucauuuuuauuuuauuaagagaucaucauuuuuucauucugacuucucacgucugcuuguccuggcaccuggaauuucagagaugucccuggaguuuagccuggacauuaacuuguuuguuuuguuuaaacaauuaguacuaucauucauucaguuguuuaagucagauguguuauuccuucaauccuugauaauuaccauaucuuguuuaacuucuuaccauagcaucuuucccuaucuucauuugcauuaauuuagcuucagcuugauaaucuccuaauuagcuuacuguaauucuuacugcucugugcugaauuguguucccaaguuuaaauucaaaauguaaucuuucuugaaauuguguuuagagaugggcuucuuaaagagaugauuaaaguuaaauguaaauaccauggugguguccuaauugaguggcagaguuuuuuucucuccaggauuuuauaucugagagaugaccauguaggacagugagaagguaggagggagugagguggggcaggguauguguguguggggggggggggggaggaggaaaggaggacuuccacaagaaccagauuagccuacagcuugaucauggacuucuaagccuucagagcugugaguucuguuguuugacccauucuaucuguaguauuuuuacuucauuucuugucccauggcaacuuacacagcucaacuguguuugagcuauauuaaucuacuaacuuaaaaaaagucaugcuguuuuauauuucuauuacucuucucaggcaaagagcauaugaugccagcugugugcuguaccaccuauggacuugagguguaguccaaccuuuaacaauguguucuuugauuugugugauagaaugucccuucucacguucaugucucauguucuuuuaaagcagcuauucuacaacauguacaauguuuuauauuuauuaguccaccagccuuucauaacacugcuuuaaaaguuugauaacaccaagcuuucaauccauucccuuccccucuuuggaaucauugaaagauuauacacaaauggagacugaaaggagaaaaauuguacacagcaaaccuaauauugcauaucaaacucucugaaaguugagaaaccucaguugagaaaaugucucuacaagauugaucuguagguagguguuuagggcauuuuaaaaauuauuuaugugggagggcccagccuauuguggggagugucaucccugggaccuaucagguucuggguucuauaaaaaagcaggcugagcuagccaugaggagcaagccaguaagcaguacugcuccacgccucugcuucagguccugcuuacagguuccugccuugcaugaguucaugcccucagugcucuugauucugaacuguuguauggaauugugaaugaaacaaacccauuccuccucauguugcuuuuggucacaguguuucaucagaggaacccuaauuaagauagcuuuuuagcuacuucaccagcgacagcccauuuagcaugcaacaaggaccaagacauuucuguuuccagaaaauagguagguuuauauuaauacuuuaacagucuaucauauacauuggagugaguugugauuuuuuagacugguguaaauauccuacuuuguucuguagcauccaaacugaagaauguaccugucaaaguaguguucuuauuuaguuuugagaguuucauacuauuauauaaacuauuuccauuauguucacacccaaguccucuaauguauuuuauaacauuuuaggaagauggugauagcaagucacaaaacuagauaagaucuucacaguauacccagugcuggaggcuacugugaaugacacuccacaggcucauguguuuacuucuacccagcacugcuuuggaacacuguagaaaagcuggaggugcagccucacuggacagcauaguuugagguuaagagagucuaaaggacuguccugcaucuguccugucaugguuaguauucugcuucuugaucuaaagaggcaugucugccugcuucugcugccaccacggguaacauugcuucuguacuuggaagccagaggucacaagaagccuuuccucccuaagcugccucucuuuugauaguuuguuacaaugacaagaaaaagaauaguuuauacacuuuauuuuucaggggguuuugauuguuugcugcuuuuuguuuguuucucaagugucugaacuaacaucugguaauaacugaucauacaggugcuuugugguucugguguaguuuucccuuuaagagcagcuaaucauguucuuuacucucgcccucuagcuuucagagaaauggaaugggaugcauuuuguucuuugcauuuaagcacuauuuauaaagugcauacuucacaugcgguuauauguucacugaaccacugagugguuuuacugucugauuaauagagaaguuuaguaaggcaugacugcuugacuuucauggauuccagaccucauacaccauccugacucuaagagcuuaggcaucucuuucuuuuucuuaucccuuugaaggucugauagaacucugcacuagacccaucugguccugggcuuuuuuugguuggggcacuauuaaugauuguuucuauuucuuuaggugauaugggacuguuuagaucauuaaucugaucuugauucaacuuugguaccuggcaucugucuagaaaauuguccauuucauccaggcuuuccaguuuuguugaauauaggcuuuuauaguuggaucugaugauuuuuuuggauuuucucagguucuguuguuaugucucccuuuucauuucugauuuuguuaauuaggauacugcccugugcccucuaguuagucuggcuaaggguuuaucuaucuugcugauuuucuuaaagaaccagcuccugguuugguugauucuuuguauagugcuuuuuguuuccucuugguugaucucagcccugaguuugauuaauuccugccuucuacuccucuugggugaauuugcuuccuuuuguucuagaacuuuuaggugugcugucaugcugcuggugugugcucucuugaguuucuuaucccuauacuuucuuucccuacugagauuauauuaguucucuccuccacauaguauaugccugcagaugucacuacuaaaggguaggugggagaaggcuguuggaaugauacuuagauguuacguuucauggacucauuucagagugagcaaaauaacucaaacugcccauucagggaccaggagaaucuuucuucaugcacuuaauugggaaaagugaccaggagagcauguacuaauuaaagguucugucugcuagcuagaaaaugccuuuacacuauuuguuuuaauuaaaucauaauagccuuaaucauuuuguuuucacaauuguuucucagaguauccaguuaaaaauuaauaagcuauaggugugauacaacuaggagagaacaguagagcuaaguaagcaagcaaagguagaaacacguauuuccuauaugacuagcacuaugaguuguaacaaagaauuuuaauuuuuccauaacauuaacaagcauugcagucagcaaauuuuaaaaucaccaaagccuucauuagcuaauuuugaaaaaauaccauccugauuuuaaccucuaaauugaagaugagagagaaacaggugagguuuccugcugaguuugauuaguggauuaggagagcaaguaagguaaacaaaauaauaacuuggcuauaaacagcacuauuuuauaacuaggggcaauuaaggaacaguuauuuguaacagguauuuucuaaaaguaagcuaauaguuaauacugacaaggagccuacagaguaacugaauaaacaaauaaaggugugacugcccaguucuccauaugcugacauuuaagguaauguguuaauuuaucaguuuuuaaagaauuagcucaauauacauacauuuaugaaaaauacaaugccaaaaaaucaucauauauugcucaaauacauuauuuuguguuuucauaaaaaugcauguugucuauugaagguuaggagcauuuucuuucacugaggccagaucaggcagugcucugcuagauauguguugggggacucccaccaccuggugugugcuuccucauuggugguucaaugucugagagaucucagguuaguugagacugcuggugaccuauggggucacccuccuccucagcuucuuccagccuuucuuuaauucaaccacagggguccccaaugaauaaguugggugcaaguauaugccugugucucagucagcugcuuguugggccucucagaggacaccauagcaucaguaacaguaucaggccuuggagccuuccuuugagcuggauuccaauuugggugagacacuggacuuccuuucccucugucucuucuccauuuuugucccugaaauucuuuuagacaggaguagucuugguuaaaguguuugacugugggauuucaaccccauuccuccacuugaugcccugucuuucuacuggagguggacucuacaaguucccucuuccuacugaagggcauuucauuucaggucucucccuuugagugcagagagucucucaucuggcacauucuagaggguucccccaccucccaccccugaaggucgcauauuuccauuuauucugcuggcucucagagcuucuccccuguuucccuaauaccugaucauguuccccuuuuccuuucccccuccucucucccacccaguucucucccucccucugcuucccuugauugcuuuuugcuuccucccaagugggauugaagcauccucacuugggcucuucugcuuguuaaccucauugaguucuguggauuauauccuggguaguuuguacuuuuuuggcuaauauccauuuauuaguugaguauauaccauacauuucuuuuugggucugaguuaccucacucaggaugacauuuucuaguucgaucuauuugccugcaaaauuuaugauguucugguucuuuuuuuuuuuuuuuuagucuauaacauuuuuuuuauuagguauuuuccucguuuacauuuucaaugcuaucccaaaggucccccauacccacccccccccaauccccuacccacccacucccccuuuuuggcccuggcguuccgcuguacuggggcauauaaaguuugcaaguccaaugggccucucuuugcagugaugaccgacuaggccaucuuuugauacauaugcagcuaaagacaagagcucccggguacugguuaguucauauuguuguuccaccuauaggguugcaguucccuuuagcuccuuggguaauuucucuagcuccuccauuagggccgugugacccauccaauagcugacugugaucauccacuucuguguuugcuaggccccugcauagucucacaagagagagcuauaucuggguccuuucagcgaaaucuugcuaguguaugcaauggugucagcauuuggaagcugauuaugggauggaucccugcauauggcaaucacuagaugguccauccuuucgucacagcuccaaauuuugucucuguaacuccuucuauggguguuuuguucccauuucuaagaaaggguaacguguccacacuuuggucuucguucugguucuuaauagcuaaguaguauuccauuguguaaaugaaccauauuuucuguauucaugauucuguugagggacaucuguguuguuuccagguucuggcuaucacagauaaggagcaugugcaccucuggugugcuggggccucuuuugggucuaugggcaagagugauauagcugggucuucagguaaaucuauuuccaauuuucugaagaacuuccacauugauuuccagagugguuguacuguuugucuuuccuuacauccuugccagcauuugcugucaccugaguuuuugaucuuagccauucugauugauacaagaugcaacucagggucauuuugauuugcauuucccugaucacuaagaacuuugaacaguucuuuaagugcuucuaggccauucgagauuucuuuugugaauucucuauuuaucucuauaccccauuuuuuguucuuuuguuuuucaagacaggguuucucugugcagcccuggcuguccuggaacucacucuguagaccaggcuggccucgaacucugagauucaccugccucugcuucccaagugcugggauuaaaggugugcaccaccaugcccagcucuauagccuauuuuuugauuggguugcuuacuuaauauuuuuggacauuagcuucuugaggaauacgcacgcaugcgcacacacacacacacacauauauacacacacacacacacauacacacacacacacauauauaugugauguagggucagugaagauuuuuuccaaucuguagugugccaauuuuaauuaaaauuuaguuccuuagcaguugaauauuuagaaugccauauacauagcuccugaggaguucacauccuucaagugaguaauuaugcucaaaguguauugcaaguucauaccuaucuuuugucuauugugaccauauauaacuuucaugcuauucuuuccaguuacaauuguuaauguguacaugaguuguaagugaaaggaaagaguaaagcauagugaguauuaauauauuauuuugaggcuauuuaguucaucaggguucuuuccagcuucuggcuauuauaaauaaggcuguggagcguguguccuuguuauauguuacagcauauuuggauuuaugccgaggaguggcauaucucagaccucagguaauacuaugucaaauuaucugaggaacugccagacagauuuucagagugguuguaccauugugcaaucccaccaacaauggaggaguguuccucugacuggugugagguagaaucucaggguuguuuugauuugcauuucccugauuauuaaggauguugaacauuucucuaggugcuucuugaccauucaaguuucuucaguugagaauucuuuguuuagcucuguauccuguuuuuuaauaggguuauuugguuguacgcagucuaauuuccuuaguucuuuguauauuuuagauauuagcuguauuagucaggguucucuagagucacagaacuuauggauagucucuagauaguaaaggaauuuauugaugacuuacagucggcagcccaauucccaacaauuguucagucgaagcugugaauggaaguccaaggaucuagcaguuacucagucucaugcagcaagcaggcgaaggagcaagagcaagagcuagacucccuucuuccaauguccuuauauugucuccagcagaagguguagcccagauuaaagguguguuccaccacaccuuuaaucccagaugaaagguguagcccagauuaaagguguguuccuuaaacucggagauucaaucuucuggaauccauagccauuauggcucaagaucuucaaaccaagacccagauaaggaucuccaagccuccagauaagggucacuggugagccuuccaauucuggauuguaguucauuccuaauauagucaaguugacaaccaggaauagccacuacauuagcccucuauuggauaugggacugggaaagaacuuuucccaaucuguugguugcaguuuuguccuauugacaguuuccuuugccuuacagaagcuuugcaauuuuaugagguuccauuugucaauccuuuuuuuuuuuuuuugugguuuuugguuuuuccagacaggguuucucuguauagcccuggcuauccuggaacucauucuguagaccaggcuggucuagaacucagaaauccuccugucucugccuccugagugcugggauuaaaggcaugcaccaccacgcccggcccauuugucaauucuugaucuuuuagcauaaaccauugguguucuguucaggaaauuuuccccugugcccauauauuuaaggugaaaucaugaaauucuuaggcaaauguauggaacuggaaaaugucauccuguuaauguucugcuagaucuuuccaugaaauuuaaagcauucuaucuucugcuucugaaugaguuuaggauaaauucuguauuccuugauauggccuguccagcccauguagcauucauggccuagauagcauaauuauccucugcaguaugcucuagucaaguuuuuauggacugguagaauaacuugagguuaucuuccucacagucuuaauaugauuuauuuucuuuguaauaaauuguucuuccuucuuuccucccucccucccucucuuccuccuuccuuccuucucucccucucucucucucccucccucucuuccuccauuccuuuuuuccaucuucauauagcuguuacuuaccucuuagauaaauguccuuuuaaugaaacuuuuucagaucuuggccuagauaacaucaauagacagcccaguacuuacuaucaaaauauauuguauuuguuuuuaaguuuaauauguuucucuguguguggggugugguucaugaaaggaagccugguagggucgaccuagggcuugaggccugggguauccagaaggaacaguaagaacuucaccugcucaggacuccaaggcccugucagauagccacagccccccauaaaguaaauuccggccaucagucacauagggccaguacccacaagucccuccucauguaguuaaggccucucaugccaggcaaauaggcagucagaucuacccuaccccagaacuguauauaagauccuauccacaaggaagaaguguuugugagaauuacucccuugucugagugcaucugucagaagagcuguaacacugcuugggaagagaaugcucucccaaagcuuuugucaccagaagcuccccuguacucugcuugcuaaccagcccuguacuggcucagcucugccuggcucugcucagcauggccagggcagcaucugggcacaacaguggcugcuggggcaguggcacuagagcagaggugccguggcagcacuccccaucccugcuugugcccuuuccccuuugcuugaauccuccagcugggacaagucagaggucuuaguggacagccucugguacauagaucgauauuucucuaaauagcuuuuuguauucauaugaauuaaaguaguauucuuggugucuggcacagccuccugcaaggcuguagucaucaaauaccuaaucuaaguaccaguuaauuucaacuuugucuuaccuugaaaaguacuaucaccuacuggaaaugcuguccaaucuaacucaucagugaaagaagcucuucauuaggucagaaccuuacagggauggaguccaccagcuggggaacaagccuucaacacaugaaacuuuugggggacucuauauucaaaacauaacaugcauggaaaucuuagacccaaugauacaguuaaaaggaguuuugcaacauuuuagauauaguauuguaguuauguaauaugcaauuuuauuuuuaaugugguuguaucuuuaaauuuuuuaggacagucuacucauuauaauccucuaaaugacuguuccuaacauguuagacucuguauaugaaauaaguugagcauuuaggaagauaaucacacuccucagaaguaauuuguaguaaauuaguucuuuuauaauuauccuucaggaugauuuggguagguaguauuuacaauuaauuuaagauaaugacuuauuuccacaagaaaauauagauaauuuggaauuuaaaaacuacauuuaugcuaugcuacauuuucuuauacagggauaaccaauuuaaaauuuuuuuaguacaaauucuaacacugaucugcucucugcacacugacuaguuuuccacccuaagaauacuacuguuuuuuucugaggaauuuuuguguccucucuucuaccuguauaacuauuuuuccuguaacacaaauugcauccuuuauuuucuuugaauuauguacaggaacucuuaaaaaucuuuucaaaugcuuguuucauagaaaaaggagguaggauucucuggcauggcuccuuucauagauuaaaagaucuuugaaucaguugccauuugauuugauacuuacacuuugaucacuaauuguucucuacaagucucuaguggggcaggcagcauaaaucggcaggaaaaggcacucaccacuaggcuuaaaauccuaaguuugauucucagaaacagcaugguagaaggacagaacaaaauuacagcccuuugacccccacaggcugacugugguacucaguaccccauuucaugcacaguaaaccaauaaguguaaaaaaugaggcaccauguuauagauucuuucuuuucuuggauauuuucuuuauauuucaaauguuauccccguucccaauuucuccugucccagaaacucccuaucucaucccccuccuucuucuaugagggugugccaccacccaccuacccacuccugacuccccacccuugcauuccccuacauuguaucaucgaggcuuuacaggaccaagggccucuucucccagugaugccugacaaggcuauccucugcuacauauauggaugaaccaugggucucuccacgugcacuccuugguuggugguuuagacccugggaacucugguugguugauauuguuguucuuccuaugggguugcaaacccuuucagcuccuucaguccuuucucuaacuccuccaucagcgaccccgugaucaguucaaugguuggcugugaacauccaccucuguaugucaggcucuggcaaagacuaucaagagacagcuuuaucaggcuccugucagcaugcacuucuuggcauccgcauuuggugacuguauaugggauggaucuucagauggggaagucuaaauggccuuuucuucagucucucuguuccacacuuugucuccauauuuuguuaacccuucugagaaggaaugaagcacccacacuuuagucucccuucguuuuuagcuuuaugugaucugugaauuguaucaugccuauucugagcuuuugggcucauauccacuuaucagugagugcauagcaugugugaucuuuggugauuguguuaccucacucacuuauucuauccauaugccugagaauuucaauaauucauugcuuuuaauaucugaguaguacuccauuguguaaauguagcacauaucuauuccucuguugagggacaucuggguucuuuccagcuucuggcuauuauaaauaaggcugcuaugaacuuagugcagcauuuguucuuguuauauguugcagcauauuuggauauaugcugaggagugguauaucuggaucuucagguaauacuauguccaauuauccgaggaacugccaggcugauuuccagagugguuguaccagcuugcaaugccaccaacaauggaggacuauuccucuuucuccacauucucgccagcaucugcugucaccucaguuuuuuaucuuagccauucugauuggugugagauggaaucucaggguuguuuugauuugcacuucccugaauauuaaggauguugaacauuucuuuaggugcuucuugaccauucaaguuucuucaguugagaauuuuuuguuuagcucuguacccuauuuuuauauaggguuauuugauuguaugcagucuaauucccugaguucuuuguauauauuggauaucagccuuccuuuggaugugggauugggaaagaaccuuucccaaucuguugguugcaguuuuguccuauugacaguguccuuugccuuacagaagcuuugcaauuuuaugagguuccauuugucaauucuugaucuuggagaauaagccauugguguucuguucaggaaauuuuccccugugcccauguguuggagacuccuuccuacuuucuuuucuauuacuuucaguguaucuaguuuuauguagagguccuugauccacuuggauuugaguuuguacaaggagauaaaaaugaaucgauuuguauucuucuacauguugacuauauuccaguuuuguugaguauaggcuaggcuuuuguaguaggaucugaugaucauuugaauuuccuugguuucuguuguuauguuucccuuuuucuuucuuucuuucuuuuuuuuuuuuuuuuuggauauugauguucaaaauguauucucuuuauuuuuuauuuuuuuauuaguuauuuuccucauuuacauuuccaauacuauccaaaaaguccccaaugcacuccaccccacuccccuacccacccacucccacuuuuuggcccuggcguucaccuguacuggggcauauaaaguuugcaaguccaaugggccucucuuuccagugauggccaacuaggccaucuuuucauacauaugcagcuagagucaagagcucugggguacugguuaguucauaauguuguuccaccuauaggguugcagaucccuuuagauccuuggauacuuucucuagcuccuucauugggggcccugugauccauccaauagcugacugugagcauccacuucuguguuugcuaggccccugcauagucucacaagagacagcuauaucacgguacuugcaacaaacgcuugcuaguguaugcaauggugucaucguuuggaggcuaauuaugggauggaucccuggauauggcagucuuuagaugguccauccuuucgucacagcucccaauuuuaucucuguaacucuuuccauggguguuuuguucccaauucuaagaagggccacaguguccacacuuuggucuucguucuucuugaguuucaugcguuuaacaaauuguaucuuauaucuuggguauacuaaguuuuugggcuaauauccacuuaucagugaguacauauugugugaguuccuuugugauuggguuaccucacuccggaugaugcccuccagguccauccauuugacuaggaauuucauaaauucauuccuuuuaauagcugaguaguacuccauuguguaaauguaccacauuuucuguauccauuccucuguugaggggcaucuguguucuuuccagcuucuggcuauuauaaauaaggcugcuaugaacauaguggagcaugucuccuucuuaccgguugggacaucuucuggauauaugcccaggagagguauugcuggauccucugguaguaauauguccaauuuccugaggaacugccaaacugauuuccagaaugguuguacaagcuugcaaucccuccaacaaugaaguaguguuccucuuucuccacauccuugccagcaucugcugucaccugaauuuuugaucuuagucauucugacugguuugagguggaaucucaggguuguuuugaguugcauuucccugaugauuaaggauguugaacauuuuuucaggugcuucucugccauucgguauuccucaggugagaauucuuuguucaguucugagccccauuuuuuaaugggguuauuugauuuucugagguccaccuucuugaguucuuuauauauauuggauauuaguccccuaucugauuuaggauagguaaagauccuuucccaaucuguugguggucuuuuugucuuauugauggugucuuuugccuugcagaagauuugcaacuuuaugaggucccauuuauugauucucgaucuuacagcacaagccauugcuguucuauucaggaauuuuuccccuguacccauaucuucgaggcuuuucccuacuuucuccucuauaaguuucagugucuuugguuuuauguggaguuccuuaauccacuuauauuugaccuuaguacaaggagauaggaauggaucaauucgcauucuucuacaugauaaccgccaguagugccagcaccauuuguugaaaaugcuguuuuuuccacuggaugguuuuagcucccuugucaaagaucaagugaccauagguguguguuuucaucucagggucuucaauucuguuccauuggucuacuugucugucguuauaccaguaccaugcaguuuuuaucacaauugcucuguaguacagcuuuaggucaggcauggugauuccaccagagguucuuuuauccuugagaagacuuuuugcuauccuagguuuuuuguuguuccagaugaauuugcagauugcccuuucuaauuccuugaagaacugaguuggaauuuugauggggauugcauugauucuguagauugcuuuuggcaagauagccauuuuuacaauguugauccugccaauccaugagcaugggagaucuuuccaucuucugagaucuucuuuaauuucuuuuuucagagacuugaaguucuugucauacagaucuuucacuuccuuaguuagagucaugccaagguauuuuauauuguuugugauuauugagaaggguguuauuucccuaauuucuuucucagccuguuuauccuuuguguacagaaaggccauugacuugcuugaguuaauuuuauauccagcuacuucacugaagguguuuuccaggcuuaggaguucuguuguggaauuuuuagggucacuuauauauacuaucauaucaucugcaaagagugauauuuugacuucuucuuuuccaauuuguauccccuugaucuccuuuuguugucgaauugcucuggcuaggacuucaaguacaauguugaauagguagggagagaguggacagccuugucuagucccugauuuuagugggauugcuuccagcuucucaccauuuacuuugauguuggcuacugguuugcuguagauugcuuuuaucaugguuagguaugggcauugaauuccugauguuuccaagacuuuuaucaugaauggguguuggauuuugucaaaugcuuucucagcaucuaaugagaugaucaugugguuuuugucuuugaguuuguuuauauacuggauuauguugauggauuuccauauauugaucuauccuugaaucccugguaugaaaacuacuuggucaggauagaugauuguuuugauguguuccuggauucuguuagcgauaacuuuauugaggauuuuugcaucgauauucauaagggaaauuggucugaaguucucuaucuuuguugggucuuuuugugguuuagguaucagaguaauuguggcuucauagaaugaguuggguagaguaccuucuguuucuuuuuuguggaauaguuugugaagaacugggauuagaucuuuuuugaaggucugauagaacucugcacuaaacccaucugguccugggcuuuuuuugguugggagacuauuaaugacugcuucuaauucuuuagggaauaugggucuguuuagaucauuaaccugaucuugauuuaacuuuggugccugguaucugucuagaaacuuguccauuucauccagguucuccaguuuuuuugaguauagccuuuuguagaaggaugugaugguguuuuggauuucuucaggaucuguuguuaugucucccuuuucauuucugauuuuguuaauuagaauacuuucacugugcccucuaguuagucuggcuaaguguuuaucuaucuuuuugauuuucucaaagaaccagcuccuggauugguugauucuuugaauaguucuuguuuccacuugguugauuucaccccugaguuugauuauuuccugcugucuacuccucucgggugaauuugcuuccuuuuguucuagagcuuuuagguguguugucaagcugcuaaugugugcucucucuaguuucuuuuuggaggcacucagagcucugaguuuuccucuuagaaaugcuuucauugugucccauaaguuuggguaugucguggcuucauuuucauuaaaguacaaaaaguccuuaauuucuuuguuuauuucuuccuugaccaagguaucauugagaagacuguuguuuaguuuccagguguguguuggcuuucaaauauuuauauuguuauugaagaucacccuuuguccauggugauuugauaggaugcaugggacaauuucaauauuuuuguauauguugaggcuuguuuugugaccaauuauguggucaauuuuggagaagguaccaugaggugcugagaagaagguauaucccuuuguuuuaagauaaaguguucuguagauaucugucagauccauuuguuucaugaccucuguuaguuucacugugucccuguuuaguuucuguuuccaugaucuguccauuggugaaagugguguguugaaguuucccacuauuauugugugaggugcaauguaugcuuugagcuuuacugaaguaucuguaaugaauguugcugcccuuguauuuggagcauagauauucagaauugaaaguuccucuuggaggauuuuaccuuugaugaguaugaacugcccuuccuugucuuuuuugaugacuuugcauuggaagucgauuuuauuagauauuaggauggcuacuccagcuuguuucuuccuaccauuugcuuggaaaauuguuuucuagccuuucauucugagguagugucuaucuuuuucucugagaugaguuuccuguaaguagcaaaaaguuggguccuguuuguguagccagucugguagucuaugucuuuuuauuggggaguugaguccauugauauuaagagauauuaaggaaaaguaauuguugcuuucuuuuauuuuuguuguuagaguuggcauucuguucuuguggcugucuucuuuuagguuuguugagggauuaccuucuugcuuuuucuagaaugugguuuccuuccuuguguuguuuuuauuuuuuuuuucuguuauuauccuuugaagggcuggauucguggaaagauaaugugugaauuugguuuucucauggaauacuuugguuucuccaucuaugguaauugagaguuuggcuggguauaguagccugggcuggaauuuguauuuucuuaguuucuguauaacaucuguccaggcccuucuugcuuucauugucucuggugaaaaaucugguguaauucugauaggcuugccuuuauauguuacuugaccuuuuucccuuacugcuuuuaguauuuuaucuuuauuuagugcauuuguuguucugauuauuaugcguuuggaggaauuucuuuucuaguccagucuauuuggaguuuguaggcuucuuguauguucguugguaucucuuucuuuagguuugggaaguuuucuucuauaauucuguugaagguuuuugccgguccuuugaguugaaaaucuucuuucuuaucuacuccuauuaucuguagguuuggucuucucauuguguccuggauuuuacuggauguuuugaguuaggaucuuuuuggauuuuguauuuucuuugauuguugugccgauguucucuauggagucuucuguaccugagauucucucucccaugucuuguauucuguugcugaugcaugcaucuauguuuccagauuuuuuuuuuagguuucuaucuccagcguugccucaauuuggguuuucuuuauugugucuacuucccuuuuuaggucuuggauucuuuuauuuauuuccaucacuuguuuugucugguuuuccugcaauucuuuaagggauuuuugugcuuccuguuuaaugucuucuaccuguuuagcaguguucuccuguauuucuuuaaguuugugauuaaauuccuucuugaugucuucuaucaucaucaugagauaugcuuuuauuuuuuuuuccauuuuuuauuagguauuuagcucauuuacauuuccaaugcuauacuaaaauucccccauacccacccacccccacuccccuacccacccacuucaccuuuuuggcccuggcguuccccuguacuggggcauacaaaguuuacguguccaaugggccucucuuuccagugauggccgauuaggccaucuuuuguuacauaugcagcuagagucaagagauccgggguacugguuaguucauaauguuguuccaccuauaggguugcagaucccuuuagcuccuuggguucuuucucuagcuccucaaugggagcccugugauccauccauuaucugacuguuagcauccacuucuguguuugcuaggccccggcauagucucacaagagacagccucaucuggguccuuucaauaaaaucuugcuaggguaugcaauggugucagcguuuggaugccgauuaugggguggaucccuggauauggcagucucuacaugguccauccuuucaucucagcuccaaucuuugucucuguaacuccuuccaagguuguuuuguucccaauucuaaggaggggcauaguguccacacuucagucuucauucaucuugaguuucauguguuuagcaaauuguaccuuauaucuugggaauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauaaaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuuccuaaucucuguugguggucuuuuugucuuauugaugguguauuuugccuugcagaaacuuuggaguuucauuaggucccauuugucaauucucgaucuuacagcacaagccauugcuguucuguucaggaauuuuuccccugugcccauaucuucaaggcuuuuccccacuuucuccuuuauuaguuucagugucucugguuuuaugugaaguuccuugauccacuuagauuugaccuuuguacaaggagauaaguauggaucgauuugcauucuucuacaugauaacaaccaguugugccagcaccaauuguugaaaaugcugucuuucuuccacuggaugguuuuagcucccuuguggaagaucaagugaccauagguguguggguucauuucugggucuuuaauucuauuccauuggucuacuggucugucucuauaccaguaccaugcaguuuuuaucacaauugcucuguaguaaagcuuuaggucaggcauggugauuccaccagagguucuuuuauccuugagaagacuuuuugcuauccuagguuuuuuguuauuccagaugaauuugcaaauugcuccuucuaauucuuugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauauagaucuuucacuuccuuaguuagagucacgccaagauauuuuauauuauuugugacuauugagaaggguguuguuucccuaauuucuuucucagccuguuuauucuuuguauagagaaaggccauugacuuguuugaguuaauuuuauauccagcuacuucaccgaagcuguuuaucagguuuaggaguucucugguagaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguuuaaaagguagggagaaagugggcagccuugucuagucccugacuuuagugggauugcuuccagcuucucuccauuuacuuugauguuggcuacugguuugcuguagauugcuuuuaucauguuuagguaugggccuugaauuccugaucuuuccaagacuuuuaucaugaauggguguuggaucuugucaaaugcuuuuuuugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuuugggucuuucugugguuuagguaucagaguaauaguggcuucauaaaaugaguuggguagaguaccuucuacuucuaauuugugaaauaguuugugcagaacuggaauuagaucuucuuugaagguuugauagaacucugcacuaaacccgucugguccugggcuuuuuuuggcugggagacuauuaauaacugcuucuauuucuuuaggugauaugggacuguuuagauggucaacuugauccugauucaacuuugguaccugguaucuguccagaaauuuguccauuucguccagguuuuccaguuuuguugauuauagccuuuuguagaaggaucugaugguguuuuggauuucuucaggaucuguuguucugucucccuuuucauuucugauuuuguuaauuagaauuuugucccugugcccuuuagugagucuagcuaaggguuuaucuaucuuguugauuuuuucaaagaaccaacuccucguuugguuaauucuuugaauaguucuucuuguuuccacuugguugauuucaccccugaguuugauuauuuccugccuucuacuccucuugggugaauuugcuuccuuuuuuucuagagcuuuuagauguguugucaagcugcuaguaugugcucucucccauuucuucuuggaggcacucagagcuaugaguuucccuccuagaaaugcuuucauugugucccauagguuuggguacguuguggcuucauuuucauuaaacucuaaaaagucuuuaauuucuaucuuuauuccuuccuugaccaagguaucauugagaagaguguuguucaguuuccaugugaauguuggcuuuccauuauuuauguuguuauugaagaucagucuuaggccauguuggucuaauaggauacaugggacaauuucaauauuuuuguaucuguugaggccuguuuugugaccaauuauauugucaauuuuggagaaggugcugagaagaagguauauccuuuuguuuuaggauaaaauguucuguagauaucugucagguccauuuguuucauaacuucuguuaguuucacugugucccuguuuaguuucuguuuccacgaucuguccauugaugaaagugguguguugaagucucccacuauuauugugugaggugcaacgugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuuaauaacuuuggguuggaagucgauuuuauccgauauuaaaauggcuauuccagcuuguuucuucagaccauuugcuuggaaaauuguuuucuagccuuucacucugaaguagugucugucuuuuucccugagauggguuuccuguaagcagcagaauguuggguccuguuuguguagccagucuguuagucuaugucuuuuuauuggggaguugagaccauugauauuaagagauauuaaggaaaaguaauuguugcuuccuguuguuuuuguuguuaaaguuggcauucuguucuuguggcugucuucuuuuaguuuuguugagggauuaucuucuuguuuuuucuagggcgugguucccguccuuguauuguuuuuuuucuguuauuauccuuugaagggcuggauucguggagagauaaugggugaauuuaguuuugucguggauuacuuugguuucuccaucuaugguaauugagaguuugguuggguauaguagccugggcuggaauuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuuguuguucugauuauuaugugucaggaggaauuucuuuucugguccagucuauuuggaguucuguaggcuucuuguauguucauggguaucucuuucuuuagauuugggaaguuuucuucaauaaucuuguugaagauguuugcugguccuuugaguugaaaaucuucauucucauccacuccuauuaugcguagguucggucuucucauuguguccuggauuuccuggauguuuugaguuaggaucuuuuugcauuuuccauuuucuuugauuguugugcugauguucucuauggaaucuucugcaccugagauucucucuuccauuucuuguauucuguugcugaugcucgcaucuaugguuccagauuucuuuccuaggguuucuaucuccacuguugccucacuuuggguuuucuuuauugugucuacuucccuuuuuaggucuuggaugguuuuauucaauuccaucaccuguuugguuguguuuuccugcaauucuuuaagggauuuuuuuguuuccucuuuaaugucuucuaccuguuugguuauguuuuccuguaauucuuuaagggauuuuuguguuuccucuuuaaugucuucuacuuguguagcaguguucuccugcauuucuuuaagugaguuauuuaaguccuucuugauguccucuaccaucaucaugagauaugcuuuuagaucagggucuagcuuuuccgguguguuggggugcccuggacugggagaagugggagugcuggguucugaugaugguuagcggucuugguuucuguuaguaaguuucuuacguuuaccuuucgccuucugguaaucucuggaguuaguuguuauaguugucucuguuuagagauuguucuucuggugauucuguuagccucuauuagcaguccuugaggcaggcuuccuccucugaguuucacuggucagagcacucucugcaggcaagcucuccucuuacagggaaggugcacagauauuugguguuuggacuuccuccuggccgaggaugaagucccaaaacaggaccuuucccagaagcuguguugcuuugacgggucacagaagcuguuagcuucuauggugcacacucucaccugugcagacuauguuugguggaguuccagaaccaagauggcuaccgccaaucuagaggcaaaagccuacugggccggguggacaccuguccucuggccaggaagguggccggaugucuggggcccuaaaagggugcugccucaguagcucucuggcucccgccuguuccagaagcugucagcuucuguggugcacacucucaccugugcagacuaaguucaguggagucccggaaccaagauggcucccgccgauccugaggcaaugggcucccgggcuggguggacaccuuuccucuggccugggggguggccggaagucuaggggccgaaaaggacgcugccucaaaggcucuguggcacccgccugucccagaagcugucagcuucuguggugcacacucucaccugugcagacuaaguuccuaaguucggcagagucccggauccaagauggcuccaucagauccugaagcuaagggcucccgggccgggcagagaccuguccucuggccgggagggugguggucggaucaccugaagucuuuuuuuuuuuuuuuuuuuuuuucuguguuuuaguauuucuuucuuuuuuuuuuuuuuuuauuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugaaacugaaacaaaacauacauauuauuucaaaugaaugugaaguuagaugcuuagaaucauuagauaacagcaacuuuugaaauaaacugggauugaaugaaguauggauauaauaauuaugauugaauuugcuuguuuggguuauauauauguacauauauauauaauauacauuauaauauauguauaugugcauauauacauguauauauauguauauauaugaagcaauuuuauacaauacuuugaaaauuuucauuaaagauuuuaaauuuguugagauucucuuuaaagauaucagaaauuauagaugaccuaucauuugcacggaauuuacaaaggucauccauacccuguuuuagauaguaaaauugcuuuuacuaucuauuaguaauggcuguauucucugcaugcccaaaccccaguaacagaaagugaauugucccaugccuuauaucaacaaagcagagaacauguauaaacuaauuuucagacagugaacaguaucuuaggaauguagcauagagugauaguuaggaccugcucaaaucugugagccuuuacucuguaggaggaauacggaauagaaacuaaauaaguacuugaguaaaguaguaguucucaaccuucuuaauuuuguaacucuuuaguauaguuucucauauuguggugaccccaaacauaaaauaauuuuaucacuacuguaguauuuugcccuguuauuauaguauaaauaucugauauguaggaucugauauguggcuccugugaggggucacuucccacagguugagaacaacuggaucaguguguucauggaguaaucuaauuagaguauaggauaaaccucuagaagaaacauguuuuauccuguauuaggaauuguuucuguuuucacuggaaugagguaaucuugaaaaacauggauaauuugguauuccaugggaggauauuguuaaauuauccaaaugaacuccagaguaaaaggccauuuuuuaagagcauuuucacaagagccaagcuaauucaaguaccuaaacuacauuuuugcauuccacaaaaugucauaccaauaaaguauagcaacaauaaacauaaaacucacaguguuuggaaaucaauuuaaaaaauaaagguauguauauagcaggaacauaagaccugugacuguaauaaauagucagaaaugauauuaaguuaauauuaaaaugauccuguuuguauauaauuucacuaugaaauuaguccaagaagauagagaaauaugaaaacaugauaaaggguaaaacaaaauagauuccaaauugagcuucuagagaagaaaagaauaaguugaaaaaauacaacuaaugugaauuuuauacuguauuaauaaagauuggagaacuuauaggauaauagugaaagcuacccagaauaaaaguaaaagagagagagagaggagcagagcugugggacaaugucaaggcacuguggauauaaaaacaauagauuaauuaauuguauauaguaauauguauauuauagcacacaugaaaguaggaggagaaauuguuuauaagguagaucuuuucuucuaccauguggguucgaaagaucaaacuuaaauuguuaucauugaugacacauccuuuuacuugcuuagcagucucacuggccuccuucugggauuagagccucagaaggaggggaaauggaugauagaaauguuacuugaaaaaaauaauggcugaaauuuuucuaauacugguaauaaaacucccaauuuccccccaggaaaacucuaccuacccuacccacucaacuuuauaucuucguuuuuaaaacucaucaaguccaauuuaugcugucuauauauuuuuggauguauuuccuuccauuggccacuuccaaguuaccaagggauaugcucuuaaagaauuccaacuuuucuucuuguagauaucccucauagccagucgauucuugauuaugggugggacuucagaccuuggcauacugggauuuagucugguuugaaauuauacaggucuuguauaugcucuuauaacugcuaugaauuuucauguacagcuggccugcuguguaugggagauacuguuuucugguugucauucacugacucuuuuacagucuuucuacguccuuuugugcaaugauuccugaggcuugggaggugugggugugauaagguaucccauuugggguugagcauucuaugacaucuuguucucuggaccuuggcaaguugugaaacucuauauuaguuaccauuacuaaaauuagaagcuaguuugaugagagcugugagauguauuaaucuauggguauaauggugaauuuuuagcaguugguugagcaauaaggaaauuuuagcagaauaauaauaguagauucuuuucuagggcuuaauaccugucuagccacaggauuuugacuugauacuggugccaaguaaguguuucaucuuguguuuauuuuuaagagcccuuaaauuuaaucagaaugugguuuuguauucccaugauguuuguuccaguauugcugcaauaaucacauuuuaagagaccaguuacuauagcuugcaagguugacagcuggguaaaauugguaauuacuuuucuccucuuagagaauguguagcaccuucuaauacuauguacaaucaucaauaagaaugaagaguuuaggcuaguaguuuucugaucuucccauguuuuaugauuuaaguauguuguaucuucagcaauaaugucuuauuaucaaguucuggaguguagccaauugcauuagcaagagccuauaauguuuggaggugggguguacugggggaucuuacgggcaacaguucugaaaagguuaacucauucuuagaaaaauuuuuauauuugauagcuuaugcuaucuaguagguucauugucauuuucuuaggaugaauauugcuuugauggaauacuaugcgcaaaagcaacuuggagaggaaaggguuuauuuggcuuauauaucuagaauauaguccagugagggaagccaaggcaggaacucaaacuggccaggaaccuggagguaggaguugaugcucaggccauagaggagugcugcuuacugccuugcucuucauggcuugcucagccugcuuuuuauuuuuuauuuuuuuauagaauucaggacuacuagcucagggguuccccaccuacaauaggaugggcuuucccugaucuaacauuaauuaauaaagugccauuuagacuugccugccuauagcucgaguuuuuggaggcauuuugccaguugggauuuccuuuuuuuucaggugauucuaacuuuugaccagucaacagaaagcuauccagcacagucauucuauuauaggacaacuccauuuuaauaucuuuuuauguauguguauauaugucuguauuuauaccaccauggcccuuguuguaguuagggcucuauugugauaaaacauuggcuacaaacaacuugagaaagacaaggauuuauuuccuuuuacagcuuguaguccauccuccugagaaguuagggcaggaaugcaaagguaggaacauggagguaggaccugauacagaggauauguaagaggacugcuuauugucuugaucuauacaacauguucagcuugcuuucugauagcauccauauguuaggggugcccaaagggaucugggggucucucacauuagucaucuaucaagaaaaugcaccacaaacuuguccauaaucuaaugcgugugugugucauuaagguuccuauuccugaaugauucuagcuugucauauugacccaaaaucuauggauauuucaagugaaacacauaucugacaauucaaagccaacguucacuguugcagccggccagcggcucacaugucuggguucuaaccuggaaggcauccuggaaucuggaagagaagagggggcuaggcuacgugagaaagaugaaaccaagacaaggcucugaucaagguucaauuuuacuauucuagacacuggguuaugaagcaggggaaaggggcccauucccgccaaaucauccuggauuccaguuucaggugaccaaguguuuggcuccggaacagccagguggcaggcaggagcgggauagggcgguaggcuccaccccaugcucucuucuugcuaauagugaaaccugagcagccagguuucagguugggggucaggggggguggggggagguuacaguucacaaauaagaaauaacaugugaugcuuuucuuucuaugucuacguugccuuagucagaauaauucuuaaaggcagacuaaaguggaaaaggcauuguguauuacuuaauuauauacuuacuaacuuauuuguuuauuuguaugugugugugcgugcacaugugcgugucuacaugcauacauacauguauaggauguugcuagcucuugugcauguggaggccagaguucagugucuggugcuuuccucuguuauuucccacauuauguuuuggaauggguucccuuacuaagcugguacccacaaaugggcuauacuggugaucuuggcuagccuguuacucucuaggauccuuauguuuccaucuuuuuggugcuuagauuugguacccacaaaugggcuauacuggugaucuugguuagccuguuacucucuaggauccuuauguuuccaucuuuuuggugcuuucgcuuuagauuuuuggugcauguugcuacaguuggguuuuuuuuuaugugguucugcagauccuacaggucucaugcuugcccagaauacuuuacguacuaggcaucucuccaaccucacaccuuauauuuuaaaagagaaauaacauaaaccagaacagaguggaauacuaaauuugaaguucuggaagaaaaacaaauuacucuacaaguuuaaaguauuauuugaaagaaaggggaauauacucuuugaauacuuaaaaaccuaaauaacaggauucucuugcuauugaugguggcaauuaaucgcauaaaagccauacuucuaauauuaguauuagaguuauuaauauggaguguuacuaauucugauaagaucauuauauccugaugaauguguugaguuuucagcaaggcauaauaauccuaaacauuuacuucuuuaaaaauuacagaacagauaaacuacgaagcugucuggauugauaguauaaauccacauauaaugaagauuuugcaugccuuucaacugugugaaugacuaguagauuuuuuuuuucagauauagaaaauuuaagcacuacauauauaaaucuaaugccauaagcauacaugaguuugggggcuagggagaugguucaguugaauaaaaugcuuguuucacaaguaugaguucuuaucuccaguacuuacauaaaugccaggugggcaugguacuuccagcacuuggaagacauaaacagggacuuuauagagcaagcugacuggucagaggagccauaaggucaaguaagagacuuuuccucaaugaauaguaaggaaaacagucaaaguugauauuaaccucagauccccacaugcccaugcucauauacacacuugcaugaaucccagugaacauauacaugaacagaccaacacugaacacauguucacauuaagaacaaaaagaaauaaaaguacacauucuuucaacuguacuucuauauacuauuugaggccaucaaacuugucucaaauaaguuauuagaaguauauuuucuguccacacacaacuugccaguucuuacagagaaauuuaguuggaaaaccccaauuuauucuuucauugaaaaucaaccaacuuuuuaacaauaugggugcugggaauagaaccgaggugcucugaaagagcagccaggucuuucuaccagcgagcuaaaggucucucuacucagaccuaaaggcccaccuaucagaauuauaccagaauucucaccagagacuaugagagcuagaagaucccaggcaaaugucauacagagcccaagagaacacaagugccagcccaggcuacuauacccagccauacucucaauuaccauagauagaaaaaucaagauacuccacgacaaaaccaaauuuaaacaauaucuuuccacaaauccagcccuacaaaggauaauagaugaaaaaugucaacacaaagagggaaacuuacacccuagaaaaagcaagaaaguaaucuuucaacaaccccaaaagaagauagcuacacaaacaugaaaauaacauaaaaaguaacaggaagcaacaaucacuuuugccuaauaucucauaacaucaauggacuuaauucgccaauaaaaagacauagacuaacagacuggauauguaaacaggacccagcauuuugcauacaggaaacauaccucagugucaaagacagacacuaccucagagaauuuuuaccaaucuuauauccaauagaggucuaauauccaacaaagacaaagaacuuaagaaguuagacuccagagaaacaaauaacccuauuaaaaauggggagcagagcuaaacagagaauucugaacuaaggaauacugaauggaugagaagcaccuaaagaaauguucagcauccuuaguuagcagggaaaugcaaaucagaacagcucugagauuccaccucacacaagucaguauggcuaagaucaaaaacucaggugacagcaguuacugaugaagaugugaagaaagaggaacacucuucuauugcuggugggauugcaagcuuguacaaccacucuggaaaucagucuggugguuccucagaaaacuagccauaguacuaccugaagacccagcuauaccacuccugggcauauacccagaagauauuccaacuuguaauaaguacacaugcuccacuauguuuauagcagccuuauuuauaauagccagaaacuggaaagaacccagauguuccucaacagaggaauggauacagaaaacaugguacauuuacacaguggaauacuacucagcuauuaaaagcaaugacgucaugagauucucaggcaaauggcuggaacuugaaauuauccuccugagugagguaacucagucacaaaagaauacacacgguaugcacucacugauaaguggauauuagcccaaaauucagaauacucaagauucaauucacagucuauaugaagcccaagaacgaagagcaaaguguggaugcuuuggugcuucuuagaaggaugaacaaaauacucacagggggaaguauggagacuaaauguggaauagagaccgaaggaaaggccauccagaagguaggcugccccauaucaggauuccauauacagucaccacaccuguacacuugugggugcugggcagugcuuguugacggaagccugauauugcuguuuccugagauacccuggcagagccugacaaauacagagguggaugcucacagccaaccuuuggacugagcacagggucccagauggaggaauuugagaaggaacugaaggagcugaggggguuugcagccccguggagggagcaacagugucaauaacucagacccccccccaagagcucccagggacuggaccaccaaccaaagaauacacauggagggacccaugguuccagcugaauauguggcagaggauggccucagugggaggagaggcucuuguuccugaggguucucgauucccaguguaaggaaaugccagggcgggaagaagggaguagguggcugggggugggggggguggauacccucauagaggcagggggaggaaggaugcaauaggggguuuuugaagaggagaccuggaaaauggagaacauuugaaauguaacuaaagaaaagaacaaucaaaacaaaauaaaacaaaacaaaaaaaccccaaaaaauaaaaaaauaaaaucaagcaacacaaguuacaucuaauuuccaaaauauucccaaggaggggaaauauuucccuuuuauugaaugggaaaauaucugguuuugagauguagcuaaaguaguacuuacagaaaaauucguaggauuauauacuuauauuauaaaauuagaaagguuuaaggucaauugcccaagcuuuucccuuaagaaacuaacuaaauaaaagcaaauuaaauccaaaguacaggaugaacaaaauaauaaaaccaguacagaaguuucuguggagcucucugaggugcuugcuauacaagcaugaagacccauuucugaaacaccagagcucacagauugagcugcagucccagugcugagaaacagagagggaaagacccugaggacugcuguccagcccaucuagcugagucucugagcuccagagauagugagagaccaugucucaaaauuaaaagcagaaaguggucauggaagacauccauugauaaauucugggcuagacaugcugugcacacauguacacauguaccagcacccacaaacacacacaaacaugaauauauacacagaccacaaacauaaaaaauuaauaauagaaguuaacuuaauagcagacagugaggaaaaaauuaucaagcuaaaaaugauugauguuauuugcaaaauaagucccuuuucagaguuauaugugaauggggguaaauauagaagaaagugaguguuuuauagacauuaaggcaauaaaaauuaaagagguauuauauguaauuuuaugccaauaaacucaacaacuuagguaaacugggcauucuuugccaaagacaagccauaaauucuaacuaaagaggaaagaaauaccuaaguagacagccccauuucugccaaaaauccuuacauauuucuucuaauggaaaacacaggucuagguaguuuuaguggugcaugcuaugaaacauuugcaaagaccacauaggagagaauauaauuauuucauugcaaauuuauucucccuuuuaauugauuuugaaagaaccuaguggggaaacccccacucaacuccugauucagcaugcacccaagaaucacgaacaaacagaccgucuuguuauaaaaacacaagguaguuuaauggcgaagcuccagguugaaacuuaucucaugcaggagacaguggauuggaccacgaggcuuggaagcuaggggguuuuauagaaaaggggaggaauuggcacgguuucacaugauugguucauuuaaacaucaguagacuguacaugcagauaacguuuaacuuaagucagaagugugggagauagggaggcgccuggccagucccacaugucauucucuuuaucuuuauggccaagcagccucaggaaugucuuaaugacuggccugccugggcauguccuggccuguucugcuauguucucagccccagguuucaaagcucacaaacaacccuuugggcuauuugacauaaauuacaugaaucacaggucucaaguuuuauuuccuuucaauuuuaguaugagaaauucauuaauacuugaaaagcuacauauaguccagaaaacaaaauaaagucugaaauauuuguuuucuuaaaaaucagacagcuguuugaaauuuuuugagacauuuugccaucuuucuaucaaaucaauggaaugauuuuuauuauuguuuacauaucaaaauuauugauuaauaauuacuaaauauguuccauaauauuaauugaauuauguaauucaguuaaaauuacuaaauaauuuuauucagaaaauuuagugaauaauaauaaauucagaaugaaauauuuucuuuuuagcauaaauuaaguauacaaaauagguuaauuauaucauuuuuuguuggauauuuucuuuauauacauuucaaauguuaucguuuuccccaguuucacucccuucuacaaacaaccuauuacauccucccucaccuugccucuaugagggugagauugggaaaagauaauugccaauucuacauccaauagagggcuaauauacaauauuuacaaagaacucaggaaguuaaacuccagacaaucaaauaacccuauuaaaaaugggguacagagcuaaacaaagaauuuucaacugaggaaacucgaaugguggggaagcaccuaaagaaauguuuagcauccuuaguuaucaggguacuucaaaucaaaaugacucugagauuccaccucacaccauucagaaugacuaagaucaaaaaaugcaacugauagcagaugcugguaaggauguggagaaagagaaacacuccuccauugcuggugggacugcaagcugguaaaaccacucuggaaaucaauauguaggucauccccugaaaauggaauaacauuugaaauguaaauuguuggggccugccagcugcucacauguccagguucgagccuggaaggcaucucggaaucuggaagaaaagagggagccuagguggguugagaaauaaugaaaccaagacaugcuacucuguucaagguucaaauuuuuaauggaggacaugcuuuauaaaagaguggggaaaguccauucccuccaauucauccuuggagccuggauccagcugcagguaaugaugugcaggauagggcuuagucuccagaacagcuguggggggggggguggcuuucagccaguagcaguaucuugaagaggaacaaaggcaguggcagaacaauauagugaucuagggaggaaggcuccacccuagauaaucuccuuaguggcagcaaggucaaguucugguuuagccugcuucaggcuuaugggaggcuacaguaaauaaagaauauauccaauuaaaaaaaagaaaaaaauuaguacaacaaaaccggacaucaguguugccagugcccaagcuccaaggucauggaaugggauauaaagauugaggagcugugcuaugcucugagcaugacauggcuguuacauucaaacucaaaacagcauuucaucaugggugaggagggguugugacgucccaccucuuccucaguggcuuuuguugcuugccagauuuucuugaguggccuggucacuguuaaauugcuugugaacuaguaaauagcauacaccccuguucaugcagaugaacucaauuaauaauggauacacagagauggaaaaguagagacagacuauuugggaagaagggcuucaacaggagugggagagugugacgggacaaaagggggaugaaauaaccaaauauaauauauacauuuaugaaauugucaaagacuguaaaccauuacuacaagagaauaauaaugacuuuuguaguucaguaugugacuauguuuuacuauuuucauuaaauuucuuaauuugaguuguaaauuuucauaaaguuguaagaaauaauaugcuggaguuuuauagaguauauacccgcauuuuucccucuaaagcuacacuuugcaaauuuauaguuaaauuucacauuguaucaaauauacauaguuaagguauauaauaguguuguugucaagguccucugguguuuuucuuuaucauuagauauucauuaucauucuuuaccuguaguuuugacagucacuggugcuuccccaccucauguuccccaaaucauagaugcuauauagaauuagagaauguuuagucuugugagauuaacugcucuuccaguauaauuauuugaauauucauagaaguaacuauauggauuagaauuaauuucuuuuuguuacugaccaugguauauaguuuuaccauuugguaguugauaaaauuccaguuagacaauaguauuuuaaaguugcuacaaagcuuuauguucagguuauauguagaugaauguauauuucucuagaauaaauccucagauguguuacuguuagguuguauaguagauacauuuauuuauuuauuuuguggcuuuuucuagguuguauaguagauacauuuauuuauuuauuuugugguuuuuucuagguuguauaguagauacauuuauuuauuuauuuauuuauuuauuuuuuuauuuauuggcuuuuuuuccccucuuuuuagucuuuucaauguuuaguucuuauguaguuuuuugguuuuaguuaauggaccugaauauaggccuaugauaugcuuuucagacaaaaauauacuucuuauaauuuugucauagcucuacuuuucauaguugagaaaaaaaaaaagccuugcuaaccauguccauugaagcacucaguccaaauguacuccuaucuaagaaacugaguccuugucagagaauauuucuuugucaucuuuaaauuugaugauuccuauuaagaaaaggcaugggauauuacauacaaguuauugugauuuaagaacuuuuaaaaaaauuaauuguuccauuugcuuacaucucaaaugauuucccacuuccuaguuaucccuccacaaaccccauucccacucccacccuuuccucccuccccuuugccucuaugaggguguuccccaauccacccacccucuccugcuccaccacuucagcaucccccuaugcuggcccaugaaaccucuacagaaucaagggccuccccuuccauugaugucagucaaggcuauccucugcuaccuauguaucuggagccauggaucccucccuauacacuccuucacugguugucuagucccugggaguaccgggauggccuggcuaucugauguuguucuuccuaugagguugcaaucccccucugcuccucuaguccuuccgccaacucccccacaggguuccugagcucagucuuaucuuuggcuccaagcauccauaucuacauuggucaauugcuggccgaaccucccaaggaacagccacaccagguuccugucagcaagugcaucuuugcaaaagcaacacuguuggguuuggugucugcagacagaauggauccccagguggggcagucccuggaugguccuuccuucagccucuacuccauuuuuuuuuugucccuguucuuccuuuggacaggaacauucuggguucaaaacuuugagauggguggguggccccuucccucuacuggggcugugccuaucuacuggaggugguguguauaggaucuaucuccccuucucugcucauuuuagcuaaagucaucccauugaguccugggagccucauuuccccagagucugauacuggcuaucaccaguuccucaucccccacugcuacauauuuuuauugaauuuccugacccucugcaacucucuuccauccccuacaguagcugauacuacccccguuauuuccucccucuccucuuucccucccauguccccccucccucuaccucccaugauuauccuguucccuccucaaugcaggacugcagcaugaacauccuggucuuucuuuuaaguuccaucuggucuguggguugugucaugggcacuguaagcuuuugggcuaaucuucacuuaucagugaguacauaccauguauguucuuuugugucuggguuaccucacucaggagaauauuuucuaguuccaugcauuuuccugcgcauuucaugaagucauuguuuuuaauagcugaguaguauuccacgguguaaauauuccacauuuucuguauccauuccucucuugagggauaucuggguuuuuucaguuuuuggcuauuauaaauaagguugcuaugaacauaguggagcauguguccuugucauauguuggagcaucuuuuggguauaugcccaguagugguauagcugggucuaaauauaguauuuccaauuuucuuaggaaccgcaauauugauuuacaaagugguuuuaccagcuugcaguccuaccaccaauggaaaaguguuccucuucuccauauacuugccaguaucugcugccaccugcauauuugaucuuagccauucugacuggugugagguggaauaucagggucguuuugauuugcauuucccugaugacuaaggauguugaacauuuuuuuaggugcuucuccgccaggugagauuccucaguugagaauucucuguacauguugugccuucauuuucauuaaauucuaaucagucuuuaauuuccuucccuuuuucuuucuugaccaaguaaucauugaguagauaguuguucagcuuccaccuauaugugggcuuucuguuguuuuuguuguaaagaccaggcuuauuccaugguggugcaauagaacacaugggaaguuuguuuagugucugaauauaugaucgauuuuugaggugccaagaagaauguauauucuuuuguuuuaggaugaaaugcucuauagauguauguuaaauccauuugguuuuuaacuucuuuuaguuucacugugucucugcuuaauuucuguuuccaugaucuguccauuguugagagugugguguagaaaucuacuauuauugugugagguucagugugugcuuugagcuucaguaauguuucuuuuacaaaugugggugcccuugcauuuggggcauagauguucagaauugagaauucaucuugguggagggacuguacucauggccuagucggccaucacuggaaagagaggcccauuggacacgcaaaauuuauaugccccaguacaggggaacgccagggccaaaaagggggaguggguggguaggggaguggggguggguggguaugggggacuuuugguauagcauuggaaauguaaaugagcuaaauaccuaauaaaaaauuaaaaaaaaaagauaguauguaaaaaaaaaaaaagaaaaaucaagaaauuaaucuuuucauaacaaacccaaaagaagaaaaacacacaaacauaauuccacuucuaaaaacaaaaauaacaugaagcaacaaucacuggucccugauaucucucaauaccauuggauucaauuccacaauaaaaagacacagacuaccagacuggauacauaaacaggacccagcauuuugcugcuuucaggaaacacaccucagugauaaagacagacacuaccucagaguaaaaggcugaagaaauuuuccaaccaaauggucccaagaaacaagcuggaguaaugauucuaauauccaacaaaaugcacuuucaaccagagaauauuucugauuugauacauucagccucuuuucugggccuauaguauuuucuuaugccuuauaguuuucauggguggcuaucaaaaguuacaguucauacuacugguagauuaucuaaauugaagacacagaguaagcuucaaaaguggaucuagaguggagccuggaaucacuagacuuggaauuuaaagcaacuauaaauauuauauacauaauauauaauauuauguaaaagaaucuaaaacauaauaaucuuuugguaaauugggaacagauuggaauuuucucaguuuaauaaagaauaacuccccaaaauauacauuugacaucauacaggugauaaacuauguuuucagccaggucaggagcagggaggaugcuuuuuauaggcauuucuuucaccauaguacuggaagauauagccagugcaguuagaguugaaaaggaaacacagaacaggacaugcaggaagaaauaaagcugaaacauuugcacuuaugauuugaccauaucucaggcaaguaaucuaaccacagauaccucucuuggaauuaguaacaauuguagaaacuguauaggaaacaauuuuagcauuauuuuuuaaaaauuaucagcuuauuguaaaccagcacugaacagauacauuuugaaaacacaaugccauucaugguaauaauauauuacaauguaauacugcaauauaaacuuaauaaaauaggaacaaauguaugaguaaaauaauaaaccacuguuggaauaaaaauuaaauauuaaaaaaauuaaauaaaugggaaaguaucucauuuuagugaauagguuugcaauucuggacauaguauacuggcuauaugcauuucggggcaguggauauguaagauaucucuauauaugcuaaacuuuacugugaauuuaagggaacaaaaacuuucugggucuuuccugggaugcaguagauaucuuucaaugauuuugaguauuuuauauauaaguucuuuguuacuuggugugaucuuaauacagugcacugggacuagauuaacagugcauuguucaucaaguggccagcaacucaugucuucacaacaaguucucuugcuucugucucauuugcacuuucuuaccuuugguuauacucugaguuuuuacuguugcauuugagaaccaaagauaagccuaaaacuuggauucucuaugaagguauaaugagcuaccaccccagccauuuggcauaucacccauguuauuuuagaaaaaaaaaaugccuuucaguggaaugagauuauuuuacuuuagcaguuuucuauguuauaaaguuuaauuacaaguuuaaaugaacagaaguaaauuuguacccauauggcauuaaaguauguuaacuuuaggggagagaaauaauaugaauaauucuuugagauguuuuucugugccaaaaacaaaagcauaauauuuaaaauugucucugcacugaaguguaccugucugaguaaagaauaauauguuguaugcuguuuguuuuucuuggaucauggucaguuccaaaaguagaaugaaacuguagccaaguuguaguuuuagaagcaucacaguuacugagcauuuacucuauugugaauuuccuauauuucuauugaugucauuaaacauaagcauugugcauuccagaaucauuuagcuauccuuacucacauugacaguuggugcauuaguucauguuaaguggaauaucucuuuaaacuauucuuggcauuuccuagauuagacgaauugugaauuugauuauuaaaauuaaccucuuauguucaucugcuaugcuguucugagccaauguccuuuuguacucaguuauuuuaugcucugaaaaaauauuuuauucagguagauauuuaaugcaaaauauauuuugcauaugaugucauuuucaguauauguaauuuguuuuuacauacaaauauuuuacaaauauauauuuuaagagccagaagaaauauugauauacuguguuuguguuucuacaugcuuguuuugucuuucacucuuuacaggugauuaauaacauuuauauuagauucuauuauugcccagagagauaaauaauaguucauuuccaaagaauauggcaauuggucuguaccuauccuuucauauaccacuauuuuuuuuuuaaaacuuccagguucuaagaauauuuuguuaaauuaaagggaaaaugucguuaaaaacaaaacaaaauaaaacaaaaaacaaaacuguuuggcuguucugucacagcagguggcuuugucaucacacucuguuuuacuccuccucauggaucuugcacagguuguccuugagccguuuuuuauuugaggguguaugggugccuccucucugcuccuccaggcauuucacuguugggaauuucucuuuggacauuuauguauucuuugaucaaaguagugguauuuugauacuaugcauugugaaauagaauuuagauagauuucuggaaguuaauuuauuugaaaugagcaugugugggucaguguaaauauuuaaaauuacuuuaauacuuaaauaaaacuacucuaagucauugacuauaaacugauuuaaaauauuucccaguguaaauucuuguuggcuuguucccacagaugaagucaucucuggcauaagauaaucgauuacauggaauuaucaaaucuugaauuaagaauucaaggauuuuaaggcauuugaacucccuuuuuuauuggaguaacauuucugggaguuacagcagauguauucucaaggaagaaaaacuaauuugugaaacuguuuacaaacauuagaugucccaaaccuaagcuucauugucaauuugauuacugggcagcuugaggagucuguucagugaaaauccuguguuuauguuggagcauugcagaggcuucagaaaaaacuuauugaccacaagauaaugaguugacccuucaccagauucccugggaaggcauuuaggauucaauauaucccugccuuccaguuacuggagcgcuuggucuguuguccuguuccuguuaccugaggugcaagcaacauauggaggaguuauuugcuaccaucaaauucaguggauguacacauuuucuggagccuuucacagcgcucacauaacuuguauuuagugauguuaguuguggaaauuuucauuuuuugaaaacgaggauacugacaacuuguaaguaaagggagcuagcagauccugugggcucucagaagcuccccguaaaagguuuaauuagauuauguaguuuuuaaaguaaaguucucuuguauaauguuuguuuacuucgaauugucuccaaaaacuagauguuuauuuguuuguuuguuuguuuguuuguuuguuuguuuuucacuagugucuggcuuaauggugggcuuagucaucuacaaauccuugucaauugaacgaguuaccuggcaugcaggaagacuuaggcuuccccuaggaugaccauagucauuacaugcugcagucagaguagaagagauggcauauguuuaagaaguauuucugcuuuucuuucgaauaugauaguuaucuuacauuauaacuucuuacggagcaaugguaccauaagcuuaaggcauagauuagucaaacaggaagauguaacuguggggaaguauuuuucuguagcaacauaaaguguaucauaccaguaggagucugugacaagggaagagauuaaguuuauaauuuuugggggcggguguucgagacagaguuucucuguguagcccuggcugucuggaauucacuccauagaccaggcuggccuugaacucagaaauccuccugccucugccucccaagugcugggauuaaaggcgugcaccaccaauaaaagauuauauaaguuuauaaucuuuuauuuauuuaauuuuagguugugugugugcucacauacacaugugcacaugcccaugcaugcaugugugaguacacacauacauaugaaugcugguguccuuggaacucagaagauggugucagaaccacuagauccagaauuaagaggcaguucugcaccaucugauguggguccuugugagcaaauccaaaugaguucucauucucauccccuuauacuucaaagaaugacaaaugucuagagcuugagaguugguaacaguacuugauguuguuucagaagacugaagauugcuauuuaaacugugauggucauuggagagguguuccuguuucuuauauggguuauuaaaauagaaauaaucucccacggggcugcgaacccuuucagcuccuugaauaauuucucuagcuccucauuggggacccugugcugugucuaaugaaugacugugagcauccauuucuguauuagucaggcacuggcuauauaucagucuccugucagcaagcucauguuggcaucuacaauagugucugguuuuggugguuguuuauuauauggauccccagguggggcagucucgggauggucauuccuucagucucugcuuugaacuuugucucuguaacucuguccauggguauuuuguucccccuucuaagaaggcuugaaguauccacacuuuggucuucuuucuucuugaguuuaauguguuuugcaaauuguaucuuggguauucugagcuuaugggcuaauauucacuuaucagugaguccauaccaugugugcucuuuugugauuggguuaccccacuuaggaugaucuccuccagauccauccuuuugucuaagaauuucaugaauucauuguuuuuaauagcuguguaguacuucauuguguaaauguaccauauuuucuuuauccauucuucuguugagggacaucugguuucuuuccagcuucuggcuauuauaaauaaguucauaguggaguauguguccuuauuacaagcuuaagcaucuucuggguauaugcccaggaaagguauugcugaaucuuccuguagaauuauguccaauuuucugagcaaucgcaaaacugauuuccagagugguuguaccagcuugcagaaccaccagcaauggagaaguguuccucuuucuccacauccucaccagcaucugcuguaaccugaguuuuugauauuagccauucugacuggugugagguggaaucucaggguuguuuugauuugcauuucccugaugauuaaggauguugaacauuuuuuaggugcuucucagccacucaguauuccucaguugagaauucuuuguuuagcucuguaccuuauuuuuaauuaggguuauuugguuuucuggaguccaacuucuugaguucuuuguguuuauuggauaucaguccucuaucugaucuaggauugguaaagauccuugcccaaucuguugguggccuuuuugucuuauugacagugucuuuugccuuauagaagcuuugaaauuucaugaggucccauuugucgauucuugaucuuauggcacaagccacugaugcucuguucuguaauuuuuccccugugcccauaucuuugaggcucuuccccacuuucuccucuauacguuucagugucucugguuuuauguggaguuccuugauccacuuagacuugagcuuuguacaaggagauaagaaugaauaugaacuaaccaguaaccccagagcucccugguacuaaaccaccaaucaaagagaacacagggagagacucaaggcucuagcagcauauguagcugaggguggccucgucagucaucaacgggaagagaggcccuuuguccugugaagguucuauaccccaguauagggaaugccugggcaaggaagcagaaguggguggguuggguagcagggagaggcaggagaggauaagggauuuucagaggagaaacuaagaaaggggauaacauuugaaacguagauaaagaaaauaucuaauuaaaaaaagaaaauuaucauaaaaaaccauaaauaauaucucuugauagaucucuuuuagaauguauguuuuuugaaauguucugaauguuauuaauuauuauggauuuaaagagaauggcucccauaggcucauguauuugaauucaugguccuuaguuguugggauuuuuugagaaggauuuggauguguggccucuuuggaggaagugugucacugggguuuggcuuucagguuucaaaagacuuccugauucccaguacucucuuucugccuaaugacuauagaauaagacaugaacuuucaguuguuccuucauucugccaucauggacucuugcuuucugaaacuguaagccaaauuaaauaccuuuuaagaugccuugguuaugguacuuuagcacagcaaaagaagaguauuuacauuaugaauaauuuguguucugguucuaagucagagaggaaggaaacauuuauaccucugaaucuuagguuuucucacuuuauuuuuaauauuuuuuauuacauauuuuccucaauuacauuuccaaugcuaucccaaaagucccccauacccucccaccuccccccuacccacccacucccacuuuuuggcccuggcauuccccuguacuggggcauauaaaguuugcguguccaaugggccucucuuuccagugauggcugacuaggccaucuuuugauacauaugcagcuagagacaagagcuccgggguacugguuaguucauaauguuguugcaccuacaggguugugguuuuuuucacuuuuauaaaagaauaucuaaaugauaaaaacauuacauuuugagagaaacagacauuuuggcuggguagauugcucuuuugugacaucuuaacuuuuagccauugcaacaaaauugcagaggugaagaacauaggaggaacaaagauauauuuuuccccauuguuucuaagguuucacuaugcacauauacuuguguguauggauuauauuuucuuuaccugucuuuuuguugugaaccuccaagcuguuucuguuuccucucuaaugucaauaguauagaaguagacauggauggacaaguuuaucucuagugugucaauuaggucuauaacuaaauaugaaguuacuggaucgugugguagaucuaagcuucauuauugguagaacuuuauacugauuuccuuagcaugaguaucaguacaaaaauacucaauaaaauucucgcaaaccaaauccaagaacaaauuaaaaacgaucauccaucaugaucaaguaggcuucaucucagggaugcagggaugguucaauaaacagaaauccaucaauaucauccacuauauaaacaaacacacacaaaaaaacccacauuaucaucucauuauauguugagaaagcauuugaugaaauccaacacccauucaugauaaaagucuuggaaagaucaggaauucaaagcucauaccuaaacauaguaaaagcaauauacagcaaaccaguagccaauaucaaacuaaaugaagagaaacuuuuagcaaucccacucaaaucggggacuagacaaggcuguccacucucuuccuaccuauuaaauauacuacuugaaguccuagacagagcaauuagacaacaagaggaaaucaaaggaauacaaauuggaaaggaagaugucaaaauaucacuauuugcagaugauaugauagcauacauaagugaccuccaaaauuccaugagaaaauuccuaaaucugauuaacaacuucagcaaaguagcuggauauaaaauuaacuuaaacaaaucaguggccuuucucuacacaaaggaugagaaagaaauuagggagacaacacccuucacaauaguuacaaauaauauaaaauaccuuggugugacucuaacuaaggaagugaaagaucuuuauaagcucuucaagucacugaagaaagaaaucaaagaagaucucagaagauggaaagaucccccgugcucauggauugucaggauuaauauagugaaaauggccaucuugccgaaagcaaucuacagauucaaugcaauccccaccaaaauuucaacucaauucuucacugaguuagaaagggcaauuugcauauucaucuggaauaacaaaaaaccuagaauaacaaaaacuauucucaauaauaaaagaacuucugauggaaucaccaugucugaccucaagcuguacuacagagcaauugugauaaaaacugcaugguacugguacagcaacagauagguagaucaaugggauggaauugaagacccaaaaaugaacccacacaccuauggucacuugaucuuugacaaaggagcuaaaaccauucaguggaaaaaagagcauuuucaacaaauggugcuggcucaauuggagguuaucauaucgaagacugugaauugauccauucuuaacuuuuuaugcaaagcucaagucuaagaggaucaaggaacuccacauauaaauauauaagauucagagacacugaaucuuauagagaaaaaaguggggaagaguauugaacaaucaggcacagggggaaaguuccugaacaaacaccaaugguuuguacuguaagaucaagaauuaacaaaugggaccuuaaaaaauugcaaagcuuaugcaaggcuaaugacacugucaauaagacaauaaggcaucgaauagauugggaaaaaucuuuaccaauccuaaauaugauagagggcuaauauccaauauauacaaagaacucaagaaguuagacuccauaacaccaaauaacccuauuaaaaauggaguacagagcuauacaaagaauucuuaauugaggaauacugaauggcugagaagcagguaaaaaaauguucaacacccuuaguuaacaggggaaggcaaaucaaaacaacucugagauuccaccucacaccagucagaauggcuuugaucaaaaacucagguuacagcagaugcuggugaggaugugaagaaagaggaaaacuccuccauugcugguggaacuguaagcugguacaaucacucuggaaaccaguuuggcgguuuaucagagaauucuacauauuacuugaggauccaggaauaccacuccugcgaauauacucagaagaugcucaaacuuucaauaaggacacauguuccuuuuguuuuacaaagacugacauauguucccacugaaauaaauguaugagauauuuugccaacagguagcuacagacaucuuuaggaggagaaauacucuuacaguggucauucaaauugccuauuaaacauuugcuccuauuccaguccuucuaagucuuugcuuauuuccuaccaaauaaauaugucucauauugcugcucuaaaaaguuaccauuaguuucuuguguaaaaugauaaaaauuauuaucuuguaauucugcagaucaguaggagacauaccagagaaaaaugaagguaugggcaagcacuuuuaagcuagaagagagaaucaauugcuuguuuuuuguguuguuggcagaauucagcacauggauagcauugaacuuucauguuuauauugguuguaaaauauagguccccagaagacauaucucuuggccugugcuuuucuuaacuuucaaacccagcaaagcuaguugaggccuuccuaccugacgugucuguaacacaucauacuucuauaacuuuccacuuucaaguacguaggugauuugaaucgaaccaccucauuaauuccagcuggucuuuuucucaaggucuuuaagaacagucauauguacugggauuguuaucaugugacuuacacauacaaauguucaggacuugggguggauauccuugaagagaccauauuuccugaaucauuaacacaggauugacagcccuugcccuggucugguugguuuuccuuuucugcucauaauacuucucacagauucuucuuucuugauuucaugggggcgagagaaaauuccuugagcaguuacauuguauguaaaaucuauggagacaugauaaacgaagcaauuucuagaaacacuggaacacuucaaguuauucauuuccaaaagagaaagucuuauguauuuuccaggaauuuguaaaacucguuuuaauccuucguagccauccacauagcaacagaaggugaagcguuaccuacuugguaagagccugggugugacaccacaacuuuugaaggagaagagauaacagugacuucaguaauuuaucaaaaauuuaucuugagaguagaugauauugaaucuuaauauuuuauuucuuuccuccuuagaucaucacaagauauguuuaugagcuccuggaaagugacuguaauuugaaaaaaaucucuauuccaguaaguucaacuuucaaaaguguuuauuccaaauaaaaugccuuguucuauauaaaauaguuuucaguccaggagaaaaauuuuauuguugguuaacuaugcuaagguuaaaguaucugcuacguguuaaguauguuaagguauguguuauguguuaaaguauguuaaaguauguguuaagguuaaguaucuguugauccuaauaacucaaugccuguaagucugcuuacucuucuguaauaguucuuacaaaauaucacuccaaauauaaaagaggagcagugcugauggcguuuaccacagugaugaccucuucucauuucauguacuguuuuuauuuguuguguauaaaacaaauaaaacaugguuucauauuuguuucgguguacuuuacauuguaauaaguauuaauuaacucuuuaaguauuguuugagucuucaaaacagguuuccuuuuuaaauuuuuuuauuuaauuuuauauuuaaagaguaucuugucuacauguauguguauuggcucacacagggcaucagauauccuggaaguaguguuauuguggaguaugaccauggguugauacugggaauugaaccuggguccuuuguaacaguagacccugcugcucuuacaacuaagcuauuuguagccccuuuuuucuacagaaaaugcuccccgcccuacacuaccaaaaucauuucugauuuuuguuuuuuaaaauauuacuaguguucuuucuaucaggggaauauuuggaaauuuuguauacuuuugaaauuuugggauguaaacauuugagauuuguuuuuagucucaaauucuaaacaaaaugucuuaucaauuuuuuugacuuuuaaucuaauuacaacguuacgcacuuccuuccuuuccucccucuaaauauucccuccucccacccaacacgcagccacuuaucucuuuuaaacuuauggcuuccucuuuucuugauuguuauugcaugcauauauguaucuuuaauuuauaucacaaaacacuaagcuuuuaaaaugaaaagauacuaaucuucgguguaaaaugauugcuggacuagauuagguaaucuuuacugcuccuggcaacuuuuucauuuuaugacaugaauccagaugacaaugaaauuaauucauuuaauacauaaaacuuuauauauagauaauuucucugaacuuuuacagaguauuuuuaauacccugggucauguuauugaggaguuugaagauaccuugcuuauuuagauuuucaccucugauuacauaguuccaguaaaaacuauuuuuuauuuaaucuuuuguagguaaccucuaguuguagaaauuaauauuacucauucauugauucauucaagucaauaaguauuuacuaaguaacucucacuaauauaauuauaaagacaaugcuauugcaugccacagauaugccauuccuugcucuaguuugaaucauagauucuuucaagagagccuugaaaucuaaaauuugcagucaguauuuguccuuuggggagucagaacucuugacuucaugucugccuuuuuuuuuuuuucuuaaaaaugacauuucauuggagcugguuuacaaguuuagacgaucaguucauuaucaucaaggugggaagcauugcaguguccacgcaggaauggugcuggagaaaaagcugaggguucuguaucuuauucugaaggcaaacagaggacugguuuuuaggcagcuaggagaaagaacucaaagcucacucccagagugacacacuaacucuauuaagacccaccuauuccaaaaggccacgucuccuaauagugccacucccuggaccaagcauauucuacuaccccauucuacuccuuggucccauagacuuguuuaaacacaugaguuuaugggggcuauaccuuccaguaguguaaugcaaaauacauuuaguucaacugcaaaagucccacaguuuauaacagucucaauaauguuaaaaguccaaaguucaaagucucuucagagauucaucccgucauguaacugcaaucccuuauaaaauuaaaauaauaaaaagcagaucacacaccaccaucacuauuccaaaacuucauacugaggaaaucuggaccaaaagaaggccaaaaaccagaugggcaaauuccaaacucugcaucuccaugucugaggucaaauucuucagaucuccaaaucuuuucagcuuuguuuacuacaacagaauuguuucucuuuggcugguuccacuccugguuagcagcuuuucuaggcaggaauuccaugaagacccacuuucuuauucuguaaacaauguguauuaaagcuggguauuguggcacauguccuuaaucccagaacuuaguugggaaaugccagcagaucugugugagguugaggacagccugguucuauugauuuccaggccagcuugcgggcucuauagugagauggaaucucaaaguaaggaagcaagcaaacgaccuauauaaauuuguuuauucggucucuaaagaagaacacuuaaagacucuugagacuauccauauccugucccuuguugacuauaacauuucugccucuuuggaagucuuuucuuuuuuuaaaauuuuauuuaaaaaauaaauuucaguuuauuuuuaauuuauuucuuacacuccauauuccauuaaccuucucccccaucuacccucugacugcuccacaucccacaccuccuccccgacccacuucaccuccacgugaaugcccccacccccccaccccaccugaccucuaaacucccuggggccuccagucucuugaggguuagguucaucaucucugaaugaauacaggcccagaaguccucugcuguauguguguuaggggucucauaucagcugguguauguuguauguuuggugguccaguguuugagagauauugggggguccagauuaauugagacugcugguccuaguacaggaucacccuucuccucagcuuccuuuagccuucccuaauucaacaacaggggucagcugcuucucuccauugguugggugcaaauaucugccuuucacucuuucagccuuuuguuggguuuuucgagggacagucccuuucugugagaucuccauagccucaguaauagugucagaucuugggaucuccccuugagcugaaugccacuuugguccuguugcuggacuccuuuuccucaggcuccucuccauuuccaucccuguaauucuuucagacaggaacaguuaugggucagaguuaugugacugugggaugacaaccccaucccucacuugauguccuguuuuccuguuggagauggacucuauaaguucccuuucccugcuguggggcauucaucuaagguccccccuuugagucuuuggaaaucuugaagugcucuuugcucucuagauuuauagcacagaccacaauuggcuaaaugagagugguuuggauggaauuuuaaaauuucuaaagagaacaccugaaauuagauugacaacauuguuuuauaaauuugguaauucucacuuuaaauuuaauguacauauuauguaaguuuacagaaagauuugcacuguguuuuuuguuugguuaauaaaucccuuuguaagcuuaaaaaggucugucuuucauaaaugauuccauguuacauaauguggaaguuauucgucaauaacgauuacuucucucuugcuuucucuuaaguacgaguuaguacugauaauguuuguuugauuuuuuaauagaauauucuuuucuacugaaagaauauuagcaaacuuuucuccuuguuacugaacuaaggauuaaagaccuucaguagagggguccuuccaucacuuuuaaggugguagcauuuuggggaagaaaggcgugacagucaugaucaugcuuauguucugcacaagcacaggguaauaagaacaauuguccucaacugccacauuccugcccacaugagugcuagagaugugagugugauuaauaauuucucacgaaauuucauuuuaguuuauuauuuacauuuuguuuaagagaaacaucacuuuuugguguucacauguauuccacagugaacugcuaagugcuauaaauuauuugguguagucucaugaucugggaacauguaaauuggacuguauuagaauggccuuuguguuuuauuuuuaaaaggcuuagguuaguugcuugcaauguuugagauaaacaucuuuguagucauuuccaaacuuuauugagguagugaggaaacaccauuuuauuuauauaaauauuuugcuauauaaauuuagcacgaccuuauaugaagcauguucagagucacuuuucugguuuacucuggucaguucugcccaaugguuuguacacacauugcccuucucauccugccauucauauuuuuauauacauugcuugaucucugugucgucuuucauaggacacucugaauuucacauauguuucaaugacuuuuuuuaacuggucaauucaaguuaauucauggcuaccuuuagcuuuagucucaugaaaaaauucucaaguaggauuauagcauuuuucuuuuuugaaaauaauuauucuucuaguguuaaagagauuguucuugaauucaauggaguaauuuuccaucgcuugaaaugauguuuaggaacuggagguagccaugcuuguuaccuuugcacacugcacuggagccaagggguuaagaguucagcaucauccucuauucuguggcagccuugaagccagucuaacucacacaacccaaucucagacaaacagaacaauuguacuauuugggaacuuggauuaauaaaugacuucuuugugaccauuaguuuggaacuguucauuagauccuggugggcuccucuguggguacacaagugaagauaguagcuguuuuucucucuauaauccaccuguacugaauaguuuauaggugggauagggccccaugagccuccaccuguauccuugauugauugacaagccuaacuuguguaagaggagaaacucuuacuuguuaauaggauuauuauugucaugacugugcccuagaaguagcacuuuugcuuuucuucugguucuuacauuccuccuauuuucucuuauucaggauucccugacauuuucaaagggugguguaaaugcuccauuuaggucugagcaaccagcugccacugauucuuaaaccuagggcagcuaugaguuuaugcguucacugcgaaaaacuucucugauuaaggcuaauauuugucugaugguauaaguuuucaguaggcaguaugaagccuugucaguuuaguacaugccuucccauuucccaagguuuaagauuucucagacucugguuuuuauaaaauaccagacaugaauuuauuccugugaaggagacaucaaauucaguaagacaguggugguuuauuccaguaacaguugcaccaccauugcacuaguggggacaucuugcuuagcaaguuagugcaauucauaggucucacagcugguggaggcgauuguugccuuuuucccccaggagcuugcaccauggcuuuuaggauucuguaagcuagccaguggagaggaagcuuuuaauucacuucuuccuuuauuguucuauguuuugcaaugaauauggccucaugucuucagcaauagggaauuauuaauuaguucuaguugguaauuaggaggauaaguggcagaggccuguauguuuuucaugaucuccgaaggcuucccugaccaauuauucauagaaacgugcuucauaucuggcacuagaaauuuuguuuaauauuccuaggcuuuugugaacaauacuaccuggauauccauccucccucuguuuguuuuauuuuaaucuuuuaaguuuuuauacaccauucaaacuuuauuuccauacaaguuucauacuugcuuucacuuucguuuaacucccccucugcucuaucaucuccccagcccuccagcccuuccaugguuaaguacuucuaucccugagagucuuauucucuacuuuucuguuauuuacuuucuaguauccccucuguccugaaagaguccccuaaccuagugacuacuuccucauuuucuuccuucuauaaguaguacaaguuaaacacauacaucugaagauucaaagcuagaaugcccacaugagagagaacauguggcauuugucucucuaugccugggcuuucauccauucauccauccauccauacauacauacauuacauuacauacauucauacauauguauauuuauguauauauauuuguauauaugaguguauauauguauauagauauagauaugaaauuagguauuaagccuugggaaauggggaggcaugcaccauugcuguguagcuaaauugacauggccucauacauccuucaaaauacucauacucucagaaaauaucauccucagccuuaaucaaagagucuucuguuugcaaugaauggcaauaaaugcauaaacuuaucgcugcucuagguuugagaguuaguggccacugauugcuuagaccuaaauggaauauuuacaccacccuauguaaguuucagggaacauuguagaagagaaaaugagagaaauguaagacuaagaagacucugugugugugugugcguguacauauauauguauauauuguuauuuguucuuuaauaauugccauuaugacgggugugagauggaauugauauuacuaauuugcauguccuugguagcuacugauguuuaacacauugaaaaaauuaucagcuauuuuuaugucuucuuuuuuuuucucuuauuuauuuauuuauuuauuuauaucagauuuuaucaccccaccaaguccacccuccaacuauuccacaucccauaccuccucccacccccugucuccaugaggaugucuccacccuccaccccccccaacccaacucgaccucuauacucccuggggacucuagucucuugaggguuaggugcaucagcccugauugaacccauauccagcaguccucugcuguauauguguugggggcccuauauaagcugguguaugcugccugguuggugguccauugucugagagaucucagggguucagguuaauugagucugcugguccuccuacaggguugcccuccuccucagcuucuuucugccuuuuccuaagucgaccacagggaucagaaucuucuguccauugguugagugcaaauaucugcauuugacucuuuuagcugcaugcuaggucccuuuuuaugagugcuccauaaccucaguaguagugucaugccuaguuuuuaugucuucuuuugagaauucuuuauucagaucuguaguauauuuugcaauuugauuguuuuuuauguuuauuuaaguuuuugugugcauuuuagcuauuaauauucugaaucauuuaaaaucauuguauccuuaggacaucacugucaauaguaugauuucauaauucaaagguucuuaaucuuuauuuacugaguaucuauaaggucuagucucgguuauagacuaagaauagugccucauauaaauuagaaaauauuauuucuuuuuagauuuaccuguaguggagagagaugaaugaguauauauacacacaaaggcauacacauguaugcacccacacuuguaugccacacaugcaugcacacaugcacucccaugcaugcauauauacaugcacaugcaugcacaucagucaucuaucuaugaaugaauacacuuugauggauugcucuguguguugugaaaaagacacagaaagggaguagagauucacgaggaaaaguuugagaugcucuuuguagacaagaaaagcuucacugaaaaguuguagcuaugcauaagcuccagccauucuguuccuauugauccgguugcucuugcgcucuguuuacacacauagcaacaucagauaaugagaccaauauuguuuuaaaccuagguuugguuuucuauuccuguacauuuugaaugaaugggaaaauuuagauuuuaaaauuuuagauucacuucuaagaauuuuuuuuagaauuguguguguguguguguguucuaacaaugauaccuguaugaacauaauuuuuugcuggagucaagaacuggugcaguauauagcauauagagugaucauuuauguauguaguugugguuagaggacacauuacuaguuguuaguucuggcuuuaaccugguuguauaaggcuuccauucugaguccuggcucuuauugauguaccauagagcuucauguacauauguaaugaaaugaucagaaauuggacuucuauaguauuucuaauaucuuugaaacugaaguuguauuuaauaaaaauuaauuuuuauuauauguuuauuaacuagauauaaauggauaauccuugaguaagugaagcauaaauaaguugcuagcauguacaagugguuguugugcaugccuguguuugcaaucugaaugucguuucaaagcccuauuaaauggagcaccuugaacuuggaguuuuagauaggguuuuuuuuuucauaguuuauacuguucuggcuaagguauuuauauauuccaguuuggccuuucuguuuuuuuaugauagguacaaucuguuucaguuauagaguuauaggcuguaugcuguguaagccuauaacuuaaauuuauccaaauauaauuccuucauuuauugaugauuguugugguagugacaccucagugggauugugaauaacgagaguaauaagagcaguuggaucauaucuagaccacgggaugcuuucaaaauuaguuauuuuaauguaagaugguaauacaauucuaaauauacaauaacaacauagggauacaugcuuuaauuauucuuuuuauauguuuuuauauuuaaaauacuuguguugcuugauaaucuauuaugcaauugcuagaucuuacuaucuuucuuuuauguaaguuuuuuuuuaagaagugauucuguaauaaccauucaaucauuuguaguagccguuaguuguuuucucauugugugaaugcuugaccaaaaaacauuuuauuuauuauuuaauuuuuuuuuuuuuuuugauuacagguagaugccacugagagugaaccaaagaguuuuaucuuuaugagugaggaugcuuugacaaauccacagaaacugaugguuuuaauucaugguagugguguugucagggcaggucagugggcuagaaggcuuauuauuaaugaagaucuggacaguggcacacagauaccuuuuauuaagagagcuauggauguaagugaaucuuccuuuguuuuggggggcauuuuaucauucuguuuuauugcauagaacaguuuuauuaucauuuucagaaauauauucauagcauaaucuuauuaagccuuuauuuaccuuacuuguaugauuauuauuuugcagugaugcaggaaaauguagugauauuguuguuuacguaaaggguuaaaugucuuugaaaugaguauuuuaaauuuucccauguuagaaaauuuuuuuuauuuucuuuguuuaacaauaugaacuaugaguuuuaacucuucuuucauaucaucauuaacaaugaaauacuucugacaaacccccaaacauaacgaaccuuaauugugcuuggaauguuuugcuuucguccugucaugaagauaaaagggaaggagacuugcugaugauagguaaucugucccgugagggacauacagucaggacauggucuuggaauuuaaauaauauucugagcccucaaauaaaauguuucaagcuuaaaauaaucauauaaacuguuaaauuguaauauuuuagaauauuuuucuauucuaguauuguucuaauguucaauuguuguguauaagucuuuuaaguuauucagugaagagccaguuuucacaaaguaugaguuucuuuuauauguuacuaggaauauuccucaaaaacuguugucuuguaaaaaacauuuaugauagagaggguauguuagaaaugguacaugugucuauguauauauuuuauuucuaaaaaugacaguauauuuuauaauuaacauuguaaauauaucuuggauauauauuuacaaaauagaacaguaaauauuuuaauauguucaguauucuuuuguccuggauauaaugauagcauuuaagacaaauccuagagaaugcuuuucuuaguagauuuugugaauccucaaaguuuggcuuuaugaguuccuuaaguuaaugcuuuauccaccugugcaaagaaacaugcaacuuuuauuuggguacuacucuaauugugauuguagaaaaaaauguaguaacugauuauucaauuaagaagucagaauaauuaaauauucauuuacuaaguugaaauauauacuaaaaugacaaaaauuagugcuuuuuaaacugucuuauuuuaugauauaguuaguaaauuauuucuucagugguucugguugugauuuuaacacaguauauguuuuagagagaacaugcauggaaaauguguguacaguucauuaaguauuugaaaauaauagucaagaacugaggaauuccagacagcaagcacuuggugagaugcucauggaguucuguuccccugcaccagugucaccugcuuugucuaauguagaacauuuguugaugugcuuuuugagguaaaacuguguggaggaaacugugaaauaucuuuguauggauagauuauugauuugcucaacauggaagugcuagguuuuuuuguuuuuguuuuaaauaacauuagaauaguaaaccauuuaaccuuuuaaguggaaauaauguuuagaauauaacaguguucuucauuguuuauuucucuacuuuucucaaccauaguaaauugugauucuuugaaaggaaagaauucauuuguaaauauauggcuugccuaaguucuaguuuuagguaguuacauuuucuuuaguuuuaaauaagaaguuuauuguaugaaauccaucaugaauuucuaaaaauguaugucauuuuuaaauccagaugaagugauuuuuaccaucuggcuucacuuguuacaguuacugcucuggugguagggaaggauuuauggcauuuuaggggagcaggcagaggaagauccacaggagcaaggugcagucccauucuuugcuuuuaacaugguaguucagcuuuuuuuuauuuuguuguuuucugagauuucacacuguuuucauaguguagaaaggguuagcugaucauuaggguuuugagguccugugaguuuuuauacugguguacaagucaauuuuaauauuuuacagguuagacauugucaucuccauauaguaugaauuaucaccagauuauuuauauauuauuucaauuucuaaauuauguccauaucaauguaucauaauccucucgagcagguaagccauguccuagaggaacacugcaugaagggcaugaucuuuuaccuauggcuucauuguggcuaacauugugggugugaggucuguaacaaagauuucucuagaauuuuucaacuccaaagaaaaugauagguguucuaucccuuauauuuagaacuugauuauaaaauauauauuaagauuucauuagggaagaauggugccuaucaaauaccuuccuguaaguacuuacaagguuuccaggguuggugguuuuagucuuuaauaggcuucauugcauaauacaguacucagguaagaaaguuuauuauuuauccacacaucuaugauucaguaucuuuauaauuugaguuacucaauguguuaguagucuuugacuucucccuuucuuuucaggcguuucugcuuguguguguaaagggggaaaguaaaguagauggcccugcaauccuuuaaaugcuucuagauuuaaaacaaaugaccaaaguguggacacuuugccccuucuuagaauugggaacaaaacacccauggaaggaguuacagagacaaagauuggagcugagacgaaaggauggaccaucuagagacugccauauccagggauccauccuauaaucugccuccaaacacugacaccagugcacacaccagcaagauguugcugaaaggacccugauauagcugucucucgugaggcuaugccagugccuggcaaacacagaaguggaugcucacagucagcuauuggauggaucacaggguccccaauggaggagcuagagaaaguaccuaaggagcuaaaggggucugcaacccuauagguggaaaaacaauaugaacuaaccaguacccuccccggagcucgugucucuagcugcauauguaucagaagauggccuaguuggccaucacugaaaagagaggcccauuggucgugcaaacuuuauaugucucaguacgggggaaugccagggccaagaagugguaaugggaggcaaagagaguggggggaggguuugggggauuuuggggguaggauuggaaauguaaaugaagaaaauaccuaauuaauaaaaaauaugcaugcaguuaaggagacaccucagugacuucauccuuaucucauccuuggcugauugaguugcacuauggagagcuggguguaggggugucuggagguugacaugggaaaaugucaauucaagacuagucuggacaaugaggccuaguuucagaaaaaaaaaaaaacuaaacuaaacaaauaauguuucugugaaaagcuuugugacagugauuuucaaccuuucuaaugcuguguccuuacaauacaguuccucguguuguguugacacucccuaacccccaaacauaauauuauuuucauaacuacugcaugacuguaauguugcuacuuuucugaauuguaauguaaaugguuuuuuuuuuuaagauuuauuuauuauuauguguaaguacacuggagcuuccuucagacacaccagaugagggcgucagaucucauuacgggugguugugaaccaccaugugcuugcugggauuuggacucaggaucuuuagaagagcagccagugcucuuacccgcugagccaucucaccaguaaauguuuuccgauggucuuaggugaccccugugaaaaggucagucaaacuuuaucagaaggucuaguugacaccugagaauucuuaagauacacaggacuuguguuuguuagauaaacagacuacauggauuaucuccuuucuauuagcaaaaucuagacauguucacaucaagugaaguuagaaauacugugguuucugugucuaaccaacagacaucccuuuguauacuuuaaaucaguucuggaauacauguaaugccucauauacuggaaaucuuucuuauauguggaggcacaaaaugggggauucccuucaccaucagggcuucuccuucucagaccuugucuuaugaccuugaacccccacccccaccucuaccuguggaaugucacauagccuuguugagauuaaagguucagcuuccuuucucuagauaagaaccagaucaacaaacaccugacgcaccuggaaugccucuccaugcuaaugacucaucucaauaccuuagccuucagccagagaccuuugccuacccuggauagccuuauccccauccccccaaauauauaacccuauuucacccagauuaaaguagaucugucuccaaauagccugaagcuggucacugaaugugucauuucuguuuguacucccgggcugucuaaaaacccuauucuuggacuuuguucucuuugaccuccugggccagcgaccagugacccgagaagaagggagaccuacagcucuauuauauuuuuaggaaauaauaaagauguacacuauguaaauguuuuaaaacauauuuucaucuaugguggaucaauaggucuagaucaauguaucuuagaugaagaacccacaaaaagauagggcuacuuuguacacuuuauuccuugggcauaauggauauuauugaugucaauaguauuugugaaaauuaggauugggauauaauaaaaaaugauaacucauaaauuuuuaguuuuuuauuuuaguuuuaugucuuuuauaaugaugaguauuuugaaucuucauugucuuaacaguaauuuuuagcaugaugaaaucuaagcagauuaucuccuagacuuaucuagacuuaguucuucaucugagagcuauuuuguuuucuuguggacuuuuauccaaguuucccuggcucguuucuuaaggcugccauccucuuauucugagaugccccuuaguuguuaccuggauucuuugcuuucuugauauauuuccuuauauuuuagauucaucagaggaucaguagaaaaacaaguuuuaugugugaaguauguguauguauuugaucaucuaugcacauauauguguacaaccacguauguuuaaacauguuuaaauauguacaaagguuaaugcuacauucuucuucagucauucuccacauuauuugauuugacaaggaguggaaguuaagugacugagcuagacuggccagucagcaagcuguggggacccuauuguccccacuuccuuacacaaccacaguacaaccacagugcucaacaguuuuguauaaguguaaggauuugaacucaggacuuuaugcuagcacaaguacuuuacggacugaaucaucucacuaggccuggaaauaauuuugaaaccuuucuuuuuuuaaaaaguugucuuuacucuacuuguuuuaguaauuaauuagcuguuaucgugugagcuaaaauaauuuuuauucugaaauuugacagcuuuauuuuuuucuaacauguaguaccuuugaccuugaauucuuucccuauuuccuauggaagccccucauccugugucucuuauuuuuuucuguauuuucguauaauuuuuaggugaaguauauaaauaacuuuuuuguugaaauuguguuaaaaaauuaaugcuuuuuuaaaaauagaauauauucugauuaugguuuccccuucucccucaucuccucccaccucuucacuaauucauggcuuuugccaucuauaaaaaauaagcaagcaaauaaaacaagccauuuuuuaaaguacaagaaauauacagacaagcaaaaccuauuuaaaaaaaaaacacaaaaagggaaacaacagcauauaagcaaucgugcaguauggggaaaaaaggggguaaaaaagagcucuaugagacacaaacaaaaccaccauucaggucuagucaguguugacuguguacugcccuuauguuugguuuguaaauccauucagucuuuauuggagaaaccuauuguuucuuugguaaugguugucaauugaagauaguuucuugauuaacuuuuaaacaucauauuaucacauaauuuauuuggugauacauuuauaaugcuaguuuuaaauuuugaugugaauacaaauugaaauaaucucuuuacauggaagcuuaguaaugcuacccaaaauuuaauaucuaugcuaccugguaacucaaauucuaccugaaaugauguacaccagagcgguacacguacacaugcauagcugcugagagcaggagcugagaacaauacacaacuauuuacuaaccacucgguuucuaacaguagaggacugugugaauaaaugacaguauauuuacaaaaugaaagacuguaguuuuuagagagauuauguguggggcaugauuauuuugugugaaaugauguagauuaagugaaaacucaagaaugacauuagggcgcuuuuacccaggaagaccauucuucccacucucagucuuccagaguugcuguagcucuuaucuagaauugaggcauuuugaaacuuuuccuucugcauuagcaugucuguggcaucaucuuuauauaggucauguuuaugcagcuauggugguaagaacgacacaaguguagaaucugacauuucuaggagauuuuaugguaaacuucacccuugcaucccuucuucugcaguguuuccuaacuucagugcaagaguuguguugcagauguuucaggugggauugugcuccucauuucuguauuacgaggggguaugaagaggaaaucaaaagagcacggagagagcucuaauaagguugggaaaagggagcuacaucuggaagaaaggaaacugguaaaacgacaggaaggaugucugauaucauaaggaaacagaccauuagcuaucuaccuaaaacacuuauguaaguaagucaauguauaaauacacauacauacuuugaaugaaauuuucuuauuugggcugacagugcuuccuucuagagccaacuccaaacuuucuaagcaaaaccccacagugggcaugauaugccuguuuuaaguugcgggucaggguuauccaagguaaggcacuauagcaaaagacacuguaugccucagacacagggcacagugaucuuugagcuguaacuggcuugaauuccuccucucuaaggaccaacuuuccagaaggcugcauacagguuuccaaaggagggaugccaacuacuuaacuauuacaccuauaaaucgcaacaacuaacuugacaguaaucuuaauggugcaguaguggcaaauguacuuuggcaguaacaagcaccucuguaauuggacucaaggaaugcuaaaaaaaagggggggagugcagaaaucaugcuugggcaccuagccaucuucccaaggcuagugaagucaaauauguauuuuuauuuucaccccucaacaaggaaauuuuucucaacaacaaauggagaccauuacaaccacaacugaggaaaauauauuuuaagucuuacagagggacagggcgaauuauaagagaaauccuuacuauauggucuccaaauguacuaaugccugucucacagucuaacacaucuaaaaauaauacaugaauauaacuagguguugauggaagaaaccaucaucuucauuaauuucuaucccaaguuauuuacuuauguuuuaagucugcaaaugcuuuuauguuuaaaaagauuuuccuauaauguauuuauuaugcuauuuuauuauaguaauugaauaaucauuucuaacauuuaguaaaugaucauagaauugcagacauauccuuuaauuacucauuuuugucacuuaccaagaaguuuaaucaauucaaauugaacucuuaaaguuuuaaagcaguugaugccuuuuccuccucuaacugagugcgggacuauuaaacucaaagguggagcaaaaauugcauguuccagacuucaaaacuaaacuuugaagacaaauauuaaaugauuaaugaauacauauuuauaauacagaccauaaaaugaugaaguaaaaauuucccuaaugauuaaacuuagugcauuucucaacuuagauaguauauguguccacagcaguggcccuuaguauugcgaagauuauaugccccaguacaggggaaugccagggccaggacgcaggaguggguggguuggggagcagggcagggggggguauugggggcuuuggggauagcauuugaaauguaaaugaagaaaauaucuaauaaaaaaaagaaaucaacagaugacaguucuaguguagggaaagaggugcugagggcagcucauuucuuuucucuuuucuuuccuuuucuucuuuaagcuuuauuuauuuguuugcuuguuuauuuauuuaaacaguuuggacuuuuuuuuaccuccagguccccccugcccugacuguuccacaucccuuaccuauccuagcacacgcucccuccucaccccauuacccccauaccacccuacacugggacaucaaaccuucccaggcuauccucugcuacauaugugacuagagcuaugguucacuccauguguacucuuggguugguaguuuagucccugggaacucugggguuggggaggucugguugauugguauuguuguucuuccuguggcuuugcaaaucccuucagauccuccaguccuuucucuaacuccucuauuggugacccaggcucaauccaauaguuggccgcaagcaucugccucugucaggagacagcuguaucagguuccugucagcaagcacuucuuggcauccacaauagugucugccuuuauauguuacuugaccuuuucccccuacuucuuuuaauauucuuuccuuguuuugagcaugugguguuuugguuauuaugugaagggaagaauuucuuuucugguccagucuauuuggaguucuguaggcuucuuguaucuauaugggcaucucuuccuuuagguucggaaaguuuucuucuauaauuuuggugaagauaucuacuggcccuuuagauugggaaucuuugcucucuucuauacuacuauccuuagguuuggucuucucauugugcccuggauuuccugaauguuuuggcuuagagacuuuuugcauuuugcucagggcacagguucagaccagccuuagucaguggugaucugauaagaugcaugggguuauuucaguauuguaucuguugaggccuguuuugugaucaauuauauggucaauuuuagagaagguaccaugaggugcugagaagaguaauuuuucuauagauaucuguuaaauccauuugguucauaacuucuguuaguuucacugcauuuuuuauuuuuacauuuagcuaucuaguuugaucaaaauuauuuauugaagaugcuaucaaauuuguauuucugucuuaucaaagaccagaaguccacagguauaugucauuaugucagggggucuguuuuuaugccuuaucaugcuguuuucuaaugccauuguuuugcauuagaucuugaggucagggaugaugguaucuccagcauuccuuuuauuauccaggauuauuuuagcuauucuuugucuuucuuauguccauguguagcuagaaauuguccuuuuaauuucugugaugaauuguguuagaauuuagaugaagagugcauugaaucucuagauuaauuuccuaucuauccaugaguaugggcagucauuccaucuucugauuucuucaccuuauuucucauugucuuaaauuuuuuuauuguauaagucuuucacuuucuuucuuagaauuagcccaaauuauuuuaguauuuuaaggcuauugugaaagguauuuuucucugauuccucauuuguuuaauacaauuacugaauuuugccuaauucuguaucuugcuacuuuucugaaaauguucaucaguuccuugauggaguuuagggacuuuuguguauaaaaucuuaucauaugcaaauaaagcuacugugacuacuucuuuuuuguuuguauaucacugaucuucuucagugaucuuacuguuguaucuaaaacuucaaguacuguauacugaauaggcaugucuucuuacuaauuuuaguugaaaugcuuugaauuuaucuccauuuagguugaguuuugccugugagauugcuguaaauuaucuuuauuauguugaggaauuucucucauaucccuacuuuccucagaacuuuuaaucaugaaagucuguucaguuuugucaaaggcuguuuucuauagcuaaugagauggucaugugcuuuugucuuuccaucuguuuguauaugguagacuauauuuguccauuuauguaugcugagccauuccuacaucuuuguuaugaauccuauuugauuaugaaagauaauguuuuugauaggcuuuuagauuugguuuggaaauauuuuguugagaauuuuuguauguuuguagaagaaggggguuaguuuuuuguguagucuauguaucaaugaaauuguugccucauuaugaaguaauuggguaauguuuguucucuuucuauuuuauggaauaauuugaagaauauugguauuaauucuucuuugaagugggauagaauucugugcugaaggcauguuuaguaaauuuguauguuuagccaucuuccugauuuucucaaaggaacacugcuuuguuucauuuacucuguauauuuuguuucuaugucacugauuuuacccauuaguuucauugucuccucacuucuccuggcuuuggguguuguguuguuaagauuguaagguaagugcuuucuuuccuaacuuuggguguagacacuuaguguuaugaacuuggcuuguagaaccaccuucuccgugucuuguaguuuggagcacuucaaggugauuccucacuuuucuucuaaguuuuccuguccagugugugcacaugcaugugcaugugugugcaugugcguaucuuuagugauuuugucuguugccaacucaugaaauuugugauuuuguuuuguuuuguuuuguuuuguuuuguuuuucgauacaggguuuuacagguauaguccuggcuauccuggaacucacuuuguagaucagguuggccucaaacucagaaauccgccugccucugccucccaagugcugggauuaaaggcgugugccaccacugccuggcugaaauuugugauuuuaauaguuggcuuucaugagcccaugugagguaguuucaguacaccacuguuuucuuuaaaucaaggaucuuuauucacguagcuaaaaacuaaaacuuucucaguccucaucaucagcaauauuauuuuauaauaauuuuauaugucuuaauuuuaauuguaaauuccaaugauuaucuuuauguaauacaauacauacugcauugaacugagcaaacuugcacaacuacugaaagugcccuggauaaacccuagaaauuaccuuuugagcuaaaacagucaaucacuaauuucacuuaccugaaguucagaauguacaaaacccauguaccaucuuagaaauaaggauggaaugaauauuuaaagaagugcuuuuuugaagugcucauaaagaggguauuucuuucaaaaacuauuuuuucugauucucugagaacuucauacaguguguuuugaucacauguauccuccauuccucuauuugucuucccagauccacucuuucuccuuuuucuccauauuauccuuucauccuuguaaugauuuauugaguccauuuugugcuacccauauacuccuuucucuuguucauucuacccuuaaagaaaacugacaaucccagcagcagcuguaaauuccuccuucucuagaguugcgacuucaugacuacucucccuuuguaugcaagaauucugucaauauuaauaucauacagaucuuauguaagcuguuagagcuucugugaauuuauaugugcaugcaccuugcuguauacaggaaacacuauuuugacauagucauuuacugcuucugguucuuaacaaucauuccaccuccucuuucaugauggucccugaauuuggaaggaggauauauaauauagacaucccauuuagggcugaguacucugcaguuccuuauugacuacaugauaucuaguugcaggucucuugcauacaucaucuguugcaaacagaccuucugugguaaggguugauaaaugcaauaguuuacgggaguuacuauuaugucaucaggaauugguugaauacuguguccauucagcagaauaauagaguagugucuaugauuuuucuugucacauuuuuuuuuuacacacauaaccauaaugguuuugucuuggggaacaaggcuuaaguccaguuuuuaaaaaaguguuugguuacuccuauggcauuucugccacucuugcaguugcagccauccuuuucuaugucagucauuaaugucacucacaugggucacaccuggguaagcuugaggacucuuuuucuccuuccauugugcauaguuccuuggagcacuauaaaagguagcuaguagugcuaccuuacaguugguaucuguacuggcuaguuuugugugucaacuugacacaggcugaaguuaucacagagaaaggagcuucaguuggaggaaugucuccaugagauccagcuguaaggcauuuucucaacuagugaugaagggggaaaggccccuugugggugggaccaucucugggcugguucuauaagagagcaggcugagcaugccaggggaagcaagccaguaaagaacaucccuccauggccucugcaucagcuccugcuuucuuaccugcuugaguuccaguccugauuuccuuggugaugaacaacaguauggaaguguaagccgaauaaacccuuuuccuccccaacuugcuucuuggucaugauguuugugugggaauagaaacccugacuaagacaguaucacucugauuucuccauguuauaugacuugaguauaugguagauuuaguaaaaucuugccguuuaaauucuggaaggcaaccaagaaugguuggccauagccuauaauuuguggugaagauagugguaguuauagaaucccauugacuaauaacuacaaaaguaguaaccaauuucugguacuggguuuuuuauuugauagcuuauaauaucuagaagggacaucauucuccaauuauagaauaacuccauauuacacugggguguuuguuuuuguguauguguuaaagaccaugggagaggggcuuuaaagcaucaaugacugcugguggccugaaaaaggauauccgaagauauugcuuuuaaaucugcuuaucuagaaacauacuugcuuugugaaguuacugaguaacuguaaaguuaucucuguguaauauucaaauauuagacuugaaauaugcaugugggaacuugccauuugaagucuuuucgggauaaugacuguuaagcucacuugagauaaauccaaggcucauucuaaauaaucacagacuuggguuuucucuuuaaugugcauuucuguaucagcugaaauuuucauuucuccuugaacucagcacauucucauauauacugcuucuacuuuuguauuucuguugcuauucggaguccuucgccccggaugcugaucccgaggauuauaugaacuaauacuugucuuaccauuuaaucccaaggaugauaugaacuaauacuugucuuaccauugaaauucuaggcuuaguucaggacugguguucuuucuaaacuuugcguguuggaauuucucacuauucuauuuauacauaaguacuuaaguuuuuauuuuucauguuuaaagcaggguuuaauguaugcugggauggccuuaaauucaugcaugauauaaccaaagauguccucggguuuuauaguccucacacagaguacuggaauuauauguguacacuacaaugcucaauuuaugcagugcuguggaaucaagcucagagcuucuuggaugcuaggauagcacuguauuaauuaaacuaguguccauguguuugaacacuagggccuuagcuuuuggugauguuuugagaggcugcagaaugucuagugucagagccaaagcuugguugucaaucacuagggacuggguuuugaggguuauggcccgagccucucaucucaucaaagcucucuguguccucuuuccaaaauauggacaagcugugcaagcuugucuugcugggaacagaacuacuccaacuggagacugcaaagauggcucagcaguuaagaguauuuguguuucuagcagaguguaaguuugauuucaaacauuuauaaugggugggucaccacugcuuauaacuacaacgcacuaguaucuagcgccaucuccuggcguccuuguacacaggcacuuauguucacauauacauucauagacaaacacauaauucaaaauuuuagaaaaucuuacuauuaauuuuuaaaaauaaaacaaucauuccagaugcccugccuuuuuuaucaucuagacuguauuucuugaaauuaugagcuaaaauaauauucuccucguuuguaucuguccgaauccugucauagugacaaauaaggaaacuaauacaggaaaauacugcuuugcugugcaccuacagccaguuuaagauuaaugugggcaucgucacauauggcuuuggcugaggugaguuacacaauuacacaagugugacugcagaauuaguugacuuguuucagcugugcuugauaguacagcuucuaguuuuauaucuuagcugucauuuccauugucuuuauuguaucuguaacgugcucauaaaaggaaugcuucaucauugccucuauaguguaaagcacacuacaucaaucucgaagucauuuaugauuuuauggaaagaucaauaaugagaaauuucaaauagguuuuccaguuggagaucaucggugcaucugagccuucuuaguaguuggugcucgguauugacuuuggaaauaauaagguacuacuauguuuugagacuucugaauuugugauacuuaguuaaaaauauuccaggguccauucaguucucaauucaacucaacucccugacguuuuucugucucaucauaugaauauuauaaugugcuuauuggugaaaccaaguugaagcugcugguaugugugacaggguaauauuuccuaguaauauuugccagaccuucuguggacauccuccaaaagacauggccauaucugguuuaagaguguaugugauuguaugugaagugacuuaagaguguaugugaguguaugugaagugacuuauaacggcugagugacauuuucaacagaauuaaaguucuuggaacaauauuuucugcuuccuuuggcaugaaauagccaaugauuuugcuuucccaaaggaacuuguuuucuuuacacacuccauguuucuggugcuggcacacuuaguuuguacuauucucucuuggaugcagauuuuuuuuuuuuuaacagcauaaagguuauaggaaaauagccagcugucacauuccugagguccgaucaucccccguagaugaaguucacuguuuuggcuacauauuacuugccagauugcuaagcagauguucuaggcuauaauucaggaaagugagaccucuugcagcauuuccugagagucacuuuugacaucuccaaaaucauuuauuuagacauaauuaguccuaggaaaagugaacaaguauaguauaugaaaagaaaauuauuuuauagucuuaggaguuguguguguguauccauuuguaaaaacauguuuaccuaggcagauuguaauuaaguuauuuucacuuuaaaauauauagaaaaguauauuagaaaauaguaugaaaaauguaauaagaaaauagcaacaaaaaaagcuuucggcuuuuuuuaaauguuaauuuuuuucauuagauauuuucuucauuuacauuucaaaugcuaacaccuuuccuaguuuccucuccaaaaguccccuaaacccucccccugcccugcuccccaacccacccacuccagcuuccugacccuggcauuccccuguacuggggcauauaaucuuugcaagaccaagggccucuccucccauugagggccaacuaggccauccucugcuacauaugcaacuagagacacgagcucuggcagguacugguuaguucauauuguuguuccucuucuaggguugcagaccccuuuagcuccuuggguacuuucucuagcuuuuucauugggggaccuauguuccacccaagagaugauuguaagcauccucuucuguaauugccaggcacuggcauagcuucacaagagauagauuuaucaggauccugucugcaaaaucuugcuggcauaugcgauaaugucugguuuuggugguuguuuaugggauggaucccagguggggcagacuuuggaugguccuuccuuccuucuuuccuucucagcucggaacuuugucucuguaacuccucccauggauauuuuguuccccauuauaagaaggaaugaaguauucauaguuuggucuuuguucuucuugaguuucauguguuuugcaaauuguaucuuggguagucuaaguuucugggguaauaucugcuuaucaguaagugcauaucauguguguucuuuugugauuggguaaccucacucaggaugauauccuccagauucauccauuugccuaagaguuucaaaaauucauugauuuuaauagcuuuguaguacuccauuguguaaauguaccacguuuucuguauccauuccucuguugagcgacaucugaguucuuuccaacuucuggcuaauauaacuaaggcuccugugaacauaguggagcauguguccuuauugcaaguuggaacaucuucuggguauaugcccaggagagguauugcuggaacuguccaguuuucugaggaaccaccagacugauuuccagagugguuguaccagcuugcaaucccaucaaaaauggaagaguguucuucuuucuccacauccucgccagcaucugcugucaccugaauuuuuuauuuuagccauucugacuggugugagguggaaucucaggguuauuuugauuugcauuucccugaugauuaaggauguugaacauuuuuuaggugcuucucagccauucaguauuccucaguugagaauucuuugcuuagcucuguaccccauuuuuuaagagagguauuugauuuucuggaguccagcuucuugagcucuugguauguauuggauauuaauccuauauuggauuuaggauugguaaagagucuuucccaaucuguugguggcuuuuuuaucuuauugacagugucuuuuaccuuacagaagcuuugcaauuucaugagguccccuuugucgauucucgaucuuauagcacaaaccauugcuauucuguucaggaauuuuuccccuguucccauaucuuugaggcuuuugcccacuuucuucucuauaaguuucaguuucugguuuuauauggaguucuuugauccacuuugacuugaauuuguacaaggagauaagaauggaucaguucgaauucuucuacaugauaacuaccaguugugccagcaccauuuguugaaaaugcugucuuuuucucacuggaugguuuuaacucccuugucaaagauuaagugaccauauguguauggauuaauuucuggaucuucaauucuauuccaucgaucuacugucuguugcuguaccaguaccaugaaguuuuuaucacaauuucuauguaauauaccuuaagguuaggcauggugauuccaccagagauucuuuuauuguugagaacaguuuuugauauccuagguguuuuguuauuccagaugaauuugcaaauuucccuuucuaacacugugaagaauugaauuggaauguugauggggauugcauuguaucuguagauugcuuucggcaagauggccgcuuuuacuauauuaauccugucaauccaugggcauggcagaucuuuccaucuucugagaucaucuucgauuucuuucuucagagacuugaaguucuucucauacagaucuuucacuuccuuagagucacauaaagguauuuuauauuauuuguuacuauugugaaggguguuguuucccuaauuucuuucucagccuguuuauccuuuguguagagaaaggccacugauuuguuggaguuaauuuuauaucaagguacuguacugaugcuguuuaucagguuuaggaguucucugguggaauuuuuagggucauuuauauauacuaucacaucaucugcaaauaaugauauuuugacuucuuccuuuccaauuuguauccccuugaucucuuuuuguugucuaaauucucuggccaggacuucaaguaccauauugaauagguagggagaaaguggcagccuugucuagucccugaauuuagugggauugcuuuaaguuucucuccauucaguuugauguuggcuacugguuuucuguauauugcuuugauuauguuuagguaugggccuugaauuccugaucuuuccaagacuuuugucaggaauggguguuggauuuuuuucaaaugcuuucucagcaucuaaugagaugaucaugugguauuugucuuugaguuuguuuauauagugguuuaccuugauggauuuccauauauuaaaccaucccugcaucccuggaauaaaaccuacuuggucaggauggaugauuguuuuaauguguucuuggauucgguuagcgagaauuuuauugaguauuuuugcauagauacuuauaagggaaauuggcaugaaguucucuuucuuuuuugggucuuuaugugguuuagguauuaaaguauuccuagcuucauagaaugaauuggguacaguaccuuauguuucuauuuuguggacuaguuugaguagaauuggaauuaggucuucuuuggaagucugauagaacuguggggagcggguguggcggcagucccaaaggcgccagggacugcagcuaagucauaugacuugcaccugacuuccucauauaagacacaaacaucuugagugcugcgcauguguaccaggauacaggugaauccaauuugguggagauuugccccugcuguccugauuagcugaagccucgugacuggcgagggggcguggccugcggugcgugaaugagagagaguauaaaaggagugagaggcccaggguucgggggagauauaaacuagaagaaucaggacugaauaaacugcuguuagaaggacugguggucgcgucguucuugcuggucgagagcgggcgcgacauagaacucuguauuaaacccauccaguauaggguuuuuuuuuuuuuucuuuugauuuggagacuguuaaugacugcuucuauaucuuuaggggacaugggacuguuuauaucauuaaucuguuccucauuuaagcuuuguacauaguaucuaucuuggaaauuguauauuucauacauauuuuucaguuucuuugaguauagccuuuuguaguagaaucugaugauuuuuuuuuuuuugauuuccuaagguucuauuguuaugucucccuuuucauuuuugauuuuguuuauuaggauaaugucucugugcccucuaauuagucugguaaggguuuauguaucuuguugauuuuucucaaagaaccagcuccugguuugguugauucuuuguauaguucuuuuuguuucuacuuggaugauuucagcccuuaguuugauuauuuucuguggucuacuccucuugggugaauuuucuuucuuuuguucuugagcuuuuaggugugcugugaagaugcuugugugugcucucuacaguuuguuuuuagaggcacucagaguuaugaguuuucuucuuagacugcuuucauugugucccauaaguuugugcauguuguggcuucauuuucuuuaaacucugaaaggucuuuaauuucuuucuuuauuucuuccuugaccaaguaaucauugaguagaguguuuuucaacuuucaccugaauguuggcuuucuauuauuuuuguuguuauugaagaucaucauuagucuguggugaucugacaggauacaugggauaauuucaguauuuuuguaucuguugauggcuguuuugugaccaauuauauggucagcuuuggagaagauacuaugagguacugagaagaaagcauauccuuuugauuuagaauaaaauauuuuauagauauuuguuaaauccauuuguuucauaacuucuguuaguuuugauaugucucuguuuaguuucuguuuucaggaucuguccauuuaugagagugggauguugaagucucccacuauuauuguguguggugcaaggugugcuugaguuuuacuauaguuucuuuaaagaauguggcuucccuugcauuuggagcauauauauucauaauugagagaucaucuuggaagauuuuaccuuugaugaauaugaagugccccuccuugucuuuuuugauaacuuuggguuggaagucaguuuuauucaauauuagaauggcuacuccuccuugaaucuuuggaccuuuugcuuggaaauuauuuuccuggcuuuuacucugagguagugucugucuuugccucugagguggguuucuuguaugcagcaaaauaugggguccuguguauguagccccucuguuagucuaugucuuuuuauugggggauugaguccauugauauuaagagauauaaaggaaaaguaauuguugcuuccuguuacuuuuguuuuuagaguugggauucuguuuuugcagcuaucuucauuaacuuuguugaaggauuacuuucaugcuuuuucuagggcauaauuucacuccuuguguuggaguuuucccuuuauuaucuuuugaagggcuggauucauguaaagauauugugugaauuugguuuuguccuggaauacauugguuacuccaucuaugguaagugagaguuuuguuggguagaguagccuggguuggcauuuguguuuucuuaguguuuuuauaacaucugucuaggaucuucuggcuuucauagucucugaugagaagucugguguaauucuaagagguuugccuauauuuguuacuugacccuuuuccccuacugcuucuaauauucuguuuuuauuuagugcauuuguuguucuaauuauuacgugucgggaggaauuucuuuucuggucuacuccauuuggaguucuguaggccucuuguauguucaugggcaucucuuucuuuaguuuaaggaaguuuucuucuauaaauuuguugaagauauuuacuggcccuuuaaguugaauaucuucauucucaucuauaccuauuauccuuagguuuggucuucucauuguguccuugauuucuuguauguuuugaguuugaucuuuuuccauuuuucauuuucuuugauuguugugcccauguuuucuauggaaucauuuugguuuuguuuuguuuuguuuuuguucauguuuuuguuugguugguuuuucgagacaggguuucucuguguagcccuggcuuuccuggaacugacuguauaccaugcuggccuugaacucagagauucaccugccuuugccaccuaauggugggauuaaaggccugugcuaccaugcccugcuuucuauggaaucuucugcaacugagauucucuuuuccaucucuuguuuucuguugcugaugcucgaauauaugguuccugauuuuuuucccuaggauuucuaucucuagaguugucucccuuuggguuuucuuuauuguuucuacuuucacuuuuaggucuuggauaguuuuguucaauuccaucacuuguuugguugucuuuuccuuaauucuuuaagggauuuuuguguuuccuccuuaagaacuucuaccuuuuuagcaguuucuccuguauuucuuuaagugaguuauuaaugcccuuuuuaaaauucucuaccagcaucacaagauaugauuuuaaauccaaaucuugcuuuuuggguguguugggguauccaggauucguuguggugggaauacuggguucugaugaugcugaguggucuugguuucuguuaguaagguucuuauguuugccuuucaccaucugguaaucucugguguuagauguucuaguuuucucuggcuugagcuuguuccuucugugauucuguuagccucugucagcacuccugggaguccaguucuuccugagucccaguggucagaucacuuuuugcaggcaagcucuccucuuguagggaagguucacagaggucugcagauaagcccuaccuccuggcugaagaugaaagcaugaagagacccuauccaagaagcucuguugccucuguggcccucgugcucuccuguggauaauggaucugagagauccaggauacaagauugcguucuuaccucugucccggggucagcucccuccguggugcccaacuuuccucucgucagguagguucucagacaaaaacaaccucucuuuuucuacacuagauagaacaccaguugcauaauuuuaaaaacaucccauguuuagaccuugaauuuuuaugaaauaguaguuucauauaguggguuuuauuuggauagauacaucuaucauuaaaaucuaucauuaagaaauaauuaaaguagauauuuaagucuuaucaccuaaaaguauaaaaaauuuguaaaaguuaugucugauauauucagauucaucuuuccacuuuauagagccauagaggcauugcuccuguuggaauauuucacuaauauucauuacaguuugcagaguuguacuuuuuuuaauuggauauuuucuuuauuuacauuucaaauguuuucccugauccugguuuccccuccaaaaacccgcucccccauuccuuuucccucuuccuccucaccagcccaccuggcccuggcauuucccuacauuggggcauagagccuucacaggaccaaaguccucuccucccuaugauauccgaucaggccauccucugcuacauauucagcuggaaccaugaguccuacuauguaugcucuuugguuggugguuuaguccgugggagcucugggguauugguuaguucauauuguuguuccucuuauggggcugcaaaccucuucagguccuuagguccuuucucuagcucccucauuggggacccuaugcucagaucaauggauaacugugagcauccacuucaguguuuaucaggcacuggcagagccucucaggagagagcuuuaucuggcuccuuucagcaagcacuuauuggcauccacaagaguaucuagguuugguuauuguauaaccagguggggcagucucuggauggucauuucuuuagccucuucuccacacuuugucucuguaacuucuuccuuggguaauuuguuuccccuuuuaagaaggauugauguauccauacuuuggucuuacuucuucuugaguuuuauguguuuugugggaaaaaaaauguucaaccuucuuagucaucagggaaaugcaaaucaaaacagccuugagauccccccucauaccagucagaauggcuaugaucaaaaacucaugugucagcagauucuggcgaggauguggagaaagaggaacaauucuccauugcuggugguauuguaagcugauucaaccacucuggaaauuaguguggcaguuccucagaaaacuggacauaguacuaccugaggaccuagcaauaacucuccugggcauauacccagaagauguuccaacuuguaauauggacacaugcuccacuauguucauagcagccuuauuuauaauagccagaagcuggaaagaacccagaucucccucagcagaggaauggauacagaaaaugugguacauuuacauaauggaguacuacacagcuacuaaaaacaaugaauuuaugaaauucauaggcaaauggauguaucuggaggauaucaucuugaguguucacaaaagaacacacaugauaugcacucauugauaaggggauaugagcuuagaagcuuggaauacuugaguuguauuuucaaaucuguaaaaucuagcauuuuuuaacgagaaaaaaugagagcaacaauagaaauaaagucgaagucucauuucugcgugugguugaggauaagauacagaauugugaggcuugacagauauugugcauguuuuuaaccgucaccucaaagaacaucucagugugaaaagucaaacucuaaaauugccucuacuuucuauuuaaacaguucuugagcacuuucuggcucuuauuuuggauaaauagcucuccaguggcauugaugcccaagugugaucauagcauuucuuccagaacucugcagagcuagucaaaggugcaaauuuccugaagccaccuugauuucuaaguuuaaauggauguauauuguuaacuccucauaguucuuaacuuuugcugaacuaaaagcugcuuuccaauaagaaaaaagcaaggguuugcaauauaggacaaaaugcaaaagauuggcaaucccagguuuuagacuaaaagugcagaguuacuaggucuauggagaacuuaauuugugcagaaaguuccuuauuugaauggaugguaguuagauacuagugaucuuuauucuucccuccauuccucaccuuugcucuccaacuccuuccuuacagaucuucauucagacguuagcaaguuuucaaucuaaguaucagauuggugcuuuucaauuuuaaguuauacauuuauauguuaacaccucaacuuagaugcagcuaucuuuuuaccacccaaauuuagaaaaguauuaaaggagaagguaaagaucaguuuaacuaauaaauaauuuguaacuaauaaauaauaaaugugagaauuagugggucucuuauucaacugaggugucuuauauaucaccugagaucuaggcagacucaccgguaggccuccucgugagaaucuaaguguacuaaagaagaauaugugcuuuguauggggaauuggcugccaagaguucaguaaauggaaaggaaacaguuuccugacugauucauaguagcucugaacugggggcccaugggccaggaugaggggggacuggauaauuauuaggcuuuauggagacgagcugauggcaguugucuuccccuaggucccugugaguugaggcucauaauuaaaaucucauuuucauccaucuucauacugucuaauacucagaaaggaauuaagugggggagugugaaacuagagacucuuacaccacucuguaggaaucauucauuuuauaaucuuuccucauucuuuagguuguuuugccucaucuuucuucuuuguacucuuuuacuuauugacaguauuuggcuuaguucucuuaucaaaagcaaauuauagauuuaguguaaucucagucaaaaucuccauggcauucuuuacagaaauacaaaagauaaacaaaaagcaucaucaucaccuaaccuccuaaaauucauguggggccacaaaagaauagcuaaagcaauuuggaaccagaaugacaaugccacgggguuacugauacccaagucaaguaauuguacagcggcguuguggugaauaaaacaguaugagacuggcacaaaaacagaugucuagacugguuuacaaaauagaauaccugacuaugaguuuugucauuguguauugcuguaacaaaauaccccuguaaaagcaacuuaagggaaaaaggguuuauaaugcccaugguuucagguuacaauccagcauugcagauaaauaugaggaacuuaaaacaauugguuguauuauauccauagucaagcagagaacaggaauguauauauuagugcucaacucuugcuuuuucccgucuuauacaguccaggauucccugccuggggaauagugccaggaaaguuugggguaauggaggggucuuugcaccucaauuaguauaaucaaaauagucugacaacuaggcacagaugcucauuucccagauaauucuagauauuuucauguagauaguuaaccaccaugucacauaucaccugcaugugugugugcauucuuuuacuccuguguuuccuacuuacuguuuuauucucccauuuuuuuguuuccuauaucagugucuuuucugccuaagugaaaacauuuguuguuuuuguaugugaacaaguauagccagugauuaguucaugauauucugucaccucaguaauauuuaaaccuuugucauuaauuacaaaaguccccuuugaauuacccacaacauucuuuacagaaauagaaaaaaaaaguucauauggaaugagagaaaaccccagauagcaaaaggaacccugagcaaaaggaacaacacuuagaagacuacucugccagaucaagauggauuagagaguuucaguaauccaaagaccauggaacuggcacagaaauagcaagguagccuaguggacaaaauagaagacccaaacuuguaacuacagccaucagauauugggcaaagaugcaaaaacauacacuguugaaggaaaaaaaaaaccagcauuuucaauaaguagugcugaaaaaacuggauguccacaugcagaggaaugaaacacauaucuaucaccuugauuuuuuuuucuaguaauuaaguacagaagaggacacaaguaucaucaaugucaaacuuuugaaagguggaauuuuccuuugcuuguauacaauuaugaauucaguuagugacuggccaauuuauacaaacagaauuccacaaacggggaugaaguaguuuucagugauaugaauuuuggaacagagauuggucaguugaauuaaccauacaugaggcuggggagaauauauccagagaggacaucagaggaugaggguuaagccuugaaaggaaccaucuuuuggggucaauggaagaaacggacagggaaagagaugacaaauguuagaaaauccacuguauuauacucaccauauucauuaaauggacaaauggaacaaaauaugagaaauaaauguauuccuucauucauuaauuuguuuauaucauugugauuaauuucucagacauucaagaaaaagaaauuucccaauauuuacgggaauuauggaaaaggacaucuugugagucuacuuuccuagucaugaugacaaugccucuuuauuccauuauucagaggauuuaaugagaugaaaauuccaaaccauaauacacuguugcaauucuaugcaauauucuauuggggaagucaucagggucugaaacuuggaggugacaaacucaauuuugaguguugguccuagcaacacugacugaauuagcagaugaugaaacaucuuugugguguggggaaugagcauaauauuaguacuuuucuuuuuauuuacaauaaauagcugaaaugauguaagaaugcaaaauacacauuguguaguccauuuuguuucugcuacugcuauaaaugcuguugucuaaagcuauggauuuauuuugcuaugugaaaugucauuugcuuuucccauuuauuuuggaagaccuuuuugaagaauauuuuaauagugagugcccuuuuuugaauguauauuucucuagaauuuuucagacagucaguccaaaguauguauuguauggacaccuugcuauagauuguucuugguaauugauuuaagaaauuacaucagguaaaagauauaauuuuaucaacuaucugauauucagaucucuaagaaccaagguaaagguuuuuagacuuaugcacuaauauaaaaacauguuacuauugaggcuaauuuaauguaaguucuaccuucaaccacacuugaaguaguuuguaucucuuugaagcauaaacaucaucaguugggaauauugcuuaugucaccgccuuaaacuuuguaaagcauugguaauaucuaguuauaagucauguuuaugaucuguuaaaaauauauauuuuuucaguuucucuagguuuaaauguaugcuugauaagagcagcuuuucuuuucauuuggcauauaaaugaaugucaaaauuuauuuaaauaauaauaguuucuauuucucacuuaguuguugccauaauaaaguauuuucugauugacaguuugcuuuugccuauuuuuuacacaucauuucuauaauuuuuccuauucagaauuauauaaaucauguucuauauugguaguucaugaucugccuugguugcacgaauggaugauuuaugugugugugugugugauggggucuuacuaucuagccugguuuaucuuguucuuucugccucaacuucccaagugcugggugcuuuaaacuaucauuaacaacauuucacauuagcuguugugaagacaucuaaacuaacucucucucucucucucucucucucucucucucucucucuccccucccucccucccucccucccucccucccucccucccucccucccucccuauguauguaaguguaagcauucaugugucugugugaaggcuguuguguguauauuuguggcgucauuuguaggucagaugucaaccuuguguauuguuccucaggauacauccaucuugcccugcuuguguguguguguguguguguguguguguguguguguguguguguauuuguuauuugauauaugccuguguguucaugggugugaugaacaaccacacaugcguauguggagaccagaagucaacuuagagaaucuuuauccuuuuccauaauauuuuuaaagacaggcugucaucuuguuuuguggguagaauggauugucagugacccugucuauaccagcacugcaguuaauuuuaccucuugcuauuccuagcuuuuuauauggguucugggcuuugaacucagcucuuaugccuucacaucauuuuaaucuugaguuucagccauguuuuaauguuuagcauaguuuuuuugaaaaauuugcacuuauuauagaacaaaauauguuuaucuccuccucuuauucucuucuccauuuccccuuauagcucccuauauguucuuucaauguccugucaaaccuuuauauauauacauauauauauauauauauauauacauauauauauauauauauauauauauauauauauauauauauauauauauauauauauauauauauauauuuauuuaaaaaauggcaucuguuuuacauccuuggccuaucagguuagugaaccccagggaccccgcuacccucacuucccuagugcugagauaucaucugugauuugucacacccagcuuuuauguggggcacaacaaggacuuugugaauugagcuaucucucuagucucucauuaacaauuucuugucuguaaaauaagcuuaguacuuauaucucaacucuacugcaguagugaaacaugaggcacacacaacacacuguucuugggaacauugccuaguuuuauaaugccagugaaagguauaauugugagcaguuaucaaaaggguaccucaugaaccuuugacuucuuuucuugggucucuguucuguaauauuuguacgugcagcacuagaauguucuuucuaaguagaauugagaauuuucuucaguaucaaaguuacucucuuuuaaagucuuauuuggaaaaccuaauacacacauauucacugagggucagaacagauaaaugggauguuaauaagaccauaaaauagcuucuucaugauagccuacucuuuuaugcucuauccuugucuuuaugaauucuccugggauuacauggcuuucacagauuuuuguauaaaaaucauuacauaaaagagagagagagagagagagagagagagagagagagagagagagagagagagaaagaaaugagaaaugaaaaauuauuaugucaucucuuuuauucauuuauuuauuauuucccucaauccaugaagguuucuuugcagauuuuuggaccuauuugggaucugcuaguguacuccuuugugcuuuaccuaguccaaucaagaucaugacuagauugauuauaugaucauguaaaagucuguucaguauagacuaaauuacucauuaucaggaauaccuaagggcugcacauggcaauguauucagaaguaaacugaagcaaagacaauuuuguguuuaugccuguaguuggaacaaugcaacuaccuuugauguuguuuaccaggaauauucuugagcccacaagauggcaguauuacuucauaaagguaaacaaacuaaugaagugcuugguuuuccagaacaaauacaggaagcuccugacuguagcugcaaaacucaugguccuugaugaaguauggaaggcaguauggaaagcaagagaaccucagaggaggaaauuacuuaugugauaagucauguaguaacaguaguaaccaugccaaaugauguggaaucuuuccaugucccuuaccuucagcauuuauaagcgagguaaacaucacgaagacacauuuuuaaauauggucuugucuuaagccagguucaggccaguguucuaggcauucaugucuguauccuuauugugauggaucccaaguauggaagcuucauuagaucaucucacuuauagaggugacagacuucagaaagauuuuuacauaggaaaauggaaaauuggguuucaaagguuaaccaucaacccaaguuauuccaaauaccaauugguuuuauuaauaaguuucuuuguagaucauauuuauguacagauuauaaaguuuguacuacuaaugauugaagguauaaauuuagcauuguagagauaaaaggauuuaugacucacucuuguucuucauacugcuaauaaaaucaguuuuuauaauuguuuaauaguuuaagaacuuuacuuaguccuuccaaaugaauuuucuaaucuguuauuuuaaaugcagugcuuaccuucuuucacaaucagacacucauaaaaccaauuuauuuugaaugaaggaguuucucuaguggauguuguauuuuaaccaauaacugcauauaacuuaauaagaaauauaucuucuuacugguacagucauuauguuacgcuuaauaagcuuuuaugcuguacaguagaccuuugugauuuaaaggcaaaccuacuuucuucuuuucuaguucuucauuugcuucuacaauauuauuugcagagauaauacuccuagcuccauauuagcuaugcuaauggaauuugaacugcuacuaacaagcaaagcacaucugacuucuaaacaccccuucauuguuuguaaggcuuugaagauuuaucauauuuuagguuauguaauuuguuuugguuuugccuuugucuugaguagagagaaaguggucuaaguuacuggaauuguaaugaguauguucuuggagggauaucuugugacagacuuauuuauauauacuaaucuugagaguauguuugguguuugcuuccucugcagauacuaagcuuuuuuaguguaucauuaacugaaagguuuuuuuuuuuuuauuaaauugggagauuagagauuauucaguauuaagauagcuuaaucacugaaauauuuuuaaguaacauuacuccauugcauuuggccuuugcauaacguuuguaaagcaguuguaaauuuuaacuuguuacauagacauaaaaguaaaucuaaggaaacaggugugaauuaacaacaaaacugcucagaaugagugaaaaaguucuguucugggaauuuuaucaucccaucaugcuuauauuguuuggauuuuuuuaaggaucugaaaauucuuuauucuccuuucccucuugcagacauucuauuuggccucuuucuuucucucuuuucuuucuuucuuucuuucuuucuuucuuucuuucuuucuuucuuucuuccuuucuuuuuuauuagauauuuucuucauuuacauuucaaaugcuagccccaaaguccccuauacccucccccggcccugcuccccaaccuacccacuccagcuucauggcccuggcauuccccuguacuggggcauaugauugaauuuuugagucauaguacuauacuuguaaugggcuagugcugagguaacccagacucuuauauucauuuuuuaggauuuaggcaauaggccagcaaaagugacuuggaguuagguuuucauuuggcucauguuccaagcucuucucucucuucugaagaugcugccauuauuggcucuacuuucuacagaagacagaguaaugaaggaaagugacaaggucaucaagauagaaagggggaagcuugcaagaauagagaaguagcagguuauaugagucucaguugaacacgaccuccugccccuguccuugaagcugauaguucuguggaugccauucacagcaccaggagagucagagcaucacaacacucuuauggcuuucagagacucccauugauucauuuaaaugcaggaggaggauguucccagcuuucuuucuauagaaacuaacucuacauaugggaucuuugagaagauuaaccauacagaaucagagcagucuaucacaucuguuagcacccgcauucgaauuagaacacagaaucaauacaagaagguacagaaauggaaaauguauagaaaacaguaaagaggaaaagauaacauuuggaaaaaacaucccuaaaaaacuuuacaaaagaggcagaauuuuuuuaaaaggcuuugagauagcuauuuaaaggaguauagaaaggcacuacuaauguguagcuaauguauauaugcucuuuuguuuucaaauuccaucuuacuuuacaugaaauaguaauacauaaauggccuucaagguguagcaaguuagcuuuggaaaucacagcuaccuucuaagauguuauguugguuaaauaagaaauaugaagaaguauuuguucuuuuuuauuuuccuaaaacauuugaaaguauauaguaacauuuuauauuuuuaauguaacccuugauuaauaauguguguuuauuuuuaaaauauuuuacguagaacuuacagcauuuuauugauaauaaaaacaugaguuuuggaaacaauaagauuuuauaauuuuaugucuagggucacauugccaggucauaaugucaaugcuauuguuguauuuuuuuagaauauauuuauauaaagauauaaaaacuagcuaaauagauuuuuaaggcaugauaauauaaaaauucaauguggacagauaauuaaauagagauuuaauagcuuucugaaaguauaguuaaaaauacagagcuacuaacagcucuaaauuuacuugauuuugguuugaagccuuauucugaaaaucuuagggagaaguaaauucagaaaaaauaucaaaauugaugaguuuacuguagagugcgaagauucagaguaaauuggaauucugcucacuaagugccuuagagcuuauuccaccugacucaucaaaugaaaaauucaucaauuaauccucugacaauaacgauauauacauaaaaaucaaucuggaauugauuuuuuuagucugaacaugaaaaccaagcucuggcuuauacauaaugugagauuucucuucauuucgacuuuauuauugaguauaacagcugaaguguucauauaauuauuuguucugagucaacuacaaaaaugugauuguuugugaaagaguauauguacuagggaggugcuccaaagcucaaucugagugagcuaauaaaguugucagaugcauguaagaaugcagcucaugggaucccuagaaggcagccaauugccagggacacugcucacugagcccugaugagagaccacccaagacaguuaacagcgagcucaggacugaggaagaucaaagacaaagaagaguaacagaaaagaacucagcucucagauggggauuagaaagagcauuguuagagaugugauuccuaugaagggcagcagaaagagaaguugggagggaagggagagagggagggagggagggagggagggagagagagagagagagagagagagagagagagagagagagagagagagagagaauauguuucacaaauguuucacaaaacacaaaacauuuaaauuuuuaaucaggauuagucauuuucuguggcccaucacagauuccaaagaaaccuugcuucaagugcaugucuaaugguaaaguuuucuacauaaugucagcaugaaaauauauguacaauuauucucccaaagaaucuaagccaaauacuaaugguuuuguuuugauuuaauuaaagaacucauagcaaaauauguucugauauguuacuacaggggaaaaauucaauggucauaucuaaguuugcaucuuuccaaggugcuccucuucccaguucccaaaccuacauugcauuacugcuggggucuucauuuacauaagggagauuucacuuggaauuuuaucagacuguguugguaguucucuguguucccauugccaaauuaauauuguucuaaaugcucuaagucagcauauuaugacaagaagauauguuuucuuccagaguguaguagugugaaucagugauaagauucugagggaaaugugaagccugagaacucugucaguauuacuuaacucaugaguaguaaauuuugaugacucucuuauggacaugaauucuuguacaaaaugagcauuaaacuguuuuuauguuuuauggauguuuaaaauaagcugaguauauauauauauauauauauauauauauauauuucugaagcuauuagaauuuuccccuugucacaauagcaguaagaaaauuacaauagaaaugucuuccagagagcacagcauaugaaauaaugugucuacuccauagcuuaaaguguuggcuguauuuuaggucuuguucuuugcauauuuauaccuugacaauuaugauugcuuguuuaaagaaggagcuuuuugcuaguuuuauguuacaaugccaaauacgugugugcaguguucuguuucugagcaggucagagagucugcugaaaaccuaaguaggauaagauguauuguuaagaucuuuuguuauucagauauuuguggcucuuuuuggguuguuguuucuuagucucaucuuuaaacaaucuggggaaauguguauaagaaauacaccaacaaaguacauucuacguuaccacauuugauguucccuaauuuuagaaccaacacauauuacugaaucauuucggaacacugauccuuacaucuuuccagauucccauucuuuuguguuggauguguuuugaaaguuugggaaggauuauauaguuauauaacugccauuccugggagcuauacuuugucagaaagcagguaguaaaggacaacuuguaaguucugucugcgguaguugcuuccugcugugugugucugcuguuagguuuuauuacaucauccauguuguuggaauacguauuauuauuaaaucaaugauauaguagcuaguuauaggauauuuacagcuguauaagcugaaaacuacaccauuguaguuacaaauauuuaaauaugucuaacagcauagaaucaagucucccuguaguuuuuauagcuaauaugcauuuuuauauaaccauuuuuaauuuaucacauuagacuugaagagcuaagaauuagucauuuuguucauuauagauaauuuuauuccuucagaaaaaaauuaucuuuuuuugagacuuaaagaaguucuauaaauaauuaauugcuuaaaaauuguuacacugauuuuauuccuuuuucuauuuuuuauuuuaaguagagagauagaaaaacuguaauaaaaggaaacuuuaaguuucuugaaaaugauaauuuauacauucaauaauuguaauagacuucaucauacuucugagaguuaauuuccaucuuaccuaaaauuuuugugaugauuaauuuuggaaccacagugcgcagaagugaucaugggcaaguaaaauccuuugcuuugcuuuggauuugagcacaugaaauaaggaccauugcuucaguagucuuagauaugacacuuauagagaggaccaauaagaucaagauuaucuauuuucuuuuguucucauuuauucaaaauaugaaaauaauugauaagaauacauuuuaaucaaauuuaaaguagcucucauuuaaaaauuaacuuuuuguacacaacacugucaugugacaucagaaauugcugcugugcacuacagucacacauugggaagaugacgugaguaccucugacauaggacuuuugugaugaucgaucaugacugcuguuuucaguugucucaggacaaauucaaaaucauguuugaaauuuggagacaucuuuguuauuuguacauuuuuucucucuuaaacagcucauuuuuauuaagguuuauuaucaaauagcuuuguuacuuugacagaaaaaauaaaauuuuuaggucugaaauucaaaauauacuauucauuccagcugcauucucaaaagauaaauuaucaguuuugugggcuauuuauucaguagaacuuauguuuuugaaagacuauaagaaaguugauauuuuggaauacaacauuguagucuaaagaugagaccuuuaacagaaauaggcuuuuacauucauuagaauucuuuuacauuuuguuccaucaucuuugcauaaaauagaaauugcuuuuaacauuuucccauauuucuauuauucuucaguagaaauuaacuuguaaauaaaauguuuuauuaaauuauuacaguaugaacuuuagugcauugagacuuggugugcucaccugggcuuugccaaaacugcaccugcauuucagaaauguuugaauucacuuaagagcuggucaagugugaaucccuuuguauuaugacuuacuucauuaaguacuguauguuauuaauucuaaguuuaauuuucuugaaauguaauacguaucucccauucuccgugauaauuauauacuuuauagguuaaaauaugauuugauauaauuuccuaauauuuucauuauagaucagcucuucacauuugcaaaauguccauugaaugggguuugagcuaaggucuuuuucaaggcaguagcaggagcucaguuucuuuuuaacacaguuuuaaaguguucauuuauuauguucuugcuuuuauugaguauuuucuauguacacagagugcuuucaaaauccacauaaauaauuucagucccugauucauguuaauaucauaaugauuuuuaacuuaguuauugacaaguuaaugaaugaaauguugaugugauaugauuagcaugucaauuuuuaccguucuaaaaauuauucugaauuuuauuaucuuucaauauuuuaucauacuaaagaugaaauguuuaaaaugagugauuuugaguacaaaucaaauacuaauagaagaaaucauaguaugcauuuaaaauugauaaugauacauuauuuuugccacuuagaagaaauguccucaagaaaaaguguaacagagcauguuuuaauguuacauuuaaaauugaguaaaagcaauuuuccauuuaaaacagucuaacacugcuuugacuuuguuuuggcaugaaggcauguuaaaacugaagauaauauucugucauaauaagagucuuuuaucuagagaguaugaacugaccccauuuauauaguuuugaaauuauggcucucuguacucuguaaaccuucacauuuugugguuuacuuauagaugauagggcuucagaaaaaauggcgugguaugguagguauuuugauacuguaguugaagaguuugagguuagaagaucguauuuaagggauguaaauauaaacauuaauaucugaagguuagauucuucguauacaagugaguggagugauuuaaaacuguucuguucuauccugauggcuuuuugaaguuuucagaauuccuggguuuagccugugcuggagcaucucuuauuaggagugcauucacagcaggagcucauauauaagaacauuucugagaacguuauugcuuacucucacucugucuaacuccucgaauucuuggcagagccaaaguggagggagcacauuuuguaccuguacaguagcucucugagccauacuuucaauuugaguuaccauuagguauaucugcauacaugucugccuuccucauuugucuuuauauaacauauggagagugagagaugaaguacccagaaucuuuugaaauaaagggucaguguuacuaguauuucucaaaggccaacaggaagaaauagugagcauuugugcuuuguaggacagguagaccucuucuugccugcagaauuuucucccuagucugcucacaugccuggcucucugaaguuuuugguuuugccagugguggcucacgcuuuuaaucgaagcacuugggaggcagaggcaggcggauuucugaguucgaggccagccuggucuacagagugaguuccaggacagccagggcuacacagagaaacccugucucaaacccccccccccccaauaaaggaaacuugcaaacuuaaucuaccaguuauuacagucuaaaauaaaucuuauauaauaugucagacacaguuuuaagggacuuaaauuuuacuuugaaauuacuguauacaaaaauuauuuuuuccuauaauuuugauauuuugaccucuuauuugaguuuauuugggacaucagcaguuuuacaaaauuucaccauacauuuugcuguuauuugaggcagaaaaugcagcacuugucacuaaccccaucuugcaacuguggaaauuaagacuuagaaugucuaucuugcuuaagauggcaaagaaaguaagaagggagaggcccgaagggcccagaucucaagccuaagaucuccuguuccucccucaccucacagcucuuuauguuuauaaugaagaaaguauucacgagguucagcuuaaaguaagaaaaugaaaucuuggauaagguauuucauuuuuauucuuuuacaugaaugcuuuguugauugaguuggcaaacacaucucuuugaagaaaaaauaauaaauauaaagcagaaaaguccuuuucuguuagcuuguuccuguguuggcuaaugcaguuaauuuuuuuuucuuuuuccuaguuuccuuuagcaugaauaauacaguaaaaaaauauaguacuaauaauaucuuuuaauacaggugacugaaguagcaguaaggaaugaagcauuugcaaaaaucaaaacauuuuuaagaacuauuuucuuuuauucugaagugaaugcaaaaaaauaauaucauuguauuuuguauuuauuuagguuuauauagcuauuagguuuauauagcuauauauuuuauacauuuaucauauuuuuuacuaaauaaauauauaguacuuuguagaaggcacacauuaauucuguugugaucuagaaggaagaagcuguuuuauuucagaauacuuuaaagaaacagugguguuaguuuuugaaaacuaguaguccaugagauugcaaaugaaaguguaacauaacauuaccaucaugaggaagggcagcuuuuccuugcagguuaaucaacuagucuagagucaaagauuacuuagugcuucucaaguuuaugauccgcccaacuacacuauacuuauuuuuaagugcuagacauuuaauuuaaacuguauucacaguuuuuaaaaauuacuuuuacuguuuuuuaauaucuccaucuuuuccauuuuucauuaaccaaaaauugucuuugcaaaccaacauuugccaauaugucucucuguaagauauacugccaaccuagaguuaauggaaauuaggaacuguaauuauuuaguuccuuucuacuuaguagguccccccucccaacucuuucuuaauuaucucuagauauuaucuuucaugcuuaucuucuaguuccuuccugauacuuuacguuacgguguguuuuguuguguguggggaggaauguauugcaaagaucuggaguaagaggacuuuuuaaaaacugucuuauucaugcugucauacuccaaaacauacuugaauuaaguaaucacauaguauuuuccuuccauagaguuuggucaggggccuucuguaggacagaacuguugaggcuuggucuguuggucuguugguaugcauuauaauacuaaauacuagcccuggcugccugagcgaccagagaguccucacauaccucaaguaaucauauaugcucuugcuccccaauuuaaaucuauuuacaacaauucuuauuauuuauuuagacaguguuuuucucuguagccuggacugaccauggacucacaaggaaccuaucuaucccugccuuugucucgucucccaaguauugccuuuauuuauuuauuuauuuauuuauuuauuaucuauguacccuugaaaacauuuauaucaauucuuauuuuuuuuucuuuucuauggagauuacuaucuacacggauuuaucuggguuaugauagggaaguagauguuaauagcauagaggguagauaucugcccagccuuagugcguuaaaggcuuaucauaaauauaaaggcugugugucuuuuaccugggaagauuaaggcuggguagauacacccgguuggauuaaauauuuauuacaacauagaauuugcaugaagauucuagaaauaagaugaaaugaagugugguggugcauccuauaaucuagcacccaaggggcuugaaaauauagaguucuuagccugccuaggguacauuaugagaacuugucuugaauugagcaagcaaacaagcaaagccaucaaggaaauaauguguguaauuggcauugauauuaauugugacacuagaauugagaggcaaauacgauuugccucuuugcaguuuuauucccuuacugguguuugcauuagaccugcuucuauccaagccucccuguugaaaacccuuugucagggcuguuuagaauuaaccugcaauccaggagguuuucugcauaaggacuaaaccugccauuugccacauuuagaaauaugcuuaaacuuuuuauuuugcaaccuuuacuucaccauuuguuugcuuuuguuuugccuuuuauauuuauuuuuuaagagagacucucacuaugacuccgugacgggccucagacucccagagauuuuccugccucugcuucuagagugcuggauucaaagguaugugccacagugcccagccagcuuuuccaucucaaaauuggguuaagguaaaggauucauuuggagguuaacagucuguuucagauauuucuguagcaaacagugccauuucaagugucuacacacaaaauccacaagcuauucauuuucgugauuuaagaagaauauauguagauuuaagcuuuacaaagaagcuuuuacauuuaaggauucuuauguuuuaaaagcugauauauuuaauuuuaauuuuuuaacugugugugugugugugugugugugugugugugagagagagagagagagagagagagagagagagagagagagagagaaugugaauaaguauggacauagcuggcauguauauggaggucagauauugguccuuuauccuauaccuuguuuaagauaggguauuuuacuugccacugcguacagcaggcuagcucgucccugagcuacuggggauucuccugccuuggccuuuuuuuuuuuuuuuuuuuuuuaccuauggagugcugggauuacaaaccacauucagugauucuggcuuuauauggcuucuaggagucuaaguucaggucuuugugauuguagcaagcaccuuauccacugaacaguugccauauccaguucaugaauuuuagaucuucucuccucucccuucccuucucucucuucucuucccuucccuccucuccccuccucuucuuucuucccuccccuccucucccuuuugccauccccuccccagcacccuccucucuuauuucuuugcccuccccucuccugcauucaccuccuuuccccucccugucuccuccucucucaccucugcgccaacauucuaggaauaaaacucaggucuuucacauucuagaaaagcauuuccccauugagcuacaucccaaaccuuauuuuugaauuuuaguuguguuuucucuauggcuucuaagaaacagcucuaaauuauuuuacagaauucaaacauuccucaauaaaaggacacaacuuuuccuuaacuguuuuccugagaguacaggagaaguuucauccuaauugaaacaagucuccuuaaaauauauugaguguggccauccauuguuaauugaaacauaaaguguguuuccaauuaggcaguaacuuuggagacuacuuuuacuuccuuggaaccugaaaauauauauaucuuacuucacuuauauccucuccuuucuugccucaugagcaauucaaucuuggacagcuacaaguuuuaagaauguacuacaccuucacauacugauugccucuucugggugcuaguuacuuaaaaguauacaaaagacaaauaguauaucuuuccugccaugugaaaucuacuauuaauuuauaacaucaauuuuauauaguuguauauauguuaauauuauauacauauauauaaguauauauaguguauauuauauauagacuauguauacauuuauauauauaucacauguauuacauaaaggggaagaaggcuuuuggagucaagaagggagccaguguagaguaggaggcagauaaaagaagcaaugaggaggagacuaugaugaaaacaaaauuagauacaggaauacauuguuauaauauagccuaucuuaacacuaaaaauaaugauaauaagcuuaccaaggaacguccucaaagaccagccacucaggccaaagcagaguuaagaacugcagugauuuuguuugaaaaggccuagcuaaguguuucucccuuuuguuuguuuuauaacaauacuaaguaaccagaucaaauagacuaacuuauguaugaagcuguugcuuuagauaaguuucuuuauaacuagaaauguguguacuagaaacaguauuuuccauuuaguugccaguaguccauuuaaucguuugacuccucucauuauucaauauaccguggaugguuuaucuucauucugcaucauauucagcaggaaaauagcaauucagcucauuuuuuguugaaaaaauucauacauaaaauuagcuacuuuuaauaagcuauuuuugagagaaagagaauaauuugagucucuaucaugaaugaguggggauuuuuuuguguauguucuuauaaacuacuuauuuuaauuauauaagauacuuuaucuuaucuuuaucuuauauuuaucuugauaucuuugcucauguauaaagaaaaaucuguacauaaacacuucucauaauuguagaagguuacuuugagcacauaugcauauuauaauuugugagguacuguauagcccaucuuguauucguaauaugcacuaauaagggaguugauccugcuaaccagcagaaggacuaauaagggcagguguaugacacagcuuuugucuggccagcacucguacaggaacagcccuuacacuguccuuuugaaggcccuguguuagagucugaauaugauggcgugacaucugcaagauugggcagguggugaagcugacgauugaacuguaugccaaguaauggcucuuaauagccuugguggacaccagauuuaggugucuuuguggaaacaaaagaguagcugaucauacacuuggagcuacuuuccugagccauggcuaaaagaaaaaaugaucuuuuuacaaaaugauaucugauccucuuagguaaucugcaacucuucugaugcugcuuucuucacccggcauuuccgcaccagacuuaagcauauauuuagauuuuaaacuccuagccuucuauucuuuuuauggccuauguaggcugucaacaaaccucuuguacacaaauucugcucuaauuugauauggggaagcauguaaccauggaaacguucuuuguacccuaucucaagcccuggcugcuuuauuuacccuuuauagaauagaacaaauaaucuacauaguuaauauucaccuuuuaaaaaaacuaauccccaguuaaacaacaaauaugagacuaaaauacuucuucacaacaguaauguuuuuaaccaagcaacuguuacuauuuaaauuuuaaaaauaaauaacauuuagaguagccuuucuuuuaccauaguaauuaucuuuauugcuuauagaaguuauuuugacaaugauuuacuuagaauaugcuguaacuagauaaaauacaaaugucuacaaaagaguaaguuugugauuuguugcauuccuaauauauguuauaauaggacaaguguguucagcucuuauaucaauuaucuuaacuacugcauuuaaaguuaugcucacaguaacacuuucuuuucuaugaaauacuucucaaacugauuuuccaauuguguucuaaccuuacccaaguuaagauuuaaaaguuuaacauauuuuguuaauucccuguauuuugcuacuucagguaucauuuaacucucaauaacugagggucacuugcaucuuucauaugcuucuuuuaggauuguuuuugcuauaauaaugauugcuuccugggaauaucaagcaaguccaccuguuuacagguauaagcuuauauaugaccacagguugauuuuguuuaaauuaaaggucagcugucaguuucaucuagcuacuaaugcagugaacucuugcuauaguuguuauaguguagacacuuaacccugaaacccugcagggaaggaacuagaauguucauguucauagauaauauaugugggaucccagaagacuauuucaauuaaaaacucacuuuuuaauuuuuugagauaguauagaaguuuuagaaguauauuuaugaacauauuuuaucuagacucugccuauacuaaaugccauucuaauaaguggacgaaguaguuguucaugacuuuuuuuauuugaaggaaauuaaguccuuuaaugacuauuuuuuacagggcagacacccuucugaugugguccuugguccugcggucagcuugcccaguuaucugcucugugugcauacucaguuaucugcucugugugcauacucaggaucccaugaacaacauaaacccuugccuuacuuuauuuucugguuuguauguuuauacuuccagacuugaaucuuuccaggaccuccccuuuuucuuguucuuauuuauuugauugacauuauaauuacgucuuuauccccuuccuuuuccuccuuccaacaccuccuuauacccuugcucuuucaaauucauggacucuuuuuuucacuuacuggcauuacauauguacauacauguuccuaauuauaaucugcucagguagcauaaugugugcguguuuuagggguuauuguuucauauuugauuugguguacucuuuucuggaaaagacaauuucucuuauuguuauuccuaacuugcuuguaguucauguuggguugaggccucauggucuuucuuucauccacuuuggcauaucaauugauguuguccucauucagcucauguuuaggaacucauguugaugagacuugaugggcauagcuucugacauuaguaagagacacagucucacagccagcuccuugauccccugggucuuagaaccauuaugccuccaccuguucugcaguuuucccugagcuuucaguguggaaguuguuuuguauguuuccucacugguguuggaccuaacaguuguacauuuugauugguuguaguuguauguaaucaugucugucugcugaggagagaaguuuucuuagugagggaugagaacuacaccaaucuguggcuauggacauggauauguagaauggaguuagcaauuagugaagugguaguuguagguucuccuccaagauucaugacuucacuagcccuggguaugucagguauagguccuuuugcaagcauuaguacccucuuuuuguucaugccuuaaguacaaucagugagcuguuaguacugccaagaucugugcaccacuacugcacccuuaagguuaucaugccacacuggcuguuguaguucauuggugccauggcucaggaggacugccaguuccuucucuccuuuggaagcugacauggcuccuucugguaugaugaaagcuagucuuucgggagggggcuuucaggucaguuccagaucaggggccucgaggcccuguguuugaagugcaugguagcuucagcaauagagacuugccucacuguacaucauaucuuaaauaucuauuuacuggaacuuaagaggaacucaaacaaccacaacaacaaaaguaauuaguguuucugaauguuaaauugccaagauggucuauuaucauagaccauuauaacccucagaguagggaccaguuuucucacaucugcaaagaggaggaaugggaaggaaccagaacuacuaaagcuaaauaaggaugaaggaaaaguuuaagcuagagagaaugucaaaaaauuagaauauucaugaaccaaauguaggucucugauacuaggauacuaggacucuagucaguuucaggucaugugacuguauuguggcauuucauuuuaaagaauuuuaacaaaguuuagaauuguuuuuuaacuuauuuugagacaaggucuugcauaucgcagcaggcuucaaccucacuauauagccuaggauagucuugaguuucugaucuuccugucuccuccucaugaguucuggcauuacagguaugcccaaugucuuuacucuaaugaaugcucgguaguuagugauagauguuuagugauuugaaaaaaacaaaccaauauaaacaucuccuuuaugguuucacucauuccucaauuaauccaguauuuaggauaaacccaaaaucucucauauguugaaaaagcauucaagcaacugggcuacaucccuuauagacuacuauuagaaccaacuuuuaaagacaggacuuaauuguauuuauuguugcuggguuucacuucuauuuuuaccacuuuauuuuacuucuguuucugguaagcaggcaugacugcuccuaucuacauuucuaguuuuaacuugguuauuuuacuccuguguuuuccagauuggugacauaaccuuuagaaucuacagcuacuauuuacauuacaauaugaauauauacuauugucuuauuuuuaaagguguaccuuguuuaucuuucguuuuucacuuuaaacuguauuauucguuauccaggcaaagugcuuuccucaaguuagaaggcacagaaugguauuuuuauuauaaaaauaauacucaucauuuaagcucacccauauaauagcaguucagaaaauuacuugguuaauugaagaaugaaaggaucuauagaggagauguuuauauuagucuguuuuuuuauuacauauuuuauuuacauuucaaauguuauccucuuucuugguuuccccuuuggaacuccccuaucugaucccccuccccucugcuucuaugagggugcuccccaacucacccuccuccccccucccugcccugucauuccccuacacuggggcaucaagccuuuccaggaccaagggccucuccucccauugaugcccaacaaggccauccucugcuacauaugcagcuggggucaugggucgcugcauguguacucucuaguuguuaguuuagucccugggagcuuggggcggggguggggggagagucugguugauauuguuguucuuccuaugggguugcgaacccuuucagcuccuuggguccuuucucuagcuccuucauuggggacccugugcucaguccaaugguuggcuuugagcaucugcaucuuuaagugucagccucugguagaaccucucaggaaacagcuauaucaggcuucuuuuagcaagcacuucuuggcauccauaguaccuggcuugaugucuguauaugggauggaucccuaagugggcagugucuggauggucuuuccuugggucucugcuccacuuuuugucccuguauuuccuuuagauaggaacaacucuggguuaaaauuuuuggcaugggucgauggccccauccuucaaccagggacugugccugaccucuggauaugguccuccuucuccuuuauugggcauuucagcugaucucaucuuuguugggucuugguagcuucuugcuuuucuuucaucuggaacuguguuuuucaagucacuaaauauauaucgccaacuaccuagcauucauuaaagacauuaucauuuugucaauacuuauauucuuacuugaauaguuugcagcacuauucaauacagaaaauguuucugcuuaguuuuuuuaagauguucuauugaauuuauguauucuauuaggcacuaaacauggcaagucaagaauuaugccuaugucaccaagauuaaagcuauuaauacuagaauauuguaugaugggaucugcuggccuuuuucuguucaagauaauaguaaugcaaugaaacaauucaaaaucauaguguauacugaaguuccugaacucacaaugacgcuuucagaagaagcaauuaugagcugucacauaguucuuuaaugauuuccucaggugauuagucagagcacuuuuguccccuaauuuauaucuucaguaaaaaguaaaagcaaagaauuuuuuuuuuuuuuugccuguagcaugagccacucucagauguaguccaggaaagcaaggcuaaaauggacaaaacacuuuugggggagacugaacauucacuauuuuuuccuuugaugaagacagagggcaugguccaggauccaaaagcaguaccagcgugguuuucuccuucuagguagaguauuacuaaagacugacugaagguccaaauguguccauccuugcuauaaucuugcauuuuaguaaguggcuauguggagauggaguguuugcaaugagcugcauuuuacuuaaaauguuuuccauacaauauauuuugauaaguauuucgcccaaccccaaauuccuuccauauccuaugcaucuuccuauccacccaacuucauauucuaucugucuaucuacuguauguauguauguauguauguauguauguaucuaccuaucuaccuaucugccuaccucucucuagcuaucucucuaucuaaucuuucucaacaaacaaaaaauauuaaaaacaguaacacaagaaaggaagaaaaggagagagagagagagagagagagagagagagagagagagagaaaaagaaaggaagaaaaaagaaagagagccaaaauacaaccagcaaaaaaaaaaaaaugcacauaauaacaacaaaaaccauggacuccauuuucuguuaguuuccccuggacuuggggccuaacuuugggugugcuugaugugccuagugaaacuccacuggagaaaacagagcuuuuuuucuaacagguaucaauuauuaacuucuuggauaagguuaggauauugcaucugcuuuuucauaagucucaggcacagaugcagaagauuauaaguuccagacauggugaaugaaucuaaggaaacaucuucuugacacaacagggcuaaugcaucuaggucucacagagacauacuaaggcauuauccacugggccucuacagguuaaagauggacaaaugaauugguuuuuagcuaaugacuacuugcauuucuaauuauaacuuuuaaaauaaaacugccccuuagagguggcauaugauuauugcagagccaaaaggaccgccagucuguuuaugcugagguauuuaaaaacaggaaaaaaaaucagaauuagggaccauuuauuagacgccaaagaacaguaucauauagauccccuauuaguacugcaacgaaccagacuuugauuccauuucuacccguguuugcuauauuaagagcugggagauaaauguaguuaucaacacuaucaacccuugcaggguguaaggaagguucaaauaauauaaugcaugcaaagugcuaaagguguccaccacaugugggcuuucacaauauccaagcuauuguuguuguuuauuuuucauuccuaugcuaaguacuaggguucuugaugguauacagugguuucagcauguuuagugcaugugcaguugaaaucacuuaagguuuuuuccuguguuguaccaaagaggagacuaucaaacgcauuccuuugacauuaucuauucuaccuagaaggagcauccaguccauuuucaguguggauaccagugaggacagucaucacuaagagcuucagcuaucuaaggcauuguaaaguccaaaaggagaaauaaaagaaaaagaaaagaaauauaaaaaaaguauguaaaacaagagaaaauguggaaagauccaugugccgaguaucaacguacauagaugaggugguguguugugacugauagagacagucuugcuucaggucugcuuuaccacaguguauccaauugggaaguauguaauauacacagacaaaaauaucauaaggaaaaaugacaaaaaauauugguaauaaaaccaaagguauuuacaauaaaauguccagaaaucauaauauaccuuguuuuuguauuaauacuauuauucaucuucugagucaaaaaauuuucagauacagaaauggggaagauauauacauucaacaucacgagcaagggaggggucccagugcugcacucaaucaagcaccuuuccaauuacucuauuaacccaggacuucacuucguucugaauccagccauaggacaaagaaauugaggggaaaggguguguuuuuuuucuuuuuuaaugugaaguuauaaugauugaaagucuaaauacucaugguaucaucagaauuccuuuuagaacaauuguaugccuuacaugcuguuaauuuauuuauuuugguugucugucuuuucuuggacuguaauuaagacugaauuccaaaugguaguaagaaaaucugauacgugacuuuucuucaggaaagcaagugucucuacuccaugugauuuuagcauuaggauauagcauaaaggaacaguauagaauuaguauggaauuccuuauccauagaaugaaauuaaagcuaguuucccauuggcucagacagcaaaggccugcuucgcaagcaugagaaucugacuuagauccccagaacaacugcaucuguaagcacagugcuggguguggacaacugaaguucauucacagcagccucauucaaucaaugagcuucacauuuaguaaaagagcuugccaaucaaucaaucaaucagauuaguuacagaaaacauaaacucaguaucaaccccuggucugcacacaaauaugaacauacaugcauauauccacacuaacaacuacuuaugccauaugcauaacaccccaaaacccauaugcaugugaaauauauaguugagacuuuaccuuuuguucuaaguagcuacccugugagugggcuucauaauauuaaucaauuucuuucaagguugagaaucaugaggucaggaaucguaacacaagccuauaauucuagcauugagauugcugaaagagaggaaugccauggacucuaaggcuagucugauguacauacuguauucccagucagcaugagauccuaagaccuuaucuuaaaacgaaacaaaaaaccuaaacuaaaaaguagcuuggugugggagguguagggguguguuucaggaagaugacugucuuagauaggauuuuauuacuguaaagagauuccaagacuaagauaacuuuuauaaaggaaaacauuucauugggacuggcuuacaauucagagguuuagucugugucagggcauagguagacauggugcuggagaaagagaugagagguccuuagacagagcaucaggcagcaggaagagagagauacuugggucugacuugagcaucugaaaccaccaagacuaaccccagugacacgcuuuucuaacaaggccacaccuccugacagugccacuccuugagccuauggggcucauucucauucaaaccauuacaagccuagagacugaaauucaauccccaggacccacacaauggaagaagagacuuucaaacugcgugcaugcugugguauaccuguacacaaccaugaauaauuaauaaacauaauguguaggauuuugugcaauuuggguaacuuaguaaauggcauuagucuauuuagccuguuaauuuauugaauucagaaauaagagagauuaggaaaaaucaaaauuacaaaaguguuuccuccuacaaaauuuucaugaauucuugcuuuucagcccuuugguguuuuauguuuguuguauaucaucuaugcuucaccuaagaaaguucauuugaacacagccaacuuugauuagcaaguauuuauuuuguaucuuuuacuuaugauauggacugacucacaaaaagcauagagaucaguuuuguuuucuuguuaugggaucucuucauguagcccaggcugacgccaaccucuaacccuucagcuucagccuucuaaguauaugugauauaaccauagcuccacaccucaauggucggcuuaaauuguucacuuuuaacaggcaaggauuuuuuucuaugggguccaguguguuaugggcacuccagcucauugacauuugagaggcuguuagcugauacuguuuuuaagaugcauugggucuuuucuuuuucccuucuuuucuuuuuuuaaauacuaaaugaauucuguuauguauaugugucacucgcucuuggcuuuauguuucacaaacuuugacauacuuuuuuguuuuaagucuuucaguuaugcaaggucaauaagaucgggugccuugaaaccuucuuuggauuuuuuuuucauuagcauuuguagaauaugaauauugucuuccucagcagggggacaacuugauuuuuguuugguuuuguuguuuuuaaaaaauaauacuuacugaguuaguuuuuaauucaagcugagagaggaugacaguuuuucaagggacuacguuuuggcuucuuuuccuauuuugcauuggggaucagggauaauugagauucuguguuuguagaugacauuaaaauuaaaaauucauugaaauaauagcuaauagauaacuucauuugccuuaaauaacccauggaaggaguuacagagacaaaguuuggagcugagaugaaaggauggaccaucuagagacugccauauccggggauccaucccauaaucagcuuccaaacgaugacaccauugcauacacuagcaagauuuugcugaaaggacccugauauagcugucucuugugagacuaugccggggccuagcaaacagaaguggaugcucacagucagcuaauggauggaucacagggcccccaauggaggagcuagagaaaguaaccaaggagcuaaaggggucugcaacccuauagguggaacaacauuaugaacuaaccaguaccccucagagcucgugucucuagcugcauauguaucaggagauggccuagucggccaucauuggaaagagaggcccauuggucuugaaaacuuuauaugcuucaguacaggggaacuccagggccaagaaguagaagugggugggugggggagcgugugggggacuuuugggcuagcauuggaaauguaaaugaaauaaauaccuaacuaaaaaaaauaaauucauuauaagaaaugaauucucuuuuuuucuggaauuacaagaaguguucuuauacccuuggcaccuaccuaacaugguaacauccuuccucuugucucuggagagugaugacugauacugauuuguuuauucauuuacuuuggcuuuagagauagggucuuuagauguagcuuaucuguccuagaauucacuauguagaacagacucgccuaaaauucagagagaucuucuugcuucuacuucaugaacgugcugguuaaggugcgugccacuguguccaccucuccacugguuuuuaugugaggucaaggcuauuuuuaggggguccauaaauaugucuucuucaaucaucuaaauuuuucagacauagauuucuuguugaauaguauugguacuauauuuaaacauuuaaaacauucuuuauuuaagguguugagaauaguuauaaugacuccuauuuuugguagccaauuacauuuuguuauucuuacaacuuucuuuucuauuuuguaucaguggcaaggugaagacucacccuuucccaugauuuuauuuauuaauauucuguaaauaagaaaaucuaaauucuauugaaauuuuagaguuuuagaauucagcauuauugcaccauuuuguggggagcagugugucuccaugugugcaagggggaaaaauguagauugucagaaaguuagccuguuuauucuagggcaucugugacugcauguauuuuugugaaugauauuugugauuauaguuuuucauaaaacacauuauguuauaaugcauuuuuuuaguuuuauguugucauaucuguguugccaucaaaauacaagaauuauauauuuugcauaaagauuuaaaauuacuuucugacuuuggugucagaguacaugcaucaguuguagauagcuguuagguaaauacguguguaugguaacugacagugcuuauauuucuguaaugcaauguucaugcgcuugggcuuuuuccaaauaugacugcuucuuuuucccucuucuauugauauccacuuggaagacuucgaaagcaaaaacaucucuuacauagccaugaucaaaaaugaaugccugauggccugaagguugaaauaauuaucucugguguccgugcagaucucagugucaaagcuaagaaccacaggacagcugaauuaaagcaugaacacugacgugagcacagacaacugcuugaggcucuuuauuccuguuugauacagcagcccuuuguaaagaaucuugguggggauuuuuguuguuguuguuguucagaagcaacugugugugucuaaucucacaugugccuuuaucauuaauuccauuccugugauauuuaugaaauaagcaaugucacauguauuuauucugguuuuugaaucaguguuccugaaaccuucuucuaaucugcagauagguggcaccauucaugcagacuggaaaagcagugcuuuuccuguucacacuauuccaugcuggaaauuaaccugucacuuuauuauuugacaagaucuucauuuuuauuuaucaggacuugggccaggaugggugcauuuauggccauuugcuuugcacagcucucagcugaguuuguagguauugugagauccauuaucccuguuacaagugcacacaaugcagaugcugaucugugaugaugaugagaaaccagagucaguaaagaccacauaagccacuccugaugaaaagauaaaugaaugcauaaauaacaugugcucugcuguguuugcucagaucaagaauggaucgagaaccuggaaaacucacccuccuucacuuugcauucaguaggcauuucacuguguacagaggagcugaaagacauuucacuguauuccuggaagcuccaaaauguuugggcacuucuuuauauuuuuaauguucaaaaaaaaaaaaaaaagagccacaaauaaaugccagaaccacuaguguuaguaaaaauuaauguagugcccagaaagucaugcaaucuuuagacaguccuaacauaguucuuuauguaaauaaacuuguuuucauuguguuauaauuauauaauaauagaauuaguaaauuauauaauuauauaauucuaauuauauaauaugaauuaguaaauuguguauucacaaagauuaauaauauuuaaagaggcauauacaugauaacauaagauacauguuuaagggacguacuucaacuuuauacaacagauguauuuugaaguagucuauaaaaauaauuuagcuagugagugauuucuuugaaaauuggcagcaccacagcagacauguggaucugcacagauuaugugcuguaguguguuuguauauguggauccuaagucacauaaauugaagaaaguuuaucuguauugcccauagcacuaaauaucuuggaggacagccucugcuguuuuaaugacuuuaauuuuuugagggaaaaagauuuccuauugcauuuaaaagaguauaguuuauuuaaauugccugaacuauauuauaugauuuuuguaauuucugcuuugauguuuuucaucucuuuuuauauaaaaaauuauuuuguauaacuuuuuaagggcuaaaagguaucucauuauugccguauguucuauagaaaacauuaccagguaguauaugugacauuguauuuccuuuauuaaguauucauugcauauuuguguuucauucuuaaugcuuaccuaauuauuauacucauuuacuacauuguuucaaagagcauuuugaacaaguaaauaauaguucuggagugacaaauagcauuugaaauucacucuacuuuuuuauuuuguucuauaugugugguagauaauaacauggcauucauuuaaccauuacuggacacccggugacuagucguauuuucugucaaaagacuguuugcaguuaauguuagcaaacccaccacagucugccaguguaagcagauuaucaguaauuguauguguguaugcauuuugggggaggguagggggcaacauuuucuucaggucugaauaagauauagauuccugcuggcuguuuuguauuccaucauaaagccugugaggaggccgcuccccauugaguggcuguggcccaugaaguugcuggcgugcugugcaguguuuugaucucggcaguggcaguuauguuccugauaaauuuguaacccccaggaacaccugcaaaucagccuggauuuaaauuaaaauuagguuuuauggcauuuuuuaaucagacagaagguggugauaaaaagaaacauguauuuucaggguaagaaagguaguaauauuucaauuuaaucggaacuguugcaccaauaauggaauccagauugaucuugacugaaaauaaugcaaagauuaaaaccauauucuuugaagguauaacauuuuugagacuuaaaacaaugaugauuuuagagaagccacagauuuuagacaaaguucguuacauaagccaguaaggacugccagagcuagaauucccaucacuuucccaagacauuuugugguucuggggcuggcucauaaagcuaacucaguaaauuuagcaacaguuguauguugccgagcaaugggguggggagaguacuuuugagagggaagagaagauuauaauccaucguucaaauaggaaauuuaggucacuuagcuaaguauggcugaauaucaaguuuuaaaaaauagacugguguuuaagcacaguaggauuuuuguugcucucccgacccagauaugcuauaguacuuccaagaagcauaguaaauaacagauaugguaaaaguaaguugaaacuauauuuagagagaguuuauggcuaaaggaaucuuauaaaagaaauuguauuaaaguguuguuugcaagugaauuaaaagugaaauuguaguuuuacuuuugugugaaaaguauucuuuuuguauucucuuuuguaagcauccauagacugaacucugcaucucauauagggcuucuauuuaacagugcuugccaagucuuuaucacuauagaucuaaagcaguucggagcauuguuugauuuaaagcaguucccuguguauaauugcacuuugagucuuugccucucuuuggcugaaaaccuagcuuauugcagcuaagagaaucucacacaaaaaaugcaaguuguccuugugcauaaaagcagauucugcacuucaacaccuuuucaaauuaauauuugugaugggucuauucucugccucugaguuucuguucucuugcuuuguuccuguguuugauguaauguaagcaaggacaaaaaggagagcugggagagugugugaaaaugguaguuaagugggcuuaaggggugcuucagcacuuucugaaaggacuccucagugaauaggccuucagagugcuuagcuguagugcuguaaauagacagguccugcacaaagcugcagaugaagugagcacaugcauaucaccccuugugacaucuggccagcccuggaauaucauuucacuucuucagccccaaccaaacauuucccgaaugcucuggcgguuaaaaucuuuuguuugguuaauugcaaugaguauaauauacaagucucuuggaggucugcuguggacgaucagacaauugagagauuuaaugagauacugccggcuacucauaauaagccuccuuuucggcuugguaguuucugagguuuugugauaacauaaaacucuuuaauguuccugaaaaaaaugcaaaaugagaauuggaauuuauauuuggugauaucuuuuugcuuauuucaaucaagcaacgaggguauuuuuuuuuaaauaucguugcugccguuaugauuuuuaugcuauuguugaguuuuguuuuguuuuauuuuguuuuauaaaauuuuagaaccugaaagauggucuuucuaugaguuuuggauucuacuuaagacuccauuaugcacagaacugaaauaauauguuuugcaagggauaugugcuuuguagaaggggacaauuaucagugccaauuuugaaguccccagguaugagaacagaaaaugacauguauguauagggugcauguagauuuacuuagaccagaaucauauagggaugaaggcuaaacaaagauggcaagaugugugaaguaaaacaguaggcaaaaggacuaugugcuuccuuuccauggagaaucuuauaaguauucaaccaaacucuacuccguaaagucguccgaagaaaaacucacucucuccuaaucccagucuuaaaacaaaagacaagguccauuauuacuucaacagcagagagaaaaggaaaugagaaggggacgaggguugcuacaguuugacauggggcaauuaaucuuccaguaagcguugucaggcagaaaugaacacaaauggaucacucacauuaaccagaggaguguagguagggauuuuaacaagcauuuacgagaguccauuuucucacuaaugaagaggggaauaaacgaaccaguguaagcuagcauuauguacuuaaaguuguguccuuuuggcuaaagacgccucuucacauucuugacauuucuaguagagccuguaugaucuaagccagggcuggaaggguugaaauucuaagguuggcuuagaacuaugcagggcuuacuucagagccugugucacuggguucauuaguuuaaaauccccauuaacccuucccuuccauagaacaacuaucuuuaauauuaugucacaucagaacuuggaugggcauacagcccccucccguacucuaaacauuuaugagaaggauuuuuaaaguggaauuuuaaaauuaaggucaccuaaucauuguguguuuguaaaauaccaugugucaagauuuugcauucauuauuuuuuuccauaauagauuauuaccuaaaugaaugcugcuaagugcacaugaaauucagaggcugcuggcugauccuaaauaaacacauuuuuauaauuuacagugguaaauaauggauuugauguuuaaauugcuuaacagucagaacagcacgaucaugggaagcuuguuucuuggcuaaauagcuucgauuugauagugaacccauauguauuuaagaugaaaacaucucuaugucuagaaacaacugacagguagagagggcuuuucucccuguccuuugcuuucagccauaacacugugaggugaaccaugagacauuuuaaacuuuaaauaugauagugcuuuuaaauguuuuuccauaauuccuugccauucauuuaaaguuuguacaaaaguuuugaacucauguucugacaaauuuucaggagugcaagacaaaucagauugugcacucccaucagauugcugugccaggauugugacuuguugacugucucagacuuugcuauugcuguguauugcugcucacugaagaaaaaugaaguugugauuauaguugacaaauaauuguuuuuuuuuuuuaaacaaagccccuuaccuccguuuucuauguucuucagaugccuuuuccuaggugcauauuaugacuauuauguuuaugugaccaaagggucacagaugguagaaagauuuguuaccauuaggaaguguagcacuuugugauuauaaaauuaaucugucucuaaaucuguuuaaagaguuuuucccaucuaaugagcaauauaaauuauuaauauuuucauguucuuggggacauucacagccauaauuuuaccaacacagcuguuugacccagugacaucauguuuugcauauuuuugcauuuuaaugaguuagucauuuaaaagguuacaaagaaaccauaacucauaaguaauuaaauuauuuagcagaagaaguaugagaagaucuucugacauagguuacugugggaaggaaaauucauagcuguacucaguugcaccuguuuguuaggaaauaaauguguagaagcaucucucugacauuaugaaaugaugcuacuuguguaauaugcaaauagauaucacaaacaguacauuuucuuuguuaaggagaauaacuacauacuauuacaacaaucacacacuuagcuuaucauuuaagguuaaccauucccuaauguguauuuagguaggaacaucuuaauauuaugcuuucuccuccuaacccccuucuauuucuugaaaaauuagauguuucuuauagucuuuccagagauuuuuacucaaaucuuauuugaaauuuacuacugaauagaaauaucuuaaaaugaaaagggaaggcgccugaaguauagaauauagguguacucuuaccuguaccaaagauaaugcaucauagauaguaacugcuuauuaaauagcuguuguauaacuucaguauuuaauaccuuauuaacucagugaguauaucaaauuuuuuaugaaguccucauccuuugcaaguggaauauaggcaaggaaagcacacuauaucugugagcaauaaaguuaucucagauaugauaacuuuaguuggaagggacaggagaagauggcauauuuuaaaauacaaugauuaguguauacacuaguucuuuuguuuugagcacagaauuuuaaucauguuuaaauaauauauguauuaaaaaguaacaacuuuguggauugguguaaccacaagucuguaagggacauuagaucaagucaggaacugugugcuaggcaaucucuuuaugaaauguaacacuuuauagaugauuacuccaaagguuacuguucaaaucauuuacccuguguguacugugguauauaauuugucuaugguauacacuaguucuuaagcagguuuuaucaucgacucaagcauauguuuauguagugugguagggucaaagaauauuugaaagacugugagccaccaggaccgcaugguaguugauauuuacauaccuguguuauaauauauuuuaauaggaagccaugggaauauuguucugaaauauaauggcuugccucauaugcagaagaguaaaucuuguaagucugaagaucaaacucugcuuuggaucauuuaauaaaggugugucuguagggcuccgcagauaucuuuagggacuugaaucugacaucaacuggucaccaguuagaauucuuacuuccuuucacuucaguguguuagagggucagugucuauuuguguuuuuuuauaagcagcaaggcaucauaaaauuuccauaaagcuguagcaguaaaucuuauuacuauccuuaauaguaaaugguaauucuauuuacuuuguggugguagugaauuccuggaaugcuuccauagauaaauuauugacaaauacuagaaaucucuaugaaguuuaagcauuguaguauucuaaaaccuaggggguaaaguuagaaacagaucaggugauauuacggguaagagcaaagugaguuuuuaaaauagcacuuuggugcccuggguugucagaacuagagacaaguguguauguuugucaauauaucuuucauguuuuacagacuccuaagggaacaagggaagauacaauuucaccuuuucugugccaaaacauuuuaauuauaucuccuuccaaguacagcgguucaguaaccaaggagcugacauugaugcauguguugauaaagcugcaaacauucaaaaugagauuaacaaagauuuugagcaaagggugacagcuaauuuugcacaguauucugcaucuaauucaggccacuguaauaauagaauauuuuauaacuguuuuguuauucaaaaugacuuuuaugauacauuuauuuguggauaucuuuguaucaugcucaagaaauucucuauucuauguuuuaaaaucacuuacuguucuaaccuugaaacaguauuaacagggagaagaaaaacucauugugaguugcuuuauuuuuuuucuuuauuucucuuuuaaaauuuuuuuuagguguuaaaaucgcaucucaucuuuggaacucugguuuaccauaauuaauuuugaacauacaaguuauaagagagguagugaugaagaauauauguuugugauaaugcuuaguaugcaauaauaagauggacaugaaaaguuauauucaauuacuaaauugauaaaacuauaguugcuuuaugcucuuggccucuuuuaagcauauuuauucuccauuugaaggcaguugacagucuuucauuuuucuuuuuauuucugaaauuuucuuucuuuucuuauucacucacuucuccaucugcuuucacuuuuguuugcuugggccgucucucaucccaacuugauaaugaggaaugcagugugacccugaccucuaucagcccaugcaugaccuucugacucugccauauaaccuuugaccuucgcucugacagcuugauuaauuacccuguguuaugauuuaugaguaagugcuauguaaaaauaauagacaacaggugguccucugaaaacuuuuuguggcauguuuucuuuuacugacuaacuugaucuauuugaaguauaaggcuuaucugggauaaucuguugguccauauuacaguuauuuuauaccccauauacagcaugaaaaaucaggaaacugccaauugagggauaauccugaugaauacuuuauaaaauauuuguagggugcaguuacuuuaauacaucuugagaagaagcacaaacaggagucaagugccauuucaggcauuucagugccaggucacgucuugagaaaauugcugaaguaaugaaggggcauuuuccaagcagaccugcagauccaacagcuauguuuacuuuaacgcuucacuagugacuucugauugguugucaugaccucaucucacuguugcaccuaggauguugcaacagugacauaugcauacccuucuugugaagacaagaauaaacauaacauagcucuuucggaagagaugcuuggacaguuguuugucccgucuaacuguggguagagauaacacacuuggaguuucauuugccuugaggaugaacaccugucuucucucaagugaagcagguagaauacugaacuugaagaauaugauugauauaucuauguaaaaugaucuccuacacagcuuugccuagagaccgaaauggauaguuccaugggucaaaagauucuaguguggcccuugaccucucuggucacauguggcuuucaguauuggcgaguuaauaugcagagcugaguacuuucagcugcuuuuuuuuagagccacucaaaagagauuuuaaaagcuuuagaacuuguuccuauuuccccuucucuguguaauugguaguuaguauacaaacuuuuauauaucuuuaguuuuuauaguuucauguggugugaaaaguaggcucuuugucaguuguuuuuauacuucucucuacacauucaugauaaguaauuuucugugauuauuuaauuucucuagcaaagguuccuauguguucuuuguguugggcaccaccugucuguuucagccugcaccauuguuugcugauuuaaugauaaacuaucauuuauuaguaaauuaauuuuuagucuucacaguaagaagauucuguguguuuuauguuaaucauagcaaauaguuaagcuaaaaaauaugucacauuuuagcacuaaacuuuugagaguaucagauuaagaucguauaauuuagaauuuauaaauucagaucugaaaccaaaguuauagcuccacauacauagaaauggagccugaggaauuaacccugcccuguagaccaguacuugucuuguugaauacuuucuugaucuagacaucaagucaaaccuaagagugaguuaacagcuuugagugugcuguguuuccugaaauguuacauauuuuaaacaauuuguguaaaucauuguaaaagauguuuguagccuaugcaauggcacuguuagauaaccacuuugaucacuuacucuuguuaaaagaaacagaagagcucuccauguggguuuggaaugcugaaguuuuuuccuccugugggacuuacauguacuuaaagaacuauuaaauauuaaaaaaaaauaagcuucacuguugcauucuagagucuaagcccauguuaaagagguucccuugguaagaauagcagcacuacauaguucuuuauaguauacucaaugucugauuuuaucuuguaguuuuguaaacuuuauaaagaugauuguggcagucuuucuacuuaguuguguuguuuaauuauucagaaacacuuauauuuuaauuugguguauauuuuuauuguugaacuuguaagcucuguuucaaaaaauuaaugguuaauauauugucucugcuuugugucacuuuauuuucuuugacaccuuggcucccauauauuagaguugacauuaccaacaucuuggaaucuuacaugaaaguuuuuuuagguuaacguuguauguaagagagcagaagacacaggccaaguuuggcuauacaugacuguggguaggguugagauaagauagugcuacugucuguacuggcuuuauuguacuguuuauaaacuuguuauaaauuaucuaugugaacauuguauaagcuuauuaugaaagccuuaauucaaauugcuagguuuuugaauauccagaaauguaauuaaauuuguaacugauuuuuuccagaaauacuuuuuauuauuuugugaucacuaucauuuuaauuaauuugacaguuugaaauaucuaaaggauaaaauauuuucuaaauaauuauaaugauuuaagauaaaaaaauuuaguuguuucagcauuuauuguuaacaucuaaauuguuaaauucuuuauuuauaauuguggugauuuaaaaauaguauaauuuuuuugugcggaugcuucagugaaaaauugacauugugccuuuagaaaauugaauaaaugaaacauauaauucucaguuacauaaucaauaaauuagacaaauacuucuucuucaaugauuuguauauguuuauuuucuuauuuaggugggacaucucaaauuucagaaauuauuuaaaaugaacuaggcccaugguuuucuuucuuuaaaucuaacuuccuacaaugagaugaagcugcucagagggucugaugcucagagggucugauccucagaggguuugaugcucagagggucugauccucagagggucugauguucagagggucuguucucaaagggucugauucucagaggagucugaugguauggagauaggaguuuggugauuaaguuauauauugguuugguaauuacacuggaguacacaaugcuugcaccuccucugaaauuuaaaauuccauauggaauuuuuaacuuguguauaaguauaaaaaagcucugugugugugugugugugugugugugugugugugugugugugugugugucugucugucugugugucugucugucagaaaagacagcagagaagcaugacaggagaccacuuacucacaguacaaaaucuacuaaagaggcaguuuucuuuuuggccuguggugaccuuuugugacuguuccucacaccagcagcaguauacugcauguccacauuucaccaugguuagcagaguguaacagggcucuuuaacuuacuguggugggaggagaaguuccaggugaaauuugagaagggugugaaaaguuguaagagccacaaggaagagagcuagggacuuccuucaaaugugauuuuaauaauuagucaaguguguccaacuguagaaaaucaccaagugacaaucugucuaccugacagugagcacaaugaauuacaagacuuuugaauagcucuacagauuagaauaaagcagacccaaauaaagugucuuuuguugguaaaacuuuugacucaacagcuaacagacuuaaaaaagaaagcaugcaacaucucucuuucuuuaaaguaaaauguuuuaauuuuuaaaacuuuauuggugauuaauaaaagaggcaaaaaguauuauugaaggaucugaaggguguguggcauuuuuucaucacauaggaauauaguguuaguuuccaauguguaaaaggauuauaucuuaauuaauaguacuaucacaagaccagaacuuuagugaucuugaaauuuccaaaccaguaauuguuuuagucaauaauauccuuugacuaggcaggcauuaaaaauggaaagaguuauuccagugaagucuacagcuaguucaggagguaaaaggccaacaccgcugcauagcauucuuaaaaauaagaacuugggucuaugucaauauugaucuuauguuugguuuuguuguuaaaaauuugaguugaugaucuucauguagaaaauuuuaugauuauaguuuuaaaaacuacauuuguuuuuaguaguuuuagggauuuuuacaaacuuuuuuuccuguuguucuugugguuuugcuauaguguauuauauuucuagauaccaccuuaaagauaagggcagaauuaggacauuuacaaaacugaauagaaaagacauagaauugggagcaaacaauuuuacuccuuaaacuugauagugcuugcuguguuucuaagguuuagauuaguucaucaauugaaccuuaauguccuuuuaaaaaaaaaaaauguaacugcagaaauguuugccuugugaggagugaauaaggaaggaaaauguguguuuaaaaucuaaagcccuaauagcucaaaacauuguguuuuuaaacuguagaacuuagauuuucaggacaaggauacuaguucuuaaacaaggcagcguguuacuguggccuuagcaaauuuuaagauuaaacaguuucuacucauuguuugguugguuuauauugcucucugagguuuuuuuuuagucuuucuggauggaaagagaauaagauccaagguacauaggugauauaguuuucucaacauuauacagaaugugauuugaauguauccuugugugauaaauucuuuuaacuacacuucaaguagauuauguuuuauuuaaaauucauuauuuuucucuguagcaauuauguccauguauuuuauucuaauagauaauauaugcuuauuugugcaaacagcuuuaaucuuuaaaauauuuuaguuacuugaaaauauauuaaacuaccuuuccuaauguuuuaggacuaucuucaugaauugaaauaaauucugauauuuaauuguaacacuuuuuuuuuauuucaaaacaggaaggguauggagucaucguccugaacccaaaugaaaacuauauagaaguggaaaagcagaaaaugcauaaacagucaucaucuucugaugguacagaugagccagcagggaagcgggaaaggagagauaaggucuccaaggaaacaaagaagcgucgugauuucuaugagaaguaccgcaacccucaaaaggagaaagaaaugaugcaguuguuuaucaggguaagaaagagaaaaagucucuuuuuuguucuuugguuuucucaggauuucauuucauuucaauuacuuaauuguuuuuggaagcuguugacucuuuuaguuuuaagcaaacauucauuuuucauaauuaccugucugccugggugggauuuuuuucauuuaaguuacaaaacacuuuauagaaucucuaaugcaaauacuuuugucuuuagugcgugucauuugcuguuucaaggaacaguuucuaaggucuuaauaugauguuugcaaaaggaagaaaccuuuuuaauucacuucuccagcacauauuaauguguuaugagaauaaauauagcagaaugauuuuaaagcaagauauaagacugucaccaucucaggugacaguuuccagcagaugaugugugugaccaccuauccacccgcagugaggaggaaagcaacucauacuucaaugcauaucuaagcucagagcauccugaugcagugugaugaggagaacagcauuggugucugacucgucacacagagugagcaguuggcucuguagcacagcaucauggaaucagcccuuucaguggcgccacccacgcacauugaauuuuguacugauacacaugaacguauuugcacuuuggugucuucuuuuaugauacauuuucuaaguguuuuuguuugcuagaauuuaacaguugaguaugaaaaaaugcuccuauugagggaagauagcaaguucguauguucuuuaaaguucaauggcucagugcacuuaaacuuuaaaaucaauauuuuguguuuauggagaggguuggggaugagacgagggucacagguaccccagauuugccuggaacuugccauguaucccaggcuucgcuuaaacuggaguauagcucuucucuuucucagcugacauuacagugggacuaaccaggccuggcucuacccuguagaguauuagcaacauucauguuuauauuuacccuauauuaaagauuauuaauuaaauacuucaugcuauauuugaaggaaaugcauugauuauugguuuuaguuauuuauuuucuuuuaggucaugauggucuuucuuguuguagaaguugagauuuaauacuaaugaccagucaugcauaaauucucaagacacugaaaacagugccuugaccagaauacacagacuguaugagucagaauauuuauguacaguguaauauuucaaauuuuguaaauccuucuacuguuuaauacucauuggaaauaauuacucaauauagagucucuaaguauucugcuuuuccuacuguagauauauaaugucuuuguacaccuacaucaaaguugugauacuagccuguaggucaaucuguuguccuuagauucuugccauaucauccaaucaguaaagcaccauuuauagcaaaguuugucucuuaugcagauucuaaaauuuaauuuuaugaggccuuuuacuacuccagccauagagucuccauguguguaugugaaagacgagcagcacaguggugugcuuauuucuuccuuauuggcuuguaauuucuacagauuaagaagugccucaugcaccuacuugaagaguuccucucccuuugucuuugcauuuucucuugccacauugcuugggugcugccccacccaccuccucgaugguuuuguauguauauguuuucuuuacuuucuucaucucugcuucucaauacucuauuaagacuuggucuuuuuugguuugucuuuuuacuuuagguuuaauuguuuuauacuuuuaauauacuagcuauuucuacuucuuuuuaaaaucuuguuuauuuauuuguggaggaagaguggacgauuggcuuuuuuguuccauuugcccuaaaugaaguucucauauucaaacacuuaccagauuuguaugugaaucuuugaguuaauaacauauuuucuuaacacuguuucucaccuaggauugugcauaauagcauuuguacaaugaaagacuccaacacacuucauuuuauaaugggaaagagaugucucauuggauguauagugcauccauguguauuggauucuccucuguucuuugaaagauucauacuauaaguuuugaucauauucuccaacccugaacucuucucagauccaccuacccaaccucauauccuuggauuguaauaacccauaaggaccaauuaaugcugcccauauauauguggaugugugauauuccaguagaguaugguugacuuacuggcauguacacacuuaaauaaaacugugucuccuuucccagcagcuaaugcuuaccaguagcuccauugcuagggguagaauuucaugcccaaauuccauuaauauaaugggauuuggucuggcuugguuuugcucgaguuuugcauaagaccuuguaucuguccaaacuuauguucuugacccuauaauugugcagggcguggguuucauccuauguaguagguuuuaagucaaaucauacauugguuggcuacauuacgugaacugaugcacuggcuacuguuuaggaucauauagcuaggaaauggaaguaauuaugauggacucuuuguucccauauaucuauaccauacuguucugcccagagaaagcaaacuauagagcugaaacaugaaaauugaaucacaugugguaaaagugugacaugguauggccauaucugguggugauaaagauugauucuuuuaaaaaauuacauuuuuuaggauuuauuuauauuuuaauuauauguguguugaugauuuaccuguguguguuauauauguacuuguguauguucagugcccuagugaccaaaagagggcaucaaggccucuagaaauggagucauagaugguucuuagccaccaugugggugcuggaaacuggacccugauccuguauuugaacaacaaauacucuuaaccuuagcaguuucuucacuaugugugugcaugugugugugugugcauacaugcccguguauguguaugcuuguggguacacacaugccacgucaugaauguagaagcccgaggagaacuguggaaagaagauucucuucgaccaaaugggucuuggguauuaaacucagguuugcaggcuugccagccauuugcuuugcccauugagccagcacacuagccuuaacaaagacuucuggccaguuauaaagaauaaagacauaugguuuugcuuaauuggauaauuaauauugauucagacuuauagauaaguagacugugaucaagauaguaugaacucuauggggaccaaaaucguggacuguuucacuuagugcacuauccacugacccuagaagagguccauccuaacauauauguguacaauagagucuucugaauggcuuuugaauacaaugaugcagccauuaauuaaaauccccagguauacuuauuugcuuuaugaaaaaauguacacugcuaaaguauacggcuugcuuuuuccauaugguugcauuuuaacuaaaacaaauaaacaaaaacuauauuauuagcuuccuauccaguccaguguccaagauaagauucuaaaaauuaaguaaaggaguuacaaagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugcuugggccuagcaaacacagaaguggaugcucacagucagcuaauggauggaucacagggcucccaauggaggagcuagagaaaguauccaaggagcuaaagggaucugcaacccuauagguggaacaacaauaugaacuaaccaguaccccggagcucuugacucuagcugcauauguaucaaaagauggccuagucggccaccacuggaaagagaggcccauuggacacgcaaacuuuauaugccccaguacaggggaacgccagggccaaaaagggggaguggguggguaggggagugggggugggaggguaugggggacuuuugguauagcauuggaaauguaaaugagcuaaauaccuaauaaaaaaugaaaaaaauuagguaauauuucauuaauaucauuaguauuuuaagauuuauuauugauggauuuuuucauaauugaauauauaaaauaguauucuguuuucacuuuuuagccauaauugcuaaaauugugcuaaaauuuuggguggaaguggaaauauuuuauccuuagcuuaaaguuauuucuguuucacaaaugugcucacauugaccauaaugguguuugcguuacacauuuauucuacuguguucacacucuugguacuuugucaaauauguuacuuuguuuucuuucuuuucuuaaucuugauucuacccagaugaacuauugcccccucuacugcuauugcuaauaacuggugcuuaccaaaacuucugaaaauaaccacaaguaguuagcuuuuucacauuucaucauuugcuacuuuagagauagcucuugcauuuuugccucauaauuuuguuaugauuauuguuagcaugcauuuuauuuuccaauauugaucuuccuauuauccucuaaaucuuugaguaugcauuauacuuuuuuccauucuguuucaauccuuaacaagaagcagauagaagcauuuuuuccaaguagugcaaauuccauacuaagagaauaaagaaacaauucaaaacuuacuagaaguugaaacucaaaaagagagcaaaccaagaaaauuagaaccugguguagagauaacuagauaaacaugccuuaaauauagacaugaagauuauuuauguaucaaaugaucuuuuaauaaugaugaucuguucgugguaguuacugaguaagaguagaauacagacaaagguagaguugaugcagucaucuaacauguguuugggaugacuuggcugucucuuuccuaaggugagacuaaguguuagguguucugauggcaaguaaagauuacaacaaguauacauuaugugaaauuuuuaaaaacagaaaagugguucuaaauuuggagauaaggucaaaagauacauggccauuccaaaaccguccaaaugugaaggagacauguagaaccuuuggagaggcugccauugcauauugaagauacuuaaauguguguagacuguuuguuggcauccaucugaaacuccauuucuugacaugcaggaucuuugcuauagucuaguuuucugauugauuuuuaaaaacuuuauuuuaauuucuuucacucuuuuucacuugaauuuuugcaguuauuaagaaugcaccaacucugagaaaaccaaggauuuuuuuuuaaaguaacuuugauauuuucaauugagcauguugacagugugagugaggauugacaaaugucacacugccuugcuuacuguugucccuguagccauuucaguguagaaucuaacaaaaugaaguuuguguaaguucaguacaaauauuguuuaauacuugaaaccaccuuauuuuccucauaaacgaugucuuacuuaugcaaaaugcuuugaaaaauaaguacuccagauuuuggaguuuuucuaauuuugggacuuuaguauagacucaugauauuaagugccauaaaauucaaguacuuuugaguagugaccauguuacauacucaaaaauuugcauuuucuucuucucugguuccuaauaaauagccaauaucuuuucaaguuuauauaaguaucuaauauacauuauauaauauagcuuaauuagcacacaugucuaaaaccagaagcuuagucaaguguguugcauuugcugaaugccugugaguaggugugacuaaagaguggguucugugguaccuuucugaugcaugaugaacagagcauaagggaucaaaggacuuacucuuucauguagcaacguccuuaacuaugaaauaauauacuugcuauaauacauuauggacuauuaaggggauugauuuggucuaggcaauaaacguugucagacaugccuggcaggaaaaccugcuuaauauguuuuguaauaagauggaauuuuuuguucuugaaaacaucugccaacucaauucaagagugaagacagaaaaugucaucaguucugugguaauucuauaaauuuaguuucucuuugagcaacacauaucaagacauacaaaacucccaguguuaaccaccacugguuauaauacuuuguaaaaugaugaaacaaaaacauuuuauuuuuauauaauguguuaauuaauucauuaugaauuuuaauauuucagcugauaaaauuuaacaagcaacuugccaacagaucauuuuuuaaaagcaucuguuuuuuaauguguuggguugagaacugaguuaaauagcuaaauauguacauauucauuuuaaaaaccgaauuuccacucccauaacuauggacacacaguuuucacuucuugaaccaccaggggcugcugcuguccacuuuggauuuagcauugcuuagacaugagcacuauauccuuagcuuucuuuagcccccaaauccuuaggaagaugaccacauaaagaaaaaaauguuuuaccugauagcucuaauaaucaguauaaaauuauuuuuauauguguauguguguacacagcgcacacacauauaugcaaccuacuucuacuacauguuacuuauauguuuucagggcugaccauuuggucuuugauaaccaauagauauaaauguaacaacagcuaaugaaaaagaaguccauagcucaguagugaaagaacaugccuuuaaucucaacacucaggaggcaaaggaucccugugaguucaaugccagccugaucugcaaagagauuuucagcacaacaagauuacucagagaagcccuguuuuaaaaaaaucaaggcugugggggagggaagggagggagggagggagggagggagggagggagggagggagggagggagagagagagagagagagagagagagagagagagagagagagagugaaugaaugaaugagaacaugaauuugaaaagaacaagauggaggauuuagaguaaggaaaaggaacaaagaaauaauguaauuauaaucuugaaaaaaugcaggaaauaauucuaaauagcuuaccuauuuuuacacacaugugucaacuuauauuuuuucucaagaauuugacacauguguaccauuaaauaugaucauuaauaugccauuucuccccuuagguacucucagucccccuccaagcugcaugucuuuuucucuuuugauaauacacuaaauccacaauugaaugauucuccaucccccaacaacaaucaaguaccaguaucucauuaguaaaggauaaaggcuggagaacaccuuccccuuaugugcuggauuugggauggcuucauuuuuauaugggucuugugcagguaaccacagaugcugugaauuccaugccaugucuuacuuuagaaggcaccauaucacagcauuccucuucgaaauccucuggcucuuauuuuuuguuuuuguuuuuguuagauauuuucuucauuuacauuucaaaugcuaucccgaaaguccccuauagccuuccccagcccugcuccccaauccacccacucccgcuuccuggcccugccauucccuuguacugggggggauauggucuucgcaagaccaagggccuguccauugauggccaacuagucauacaacuaguccaucauuugcuacauaugcaacuagauacauaguucuggggggcggggggaauacuguuuaguucauguuguugauccuccuauaggguugcagaccccuuuagcuccuucauuggggguccuguguuccauccaauggaugacugugagcauccacuucuguauuugccaggcacuggcauagccucacaagagauagcuauaucaggguccugucagcagaaucuuucugggauaugcaauagugucuggauuuggugguuguauaugagauagaucccuggguggggcagucucuggauguaccuuucuucugucucaacucugaaauuugucucuguaacuccuggcucuuauauucuuucuugcagggggauugauaucaaugacccauuuagaucugaggauucaguucuuauucugagcaccuugcccagcuaugagucucugccucuaccgcuucccucuacuaaaaguuacucugacacagugcucuggaugauagguauaagcauaaaaauuuagaggacaauuugagagcauaaugauuuaguacaguaauaacagacaggaaccuacccaguuguuuacaguugguuucucugugucuuccaguaaaauuuguguuguccucagaccaugugguuguuguggggaaccaauugcaauggccauaggcuguguuuuuugugaaccaucugguaccucucugaacaguuacuccuuggaaaauuuuucaugcuauugguuaccguuugcauuucaaaacccacgucuuugggacacgguaugggccacuguccaaaguaauuuucuuccaguauuuuuuaaauuuuuauuauauuuuaaaauuaccuugcauaggcuuuaucauaauacucagcuuuaguuaucccagcuccccuuuccucucccuauuuccauauccggucucuacuuuuauaauauccaguauuuaucuaucuucuuaucucgugauucuaugauccuuccaguuaaaguuuuuauuggguaguaggguaguaggccucuuuuuaaaauuuuuuuauuagauauuuucuucauuuacauuucaaaugcuaucccaaaaaguccccuauacccuccccccacccugcuccccuacccacucacucccacuucuugacccuggcguuccucuguacuggugcauauaaaguuugcaagaccaaggggccucucuucccaaugauggccaacuaggccaucuucugcuacaugugcagcuagagacaugagcucuggggguacugguuaguuucuuuaauguauguggaugcccuugcauuuggagcauagauauucagaauugagaauacaucuugguagauuuuuaucuuugaugaguaugaaguuccccuccuugucuuuuuugauaacuuuaaguugaaagucaauuuuauucgcuauuagaauggccauuccaggggauccaaaccauaaucagcaaccaaacacagacacaauugcauaugccagcaagauuuugccgacaggacccugauauagcugacucuugugaggcuaugccagugccuggcaaauacagaaguggauacuuagagucaucuauuggguggaacgcauggcccccaauggaggagcuagagaaaguacccaaggaguugaaggggucuguaaccauauaggaggaacagcaauaugaacuaaccaguacccccaaagcucgugucuauagcugcauauguagcagaagauggcuuacauugggccgauuggccaauuggccaucauugggaagagaggcccuuggucuugcaaagauuauaugccccaauacaggggaauaccaggaagaggcccuuggucuugcaaagauuauaugccccaauacaggggaauaccagggcuaggaagggggaguggguggguuggagagcaggguggggagaggauauaagggacuuuugggauaacauuugaaucguaaaugaagaaaauauuuaauaaaaaaaauguuaaaaaaaaaaaaagaauggcuauuccagcuuauuucuucuuaccauuugcuuggaaauuguuuuccagccuuuuacucugagguagugucuuugucccugagguagguuuccuguaugcagcaaaauguuggguacuguuuauguugccagucuguuaguguaugucuuuuuauugcggaauugaauugauugauauuaagagauaugaaggaaaaguaauuguuguuuccuguuauuuuuguuagaguuggaauucuauucuuguggcugucuucuuuucuguuucuugaaagauuacuuucuugcacuuucuaggggauaguuuccuuuuuguguuagaguuuucuccuuauuauccuuugaagugcuggauuugaggaaaguuauugugugaauuugauauugucauggaauacuuugguuucuccaccuaugguaaaugagagucuuucuggguauaguagccugggcugacauuugcauucucuuagggcuuguauaacaucuuuccaggauuuugucgcuuucauauuuucuggugagaagucugguguaauucuaauaggucugucuuuauauguuacuucacccuuuccccucaaugcuuuuaguauucuaucuuuguuuacugcauuuguuguuuugauuauuaugugaugggaggaauuucuuuucuaguacagucuauuugaaguucuucaggucucuuguauguucaugggcaucucuuucuuuagguuugggaagcuuucuucuauaauuuuguugaagauauuuacuggcccuuuaaguugaaaauguuccuucucaucuauaccuauuauccuuagguuugaucuucucauucuguccugaauuuccuggauguuuugaguuaggaucuuuuugcauuuugcauuuuauuugauuguugugccaauuuuuucuauggaaucuucugcaccucagacuuucucuuccaucucuuguauucuguugcugaucuacggcuccugauuucuuuccuaggauuuuggucuccagaguugucucccuuugucauuucuuuuuuguuucuacuuccauuuuuagauccuggaugguuuuguucaauuucuucgccuguuugguuauguuuuccucuaauucuuuaagggacuuuaguguuuguuuuuuaagggcuucuaccuguuuaccuguguucuccuguaauucuuuaagcgauuuuugugauuccucuuuaaggacuucuacuuguuuagcuguguucuccuguauuuauuuaaggaauuuauuaauguucuucucaaaauccucugcuagcuucuugagauaugauuuuuaaaucugaaucuugcuuuuccuuuguuuugguauauccaagacucucuguguuuggaguacuggguucugauauugccaaguaguauugguuucuguugguaaaauuuuuguguuugccucucgccaucuaguaaucucugguguuagauguucuagcugucucugacuggagcuuguuccuccugugauucuguaagccucugucagcacuccugggagaucgggucucuccuggaaagaccagugcacagagugcuguggaauagccacaccuccuggcugcagguguaggccuauaguaauauuucccagaaacuuuguugcuucugaggugcucuccugguguggaucagccuuacaaagaaaauggagagaaaauggcgauauccccugaguccaggggucagagcacucccuugaggcaaugucuccucuggcagggaaggugcauacaggacugaggaucaccuccaccuccuggcugcagauguaggcccacagguccugcaggccuguaugacugugucccagaaguucgguuguuucugaggccugugcucuccucuucagaccagcccuaaagagacacuggagagaaaaaucaacaccuugugucuuaucagaccaccauggauuaaagcugaaccagcaacaucagaaacaccagaaagccuacacacucauggaaauugaacaacucucuacucaaugaucucugaguaaaagaagaaguaaagaaaaaaauuaaaggcuuucuagaauucaguaaaaaugaagucacgauauacccaaaugcacaaugaaagcaaggcuaagagaaaguucauaccacuaagugcccucauaaagaaaacacaaaguuucauaccagugauuuaaaaguacaccugaaaguuuuggauaaaaaaaaaaaaaaaaaaaagaaaagaagcaagcacacuaaagacaaguagaaggcaggaaauaaucaaauucaagucugaaaucaguuagauacaaagaaaauaauagaaagaaucaacaaaacuaaaagcugauuuuuugagaaaauuaacaggauagacaaacccuuagauaaacuaaccaagaaaaagaagagagaagagagagaagagagaaaagaagagagaaaagagagaagagagaauccaaaugaacagaaacagaaaugaaaagggagacaucacagcagacauugaagaaauucaaagaaucaucaguuacaucaaaacucuguauugcaaaaaaaaaaaaaaaacaaaaaaaaaaacaaaaaaaaaaugagaaauuuaaugauaccacuuacugaaguuaaaucaaaaucagguaaacuaucuaaucaguccuauaaccccuaaggaaauagaaauauucauuaaaauucucccaaccaaagaaagccagauguuuuuaaugcagaauucuuucaguuugucaaagaauuaauaccaauauugcucgaacuauuccaaauaauagaaacagaaggaacgcugccaaacucauucuaugaggcuacagucacccugauaccuaagcuacauaaagacugaacaaagaacaagaacuucagaccaguaucucuuaugaacauugaugcaaaaauacucaauaaaauacaaacuaaguccaggaauacaucaaaaccaucauucacuaugaucauguaggcuucaucccaggaaugcaggggugguucacuauauggaaauccaucuaaguaacccaacacauaaacaaacugaaagcaaagaaaucacaucaucaucuaaguagcuccuggaaagccuuugacaaaaucuagugccccuuuaugcuaaaaauaaaucugauauuaaaaaugaaaucugggauagugugugugcuauucaauacaacaugccugcaauucuuccaucuccuuuccugcaauauucccuuggcaagaacucuagcagagcucuuuccuggguuuaccuuuaaauccuaaaagcucaaacauuauucauucauucaacuaaagaguuuuuauuccuauggguuauaauuucuagugguauuauaguuuggauaugaaguaucuucccucaaaaggcuuauguguuaggaugaaauuaaccuggugacauaauuugugagguuuucuggagacuuguugaguuguaaccuaacucaggggaacgccagggccaagaauuggaaguggguggguaggagagugggugggagagccugugggggacuuuugggauaucauuggaaauguaaaugaaauaaauacccaauuaaaaaauaaaaaagauuggaccccuugcaguugacuugcuucuggcuucuucauguccuguuuucuucugcuccccuauaccauaugcuccaacuaccaugggauucugaacaaucacccgggguaagauggauguugggugaaucuacugaaacaggagauugaauaaagauuuuuuuuucgaguacuaagaagaaaauucauaccacuaagugucuugguaaagaaacuugagagaucuuacauuagaaacuuaacagcacaccugagaguucaagaacaaaaagaaguaaacacauccaagaguugacagcaggaaauagucacauucagggcugaaaucaaccaaauauaaacaaagagaauaauacaaagaaucaaugcaaccaaaaacugagagaaucaacaagauagauaaacacuagccaaacuaacuuaaggguccagaggcaguauccaaauuaacaaaucagaaaugaaaagggagacauaacaacaaaaauggaggaaauuuuaaaaaaaucaucagauccuacuacaaaagccuauauucagcaaaacuggaaauucuagaugaaaugaaucguuuucuagacagguaccacauaccaaguuauaucacgaacagguaaacuaucugaacaagaccauauuccauaaggaaauagaggucauuaaaaaccucccaaccaaaaaaagcccaauacccagacagauuuagugaugauuucuaccaaaccuucaaagaagaccuaauaccaauaguccucaaacuauuccauaaaauagaaacagaaggaaugcuaccuaauucguucuaugaaaccaaaauuaccuugauaccuaaaccauacaaggacccagccaaaacagagaacuucaaaccaaucucauuuacaaauaucgaugauaaaauaguuaauaaaauucuugcaaaccaagaacacaucaaaacggcauucaccacgauuaaguaggcuucauucuagggaugcagcgaugguucaacauauggaaauccaccaauguaauccauuauauaaacaaacucaaagacaaaaaccacaugaucaucucacacucagcuccuccugcaucuugccugccuaugugcugccccucucccaccuugaugaugauggacugaaccucuaacccuguaagacagcccaauuaaauauuguccuuuauaagacuugccuugaucaugauaucuauucacagcaguaaaauccuaacuaagacacuauguuaauccuguaaauccaugagcaugggagaucuuuccaucugaggucuucuuugauuucuuuuuuuuuuuucagagacuugauguucuugucauacagaucuuucacuugcuugguuaaagucacaccaagguauuuuauaugauugugacuagugugaagggugucguuucccuuauuucuuucucauccuguuuauccuuugaguagaggaaggcuacugauuuauuuuaguugauuuuauauucacuuugcugaauuuguuuaucagcuguaggauuucucuugaaauuuuugcgguuacuuaucauaucugcaaauagugauaucuugacuuucuccuuuccaauuuguaccccuuugaucuccuuuuguugccuaauugaucuggcuagaacuuaagaguacuauauugaauagauugggggauaguagguagccuugucuugucccuaauuuuagugggauugcuucaaguuucucuccauuuaauuugauguuggguauugguuugcuauauauugcuuuuaauauguuuauuuaugaaccuugagcuccugaugccuacaguauuuuaacaugaagcgguuuuguauuuugucaaugauuuuucaucaucuaaugagauauucauguguuuuuuuucccuuugaguuuguuuauauaguuaauuaccuugauggauuucuguauauugaaccaucccugcaucccugggaucaggaaugccuacuggaucaagaugaaugauuguuuugauguguucuuggauuugguuugugagaguuuuauuaaguauuuucgcauugauauucauaaaggaaauuggucugaaguccucuuuccuuguugggucuuuguaugguuuagauaucaggguaauugugauuuuauagaauucuguuucuauguugugaaauacuuugaguaguauugguauuaggguuuuuuuuuuuuuaauggucuggccugauaaaauucugcaauagagccaccuguuucuggguuuuuguuguuguuguuguugggagacuuuucaguacugcuucuauuuucuuaggagagaaccaaauaucccuauuuuuaaaaaugggguacagagcuaaacaaagaauucucaacugaggaauuuugaagggcugagaagcaccuguaggaguguucaacauccuuaguuaucagugaacuacgaguuauaacaacccugagauuccaccccacaccaaucagaauaucuaagaccaaaaucucaacugacagcacaugcuggcaaggauguggagaaagagaagcacuccuccauugcuggugggacugcaagcugguaaaaccacuuaggaaaucaauaugucaguuccucagaaaauuggaaauaguuucacuugaagacccaacuauaccacuacugggccuauauccaaaagaugcuccaacauauaacaaggacuaauguucucguauauuuauaacuuucugauuuauaauagccagaagcuggaaacaucccagaugucccucaacauaagaauggauacagaaaaugugguacauuuacacaaugaguacuacacagcuaauuaagcaaugaauuuaugaaauucucagacauauguauggauuuggaggauaucauccugagugaggcaacccaaucacaaauaaacacacuuagucuucucaggaagcucagaauacccacaauauaacccacaaaccauaugaagcuuaagaagaaguaagaccaaaguguguaugcuucaauccuacauagaaggggggaaaaauagucacagugguagauggagggaccuaagagugagagaggagguggagggaaaaaauaaaaggaagggcaagauuagguauuggaagagauaggagagaaguacagagguuuaggaaauuaaauagaaguauauaguagugggguguggggggacuggagguagccaauagaaagucccaaacuugagugaagcgagagacucccugguuccaugggagaugacuuuagccaaaauaccuaacaaaggggagauagaaccuguagagaccaccuucaguagauaggcauggccuccaguugagggauguggccacccacacaucucaaaguuuuuaacccagaaauguuccuguccaaaggaaagauagaaacaaaaaaauggaacagacacagaaggaaaggccauccagagacugccccaccuagggauucauccuaucugcagacaucaaacccagacacuauacuugaugccaagaagugcuugcugauaggagccugguggucuggcuauuccccgagagguucuacgagcaacugaucaauacagauacagaugcucauagccaaccuuuggacugagcccagggauuccaauggaagaguuaggggaaggauugaaggagcugaaggggauuguaaccccauaggaagaacaguaucuacuaacuagacuaccuagagcuuccagggaccaaaccaccaaacaaauaguauacauggagggagccauggcuucagauaugaauguagcagagaauggaguuaucugcuaucagugggaggggagacccuucguccugugaagucuugaugccccagcauaggggaaugcuagaguggugaggccggaguuggugaguggguggaggagcacccucauagaggcaaagaagaggaagggguuugggauggggaaggucuguggaugaguaaccaggaaaggggauaucguuugaaauguaaaugaauaaaaugauuaauaaaaaaaauguucuauacuaauuaacuuuacugccuguguuguuugguacaaauaauacaaugaaugaauagcugcacauaauauugauacaguuuuauaagucauaaaacauuuuauuuuuuaaaagaaacuagcaguuuuagguuuuucaguuuuucuuaauuaauauuuuuagagauccuuuuaauauagauuuauauugagcaaaaaaucaaaccaagcaucuuuuuucagaaaugguaaugguuaaaauaaugaacaaauuaauuuuuaugggagucuucagcacagcagugaaguguacacaaugauggaggaguacucaguucuguagaaguagcacagcagugaaguguacacgaugauggaggaguacucaguucuguagacauagcacagcagugaauuguacacaaugauggaggaguacucaguucuguagaaguagcacagcagugaaguguacacgaugauggaggaguacucaguucuguagaaauagcacagcagugaaguguacauggugauggaggaguacucaguucuguagaaauagcacagcagugaaguguacacgaugauggaggaguacucaguucuguagaaguagcacagcagugaaguguacacgaugauggaggaguacucaguucuguagaaguagcacagcagugaaguguacacgaugauggaggaguacucaguucuguagaaguagcacagcagugaaguguacacgaugauggaggaguacucaguucuguagaaauagcacagcagugaaguguacauggugauggaggaguacucaguucuguagaaguagcacagcagugaaguguacacgaugauggaggaguacucaguucuguagaaguagcacagcagugaaguguacacgaugauggaggaguacucaguucuguagaaguagcacagcagugaaguguacacgaugauggaggaguacucaguuccaugguaaauuugagugguagcccaggaggguuauaauccaggcggugguaagaguggaagauccaggaaauguccuggaaggagggaagccugaaauucauauuaaauaagcuacuagaaauacagaaaagguagcagacauugaggagaggaggaaaguagcuuuugucuuacuaggagguuuccaugcuaucaguuacuguugaacaacacucagcaagaucaaaugacacauuccaaaguaauuugugaaguuaugguuuugcacuuuucuacauauacauacuaugaugaaguuuccuguccugcuauucuagcuugaccaagacacacaucuucuuauccagugcacccauacuguacaugcuguuuaccugcuggucacauaguagccaacucugcuaugagacaaacuguggaauaguccauugcuugugcugcaauaaccugucugcuuuauucauacauccaaguaaaagagaagugguuugcaauguggaucuaccaaggaaccaaagaccuauguguuucuuuuaaauggaagggggaagguuuuuaaugguuucacaaauaaucuguaccugagagaaggaaaaacuaacucauauaguuuacuggccucuccuuaacugcaaaaccacacuacaugauaaaugcuuaguugugacagaaaaagcauuacauuaguauaguucgugugugugugugugugugugugugugugugcgcgcgcgcgcgcgugcauacacuucaugguucuguacuaucuauucagguguucacuuggcauuugaggauguaucucccaaauuggaguguuuucaucagaagaaauuguauaagcacagacacagaaacaagaaaucuuuuguacauuuuguucgggagaaaaugacuaaacuagagagggucccaauugaaauaaaauuauuaauuuacaaaaugaaaauacuuaauagaauaugccaguaugccagcuuucuuuuuuuguuuuuuugggguuuucuuuuuuugguuuguuuuuuuuuuuuuuuuuuuuuuuuugguuuuuugaaacaggguuucucuguguagcccuggcuguccuggaacucacuuuguagaccaggcuggccucgaauucagaaauccccgugccucugccucccaagugcugcgauuaaaggcgugcgccaucaccacccggcuaugccagcuuucaaaacaaaaauuuaccaugauuuuugcuuaucuaccuauuaaacaucuugagccagaauugaaauucagcuggauuauguucauauuaacauaaauguugcaaaaugaguuucuaacugguuucauacuaugggaggauaucuaagugccucugguuccuugcucucuaguuuuuaugaaagagggagggguaccagguuacacuguauccuuuaguuacauucugauagugccugugugcucagcugaaaaaaauagguaccacuuugcuguuguguuaaacuuucaaagcuaaagcuuauacucuaguacagaaagaccucucucacacacuguguaugacucucucuuuucuuagggaaaaguaaacagaggguuucaucucauauaugucaccuuaguccacaacaagggauuccauccaggucaagcuugaugaaccgcugagggguguguguguguguguguguguguguguguguguguuugugcaugugcguguguguguguuccuuacagaagaagcaaaagugacauucccacagcugcaucaccaugaagucuauccuagcuuaggugcugucucaugagagcuagcuccaccagccuccuagccagcaauugcuuacugcuuauguaaucuugacuauguaagugccaugacuuucugagcuuccugaggcuuguaacccuguauucuccugccagaaaagauuauuucaauucagaagaaaugcacaagacuaauaauuccuuauucuuaagaacaaauucaauuacuauuaacaugcuuauuuaacucagagaauuuuuuucugaauauuguagaugaaaaugauuuacaucguagaaucugaggaaauauuuugcccaguuaauuucuacaguuuaucaggcaguucugggaaacaauauaaucauuuauuccaguuaucaaauguauaugauauuaauauucuucauucugcuauauaaucuugagggcuaacccucaagaucuccccuacaccaagcacaaacaaacauucacgcugacuugcuaacuccaucuaugguuaucugaugguccucccuaacuaacuggccaggaagcucuagucauaaguacuucugcucuccagacacaugcuugcuaaguagccagcuccugccuuaggaagaacugagggucaguucuucagacaucgccuuuguuuccuuaagugauguugauaagacuagaaacaguuacuugguuuuaguuguuuuuguaugcauauaaauauaaauauaaguauauacuuauauguaaccauacgcauauuuauguaaguaaaaauuacugucaaauuaguuuaggaacuuguggucuaaaagacugcacuaauuguuagggagaugacuuaaauuccuaaaguaccaguggccuuuucuauacagaggguacagaggagauaauccugugagugcccagcaggucuugaggauuaaaugaauuagagcauauuaagcuuuagcaaauacagagcaagcacuugaaaaugauagcugcugcuaucaguguuuucaugcacuuaaaauucuuugaaaaucucaggcucuucucuuucuuaucuguugagcugcccucauuuuucaguuuguauuuaauacacuauuaaguucgugucaaccugaaaauagcuaaagaauguagcaaauuuauaacaauagggagagaaaucaacuauaauuauuuuuaucuucagguaaaaauauguccacaacauucacugucaagguuacuacuguuccacaucccauaccuccuccaugccucccugucuccacaaggauguuacccccuacacacauaccaugagaccucuaaacucccuugggccuccagucucuugaggguuaugugcaucuugucugacugaaaccaguccucugcauauauauauguguguuggggccucauaucagcuggugguccagugucugagagaucucgggguuccagagaaugcugguccuuuuacaggaucgcccuccuccucagauucuuccagauuuucccuaauucaaccauagggguugccagcuucuguccauugguugggugcaaauaucugccucuaacucaguugcuuguugggucuuucagaggacagucauaauaggucccuuuuugugagcucuccauagccuuaguaauagugauauuuuauauuuuuaaauaaauguacucuagaagauuuaggcgaauguauugaacuagaaaauaucuugagugagguagcacagucauaaaagaacacaugguaugcacucauuaauaaguggacauuagccccgaagcucagaauacccaagauacaauucacagaccacaugaagcucaagaagaaggaagaccaaaguguaggugcuuugguccuuagaagggguaauaaaauauccaugggaggaaguacagagacaaaguguaagagcagagacucaaagaaaggccauccagagacugccccaccuggggauccauccaacaguuacaaaaggcagaugcuauuguggaugccaagaagugcuugcuugcaggagccugauauagcugucuccugagaggcucuggcaagagccugacagauacagaguuagaugcucgaagccaaccaugggacugagcacaggguucccaauggaggagauagggaaaggccugaaggagcuaagcagguuugcaacccuauaggaugaacaauaucaaccaaccagucccagggacuaaaccaccagccagagaauacuuauggaggaaccuauggcucaagcugcauauguagcagaggauggccuuaucuagcaucaucagugggaggggaggcccauuguccucugaaggcuugaugccccagcuuaggggaauaguagagcaguaagcggaagugggugguuggauaggggagcacucucauagaagcagggagaaagcugaugggaucagggauuucagauguggggguggaaugggaaaggagauaacauuugaaguguaaauaacauaauggcuaauaaagagugagguaagccaaucacaaaagaacacacaugauaugcacucccugauaaguggauaguagcucagaaacuuagacuaaccaagauacaauuuacaaaacacaugaaacucaaggaagaccaaaauguggauacuucguuccuucuuagaauggggaacauaauacccauggaaggaguuaaaagagacaaaguucagugcugagacaguagaaaggaccauccagagauugucccaccugggaauccaaaccauauacaaccaccaagcccagacacuauugcauaugccagcaagauuuugcugcaaggauucugauauagcucucucuugugaggcuaugccagugccuggcaaacacagaaguggaugcucacagucaucuauuggauggaacacagggccccuaaacaaggagcuagagaaauauccaaggagcucaaugggucgacaaaccuaugggaggaucaacaauaugaacuaaccaguaccccaccgaacugugucucuaacugcauauguagcagaggauggccuagucggccaucaauggaaggagaagcccuuggucuugcgaagaucauaugccccaauacaagggaaugccagggccaggaagugggugggcugcgaagcagggcagggggaggguguaggggguuuuggggauaacauuugaaauguaaaugaagaaaauaucuaguaaaaaaaaaagaaguggaaaaauuuugaaaaaaaaaaaagauuugaugacauaguacguggaaauaggugacgccaaagaauguggccuagugugacauaaaacagcucuauguuugugaccuugguggaguuugaugaagguguuauucccucaucuugaugagcuccauagaaaauuuuguucuuuucacaguauggauuuuacauuaugaacaauuugaucuuacauuuaauuuauaguuauauauuccauuguuucaugaagucugcagauucuucuuuucaauuaucaguuuguaucaaggccuggccuguguuucuuuaacuaagcugugcucccaaucuucuaguuaggcaaccaccaaaauuaagauaugauagaaggucagugaaagaaacucauagcaaaaaaacuguucaucaugucauuaugacaggcugcuguaacaaauguguuucuguuuuaacuuaggaaauuaauugcuaaaaguaauuuaaucugacagaggugggcuguugaaaggcuccuggagauaucauaaaagcgaccuucugcucaugugcugccgaaagccauuuuuuaacaaggagcuaaggaaacacugcaacuucuuuauacuuuguuaauuaguuauugguuugaaccaacacacuuccaaauacuguugggugaacuagaugccagcaaggucagugugcagcucuugacuucugacaguccuuuagcacaggugaaguucugaagacuuuuguucugguauuccagcauugagauugcaugguuugcuaaaaugaccagccuuuuuuaauucauauuuucauguucaaauauuuuauaugcuaauaauauaaugcuuagucacaucuaauucugugacaugguuuccaaucuuuggcagccuuaaucucaaauaaauacauauucaucaaagaaaguauaugcauaucucuuuaaagaauuagcaaguuagagauuccacaauuauuuauuggguauaauagcuucucuuuuuuuaaauuugaaauuucauuuuaguaucaguuauuuuauaauuuugcuaacagaaguuaaauaaauuccuucuaauucuuuuuaaaauuuguauuaguucuaugaaaauuuuauacaaugugcuuugguaaugucuauuacccucaaacacuucucagacaacuucacauucucuguccagccaacauuguguccuuaaaaaaaaaaaaagaaagaaagaaagaaagaaggaaaagaaaggaaagaagagaaaagaaaggaaaagaaaagagaagagaauaacccauuaagaccaauuagugaugccaaaauaucuuugaaguauggccuaucacuggaacauggucaacauagcaggaacuacacucuuagagaacucuuaaaccuuccaccucccaaaaacuaauaauuugccaguugcuccaaauuagagguaggauuucaugcccagauccauugugcugauuuuauucuuuuuuuuuuuuuuuuaaaucaacuugacgaaaucuugaaucaucuggccagagggaaccuccacugaggaaaugucucugucagacugaccugaaggcaagucugugggacuuuuuccuuauuauugauugcugugagaggacccagcccacugugggccuguacaaccacuucugagccgguaguccuauguuauauaaaaaaagcaagaugagaagccauggauaaaggccaauacacagcauuuuuccaugaucucugcuucaguuccugccugacuuaacucagugauggacuaugaccugagaguuauaagcuaaaaauuacuuuuuucuuccccaagaugguuuuaguaucuuauccuagcaacagaggagcaaaguagaacacucccacuacuccugggauuuggucuauuaugaacuuggguuuucugcauuccuucacaaccacugugaguucacaugugcugcccuucuguauccagaagacauuucuuuuuuuuuuuuuuuacuagauauuuucuucauuuacauuucaaauguuauccccaaaaccccuacacccucccccggcccugcuccccaacccacccacucccgcuuccuggcccuggcauuccccuauacuggggcauaugauccucccaagaccaggcgccucuccucccauugauggccgacuaggccaucaccagaagacauuucuugagcugcugauucugcaucuuguacuuuuucuacucccauuuccaaaauaaucccugagucuuugggaaggggauacagaaaaaaaaauguauugugugugugugugugugugugugugugcauguauguguguguauauauauacaugaggucugcccugacaccuccugucacuccacggauuaaacuuauuuucucuucucagcaaguucaguuauuaacuuuuaacaaagugacuagguuuucauuuauucauuuuuaaaauaugacaaaauaaaauagaauaagaugaaauaaaagcuaugucauugaauguaggcaagacaaaugaacagaaggaaaccagcacaaaagaagacaugagaucagagacccacuuguucauacucucagguaucuuauaaaaauacucuaaacuggaagcaaugauauaagcacagacaaccuggugcagauccaugcaggcuguguccaugcuguuuuauugucugugaguucaugagagcuuugcccuuguugauuuugaggguguuuuccuaguauccuccauccccucuaagaagaaucauaucucauuaggaaagggaaauagaagaggaagauagugaugaaaguuggagacaaugacuggaauggaaggaucuaguuguggggagagguaaguaaaauuaaguaacauuggaggguuaguauggaaaccuaauacaguagaaaauauagaaaggcaauacuaaugaaaucuccaaauaauggggcagacugucccaacuggcagucucauguugccaacaaagcuuccaguacugggguuagguuacaucuaauugaauuauuggacaaaggggccccauugcaauccccaaauuauccaagcuguugccaagacuauagauugcucucuacaaacuaacagcaagaccccauugcuaaagccaacacguacacaagucauugaacauggagagguagaguuggugcccacauagagcaccaguaacgaguuauaggacaggaagguacucugcacacugucaaaagaaaaacauaaacaccaagccagccacaaacccauuauuuguaauaguguauuauuacccacauauaugucaggacagugauaacaaaaacuuguuaagauuauugaacguccaaaaaguauuucucagccauuuguauauuaucuuuugagaacucuauuuagucucaugccuucuuuuuucuuuuugcaauuauaauauacaaacaaaguuuuucucuuuuucugccuccaaacuauaccauauaccuuuccuucucucuuuagacuucauggcuccuauuuuuaauaauuguuacauguaugugugccugugugugugcauauauguguauucauacauacauauauaucccuaaauauaaccucagucuuauaauauuaauuguaugugugguuuuagggcugcccauuugguauuagguaaccaauuguugugcuccucccuggagaggaugcuuucucccacucuuagcauuccuuaguggcuuagaguagaggccucaugggcuuuucuucccauccacuuugggaugucuauuguugucaucccugaucagcuuguuuguuguuguuuguuuaguucucuuuacauccuagauucuaaacauuugccauaugaaucauugcuaaagauuuuccccacuuugucacuuaccucuucacuugaggugcaguguccuuugcuauacagaaacuuucuaguuucaggagcucccacuuauuauucuuaaucucagugccugugcuaucgggguccuguuaagaaaguccuuuacugugucaaggauuucaaacgcauuccuuauuuucuccucuauuagauuccggcuauugggucuuuuuuuuuucuuucaauuuuuuuauuagauuuuuuuuuauugaauagaauuagacauguuauaaaaugguuuuucuguaaaaaaaaaaaacaauauuagagguugaauuggaguuauacauuuaaaaaaaaccauuagcuuuuaacauuauuuaucucuuuuuuccuuuuuucccucccccccuuuuuuguuagauauuuucuuuauuuaaauuucaaauguuauccccuuuucuaauuuccccuccaaaaauccccauccccuccccacugccccugcucccuaacccacucacucccauacuuguuccugguauuccccuacacucaaguguagaaccuucacaggaccaagagccucuccucccauugauaacugaauaggccauccucugauacaaauauagcuagagccacaaguuccaccaugucuuugcuuugauuggugguauaguuccaaggagcucuuaggguacuguuuaguucauauagauguuucuucuauggggcuucaguccccuucagcucccuagguauuucucuagcuccuucacugggaaccuugugcaucguccaauggaugacugugagcauccacuucucuauuugccaggcacugacaaaggcccucaggagacagcuauaucaggcuucugucagcaggcucuuguuggaaucugccuagugucugcguuuggugguugucugugggguggguccucaaguggggcagucucuggauggucauuccuucaggcuuugcuccgaacuuugucauuguaacuccauccauggguauuauguucccccuucuaggaaagaacaaaguauccacacuuugcuuuuccuucuucaguuucauguguuuugcaaauuauacuuggguauucuaaguugcugggugaauauucccuuaucagugagugcauaucauguguguucuuuugugauugguuuaccucagucagcaugauaucuaccacauacauccauuugccuaagaauuucauaaauucuuuguuuuuaauagcuggguaguacuccauuguguaaauguaccauauuuucuguauccauucuucuguugagggaugucuggguuguuuccagcuucuggcucuuauaaaugaggcugcugugaacaaaguggagcauguguccuuaguacauguuggaacaucuucuggguauauccccaggagugguauugccuaaucuuucuaaaacuuuuauuaugaauggguguuugguuuugucaaaugcuuucucagcaucuaaugagaugaucaugugguucuuguuguugaguuuguuuauauaguggauuacauugguggauuucuguauauuaaaccaucccugcaucccugguaugaagccuacuugaucauguuggaugauccuuuuugauguguucuugaauacaguuugcgagaauuuuauugaguguuuuugcauugauauucaugagggaaaauggucugaaguuuucuuucuuuguugggucuuuguguuguuuagguaucagaguaauaguggcuucauacacugaguuggguagaguaccuucuguuucuauuuugugaaauaguuugaggagaauuggaauuaggucuucuuuuaaggucugauagaauucugcacuaaacccauuugguccugggcuuuuuuugguuaggagaauauuaaugacugcuucuauuucucuagaagauaaagaacuguuuagaucauuuaucugauccugauuuaaaguugguaccugguaucugucuaugaaguuguccauuucauucauguuuucaaguuuuguuaaguuuagccuuuuguaauaggaucugaugaugcuuuggauuuccucagguucuguuguuaugucucccuuuucauuucugauuuuguuaauuaggauacugucccugugcccucuugugagucuggcuaaggguuuauccaucuuguugauuuucucaaagaaccagcuccugguuuaguugauucuuuguauaguucuuuuuguuccuacuugguuaauuucagcccugaguuugauuguuuccugcuaucuacuugucuuaauuuguuuccuuuuguucuagaguuuuugguuugcugucagguugcuaguguaugcucucucuaguuucuuuuuggcagcacucagagcuaugaguuuuccuuuuagcacugcuuucauugugccccauaaguuuggguauguugugucuucauuuucauuaaacucuaaaaagucuuuaauuucuucuuuauuucuuccuuaacuaacguaucauugaguagaguguuguucagcuuccaugucaacauuggcuuucuauuauuuauguuguuauugaagaucagacuuaguccauggugaucugauagaaugcaugggauaauuucaauauuuuuguaucuguggaggccuguuuuguggccaauuauauugucaauuuuggagaaguuaccaugagguacugagaagaagguauauucuuuuguuuuagaauaaaacauucuguagguaucuguuaaauccauuuguuucauaacuucuguucauuucaccgugucucuguuuaguuucuguuccuaggauauguccauuggugagagugggauguugaaaucuuccacuauuacugugugugguauaaagugugcuuugagcuuuacuaaaguuucuuuaauguauguggauguccuugcauuuggagcauagaugaucagaauugagaguuugucuugagagauuuuaccuuugaugaguaugaagugccccuccuuuucuuuuugauaaccuuggguuagaagucgauuuuauuugauauuagaauggcuacuccagcuuguuucuucagaccauuugcuucgaaaauuguuuuccaggcucuuacucugagguagugucugucuuuaucccugagguguguuuacuguauacagcaaaaaguuggguccuuuuuacuaaaccagucuguuagucucuguuuuuuaauuggggaauugaguccauugauguuaagagauauuaagguaaaguaauuguuauuucguguuauuuuugcuuuuagaguugggauucuauucugguggcuaucuucuuuuugguuuguugaaggauuacuuuauugcuuuuucuaaggugucauuucccuccuuguguuggagauuucccuuuauuauccuuugaaaggcuagauucauggaaagauauugugugggugugguuuuguuauggaauacuuugguuucuccaucuaugggaauugagaguuuugcuggguauaguagccugggcuggcauuuguguuuucuuagggucuguauaaccucugccaaggaugucugacugucauagucuuuagcaagaagucugguguaauucaaauagaucugcuuuuauacguuacuuaaccuuuuucccuuacugcuuuuaauauucuauccuuauucugugcaucuguuguucugauuauuaugugucaggaggcauuucuuuugugguccagucuauuuggaguucgguuggcuucuuguauguucacgggcaucucuuucuuuagguuagggaaguuuucgucuauuauuuuuuuugaagauauuuacuggcccuuuaacuugaaaaaucuucauucucaucuauaccuauuauccuuagguuuggacuucucauuguguccuggauugccuggauguuuugaguuaggaucuuuuugcauuuuguacuuucuuugauuguuguguccauguuuucuauggaaucuucugcaccugagauucucucuuccaucucuuauauucuguugcugaugcucgcaucuauauuuccugauuuuuuuucuguuauuucaaucuccagaguugucucccuuugugauuucuuuauuauuucuacuuccauuuuuagacccuguauuguuuuguacaguucuuucaccuguuugguaguguuuuccuguaacucuuuaagggauuuuuguguuuccucuuuaagggcuucuagcuguuuaccuguguucuucuguauuucuuucuuaaaguccuacaucaucaucaucaucaugagaagugacuuuagauccaugucuugcuuuuaugguuugaugguguguccaggacuugcuaugguaggagaguuuuguucugaugaugccaaguaaccuuggucucuguugcuucuguucuuaugcuugccuccugcucugauuaucucaagugauugcugcccuuuauauaugugauuggauccugucuuuccuauaaucucgguugauucaggacuccuuagaguccaguguucucuaugauucccggcuccugugaacaugagauuuugggugugucagauuucuuggcagucaagcuuccuuugagacccugagauccuggugugaccaaucuccuguuaucuugggauccuggaauccuaagauccugggcauguuacagugccuggaaauagugucuccucuuaggaccaugccaguacagaucagaaggaaaccggggucaggcagggguccccuguccuuguuccugcugucacaggccugucacaauuggauuguaacuuauguuguguuccacucaccagugauccuaagauugaguggagaguccucuggggauccuggggccaucuacugaguucccacccaacucgaccuggaccuggcgccgaccugaagggacuugugcccccagucaggcagguuuucugcuuccccuaugcuggcucaggccaggcaugauuggauugggacagauguucuguuccacucaccagugauccuaagagaguccucuggggaccgaggggccauucgccaaguucgcacccaaggugaccuggagauggugcugaucaggguauugggucuuaucucaaugucuuugauacauuuagaguugaauuuuuaugcagaauggaauauaugguuuaaauuuuauucuucugcguacaacuaucaaguuugauuagcaacaucucuugacagugguuacuuuucuucauuaugucaaaaaucagauaccccauuuuaguccauucaucagugagacugcuuuucaugccagccucaugcucuuuccuccauaacaguucuguaguaugacuugaaaucugggauggugaucccuccagcagauugguagucauccuuguccucgucauuauuuuagcuguuuuaggccuauugguuuuucauucaugugaaauuuauuuuucuuucacuuccuauaaagagcugaguuguaauuuugauggggauuugcacugaaucuauaaguuguuuugguagaauauccacuuuuacaauauuacucuuaccaauccaugagcauggaagaccauuccaucauuuggaaucuuuaacuucuuuuuucaguacuguaaaguuuucuuuguacaagucuuucauuuccuuaguugggauuauuccaaggauuguuuuuauuuuagcuauucugaauauucugauuuucaaauaucuuuucaguguguuugauauuuguguaucggaaugcuacugcuuucccuguauuaauuugaugugcagcuacuuugauguaugauuuauuaccuggaggaguuuuccaguauuguccccaauguccuuauauaaagaauucuuaauaagaaaucaucauuugcauguguagaguaagauacguuguguuuugucuuuuucuguuuguauucccuuuaucuccucuuguccuauuguuccaccuaagacuggagguacuguguugaacaggauugaggaaacugcacauccuugucuuguuccugguuuuaguggaaaugcuggaauuuuuucucugguuugagugacucugcucugaguuuccaguacauugccucuauuguguuaauaagggucuuuguaucuauauucuugccaggacuuuuaucaugaagguauguuguauuuugucagagaccuuuauaucauaauauaaguuuacucaaauaguugaacuugaaaacuugaaaguuuugggaaagucuguacucuuuuuaaauucgauuucugaacagagcauucaagaacaaauuaaaguuuuuguggaucaacuugugagaccuguggaagagagauggagagauggcacuguacuaaaacaaggugguuuaaacucucccuucuuacucuuuagugugaaucaugcuaacuagcuuugugagcgugagaagcccaugcugucucacugugccucacucaugcaccggccucauagugucacugugaaauuucaaggaaugaccacuugaccggaaacuaguaauaguaacuacccaauaacuguuaguggccauuuuuacaugauaguuaauaauaacauuaauuuuauauucaaaauuuuguauuuuaaauuacaugguuuucaggaggucaugauaaauaaaauuacuuguuuuucugaaaauguucuuauuaacuagugugugcuugauauuuguagaaaaucuuuaaauagcauggcagaguugugcucucuuuuugcauuuuauacuggacaguaaagaaaacauuuucuacauccuucuaaaaacagaacugcuaauuaaguauagcaauuuguuauuuuauuaaaaugugccaaguuuuucaguuuguuuagauggugaaaaaucuggguucacaguagauaaaauauauuucuuagaguagauguauucuaaaaugucuugcuuuuaauuaaaauuuacccagcuuuaagacaacuucaagauuuucaaguuaaauuaugucaguaaauaauaauuuuccacagaaaaacaaaaucaaaagauuauuuuacuaagcaccagauuauuauaugaauuauauaauaucuccauuuucuuaauaucuuuguuugaaggaaauacaaagaaaggugcuacaaucaacaaauauuuguucagaagcuugauucauaaaaguuugauuggccuaaaugcugugauuaccauaauguccuaugauaccagguuuauuagguuccaacaauugaacccagaguauggguuagacuauguaggcauugcaucaacuaagucauauuuaaaacauacaaauguuuucaaugacuauaauacauacuuauuauccaccauacauagcuauuacuaacuaaguaguaaaaauguuccuuucccguguugugguaggacuaugagaaauaaguuuuaaaauaguuauugacauuuuuauguagaucaugcuuaggcaaccauauuguugagauuucauagguacagcuuucaugguaguccagaaguccugugucauaguaggugucuuggucuucuggccuucaugaucuuccucagcuuucccuaauccuuagguguaaggguuccacuauauauaugaugaccacaauuggacacccacagucauguauucucaucauuaugacuaguugugggucucuguaauagucuccagauugcggaaaccucacaaggccuuaucccuagaugaagagcuaccagcaaucaacagcugccaagaaagggagaaucuguccuuucuaggaaugugucucaagaaaacuuuucaguccuaauagaucaguccugaauacauacacaucuaaucaccacuaaaugaaucuaauaggcuauauguguaucuguguguauauguauguguauguaacaauaaugauuaaaaagaugguggucaugaaguuuagagggaguugggagugauagagaugagugaaaacgcagacaugacucccucuaguugagcagauuuuuauuauaccucagaggaacagccagaggcaucuagaacacuccacacugaacauggccaguagguugaaccagggcaugaggggcagaggguuuggagagacagcaagagaggagaggagaggagaggagaggaacaagaggccaagagaggagccaggggccaagaaagugauuaguuagccaaaauggcugggguuacagagaacaagagaagcugggagaaggggaagcagaguucuggggcuggagaggucuaggguugauggugagggugaaaagacagggcuauucucugagagccugacagccaaggguccaauucuguauguuacuagauagcucaguuagccauuuguccuggcuuucuucgagucucacugaacaauuauaaauuauggagaaucagucuucuuaagggugugaguccccaauaggucaccuaugcuccaguaaagacauauauccaagaguauaaguggagaagucuagggauaggaagccuaccuaguuuucugacaggcauggccuguguuugggcagggggugggacauagugauuaaggcauuagggacagcugagaauuuggucugucagaaacuagagauuggagguugguguagggaaauguuuaccuaagagauuggagagaguagggauggacuggggcaggcagccuaccugaacuucucaaauaccuggccugugguugggcagggagugucugcuaauggaaagcaagagaaugggggaggaggcaaugcaugaauggauagacuaccugguuuucuaucaucaaauucuuuuucuuuuccuuuuuuuuauuagcuacuuuauuuacauuucaaauguuauucccuuuccuaguuucccucugaaaauccccuauccccuccgccccucccccuacuccccaacccacccacucccucuuccuggcccuggcauuccccuauacuggggcauagaaccuuuacaggacuuacggccucuccucccauugaugaccaacuaggccaucuucagcuacauaucccauuagagccacauguaccaccauguguuuucuuugauuggugguauaguuccaaggaacucuagggguacugcuuauuucauauuuugauguuccuccuauggggcuucagaccccuucaccuccuaggggagcucuccaguuccuucauuggggaccuugugcucuguccaauggauaauugugagcauccacuucuguauuugccaggcacugacaaaggcccccaggagacagcuauaucaggcuccugucagcaggcucuuguuggcaucugccauagugucuggauuuggugguuguuuaugggauggauccccaaguggggcagucucuacucugaacuuugucucuuuaacuccuuccauggauauuuuguucccccuucuaagaggauucugagcuucugggcuaauauccgcuuaucaguaagugcauaucauguguguucuuuuuuuauuauuagguauuuuccucauuuauauuuccaaugcuaucccagaagucccccauacccucccacccuacccccuacccacucauucccacuuuuuggcccugguguuccccuguacuggggcauauaaaguuugcaaguccaaugggccucucuuucuagugauggccgacugggccaucuuuugauacauaugcagcuagagucaagagcucugggguacugguuaguucauaauguuguuccaccuauaggguugcagaucccuuuagcuccuuggguauuuucucuagcuccuccauugggggcccugugauccauccaauagcugacugugagcauccacuuauguguuugcuaggcccuggcauagucucacuagagacagcuauaucagggucucauguguguucuuuuuugauugguuuaccucacucaagaugauauccuccagauccauccauuugucuaagaauuucauaaacucauuguuuuuaauaacugaguaguacuccauuguguaaauguaccaccuucucuguauccauuccucuguuuaaggauaucuagaugcuuuccagcuucuggcuguuauaaauaaggcugcuaugaacaaaguggagcauauguccuuauugcauguuggaacaucuucuggguauaugcccaggagugguauugcuugaucuuccaguagaacuauguccaguuuucugagaaaucuucaaacugauuuccagacuuuuaguacagcuugcaaucccaccagcaauggagaaguguuccuuguucuucacauccuggccagcaucugcugucacccaaauuuuugaucuuagccauucugacuggugugagguggaaucucaggguuguuuugauuugcauuucccugaugauuaaggauguugaacauuauuuuagguguuucucagccauucuguguuccucagcugagaauucuuuguuuagcucuguacucccuuuuuuaauaggguuauuugguuuucuggagucccaacuucuugaguucuuuauauauauuggauauuagaccacuaucaaauauaggauugguaaagaucuuuuuguaaucuguugguugccuuuuggucuuauugacaguguccuuugucuuacagaagcugugcaauuuuaugaggucccauuugucuacucuuaaccuuauagcacaagccauugguguucuguucaggaaucaucccugugcccauaucuuugaggcucuuuuccacuuucuucucuauaaguuucagugucucugguuuuauguggaguucuuugauccacuuagauuugaccuuaguacaaggagauaggaauggaucaauucacauuguucuacaugcuaaccuccaguucaccuagcaccauuuguugaaaauacugucuucuuuccacugaaugguuuuagcuccuuuaucaaagaucaaguguccauagguguguggguucauuucuaaguuuucaauucuguuccauugaucuaccugucugucacuguaucaguaccaugcaauuuuauuacaauuguucuguaguacagguugagguccugcauggugauuccaccagagguucuuuuauuguugagaauaguuuuugcuauccuagguuuuuuguuauuccagagaauuuucaaauuacccuuucuaauucugugaagaacugaguuggaauuuuguuggggauugcauugaaucuguagauugcuuucagcaagaugcccauuuuaacuauauuaauccugacaucuaugagcaugggagaucuuuccaucuucugagaucuucguauucuuucuuagagacuugaaguucuuaucauacagaucuuucacuugcuuaguuauaaucacaccaagguauuuuauauuauuugugacuauugugaaggguguuguuucccuaauuucuuucucagccuguuuauccuuuguguagagaaaggccauugauuagaguuaauuuuguauccagcuacuuugcugaguuguuuaucagguuuaggaguucucugguggaauggagucacuucuguauacuaucauaucauagugauauuuugaguucuuccuguccaauuuguauuccuuugaucuuuuuuuuuuuuuucuaauugcucuugcuaggacuucuaguacuacauugaauagguauggaaaagugggcagccuugucuagucccugauuuuagugggauugcuuccagcuucucuccauuuacuuugauguugguuacugguuugcuguagauugcuuuuaucauguuuagguaugggccuugaauuccugaucuuuccaagacuuuuuucaugaagggguguuggauuuugucaaaugcuuucucagcaucuaaugagaugaucuugugguuuuugucuuugaguuuguuuauauaguggauuacguugauggaauuccauauagugaaccauccuugaauuccugggaugaagccuacuugaucauuuuggauaaucauuuugauguauccuuggauccuguuuuugaauauguuauugaguauuuuugcauugauauucauaagggaaauuggucugaaguucucuuucuuuguugggucuuugugugguuuagguaucagaguaauuauggcuucauagaauguaaucgguagaguaccgucuguuucuauuuuguggaauaguuugaggaacauuggaauuaggucuucuuugaaggucugauagaacucugcacuaaacccaucuggugcuacgcuuuuuuuuuuuuuuuuugguuuugagacuauuaaugauuauuucuauuucuuuaggagaugugggacuguuuaaaucaucaaucugauccuuauuuaacuuugauaccugguaucugucuaggaaauuguccauuucauccagguuuuccaguuuuguugaguauagccuuuuguaguaggaucagaugguuuuuuggauuuccucagauucuguuguuaugucucccuuuuuuauucuugauuuuguuaauuaggauacugucccuguguccucuaguuagucuggcuagggguuaaucuaucuuguugauuuuuuucaaagaaccagcuucugguuuguuugauucuuuguauaguucuuuuuguuuccacuugguuuauuuuagcccugucuuugauuauuuccuacugucuacuccucuugggugaauuugcuuccuuuuguucuagagcuuuuagguguacugucaaguugcuauuaguguaguguggacccacuuuagagagacacgggagagaauagaaaucuccacuguguccagggaucugagcacucccuggaggcaagcucuccucuggcugaaaggugcacaaaggacugagggucaacucugccuccugucuacagauguaagccuaaaggacucugucccagaugcucugcuuuuauguggccugugcucuccugaguggacccacccuagagaaucacuggagagaauccagugcucucuuuaaaugcagacauguugaauuuucaguaaguaaaccuauuuuuuacauucaagauauuuuuucaagugaaccugccccauaugauauaguauuuacguuaauaauuuaucaugcccuuguauuuaaggccuuuugcucuuugggucauuguuaauagauguccuuccagaguauaaugccuguaugcuuugacuuuuaaauuuggaauuuuuaaauaucuucauauuuauugcauuuuaucuugcuuuuucuaaaugacuuuuacauauaaaauuuaaauuauaggagcacucauuuuguaacuuuuuauuuauuuauuuauuuugguuucuugagacaggguuuuuccauguagcccugacuguguuggaacuuacucuguagaccaggcuggccucgaacucagaaaucugcuugucucugccucccaagugcucggauuaaaggugugagccaccacugccgggcucauuuuauaacuuugaagcaacaguuugcugaagagaaaucugucaaauuuggcagugguucagaaaauaugugaaccugucacuguaagcagucucaaagggcaaaaugcauuacaggagcuaauuaaccuuagaaaauaauuacacaaauaugcaaauauuguuucgcuuauucuaugugguaucagcucaugaaguccaucagaagcagagcucacagugcucaggugguggaggaccuggccugauugagaagacuuugcuugcugaaucagguuuuuguuuuguuuuguuuuguuuuuugcauuuagcaauugacgauggccagaguauagcagggaaggcagucuguguucucagaacugcaugcacacuucccugcuguccauacccugugguuuuugcuaccugcaaauuccagcugauguucuuagggcuuuucaugcauuucuuucuuuauauauucuaaagcaccuguaaguuucucaguacaaacuguaacuuuauuaaacacuuacaaaauagauuuuguuuguuucuauuucuguauuaggaagucuuuugaaaucaguucaauuuuaaaauguacuaucacuaacauucucucuaaauacuuuguaaauguauuaggauuauuggcauaauauggguuauagguuaugacacagcaucaccucauuuaaaaaugagucacuguuaugucacuaauauaauauuucagaauuauauauuuagaauaugcccuuuguauuaauuuuuacacacaacauuugaagaagcuuaaaauuucauagaauuuucuaagucauuaaaugauggagcuguaaauaaguaaacaaacaaaaaccuggguuuuguuuucuuuuuccuuuuuuuaaccuucuaaaguaguuauauagggcaaagauuuagucuccuuucuugccauuuaaaauuaauccuuugaauauuaaauaaagcuuuuuaauugcucaagauucuuagaauaaaugaugguuuagaguucucuaaggcucagagaacauuguggaaaaggacucaaaggaauguaagagccagagaauagggguaugacauucccauugcaacuagaucucacagagcugcaauugugggcaguagaccugcauuaaacuggacguggcaaggacaguagaggauuggggugaggcuccugggacuccaucccucccugcugagcuauuggcuacuauuggauacuaaggcaggggcaauuauuaucuucacuuauauaaguaaaaguaagcccaucagguuccaauggauaguuccacacucaucaccacccagauuaucuguguuaaaauuaauguuucauaaaauaaaacaagaaggcaugaaagugggaaaggaacauguaagaaguggaggguuccagaggugagagggaagaaauagggugugagaguagacaaaaugcugugugugugugugugucaaacaaccaacuuaguaaacaaaacagaaauaaguaauacuuugauuauuaaagcuauuuaauuguauauuacuaauacuucgaauaggaaggcauguaucaccuuugcuguucuuugcuauucauggucugauauuucugucaguuauccuuguccucggugccacuguuuacuuccucauugacacaucaguagucucacacuguuccacuacucuagcucuucugauugugcguugucuuggauuccuguuggugaucaugcuauuggccuugcucuuuuuuuuuuaauuaauauuuuuaauuacauauauuccucaauuacauuuucaaugcuaucccagaagucccccauacccucccccccacuucccuacccacucauucccauuuuuuuuuugcccuggcguuccccuguacuggggcauauaaaguuugcaaguccaaugggccucuguuuccagugauggccgacuaggccaucuuuugauacauaugcagcuagagucaagagcuccgggguacugguuaguucauaaugauguuccaccuauaggguugcagauuccuuuagcuccuuggguacuuucucuagcuccuccauugggagcccugugauccauccaauagcugacugugagcauccacuucuuuguuugcuaggccccggcauagucucacaagagacagcuacaucuggguccuuucgauaaaaucuugcuaggguaugcaauggugucagcuuuuggaugcugauuaugggguggaucccuggauauggcagucucuagaugguccauccuuucgucucagcuccaaacugugucucuguaacuccuuccauggguguuuuguucccaauucuaaggaggggcauaguguccacacuucagucuucauucuucuugaguuucauguguuuagcaaauuguaucuuauaucuugggaauccuagguuuggggcuaauauccacuuaucagugaguacauauugugugaguuccuuugugaauguguuaccucacucaggaugaugccuuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugacgaaccgccagacugauuuccagagugguuguacaagcuugcaaucccaccaauaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauccuuuguucaguucugagccccauuuuuuaaugggguuauucgauuuucugaaguccaccuucuugaguucuuuauauauguuggauauuaguccccuaucugauuuaggauagguaaagauccuuucccaaucuguugguggucuuuuugucuuagugacggugucuuuugccuugcagaaacuuuggaguuucauuaggucccauuugucaauucucgaucuuacagcacaugccauugcuguucuguucaggaauuuuuccccugugcccauauuuucaaggcuuuuccccacuuucuccucuauaaguuucagugucucugguuuuaugugaaguuccuugauccauuuagauuugaccuuaguacaaggagauaaguauggaucgauucgcauucuucuacaugauaacaaccaguugugccaacaccaauuguugaaaaugcugucuuucauccacuggaugguuuuagcucccuugucgaagaucaagcgaccauagguguguggguucauuucugggucuucaauucuauuccauuggucuacuugucugucucuauaccaguaccaugcaguuuuuaucacaauuguucuguaguaaagcuuuaggucaggcauggugauuccaccagagguucuuuuauccuugagaagacuuuuugcuauccuagguuuuuuguuauuccagaugaauuugcaaauugcuccuucuaauucguugaagaauugaguuggaauuuugauggggauugccuugaaucuguagauugcuuuuggcaagauagccauuuuuacaauguuuauccugccaauccaugagcaugggagaucuuuccaucuucugagaucuucuuuuauuucuuucuucaaagauuugaaguuuuuaucauacagaucuuucaccuccuuaguuggagucacgccaagauauuuuauacuauuugugacuauugagaaggguguuguuucccuaauuucuuucucagccuguuuauucuuuguauagagaaaggccauugacuuguuugaguuuauuuuauauccagcuacuucacugaagcuguuuaucagguuuaggaguucucugguagaauuuuuagggucacuuauauauacuuucauaucaucugcaaaaagugauauuuugacuuccucuuuuccaauuuguauccccuugaucuccuuuuguugucgaauugcucuggcuaauacuucaaguaguauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcauuccuggaauaaaaccuacuuggucaggauggaugauugcuuuaauguguucuuggauuagguuagcaagaauuuuauugaggauuuuugcaucgauauucauaagagaaauuggucugaaguucucuaucuuuguugagucuuucugugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucuggcccugggcuuuuuuuggcugggagacuauuaauaacugcuucuauuuuuuuaguugauaugggacuguuuagauggucaacuugauccugacucaacuuugguaccugguaucuguccagaaauuuguccaauucguccagguuuuccaguuuuguugaguauaaccuuuuguagaaggaucugaugguguuuuggaucucuucaggaucuguuguuaugucucccuuuucauuucugauuuuguuaauuaggauuuugucccugugcccuuuagugagucuagcuaaggguuuaucuauauuguugauguucucaaagaaccaacuccuccuuugguuaauucuuugaauaguucuucuuguuuccacuugguugauuucacuacugaguuugauuauuuccugcagucuacuccucuugggugaauuugcuuccuuuuuuucuagagcuuuuagauguguugucaagcugcuaguauaugcucucucccguuucuucuuggaggcacucagagcuaugaguuucccucuuagaaauacuuucauugugucccaaagguuuggguacauuguggcuucauuuucauuaaacucuaaaaagucuuuaauuucuuucuuuauuccuuccuugaccaagguaucauugagaagaguguuguucaguuuccacgugaauguuggcuuuccauuauuuauguuguuauugaagaucagucuuaggccaugguggucugauaggauacaugggacaauuucaauauuuuuguaucuguugaggccugcuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacaaucuguccauugaugaaagugguguguugaagucucccacuauuauugugugaggugcaaugugugcuuugagcuuuacuaaauugucuuuaaugacuguggcugcccuugcauuuggaguguagcuauucagaauugagaguuccucuuggaggauuuuaccuuugaugaguauuaagugucccuccuugucuuucuugauaacuuuggguuggaagucgauuuuaucugauauuagaauggcuacuccagcuuguuucuucagaccauuugcuuggaaaauuguuuuccagccuuucaaucugagguagugucugucuuuuucccugagauggguuuccuguaagcagcagaauguuggguccuguuuguguagccagucuguuagucuaugucuuuuuauuggggaguugagaccauugauauuaagagauauuaaggaaaaguaauuguugcuuccuuuuauuuuuguuguuagaguuggcauucuguucuuguggcugucuucuuuuugguuuguugagggauuacuuucuugguuguucuagggcgugauuuccguccuuguauugcuucuuuucuguuauuauccuuugaagggcuggauucguggaaagauauugugugaauuuguauuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacucgaccuuucucccuuauugcuuuuaauauucuaucuuuauuuagugcauuuguuguucugauuauuaugugucgggaggaauuucuuuucugguccagucuacuugcaggucuauaggcuucuugugugaucaugggcaucucuuucuuuauguuugggaaguuuucuucaauuauuuuguugaagauauuaucuggcccuuuaaguugaaaaucuucauucucaucaauuccuauuauccguagguuuggucuucucauuguguccuggauuuccuggauguuuugaguuaggauccuuuugcauuuuguauuuucuuugacuguugugucgauguucucuauggaaucuucugcaccugagauucucucuuccauuucuuguauucuguugcugaugcuuguaucuaugguuccagaucucuuuccuaggguuucuaucuccagcguugccucgcuuuggguuuucuuuacugugucuacuucccuuuuuaguucuaguaugguuuuguucauuuccguuaccuguuuggauguguuuuccuguuuuuccuuaaggacuucuaccuguuuggcuguguuuuccugcuuuucuuuaagggccuguaacucuuuagcagugcucuccuguaauucuuuaagugacuuaugaaaguccuucuugauguccucuaucaucaucaugagaaauguuuuaaaaucugggucuagauuuucgguuguguuggggugcucaggacuaggcggggugggagugcugcguucugaugauggugaguggucuugauuucuguuaguaggauucuuacguuugccuuucgccaucugguaaucucugaagcuagcuguuauaguugucucuguuaagagcuuguucuucaggugacucuguuagccucuauaagcagaccugggaggguagcacucuccuuaguuucaguggguagaguauucucugcaggaaagcucucuucuugcagggaagguacccagauaucugguguucgaaccggacuccuggcagaaguuguguuccacucacuagaggucuuaggaucccuuguggaauccugugugggcccuugcgguguccggggacucugcuggcaagguagcccggggcucgaguggaauggaaggggcuugugccccaggucaggcccggguagucugcuucucuauguacugcagucucagguuccgcgcgauuggauuggggccagcucuguguuccacucaccagaggucuuaggauccaguggggaauccugugugggcccuugcgggugucaggcaacuucgcuggcaaggaagcccggggcucgaguggagcggaagggguaugugccccaggucaggcccggguagucugcuucccuauguacugcauucucagguuccgcgcgauuggauuggggccagcgcuguguuccacucaccagaggucuucggauccaguggggaauccugugugggcccuugcgggugucaggcaacucugcuggcaaggaagcccggggcucgaguggagcgcaaggggcuugugccccaggucaggcccggguagucuccaccauaauguuuuauuguguaauuugaauauauuaaaguagaucuuaauaucugaggaauaccuggauuguuucccuuaaaauugcacauauuuaauaagcuguuuccaaagauuacauuuacaguuaagcuuagcaguaauuuacuaauaguuuuaauacuaauuuauucucuaauuuaaauauucaauagaguucuuuuguuuucuuauuucugugaauguucucuaaccaucuaaccagcuuauucuuaugcuguguuuguaagcauauaauuuaacugauuacugugacagucacuguauagucugcaguauguauuuguuuuuuauaggaaaaugguucuccugaagagcaugcggucuaugugugggaccauuucauagcccaggcugcugcugagaauguguucuuuguggcucauagcuauggaggacuugcuuuuguugaacugguaaguacauauucauuuuuuaaaagacuuuauuuauuuuacuuauuuuauguaugaguauacuguugcucucuucagacacaacagaagagggcaucagaucccauuacagauacuugugagccaccauaugguugcugggaauugaacucaggaccucuggaagagcaguaaaugcucauaaccacugagucaucucuccaguccacauacuuuauuuuuuaauguguguauggacaucucuguauuuauguauaucaugugugugccaaugucuaccuggccacaaagggcuaaguauuccccuggaucuggaguuacacaggacucugcuccagugguggggaggcucagucugagguuccugugaaacugccagagucaggcuccaaaucuuggucaccacaaaugaugaugggugcuggggaagagcuggcucugcgguccccaggccgaggccagggacgacagguucucacucuuggacagcacagacgcagcuugauguuucagaagaggugagaacagaguguaggccuacuggcugucucuacccugggaacaagagggaagggugggaagagagcucuucauugguuccugcggguaggagacuccuuguauuucuuggcccgguggcuuggcuugguggugaccauggcugagaauacaagaaauccuaccgaggaagauuaaaagugcugcuuuuuagaggaagaccugcuccauuacuccaguaugacauauccugaucaaaagacagucccugguuuaaaggcauuuauuguagaaaggcagagagagagaguagggagguaaaggcuguccauggacauguggagugaggggggaagggaaugcagaaagggggagcaagaaagugagagacaagaguaagggaguaaaagggaacagaauaagaguaagagaggaaggagagggcaagcagauccuuuuauagugggccagaccuaccuggcuguuaccagguaacuguggggguggaguccagacauaauaccgggagcuuggggcauuguccaacgugacugauagccacagaauuauggagcucuggggccuugugucaagagccuggugucugggagcauggcaaacuuccuuccgucccuugaagauuuaucuccugggucucugggguuuaaaccuagcucaaccagaaaacaggcugaguuucauggucccacaguauugggaacugaaccaguguccucugcaggaacagaaaauguucuuaauaagaaauacugaaccaucucuucagcuuguaauucuaauuuuaaaucucagccugagccuccuuacagguuuuguucuuguuuuguuuuguuuugauaugauuugggggucagaggcuguuuuguuuuuguuuugagacagaguuucauugggcagcccuacauggccuggaacuugcuguguagaccagauuagcauugaacucacagagaucuggcugccucugccuugcaagugcugggauuaaaggugugugccacuauacccagcaugccuucuauuccuuuuuccccuucauaguauuuaaagguaucucucucuuuuuuuuaauuuaguuuuaaaaauuuauuuuucucaaguguuauccccuuaccugguuuccccauccacuggauccccucuaucccacccccucuccccacugcuuuuaugaggguauucuuggcugcuagcauccaacucuguauuugugaggguuugacagggccucuuaggagacagcuguaucaggcuccugucaucaagcacuucuuggcauccacaguagugucuguguuugguaacuguuggaucgauccccauguggggcagucucuuuauggccuuuccuucaguacuuucucugugcuuugucuucauauuugcuccuguguauuuuguuccccuuucaaagaaggaccaaagcacgcacacuuuggucuuccuucuucuugagcuucauauggucugugaauuauaucuuguguauucugaguuugggggcuaauauccacuuaucauugaguccagaccauauguguccuuuugugauugggcuaccucacucaggaugauauuuucuacuuccaauugucugggaauuucaugaaaucguugauuuuaauagcugaguaguauuccauuguguaaauguaccacauuuccuguauccauuccucuguugaggaacaucuggguuguuuccagccucugcuauuauaaauauggcugcuaugaacauaguggagcauguguccuuguaauguguuggagcaucuuuuggauauauaaccaggagugguauugcugggcccacagauagaacagccagacugauuugcaaagugguuguaccagcuugcaaucccaccaacaaugcaagaguguuccucuuucuccacaucuucaucagcaucugcugucaccugaguuuuugaucuuaaccauucugacuggugugagguggaaucucaggguuguuuugauuugcauuucccugaugacuaaggauguugaacauuuuuuaggugcuucucagccauucuguauuccucaguugagcagucuuuguugagcccaguuccccacuuuuaauagguuuauuugguucucuggaguuuaacuucuugaguucuuugcauauauuggauauuaucccucuauuggauguaggguugguaaaaaucuuuuccuuaucuguugguugcuguuuuguacuauugacagugcccuuugacuuacagaagcuuuacaauuuuaugaggucccauuugucaauucuuaaucuuagaucauugguguucuguucaggaaauuuuccccugugcccauguguuugagaauuuuccacacuaucucuucuuuuagauucaguguaucugguuuuauauggagguccuucauccacuuggacuugagcuuuauacaaggagauaagaacagaucaauuugcauucuuuuacauuuugaccuccaguugaaucagcacuauguauguguugaaaauacugucuuuuucccacuggaugguuuuagcuacuuugucaaagaucaagugaccauagguguguggguucauuuuugggucuucaauucuuuuccauugaucuaccugccugcaucuguacuaauaccauguaguuuuuuaucacaugcgcagcuugaguucagggauggugguuccccauaaguucuuuuauuguugagaauaguuuucacuauucuguauuuuuuguuauuccaaaugaauuugagaauuacccuuucuaacucugugaagaauugaauuggaauuuugauggggauugcauugaaucuguagauuacuuuuggcaagaugggcauuuagauauggaaagaaugagaagccucgucuagucccugauuuuagugggauuacuucaaguuccucuccauuuaguuugauguuggcuacugguuugcuguauauugcuuuuacuauguuuaggugugggccuugaauucgugaucuuuccaagacuuuuaacaugaagggauauugaauuuugucaaauguuuuuucagcauguaaugaaaugaucauguguuuuuucccuuugaaucuguuuauguacuaaauuacauugacggauuuccauauauugaaccaucccugcaucccuuacauuaaagauaugggccacuacacccagcaugcacucuauuucuacccccccucgauauuauuauuuaaauauauuucaaaccuucuaagagccagaguuggcagauagaugaaugacuccaagaaaaccacaucuuccaaaaacccugggacugauagacauaucacacacaaagacugugccagaaccugcacagguucaaaccagaccaagucccagcacugagaaagagaugcagacacaagucucaacccuucccaagaagcuauuugcaccugaugccugcagggagagggaaaauuuguuuucucuaauagagugacacuggguauaggaaucauaccccaggcaggccuaugagcaauuguugaacacaaaaauggacuccuuuugugugcauugguggaggcagacuuuuuguuucauuuugucuugguauuuuaugucucaauagauuuuuugguuguuucuuuguuuuuauuuuuauuucuguuucguuuucuuucuugaccgagagagaaaaagaauaugaaguuaaauguauaguaacugagcagaaucugggaggagauagugagagaaugugaucaagauauuggacaauuuuuucaauuuaguuuaaaauguaauaaaucauguccaguauauguuuguaugauuuuugaaaacaguuuacagaucucugugaguguagcagaacuuuauauuguuaauccgaagugggcuuuacuugauucuucuuuccauguuacuuuacauuuuaauauuaucacaccaguuuuuauacauuuuagauguacauuucuguuuuguuuguuuuauuuauuauuaauauauuguuauaugugaagaaucaaaacuuccuguuucuuuuaacauuugguaucauuuaauaauuuucagcugacuuuaauguauauuguuuaguauguaauaccuaucaguuuauaugacuagcauuaaaacuguuagaaagguuccauuaaauuacauugaacuaccaaucuuugcuuggucacaaaaauuuuguauuuuuuaguauucugauuuuuaagaguuaaaauuaagugucaugauaggaacaguuaccaucugucucagguuuaaucugaauuguauaaaguauuaaagauagcccaguuuuugucacuguuguuguuuuuaaugauuaaugcuauaaguugacuaaugaagcguugucauuuugucuaucacccaugucacaggaccauuccuuugcuauaacagauuagcuuguugauaguguaucugagaauguuaaagccaaggaaauugacaugggcauuaaaucaaccacaauauuuguugucucauuuuagauuuuaggcuucgugugaaauuaugucaguauauuccuguaaccauuuuagauguguuauaauucagucucacaugauauagaugaaaguggugcuagcccuugacaucugagaaugauacugcaguuacccuaugucuuuugcuuauaccaugcuaagaccaaaaaaauguauugucauuucuuucuuaauuugacuucaguauuuagagauuguuuauaagcauuuuuagcuucacagauuuuugcuuauuuauuauauauauuauguuauauauaacagauaccuuaagggagggagcauuuuacauuagugugcuauuuuuaauauggauauugaaagaaaaauccaauauuuuaaaauaauuuguuucaauaucuacagauacaaguaaauaauuauacauuuguagcuauaauagcuuuuauuuguaagucaucaaaaucacuuuaaaauuaacuuuuuaaagacacuaauuuuagcuuuguaaaugaaauuugggauuaggguguauuuaaggcuauuuuuuaaaugaacuuaagaugccaaauugacagaugaccaaugugucaguccuguuuugccuguccuucuugucacacacugguggauauuucuccacuuuuguuccacuuuaauauaaagcacacagauguuucagaacaagacuugacuucugaccuugaggccauuagggucaggguccucggggccugugaaauuaucacaagcugagcuaaaguuuuucuccagcacaggaaguaacuaguaaguaagaaguuaaaaaggagcuuugucugagagacaagauggucccaguaagggucagcuucuguagucugcugucccuguaggaggccaugcaugggaggaggagauaauguaaccucugcagaucugucagccuggagcagagcugagaagucuauuuaauaugaaauaccuugcuuacaucuuaaaauauuaaugauuaucauuucaaauucuuguauuugauacuugugcaacaaaugauugcaguuguaaggcaggagcauuacgaugcaaacugaagagagagugaccccauccuaaagagcaacuuacaagcaaauaauacuugcacugcuguggucuucacuguaauaaacgugauaacauggagcuucacuagguuuuuauuucaaaaugcuuuuucaaagaaagcguugggacagaaaagcaagcucuaugaugcuuauaagcuuguuuuuuucuaaagccaagcauuaguguugaaaacguuaacaaacgucucgggauauuucaacauaugugucauguaauugucucacaugguuucaaguuguuaauacuagcuauaugaggaaauugugaagauuaauauuauaguguauaaaacuuaaauuaugguauaguuuucucuuggugcugcauuauguacaagucaugaauaaauccuuuagcuuucaacaguuuaaaauauuuuaaaauuauucagaauuuacaccucuuaaaagaauguagggccuuugucccugugucucugccucgguguaugccaucauauucaaguaugcaaaaauuauucucuucauggucauguaagguaacauuuuucuucuuugaaucauaaguauaaagaacacuguaugauacauacaguuaaaaaauaaauauaauuaaugcaauuuuguauagucuuuauuguuuuaauaucauacauuaagaccuuauauaguaauauugccauuuacuggguuaaauuuuguguaaaauucuacuuuaaauuaaguguuuacuuugaaguuugcagaacaaaauuauagaaggcccauguuuuguuaauuuuugguuuuggaagcagugaacauaauuuaucauuacauucucucuuaaaguguugacuugcuccucaagcacuggcaguagucaaagauuucuuuucggagccacuauucauuuuguaggaguaugucuugcaaagcagcuuuaccgggucuaguuucauaaaaacagugugcaguuugcuguaaccacaagaaacaugauaccaaaaguauccuuuucaccaccucugcucucacuacagagaaaacucaaacagcucucugugauccuagaaaaacaaguauugauaagacauucaaauuaaauucaacauguaguuaucaaagguaagagaagaaacaggcuuaccaauuguuaaugaauuucugaaaauaauguauuugucuauauacuuugucuaagccaucaacacaaaggcuuauaguucugucuuaggcauuuaauuuuauaugauagaauuaauaaucuuaguuacaacuugccuuccaaauugauuuggaaagacuuguacagacugugcagccuacuuauuaaaacuuaggcucuuuggcucauuuuucucuaauuuucacauuucaauucauguuuugacauguccauaaucucucucacagccacuugguugacaugauuccauugcuuccacuggccauuucacuggacuuuguucuugucuuuccaggugcuaagcaguuuaggaaaccaaguaacacucugagcauugagcuugcaguccuugucauugucccuuaccuaccugaguuuaguucacugcugugcuuacaggggcucaauacaucacauucagauaccuucccuuaaucaaagcgagaacaaucauauuuuuuauaacguguauuugaguuaguacauuucauuagcuucgcugacuugucugaacagauagaauauuaggaucugcucauuuuuaguucuuuuucuauguuguuagugguucguucacagccaucauuaaaaaacaucacuuagaaaugugugaaaacagcuccuuuugaaagcaagucuuuacccacuuuugauuuugguuuuuccaugcuugucagcacuugauuggcaccucacuugcaugugaauuaaggaaugaagggaacucuuauuuuccugccauuguuccaugcugggcucccuggccuccaggcugccuaagcugccuugagcagcugguauaaggcuaguuuugggcauggcuguaugaggacacucagccucagucuacucuuggaagacucuuuuaaguuacuuggaaaaugauuuauauuuauacuaaggaggagauggaauuaagcuaaaaauuuuuagccuuuaccuuuagggauaugacaauggcuaacuauggccuuaaaguaauaacauuguauuuuguccacaaaaagacaaaguaaaauuaguauugguaggaaguuuauuuaaugugauuuaugugaauugugacauuuugaguggcugggaaucagaaauugagaagugaaauaaggaagaauaaaccauagaaaauggaauuauaaugauaucaacauaacugagaauaaaaacacucuuacaaccuuacuuugaaucuaggcaauucaguaaaaauaacauuuguaggaaaaugacaaaauacaucuuaauuaguuuuacuuuaaaauugucuuguguaucuaagucuuugauuacccaaacacugaagaaacagcuuccagguaaagagucuaauguugucuucaaguuugggaauacucaaaacaaugagugacauauuugcaguuaguuggccauugcauggaguuuaagccuuagcagcaagauuccuacuaauuuauucauucugcucucaauuuacauauugacugauuucagaauuuuagcaaguccauuuauccucauuaaucagcauucccauuuucugcugauaacuccaacucucaguuugacaagaaggaccaccucucuacaacucauuuucccaagucuacuacuuucaguaaaacaggaaaguuauuaaagugaauuauguuuucauaguauuuuaucaccgccaauggaagaucccaaaaauaccauuucaucccaauauaguguuggcuuauuaauuuacuauuguauguuguuuuaguuauuuuaugcaugacauaaaauuuauacaacuaauuugagauauaauuacuuacugaauuucauugagauauacuuuauaugcuaggaaauucaucuuuugaagaaguacaaauuaaugguuuuuagcauauuuauagauuuuuacaaccaucaccaaugucuaaauucagauuaagucccuucagguuugguuuuuuuuuuuugguuugguguuuuguuuuguuuguuuuuugaggggagggguuguugguguuuuuuuuuuuuuuuuuacagguuuguuuuauuuuauuuauuuuuuuggauuuuuaaaauuuuuauuuuauuuguaauucauuuuucacacuccauauuccauuccccacaccuccccauccacacuccgauugcuccccaccccauaccuccuccccacccuacuccaucuccacguggauguccccaccccccaucccaccugaucucuacacucccugaggccuccagucucuugaggguuaggugcaucaucuccaaaugaacacagacccagaaguccucuacuguauguguguugggggccucauaucagcugguguauguugucuguuuggugguccaguguuugaaauaucucaggggggcagauuauccaagaccgcugguccuacagaaucgcccuucucagcuuuuuuucagucuuugccaacucaacaagaggugucagcugcuucuguccauugguuggguucaaauaacugcaucugacucuuucaguugcuuguuggaucccucgaagggcagucacaauaaacugcccccccccccuuuuuuugagcucugcauagccucaguaauagugucaggcccugggaccuccccuugagcuggaucccacuuugggccugucucuggaccuucuucuccccaggcuccucuccauuuccaucccuuuaauucuuucagacaggaacaauuaugggucagaagugugacuguggaauggcaaccccacaaauauccugucuuuccacuggaggugggcuccacagguucccucuccccacugccgggcaccucaucaaagguuccucccuaugaguccugggagucucucaccucccagguuuuuggugcauucugggggggugucccuccaaccuucuauuuccugagguugccuguuuccauucauucugcuggcccuuagggcuucuguccuuuucccucaccugguaucaaaucagguuccccucuaccccugacuucccugccaccccauccacauucccucccaaaucccucccuucccaauuauaauugcuuucuucucucucccaagugguacugagguauccucaauugggcccuucagcuuguugagccuuuugaauucuguggacuguaucuuguguauucuguaugcguuuuuuuuuucuuuuuucuauuuuucuuucuuuuuuggcuaauauccacuuauuagugaguacauaccaugcauguccuuuugggucugaguuaccucacucaggaugauauauucuaguucuauucauuugccugaaaaagucaggauguccuugcucuuaauaucugauauuccacaauaucacaauauuacacaauauuccauuguguaaaugaaccacauuuucuguauccauucuucuguugugggacaucuagguuguuucaagcuucuggcuaucacagaaaagaccaccccuucaguuuaaguccaugaaauaucacaaaaugaguagucuuaaauaucugccccuagugucuaguuuuauugcuuggauuauguuccuccccuuccuccucucuuccuacuuccccaucuugcucuaccuccucaucuucccucuccuucuccacugccuccuccuucuuccuccacuuccucucccuacuucuuccuaccuccuauuuuugagacagggucucacuauauagcccucacuguccaggcacucauggagauucucuugucucugccuucuagggauuaaauuuaugcacuaccacuguuagcguguuuggauuaguuuuuacaaauuaugugugauaagugucaaguuuaguuuaauuuuuuuuuaaguauuuguauucagcuuuccugccacuuuucauugggaaacaaagccauuuuucuuuuuauuguauuaacauuccauuaaaaaacaauuaccuaugaauguaagccaggacucugucccauugauaaauguuacuguccucuuaguggaaccacagugacguacuugaagcagcuuugcagggaguuuugaagucaggauguuggucuaauacuuuuugaagauuccuuuggcuacuuacauauccuuacggauuuuagaaucagugugguuacauauccuuauggauuacauauccuuacauauccuuacggauuuuagaaucagugugguuacauauccuuauggauuacauauccuuacauauccuuacggauuuuagaaucagugugguuacauauccuuauggauuacauauccuuacauauccuuacggauuuuagaaucagugugguuacauauccuuauggauuacauauccuuacauauccuuacggauuuuagaaucagugugguuacauauccuuauggauuacauauccuuacauauccuuacggauuuuagaaucaguguggucguugcugggaagaagaagaucagggauucugauucaggugcauucaaugugugaacauugugaagauuauugcuaucuugaugauaaaagcuuuucuauccaugaacuuggauugccuuuccauuuauccauuuacuuguguuuuaaaaguaucguguucccuagcugagaaauuauuugcaauugauugcuauugaggcuagcagacuguugaggaagguaaagucuuuucuuuuuaaagguaugagcacugguagguuacccagucuuuaguggaagacccacacccuuaggauuguauguauucaaggcuguaguauuugugacuacagcgaauuuggucucuuccuuuccaaucuggauauauuuuauguaauugauuucauuuuauaaguuguuuuugccuuguuacccugaggagaaccuacagcccaagguugagcugaucuggcugagccuucuuuaagauuuuaaaggaaagugacgaucauaugccccaguacaggggaaugccagggccaggaagcgggaguggguggguuggggagcagggccaugggaggguauaggggacuuucgggauagcauuugaaauguaaaugaagaacauaucuaauaaaaaaugaaauaaaaaaaaugaguguuuugccaccaagugcgguggucauugugguuauucauuuguuacuucccuggcaaacuaacgugaucaucucauucagaagauacugggauagagcaaagguggucuuuuuauauaauaaucaauccagacuacucucugggaauuacuuuuguaagaggcuuuugcaaugucaauaaagacuguaccaggcuagaguccuuccacauucacacagcuaagagacgagacaugaucucucuuaauaaaauggacauugaagccauugagcuguuaaauguaacauaauacuugucaacucagaaaauaaguugacaaauuaauguguuaaauauaaauaaaucuuuaaagugaguuucucauuguauagcuccuaauggccuauaauucacuuuguagaacaggcuagccucaaacucaaagagauccaccugccguuggcuacuaagcacugagauuauaggaauauacaacuaugccuaaauaauaaaucuuuaaccaagaaacauuuauuuucccauauucuauauaauauuucaaauagaaaaccuaugcuauagauaugaaaaacuaugauggucuacugaaaugcuuuaaugaaauuguagagaaacacauuuuagcuaaauagagacuuuuuuaaaagcuguucuuacgcauuauaacucacugcaaauucucaaaaauaaagugccuaacuaugccuguacuugugauuugauaucuaaaauugaaaagagcuuuugaaaaaacauauuuuaauaugaacuauuuagaaucuaccuuagacugaggacccaauccuuauuaaauaauuuacucaauuaauucacggaaguuggguaggccucaaauuuaaaccauucugaauccauauuaagauaugucuugagggagcaaggauaacaaccagaucuugccagagagcucuuuuucaguguucagaaugguuucagaaaccagucugcuacaagucagcacuggugcacguagcaagugaguccucaguaguugcauauuuauagauucgauaagcuugggcuuugaucaagagguguaagcugauugccaagggaaggaaaucaauguuaaguaugaaguaaauauagaaauuacuuauaaacaguuuuuccccuguaaaccuuacaucacucccuuauaagaaaguacaaaagaaacuacaaggucugucacugggaaaguaguaacaacauaucaagacuccacccacugccagcaagugggcaaauggaacauuuucaaaaguaagaaagagaauauaaggguaacagucgaaagaaagaaagaaagaaagaaagaaagaaagaaagaaagaaagaaagaaagaaagaaggaagagggggaggggaggggagagggagaagaggaagaggaagaaagagggagagaagagaagagaagagaagagaagagaagagaagagaagagaagagaagagaagagaagagaagagaagagaagagaaaagagaagagaagaaagaaagaaaagcaaaaauccucuugggcacagaguaacauuaugcuacucuuuuggggcuauauaauacuaauuauuaaaguuggagacacuacccugauguguauacugucucucaucucaccuucauuguuguuauuguuguuguguuguuguuguuguuuuaacagucuuacuuauggauguuaggcuaaaacccacauuucacacccagcacauaugcacucuagcucugagcccuauguucauucccucggaacuguuucugugaaugaauuaaguucacaguaaagccaauugugauuucaucggaauugcuucuuagugcccucaagacacauuguacuauuuuuuacaguuacuguuaaggguauccauucauuauucaacugaacucucccucuuugcauauguacuucagagacauugaaauaucaucucuggucccaggaagaugguagcccaagcagaaaacauugaagagagcaauagaacaggauaauuauaacaugggaugacaaccaggaaguuguuguguuaacccccgauguaaaaauaaucuauauaauagacuugcuuuggcguuaaauacuaagaaauuuuuuuuucugugaaugaacuuauguuuuucuucugcuauauaucaaaaaaauauguuuuugccuuaaucuggaaacucaguucucagguauaaggauuuccauuucagcaauaauccugacucuuacuuuccuuaaucaaagucauguuuugcuugaggucaccucauuaauuauuuuuucccuaguuggcaagaaauaaauaaguccccuguuuuucuugguuucuaccacacuuauuaccuggcuagaaacuuaccuguauacucaacagauaguuuuugugauugauugauugauugauugauugauugauagaaauaugauacauagaagauagauaaaauuccaucaaucuauguauaaaauucucucaaccauaucuuagauguuguugaaaacagcgacauugaagucagcccugaguaguaauguagagcuucaagccagaaccaagauggaugagauaacaaagaagaagaugaaagaugaguauuuagagaccuucucauugagugugcagcaaguauuuuuguggcauuaaauguuggguucaugugagaacaaauaauguaaauuacuaaauaaauagaguaaauuagcuaagaaauaucuucauaucuuaaaucucuuuuccagggaaguaagcagacauaaccccaaacuuuaguuauauuuucugugaauaaaaucaauaugaauuaggucucauauccauuaaaaguuuguuguugcccuauguaaacauuuauuauaauuauaauaaaccuacuguagacuuugugacucaaugaacaacccuuuuaaauucuacagacucaggagaucaagacacuagcuaauagaggcccugcugcugaccauguucagucauacaguuccuucaccuuucccuaaaauauucaucucauugucagaauuugaaucccaugaaauuaucuuaaaguuuccagguccauuucuucauaccauuauccuagguguaguguuuuaacauacaaucuuuugggaagacucaaacuugggauccauaauacagauucuccaaugucaaugccccuuucauauagauauuucauuaauuucacucaacagccuuuauuuuuuauuaaacauuuuguucauuuauaucucaaaugauaucccauguacagguuacccuuccaaaaaucuccaucccacauuuuccuuuuccucccuccccuuugccucuauggaggugauccccuaucuacccacccucucccacuccaccacuccaguaucccccuacccuggggcaucaaaucuccacaagaccaggggccuccccucccauugaugucagacaaggccaucuucugcuauauauguaucuggaaccauggaucccuccugguacacucauugguugacggucuagucccugggaucccuggguggucuggccagucaauguucuuccuugggguugcaauuacccuccacuccucaaguucuucugccagcuccccuaccgagguccucaaguucaggcugaugguuggcucuaagcaucugcauuugcauuggucggguacuggcagaaccucccaaggaacagccauaccagguuccugucagcaaagaagguuccaggauggcccuuuaaagcaguaauucucaaccuguaggccaagaaccccaaagaccuuuggaaaacacagauauuugcauuaugaaucauaacaguagcaaaaauuacaguuauaacguagcaaugaauauaauuuuauaguuggggucaucauaguaugaagaacuauauucauagcauuaggaagguugagaaccucuacucuaaagccauaaccuaucacaguggaccucuaaggcuaaaauuuagaggcccguguaaaugccauccaaaagugcuaagaguggcacucaaggcaugcuucucacugagguucugugccuuccuugugugaagccaugagaacacacaaguaauuuggauuagagugcaguaccaaucacugucauuucuucucuguuucauuauggacuucaaugaguaaaagcaucacuccuucaacaugcucagaucaguccuaaacauccaugaaccuguauaucuaucuuguaacaucuauaauuccuuggccucacccacaggcacagcaccuguagaaagauaaaaacauguucaacuuucuccagugguagaaauucucuucuugcuuuuuuuccacugaaaaggugucaagagugguuuauaauuauaaauguucauagacuuucccuggcaucaaaaguauggugucaaagugcugauuucaauggucaacuuguugccuccauuacaucacuguccaucucaccuaugaaaauguuuccaggaguaccacuguugcaggcucaccugcaaauucucaguguuacuuucuaucacacauuuugaggcaucuguucaaaacuaaguauauuuauacuaugucuaaauauuaaaauucaauggggcauuagauauuagaagcauuuugugcauuauaaacuaacauuugguaacauuuguuuuucuccaaguucuuacuauagaucuucaggacagauacuuugauggcugauugcuauagaaugagucaguccucucugauucucacuucugucuuuauagaauauaucaggcagccaaaagaucuuaagacaugacuguaucaauccauugcuaagcaaaugauagucugaacucuucccacuaggauuaguuaugucuggaagucuuaagagcauaagguggcaguaccaucuucaugccuaucaccaauaucaauaauacuuaaaugacauucugcaucagguggucuuuuaacucucuuacuuauuuaagugacaaauguauucaucuugcuuugagcauugaacuggacuuuggacuggacagugagcuuauauacauauacuauacuuuucuuuuauaaccaguauauaugugacuuucauauccuagauauuaugacuacaacaaacauaggaauguagguuauuuuacugauacaauuuggccccagaauaugugugauuguuuagaguuucuugaggaccaauguacaauuuuuauaaugguguagugauuuacauuuccagcaaugcacaugcaggguuucccuuuuuuucuauaucugcagcaguacuugauagcuucagaauuugaggcaauagcugucuuuucaggagugaaaugcuaccucauuugggcuuuguuuuaucugauugaagcacugugcauuuuaccuagugcauuaugcaugcuagacuaacacucuaccacuaagcuauagcccuaggucucugcacuacuuuuuuuucuuuucaggcaguguuaaguugacaucauuggccuugaacucacucugcauccuagccaugccuuuaacaacuuaugauccuccuaucucagacaagcugggauuacaggccuccuuccacacuuggcugcaguucauuguugacaauuauuugcauauuccugauaauuagcuauuuugagcauuucauauaccuguaugccauuugucugucuuuuaaaaaaauuccuacucaugucucuugauuauuuuaaaaucagauuaauucuuuaauuuauuuauuacuuuaaaauaacuugaauucuuaauauauauuguggauuuuuaugauguagauuauuugcagaguauuuuucgaccauuaaccacuguauucacacugucuccaugcugagcugaggggauuaguuuagauaugguucaauuugcuuuauuuccucugccgcucuugucuccuccaaaguacuuacccauucugagcucuugaauaacuuucucuuuuuuucuucacacuuacucgguuuuuguuggauuuuuuucuuuuuuagauuuuauaacuuaauuacaaaauuucuuccuuuuuucaccccccccccauauccucggauguacacuuccuugcucucugucagguucauggccucuauuucacuaauuguuaguguguguguguguguguguguguguguguguguguguguguguuccuguauaacuuacugaguuuguguaauguuacuuguauuuauggcuucugggaugaauguuugcuguuggguaaccaauugaugugcucuucacuggggaaaaccauuucuccuguucucagcauuugcauuuuauaaaagaagaauauuuauaaugcauagagaacaacaaauuuuuaaaauuauuguuagcuauauagucaugagaaauuucaauuuguguaggguugaggcaccgugggcuuuccuauccaguuugacauauucauagguauucuucuguuaacaacuauaacuugcuauaguuaguauuaaaggagaucuguuucauuauucuucuugcucaugcagauacucaucuuaccaguaccauuuaaaauacgcccucuuucuauuguguguucuuagaacauugguugaaagucaguuugucauggauguuuucauuugcuuuuagcuucucuauuuuguauuacuaauacauguaucugguuuuaugaaacaucuacacuguuuuauuuugugaguuuuuuauuguaauguaauuacagcauuuuccccuuaccuuaccucccuuccaaccuucccauguauaccucccuauucuucuaauucauggccuuuuuacauuaauuauuauugaaugcauuuauguauuuguguauaaacauauuccuauaaguaacaaguugauacuguauaauguuacuuuuagguauguuuucagggaugacuguuugccaguggaaaacuagugcucuucuggaaagaccacccuuucccauucccagcuuuacuggguuucuuauacuuccuuguguagggcuuuucccauccaccuuggcaugcuuguugaugucaucuuucagcucauguuugugccaugauguuggugaggcuuucuaguguuuuuccuuaugauacuaggagacauacucucacagcaaacacccugacccucuggcuccuuucauguuucuacacauuguucugcagugcucugugagaucaagaugucggaguguuaggaaguuuauccauuagcagugggcucuacacuucugcauuuucauugguugugauuuuuuuuuguaguugucuccgucuguuucacuuuagggguaagaauauacaaccacuaauuuaguaaagcagcauaaucccugacaauaaucuauaaacauaugccuuauagccaugcuguuuugacuaccauagcuuuuugguacguuucgaagucagguaguguaaggccuucugccucuuugguuuugcuccagaugauuuuagcuauuccaaaguuuuuucucugcuuuuggcuccuuaccaauuuuuagaguuucuccucuagcuugggaaaaacaucacugauacuuuggcaggcaauuucauugaauuugugaauugcuuuggauauaaugggcauuuuuaacaguuuugauucuuauaaucuacaaauuuguguguuuuugcauguguugguauuuucuucaguaguacugacuuaguuugcuuucugcucuugugaugagcaccauuacaaaaagcaguuuggggaggagcggauuugucaugaucacacucuauuauaacuggaaauuaggguagaaacuagaggcagaaaccuggagacgaaaacugaagcagaggccauagaagagcacugcuuacuggcuugcuccacaagccacguucagucuaucuucuuaucccauccaguaacaccaugccagagauggccccaccacaauggcugggcucaacagaacugccugcagggagccugauggaagcuucuucucauugugacucuuccucuccucagauaacucuagcuuaugucaaguuggaaagugugauagauacuuucccuuaaauacagcuuuuauuuccuggcauaacuuacuuuccagguauuauauucuaacguaucguauuauguugcauuauuuguagcuauugugaauaacauaguuuucuugauuuuucagucaguuaauaauuuuuauuacuacugauuuuuuagguaaaaugaccccaucaucgguccauauacuugaacacuugauucucaucuggugaaccuguuugagaaaguuguaggaucugggaaugggaaguagcuagcugacauagauuaaauaugccucugguuugggucuagaccucccuuuaauuccuguucucuaagaugugaggagccucuaucacacagucucauuguugaggagccuucugccagucucucccacuugcugaacuaauaaaaucaugaugaaaucauaagucaaauagaccuuuccuucaaaguuguuucuguuagguauuuucucauagcaaugugaaaaguaauuaaacacauuuuuaauacugauacuaguauccugaaaauuuuaaaaccacuccuguucuaguagaauguuuaacacuuguuuauaaaguaauuucauuuacaaacagauaaauuucccuauuccuuuuucuaguuguucuguuuuccuaguguuauguugaauaugaaugaugaaaguggauaucuuuuuuuuuccugugauaaaauacucagaaaagcuuacuuagagugauaacgucucauuucagcucccaguuaaaacuuacaaucugucauuguggugugggacgacacagcagaaagaacuagaggaaacuaguuauauuacauccacagugcaugggcauagcauagagcgacuaaagcucaccuuuucaaucucaaacaguccaugaucacuaggcucuccccuuccuagauaauggacccauccacaguuggaugggucuuccugucgcagccaaacagcaauuuaagauaaugcuccuuuggcuugcccagaagaccaucucccaggugauucuauauugugcuagaauuaucacagugucuuauuccaaaucuuauugggcaaaauguuuucaccuuugcuaacuucaguacaauuucaauuggaguugauucuagauagguuuuauuguguuuagauauauucaccaugucagcuuccaaaggagggagauagcccagagccuucccuuacccagcgaugauccuaugaacuacaaauacaaccagcaugccauuguaagggugcaauaguccacucauaucuuagcaguaaccaaaccuucuaguuggacuuaaugccugucaaauaagaagaaaucauggcugauacuggaaaccaaggcuacauaacuaccuagagccaguaagaucuucagucuuggagacacacagccacagcuuuacugagccagcauaaucucuaaauacacucuaaauauuugucacucacagguaaguguuauucccaucccucaucaaggaaacuuuucuuugaaaaauauggagacuguuauagaaaacaacagccaaugaauauguagaauuguguagcccaaccccaauggauaaaucuacugaggaacuccugcagacaaagcagauuauauuagauuauauuaggucauauuagauuauauuggugagaaaaaaaggauaugaauuuuaaagagagcaagaaaagguacaagaggaaaggggauugcaaaaaugaaaggaaagggguuaaugauuguaauuauaauuauaucauucuacuauaauaaaaggaaaaauguguuccuuguuccauuuuuuucaucaugaagggauauuaaauuuuacucgguauuuuuugugugucuauuuggauaauaguugguuuuccccaucauugucuugguauaauacuuacuuacuuacuuacuuacuuacuuacuuacuuagagguuugcguguguuugaaccauccuuauacuccuguuguaggucacauuuggucaugauggaucaugauuuugacggguugacagauuuuauguucuguuucuuuuuuuguuagaacuagcuacuacuuguggauuugauuuauuccuguuuuuauaaacuuaucggcuuaaacuuaaaaaguaauuucuggguuuucauguacuucaggauucuauauuucucuuuuuaauuacaugaugauuuauuuuuacagucucuuaacuucuuuauguauuuuuguggcuuccaagcaaagauuuuuaccuaaucaauuacccaagcuaaugaagguggaagaagauaaggaaauuuuauaauaauaacuccuauauuaguuauauuuaaauauugaauuugcuuuguaagagagacuuaaacaggagaaaagugaaaaaucuguaaauaucuagaaaggaaugaauuguccuagcuaaaucuauauauauauauauauauauauauauauauauauauauauauauauauauauauaucuacucuucuuuguagcucauucuugcugugaauagacacuuaucuggaucccccauaccaaaagagauccauacuuaucuuuuaauacuagcuauguagaauugaaucuguuaaaaaaaaucuguucuaucaguauuugcuacagcuuauuauugaugaguguaacuaauaucgauguagaguauucccugcuaaguacaagacauuguuccaaguguucuagaaacauuggcucaugcaaucguucuaacaacccaugacauaggaccuaguaucacccucaauuccauauaagggaaugaacacacaugauauauuauguagcuuauuuaagaucauacaagaaauaaaugauggagucagaauuuacguuggguuuucugccucaaaagcaugugcucauaaucacaaugcuguacuacuguucccaggaaucgcaugguuagcauauaguuggccuggucauaaagcgucacucagcaacuaaaguccaaccuaagugucacugucagugguaggugcuuugacucuugcuuuauggacagggacucugaaagguuaaagaacuuggagaguuugcacaggggucaaagccaagucaauggauuuuucucaaaaggcauacuuucuucuaauguuuuaauuaacuucaugaaguaaauuuucaguaaauuaggauauugugaugaaugaaggaaccaccauccauuuaaggcaacucugccucuauaauagagaacaguuuucaauaaacuaaauacaugacaccuacuuuuuuuuuaauuuaauugugauuuuuuaaaagcaagaaguacacauaguguacagauuuauauuagguaggauaauuuauuuuauuucuacuaugauaaaaauaaauauuaaauaucagauuauaauguacuaaaauaauuucucagucuuguauggauaugaaaaacauuuaaauguuguaauaaguaaaaccaaguugauacuguauaugcuauauaccacaauuggcagcuacacuucacugugaauucuagacugcucacuuuuauguucgaaauuaaaaugggagaaagggaaacauuugagucucuguaaucaaccuacugcuuccuuguuaccacuuauaagcacuuuaaaaugcugucuaauacuugaaaagcacuaaauuaguauuauaguacuuugauuuuuuuuuaaucucuauacuuuucccauggaaaauacucaaguuuuuugucaaacuuuaaaucuaaauaaaaagaucaaauguuuggcuggcauacugagcuaugcauuaggaaaacguauuuuuacaaugacacguaaggucucaccaauacagaaagcacugcacagaaaugaagaaacucaaacugugcuuugcuuuucugcauaguugcauuucuuucccucaacuaaauaagccaauguuuuaagaugucugugcucuuuuaacugcuaaguaagcaaccuaaaaucgugaacuuuaugaauaagccaugguguucauuuuuuauacgauauuugaguuacaaaaucaauacuagcuaaacuacugaaaagaauaauuguaugguuguauuuaaacuuaaaaguauuugcuaaaugucugauaagacauaucuacaacugccaaagacuagaaggcaauaaagauaaaaguuuggcauuucuaugcagacucuguuuuuugcuuguuauguuuguauuacaguugaaggcauuauaauucauauuaaauauuuucacuucuaaaaggcuuuugaaaauaaguuacaguugauauauaaaaacugaauuuuaaaaauacaaggaaaaauuugcccucgaauauuucuuugauguccaaacuuugaggcauuugugaagcaauagcccagcuucuuguuagaauccuuggcagaaauaaagcuuuguguauuacugcugucuguuaacugauuuucaaagucauuguguauccuggacagaaucuagacugauuuuuaaagacauagacauuaccuuuagaaaaaaaaaaacucauccugcuucaaauucaaccacaaaaaucaaaaaauagaguuuuauucugagaauaacuacuuuuauaucuuaaauuguuucuguuacauuuucucuuauauuuuugguuaagagcuaccugagauuguguauguuccuuauauuccuacuuucuuuucauaaauaaaaguauauuuaaaacuaagccaucugaaguguuaguaaaauucagcucuggagucuuuaagaaaugagaauuuuauauuuucacugaguauuuuuccccugauacuuucuuccucuguacuguacuccaagacuuuuaaacucacuauuaaaaaauaacacauuuuaaaaauucacaagaauuguaagauauucaucaguauguauuuacugucugaaacugagacagcugagagguuuuuagauccaauugauccagugcgcauguccccucccuagguugcaggacaugcuucuauuugcauaaggcccugggcaagguucuuucuugcauugauugcccuguccauggcugccugauguguucuugcauugaucauuuugucuuuucuuggaagacaguguuacaguguguucaucuuaaacaugcuaggaagaaaguaaaauuuaacugcagaugucucaauuuuauucaagaagagugugcccuuuagugagacugauuguuguucuuugaauuuggauguauaguuugcacuguacacuagauuauguuugaaaaagaaaauugccacaguauauaccaauuaucgugugccacuuuugcuugucagugucuuuuucuucuaccuuaaagccauuuucguuaaagguggucccaaacagaaauuacguccuagaaaaagcaaucccaauucuaacaacaaaaauaacaggaagcaacaauuacuuuuucuuaauaucuauuaauaucaauggacucaauucccaaauaaaaagacauaaacuaaaauuuacuaguguuuucagaagaguauccucuggcuuaguuuaagugaagggugcguuguuuuaugaauuuaggaguaagaacucuugcuugucccagcauuuaagucuauguucuacaguggcuuuccaggugcugcugagcagcauuggcacugguggcacguaucauguaaccugccacagacugcaagaauuauuguaggaaacauuuccuauaauguuacaacagaagccugaguuugggauuaacgcuuuaagcaaauuuauaaaaaaaaaauugagcagugaauguuauauaacuuaauaauuuuuguuauugguaugcccuuaaaacaacauuuauuuugucugcucaacauguuuguuuagacaaaugccuguuagcuccaacuuauuuccaauggacuaaggaacugacaagacagugcaggguucugucaguaucagggcacuauacuccugcagacccugcagcugcaucagagccuaugugaguuuauauagaaggcaaagauuuagaaauggaucguggcugaccuucauuguuuggcuguugaugauuaaacuuugguacugaaaguccuuaauguuuuuagaaaguaugcuuaguaguaccuacuacuacugggauaacuuuuuaugcuguuuuauuuucauuaaaugggucucaguuucugaacacuguuaaaagaauugaaauuaaacuuaagagaaaaaaauaccaugauauaaguauuucucucaguaauaccacucagccauaauaauucugcuuuauaauuguuugguauacuuugauaauaaaauauuagaggucccauuguuaaauucuugauaccacuuguuauuuuuaagaugcccuguaaaaacuccagcauuaaagagacauauacauaaauuccaugaccugcccagucaauaucuauaaauagaauacuguucauguggaugacauauauuaggaagcgugaacuuauauugaaaaauaagauuuauauguguguagagcuuaagagaaugcuuaaaauucuuauucauuuuguugugcguaaauuaugaaauguaaaaagggauuuauaauuuggcauaauuugaucauuuguaauaauguaguuugagaaaaaaacuauaugaagaugccaaugaaucaccuugauuuucagcucuacaaaauugaauccaauuuguggaaacagaaguuaccuugcagcuuuuuuauuuaagguaucucaguuugguaaauuguaggucucagaaaugcaaugauaaaaugcuuguacauuuuuaccaaguaaaauauaaugugcaucaucuuguguacuucauuugucucuagugauuaaacuugcagagcuaaaugaauaaguguauaucuugagcuuccaauugauaugaaauguguuguaaguggaaggaacacuuuaccuccaaaguccgaagagucuaaauauuuacauguuucaucucuaaucaaacaagauaauucugaugcugaggcauaccuuuccuuaucugucaaaaaaaaaaacccacuggucauaaaauuaauaacuuucugcaggagauucccuguaaaucuuuuuugggagcaaguccugagucuaagugaucaggaacagcuacaaagagcugucaauaauguacaggaaucaaggagguuuucugucauaaaauuuugucaaauuacuuuauuguuuucucccaaguuuaaaccacauaguuaaugucuuugugaaccuaaacuggagaaaugucacucaguauuugauucuuaaggcuuacauuuuaaugguaucuuaauuuuuaauaccauauguuaaaaguucaguuuuuaagguuaucaggaaaaucaaacauuaaagaucucaguuuaauaagaaauacucuacuuucugugaaauuaucauuuucaugagaaaauaaaaagauaagcuuaaaauacuuauaauagcagagauugaaagagagaguucugaggaagggagaugaucauaagaacaaagcauaauauauauguauauauacaugcacauguauagauauaacaaacccauuauauuguguguuaacuuauuaauuguguguuaacuuuuuaauuuaaaaacucaacagcuaaguuuugaauacuauuauauuuuacuaccuuuuauuacuacuccuacugcucaucccuugccccaacaugaggugcauugauuaauaaacaaacuauagcuuuguugguaaagaggagacgcuccaaaugccguguaaugucuauuacuaaagaaacucuaacagaaaacuaguaagugcuuuacacccuauauguucguucuaacuuggaaucaucugugaaaaguguucuauaguuuauucauugugaacaagacuguugguauauuaagagguguugauuuucuuuugcucggucauuuguuauauaguuauuaaucauuuaaguauauggacauuuuaucaaauuuuaucuauauauggagaguugggcacugauuaaaaauuuggauaaacagaaacacacuaaugaaaugccuucuucugacuucagcuuauguguuguauuauuuuuccacaugaaagaauguuauaagacucuucucguugguaguuguuucucaccuacuugucaaaagaaauuaucuuuguucguuuuauagagguuugucaaagguacagguggaagugcacuucuuagaaguggaccuucuuuccugcauauacauuuuucuugucuuuuaucaagauauaacagaaagaaaaaacccguaaucguggucguaaaugcaaacauccgagcuucugagcugugggccuuuucuuuuccucuucuuuugaccuuugagggauguucugacuuccaaaucagucuuccugcccagcacuauaagaaguuaaacacgagcuucaugcggcugcucacucccuuucacaccguagcuccagaccucuuuaccuuucccugcuuuuacagcaaaaauaucaucacacauucauuaaaccgaugcagaacuguuguggggcaaguaaagcauucuuaauauuuauucccaacuguguuucuuggugauauuagccuguaaagcuaacccuacucuuuuuucuuggauacugcugauuuaagauaggcaacuaguaugguuauuagaacucuugaaaugaucaguaauaguugaugaaaggugaaaacuguaaaugucugugaaaauaaauuuuuauaaaaaugcaaaugaauggaacaaguuucuauguauaaauguuuuagauuguugaaaacuugcaaaaagucacuugcuuaguggcacuuguaguagcccagcugugaguguuacugugcagaagccucugugacgcuugaucaagugucacuuuucacagucaccugucuaaguagguggcucuugguaaugugugacaaaacucuguuuccugaagagaucuuuguggaaaucuuauaauuuuuaauucagcaaaacuuugcguuaauguaaacaauguaaaaaaugccugguuuuguuuuauuuccuucuguacguuaguuaaacagugcuacauuauaacaaguguauauuuguugcuguucuuuaaaccccugagauuuuuaagucuuaccaaagaagcucuuuuuaaauggcacuaggugucuuagaacacuuuucuaacuuuacaucacugaagguuccauuucugucuuagccaagauucuaagcauggcuuagcucaccuacucugaaauguuuuugugggcauucuguucaggucuuauaaaguuuugucuugaucccuccucuuaaaaacagagcagaugaaaugcacauagggcucuucauaaaagcacauuuauauuuccuacuuugaaacuguaaagcuguguguguguguguguguguguguguguguguauguguguguguguuacugcuuugcauugagaaguaacucacgggggucuuacaaaugauaugcagggaaccuugcauaacagccaguccuccagucuuucuuucugugcgauacuuuccuuugauugagagagagagagagagagagagagagagagagagagagagagagagagagagagaaguguaguucagagacugaaaaucuggcuucaucuuuuuuguacacuguaacucucuccauggucuauaggccuuuaaauacaacuuauacguuuuccauucacuaaauucaccacaaaaacuuaucccaacguuaauucuguacaaauuaugucaaauauauuguauauuauuaugagacacaccuuacuuauuauuuacauacaggauugaguaugcagaauacacaguaaaaguugcagcauuuuuaagaucagccucuccucaguccagcucuucuaaccuccacuaccagcaggaauagacaccagcaggaauagacgcuuuacaggguuaauugcagcuggcuguggggcugaaaccuuuagagcuuggaguggccauucugcuuuagucauuagcccugcugccuggauuguguacccagcaguuccuauuggaugucuucacagugagugaucuacucuacugggccugcucacacuugauucauucauugccugguuuucuggguggaaguuuuuucccuaguuaccuggguuguuaaaggcaucuuggcuguaucaguguguguauagugugugugugugugugugugugugugugugugugugugugugcaugugugugugugcaugcauacauauguacauccucauacacauuccugagcaaauucauauuaagugaaugauuguuacgccuuucuauauaaaauagguguugugaauagugaagaauuuauaaucuguugcacacuuguaauuuuaauacuuaagcuaacauuugcgaaguaguuuuaguugcuauagucuguaguuacggacacuagggggcacugcuuauccucaguacauccuucucugggaaauuaguggaaauauucagcugauugcuucggucuuacuuuaauuaacaauugaacuuagagagcugugggauguuugaaucuuuguuauuuucauuuuauuucuaguacagauauauaggaauaacaagcaggaaaagcuauagauucucgcaaauacagucucaagugucccauacaguaacuuuuucuccccacuggaaaugucauucuuggcaaaaccagaagggcaaauuugcccagugaugagguuuagaucccuugccagcugugcugcucaccagccagagugagagaaagcuuucacaaguuagugugccucacuuggauaaaggucaaaggauguuacacggaggaccugaauggugggcauaaauagcauguuuugcauuugguuuauacacauguauuuuaguuaucuuguuuguuauuuuuagcaugugcucuggagggacuuguagccuaucagaacuauuuuaagcacuaucuacuccucaauuucuuaagucuacucacagauagugcugugggccaacaugaaagaagcuuaaguggcaguguaguuagcugaggguuuaccauuuauaauuacaccuugaauauguuuuaaaaccagcuuuauucuaaucaucuuuuagagucuuaauucucuuucuaacuuuaauauucauguuuuuagucagggcaccgccugccucuccuaagaauaugaauaccauuuuguguuacaucucuuauaugcuguaaaaacuaaaacucccucuuccuccugucucuuccacgcuucccuccucccauucuaaaagucuuugaggauguagaacaauucuacccugcucugcuaaugaacuaaaucuauuacagaacugguagcauaucauacucucucuagcuauauuuugugaaugacacucaaaucauucuucauguuuauuagugaaagaugcugauuuuuuaauauaauagguuagaauaaaguuuucuugccuauguuaacauuuugugaccuacauuugguauuaugacaaaaagagguucuuaauggaccuaaauuugucagaguaccaguagaauaccagaauaugagcauguggacacuuuuaaauaaaaguccuuaguuuugcagcauaccauauuagcuuuuucuaaauaaguacuugaaaaagaaauuauuuugaagcauuuauagaaagaugcauauguauguauauauauauauauauauauguguguguguuuguauguauauauauauauauauguauagccuuagauugauuuuucuguuuuaauuucacacagcguuucuuuagacuuuuuaaagaaaauuauuuauuauucucauuauuuccauauauaauguugaucaggagcaagugccucagcaucuauaaggaggucagagggacaguguuaugaagucggugucuucuuucaguuuacauggauuccagauaggaaagcugggucuuuagguugacucaacaaccucuuugccuugugagcggucucuccuacagccaagugauuccuuaaaguguguauugaauaauacauauuuuuuaaauaaacuagugaugggcuuuuauaauuaaaaaaaaauaauuccaaguuuaguaagcaguucagagagaaacguuguguagcguuuucuuuuccuaauguguuccauguggcaucauaagaauauuagccaaaacaggguauccgugaccuuugguaauggaucugucacuuacuaagaacaggcaccaccuaguuauaccucaucacuucauaagcaaaauacugauuaaucauuaugggacagcuuuuauuaucuucaacauuuuauaaugugaaauguuauuuucugguacuaucuacaagugaucagaugccaacccauuuauaauagguuuuucuucuucuagcaggauguugcuuugggcuauaaaaaguuaauuucagauccugauaugcuugcauuaauuuuugagacauuggaugguuauagaacagcaaagaauaacaugaacgucacacugugcuauaccuaaucauugauuaccucaagccagagacacaguguuaauuugaagacuucagugugcccauagaaaagaagaaaugugacagucagggucuagagacagcaucaugaggucccccaaagagagcagcagagagcaugaaaacaaccauggcacucacuccagcaugggccaugcacucuagcaugggccgugcuuacuucccacuguucugggugucuuugaaguuuuaugauuaaaguaaauuacucucuugaauaacacagcaccuuuuuuuauccaaauaucuuaucuucagaaugggaagucuaauuguaauguuaucuuuuuagagccauaaguguucucuaaaaaaaaaaaaacaaaacaaaacauacgacuucgauguucaucagcuggcauguuugauguaauucaccaauaaauuugaauaauuugacaaagacgaauguuuccauguucauuuccauaguaaggcagucucuacgugaagaaaccauuugacugacuugaccugccaaauugaucagaaaaagaacagaaacaacagcuauuccaucuauagaauuaaagcaguuuauguuuauaaacuaccuugguggucugucagccuacaacuuacacaaaaguuggagccugagguguuacuagaaagcagagugcuagauuuuguuaucaaggaauaaaaggcacauuugcuaacugauaggacaguguaguauaagcauguagcagagaccuuguccccuauaugccuuaguuuuugaucccagugucauuccaugucacacuacaggugacacaccuauguuaugucaccuguuuuucucuuuaauagacaacaaaugaauaauuucuucuguguuugguagucuuuaauucuuuucuucucugugagguuauagagcagccaugucauuauuaauauuuaaauuaguuucagcaacucaugauguuaauuuauaaauucauuuggacuauagaugacaucauuauuuugcauucauaacuauuagaauguaaauuuuagaacaguaggcucuaacccacccauucccagauaauaaaaagcagcuucaauauuaauuaccuccuagaaauuuuaauucaauuacuggaaaucucagcaaaaguuuauuguccucuuuguuuucggaagggacugauagacacugcugugugccgaaggcugugugggaagagauaccucuagaguagguuugcuuugccugacaagucagugacaggaaguagugugcuacgacacucacaguaaggcugacucuuguuagagagguaaggaaucgggacuccagaggcacugucuucuuuccuguaguauucccugguccuggucuguccauaguauccagcuuuucuuguucuaugacuuuucugacugugauaaauuuuccccucagagaugccacuauuacucuuuucuauucuguguuuuuugaauuccucuagaaugucuuucacucucuucuucaagcauagugauauuuuguuguuauagagccaccauuuuuucauacauauauaugugccuagaagggcaauuuggaagcugucuagcaaugugcuacuuuccuugcauaccguaugucuuuggaaauuuuuuuuuugucugaaaccaucucucuuguucaucuauaucugcagcgugucuacaaucucauuuuauaaaaucuauguguaauucucuuuuguauuuugccuuuuauauuauuaacucucuguaaaaauaguguaagaaguucagccugugcugcugucaaucuggcacuuuccaugaacuguuuuaaaauccccaaaauuguaaaugaaguaauuaaccugauaugaagaagugacaucuaauugacuuucucaauuagugaacuacuaagucuuuauuauagcauugccauuuuauaggauuucauauuggcuaaauucgccacuuaacaaaaggugugaugcaacaaaauccugccuccuaucauuauucacacagagcugguacuguguaggcuaacuacucuguuuaucuuaaauuauugcugugugaauaaguuuaaacucaugaauuugaggcaaaguuuaaugauaauaggauagaggcugcaagucauggacucaacugguagaauucucccuccccaaagaagugcaugcuaaggagcagacacaugaaagaaaauuguauuuaaaaacuucccuagacuccucccuuaccccauuucaccuucaucaguguaaguuuucauugccugauaucagagcugucauuaguugccuaaacgauggauucgagggguugucucuucugucagugagcugaagcuuugcuccuguguuuuccauuaagauggauaucgauagagaacacuuaguggacaauggcuguuguuuaugguucacuacuaguacgugaacucagaagugcucuucgacuacauauagugcaugcucauugucuaugaagcaaagugcagccauauaccugugaguaaauagcuacuuguuaauccaguaucaucuuucauauaucuguaaaaaguaaauuccugaaagccuuaucucaaaauacaguacuuuaaauguuuauuucuauagaauuauguuuuaaaauaccuccuuuuaaaaauuuccuuuacuuguugaucaguguaguguacauuuguuuuuuauaagaaacucuaauuuuauuuucaauuuaguauguaaaaauuuaaaucuaaacaauuucacagcuauuaccucagcugcauugaaaacaauuuuuuucauacaauauauucugauuacaguuucccuccccucugcucauccugucuagauccacacccuuuuggucuguccuuagaaaaaaacaggcaucuuaggaauaauaauacaauaaaacaaaccaaaaaauacucagaauaugaccaagcaaccaaacaaggaaaagagccaaagaaaaagcauaagaaauacauacagaugcagacacacacauucaugugcacauugaggaauccuauaaaggcuccaagcuggaagcuauaguauauaugcaaaagauauguaagguagaaaaaaauaugccuuuacuuaauguuaugagacaaagaaacucgaaagauaccacugagccuaauuuguauuguacuuucugcugcuagguauaagauccaccacuuaaaauauguuuucaguaguugacuggauagaaauuucuuguaggaacaguauuuucuugaaggcugaagcagacagagaaaucucagguauuuagugaaaguuccuagguagcagagccaucuggagacccuuguucaaauauuuucagacaguucuugaaacuggugguuuacaauuauuaugauacuaucuuuuacccaucuaaaaaugagugucagccuaucuuggucuguaguaauccacacuuaauuggccuauccugguuuaagaucauguaagggauuuuaauuuagcuggucuguauguuauauauacauaggauccacauaaguacauagacuguaucagugcccccauuucacuccggugacucagagccuccauugagaaaaagugaucaaaugaaaaguccuugaauauccagaggccaaacuauagagacacuugggaacacagagcaacuauguugcaggaauggcucaaauguuuguguguuuuguucacaaacuuaaguagcacaguuuaguuuucuucaauuauaagggcaaaggcugagauuggagaaguucauugauggcucuucagugacaccucucaggccaccuguggaaaccauacaacuugaucuugucucagaacauguggaguagugguuuuuuucuauacuuuauuugaaguugagauuauuuuguacuuaaguguguccaguuuugaagucauauagcuuggccuuuaaugucccacaugaaauaccuugcuuuaucugacacacaucccauuugaaauguagaaaaucaagucauuucccccugggcuuacaaaauacaauuuuaauuuuugugaguuugauuucuauuugcauuucaguggccaauacuucuaauucuuucagcuuuauauuuuucucccgaccuaaggacuguguaugagauugugaaaugauuuaaaucuaagagaaaccaauuuggucuuguggacauuaacagcauaagcuaucuagaccgagcuugggacaucacugaaggcccauccuagauucagagcagccccuuaguucucaguggauaugcugggccuucaguacccuucccauccccacugcccacucuugucucuuuccuuccucuucauuuguucacucagaggacugccccucauuagcagcauacuugcuggauacugaaaaccaaaaacugaaauauaaaauguuuuuaaaucucugaacaagaugucccucuugcccccuaucuaucccugccccccagaguccacgucuuuaaauacacaccuuccacaggucauuucugagaaaucauuauauguuaagaggucaugaacuagucaguggguagcaaauaggaaugugguguugacaaaaugugauccugccuacuaauaaccaaaauuuaguaggaaagagacacuaaguaaauggcuuuccaguauaauaacuguuucagaaaagaaaauguaggcuauaaaauacaaacaauaaaguagucaacaauaggugugcuguauacaaauuauuuccccuaccaucgagguccuuguauauaaaacaaguacaugaucuuucaacuacccggggggacggugcggggggggggguguucuaaauacagaggcccacagccagacauguagagugagaggccuuggaccacacagcccugacugguauaucuucaccaaaucacuucccucgggauuuuaggaacccugcugaacaggcuaaaguguguaagagccaguggggaugaaagacuccaacaaccucaggcccucagcaccaacaagaucaaaguucauuuaccucucgaagacuuaggcagccugcaagggucuugagcggguccuuugcauaucugguguagcuucccuguuagugguuuuauaguguuccugagaauauaaacaaaugggucuguuaacugagacuuuuauuggguucuuuucccuuuguuuguuuuguccaaucccaauguguuagcuuuuguuuugccuugcuauauuuuauuuuaucccuuauaaaccugcuuguuuugugagacagaaagggaauggaucuagaugggagggaaggugaggagaaauuggguggaauagugagagaagaaaguguaaucaggauguauuaugugaaaaaaacuauuuucaaugaaaggaaaaaaaucaugguauacauauaauuuauauaugcauauauacauauacauauauaaucauauacauauaauuaaauaauaaagcaaauuuucacacugaaaaaaauuggagggggugaaauaaaauauauguauguaucaacucaauaaauggccuauacagaacaugaauccaauucucuccuaaauuguaggaucugaauacagaaaacaucuauuaccuacaacagcuuauaaauaaaaauaugauuuucucuguucaugccauguaacagaugucauagucuuuaaaauuaauguaaaacaauauagguaguaagaaucuugguuuuuaucuuuauuuuaucuguauguauauguguguguagguuguauguggcauagcauuauuacacaugaaggucaaaggaaaacuugcaaguauuuuucgucuguaggccccaggaauugaauucaggucaucagaccccagcaucagguauauauauuaaagggggaaaaaaucucaucccuuuauauuguguuuuccaaaccaaaagaauauauaaugguguauaucuccaaggcuguaacucugcucccagugaauguaccccugcugcuauucaaucuguagcaauuuauguuuugcuauacauccucaaacccuugaacacuuguugacucuugaauacaugcauaccugugauguacuuaccagugugcccgaguauuucuagacgauacccaucaacaaaugcucagaacugacuuucaccaauuauuauacauaugaugcaguuugugucagaauucauaaauauauucauaaaguuuuaauacauauaucauuuuuaaucccagcuaucauucucuacauuucucgcuugcucaggcugauauagauuuggagcuaagcaguguucauuucucacuuacaauauuuccuuuucauauauauucauaauaaugccaaaucuguguuauauaauaacuugccuucugugcucuaucuuauaaaaucaaaccucuaucaauuagccauugugagcauugcuuaaaauauaugcuugguacugacacuccuuuuccuuuacaauuuaauugacucagauaugagacgcugacuggcuuucuuguuuuauaaaguccuuuuucuguuccuaccuuuuccuuucagaucauguaguuuuguaaagcgcuuuuccucuccccgagacugucagucaccuaacacugccuuuuuucccuuuuccucuaaaccucccuuacuuguaucuuuuguggcuccagaagccuguacaugauaguguggccuaggcaggaaaggaaaaggaagucacuacugcucccuucugacugccugcaauaauaaaugacaauuuaccauucuguaacuguggcuagagauuuaucuucaucaaugcaugugaccuaagaaucuuugguuuacaggcccuagcccuugguauucuugccuguggagagcuuuuuccuuccugaaauuagacaaagguugcaagacuugaagcuagggcuacaaaacacaggaaaagagaguguugucuuagccugucgcaguagagauccagcuggcuguauuuaccuaagcagggugugagacugcuuguccaucugggagggcucuguaaggacugagaugggcucugguguuugaaguuaggaaccuuuuaaaauacugcuuauacaucuuucuacaugggugauuuucuuucuucuuuuauuuuuagagaauuucacccaagcguacaaugcauuuuggccaaaucuacacuccauucccuccauuccaauccccccucccaggcuacaaauauucccuuuggauuucauguguucuuaaaaaaaaaaaauacgaaguccuucaacugucuuaauuuuggaguauauaauuacauuguuaagcacucagcagaguaauacuuuauacuuuuuagccauuuuguagucaaucuuaauaucuguguuaugcauacaguggccaaacuaauuucuauggagaccauaacaugugcucauugaaaaggaaacuaccacuauuugcagcaguucacagacccacuccagaugaccaugugcaaguaaggaugugugcuuauccuguuuauaccacguucgucagcccagaucacuuuagacugggagaaugcuuuaaugacucuucacaauguuccucccuugguaugaacuuuguugucacugaagaauaccuugauaccauaucucaaaggaaguaugcucuaaaaacaugaccaugaguguaagagcagaggucaugggcuggagagauggcucagcgguuaagagcacugacuguucuuccgaacauccugaguucaaaucccagggaccacaagguggcucacaaccauccauaguaguaagaucugacgcucucuucuggugugucugaagacagguacaguguacuuacauauaauaaauaaauaaauaaauauuuuuuaaaagagcagaggucagaaauauuacuaguugcuaugucuugucccucuguccuucuuuuacuaggagagugacagcuacucuuauucucauuugaggcuuuuuagaauauucaacccuaauaagagagagagagagagagagagagagagagagagagagagagagagagagagguggaaggaagaaagggagggagggagggagggagggagggagggagggagaucuuugcuugcugauugcuuuuaucuguaacacuauacugccuuccucuagacacauuuucuaucucagggcuuuaucuuuaaggaaaauguaucugcuucuguaucaaaaggauagggggacucuucuuucccuaaugugcugcauggugguuccauacuuccuggccaucucuagccacccugucaaggugggaguugggaaggaaagcagaauuaccacaguacagcucuguccuucccagugcacgcugguacugugacuucucucacacucugauuugaggauuuuaaguagacuuaauaaauagcaguuuucugucaccgaaccauaucauuauggaaguguugccccacagauaugaaggcuaaaaacaggccuacacagaguuuucccuuacggaaagaguuuuggaaaaugaaguuugucaauuaauguguuucuggacugagcauuuauauagacuggaauacaucuguggagcaguuugugccgcccauuugcaugggucaccuauugugugcuguaugccccaucugcugcuuuucuuuacuacucaaaaugauacuagcauugagguacguuuuaucauguccauugauugucucauaauaagcacagaaaauagucaaaaugauugauuuaagguaucuuuccuagacauggcuaagcaguaucugaauccauggaauacaacuuuagugucccugaauugagugcuugugugacaacauuuaguuuauaaaaccagaacaugugcaugugaagugugaacugugggagcugaauaugagucuggucugaacuuccagcuggacacuuuugucuucacauuucaugaacugaaguuuguauaacucauuaucaucaaggggucagugcccaggaggacagaagaaaaccuugaaugcuagagcaaaggaguugucgcugucacuggcauaacauaagagauggcugacuagagcuuuggugcacagcugggaaugccauuugacagagacuauccaggaagaaguagacgugacacgagaggauauugugggguagggaaguucaccaagcacauagcucuauucaggaggaaaugcugcguagggcuacagagaaagggcaaguaguacuagcucuuaaugcgcuucaaacuuuugaaacugcuuaauauuaauucuuaaccaacauaucucuagagggagcuaaucuauuuuuguacacauauauuguuaaaagacaccacaaaccucagcuacacuacuagaugcagcgaugauguguaucacgcaguaguucugauacuugcauuuuuaaaucgcaguuaugccaaauucuaaucugaaggaacaugcauugcuugauuuccuuucaguuauccuuuucuuacaagaaauucacaugcuguaaccuccaguacauauguguaacauaugucauaauguaaagcuaaggcaugccuuuucugaugaaagacuuugaaaauauucuccucauguuuaaagcagucucuuuuaaaauguagcuuugguucugccugcacacaugcauauacacuccccugcacucagaccacaguguccuuucaggggguccucuagucuugaaaaugugaggucuaguaagacaccugagugcuaguaauguaggaagguaaacugucacuccuuuccuguuaaaguuaagccaucccaggucagaacucccgccuuuagggggugaguacucuuuggggguuauuuaauuccccaaaucugagacccagaacaaaagacaugccaaagacaucccagcaggccagcaugauguccuuaagaaaccaucuucuuccuguccucaaauucaaucaggacacaccucugccaccauuuuagguaaauuacauuaauuuuuccaugucuuugauucuuugacaguuucacacacacacacacacacacacacacacacacacacacacacacacacacauaaugaguuuaaauaguuuucauuuccaguucccuuugcucauuucuuuuccucucccacugugaguacccaucacagccagucucgcuccuauguccauggcuuccauuuaugggugacacguuuaguuuaauuagguuacaugcaacagcuuuggaaggagcaucgucucagugguuacaccacuaacgaaaaugauccaccccuuccccagcaacucuaaacugccaggaaucucuuggggagaaacucuccccuauccauugaugaaauguugcugggucuagucuuguagaaaaccacagcuucagugaucccacgaacacaauggccaugucacaguguuugagguuuauuuucugggaggggaaaaaaaaacucauuguaaaguuccaggagaauuaaaucuugggaggacucuaaguuucuaaguacugaagggaaacugaaccucuaggacggcaugaaaccuguagauguguccagggacuuaugagaagaguaucagauaugucaauaagggcugugggaagagcauauaaaguaaauuaggugucagaaaaggccagugauccuggaagaagacagcagcccugcaaaaggcucagaccuuaugugaaagagaagcaagggaagucauugcugacccagggcccaagaugccagaggaucuuaugcccugacaaggucagccugacccgccauugcuuaaaguuuuaaacuuaccuuggaagaaaaagcaggaguaagugggcucccacuucauuucggccccaucaaaauugggaauaauaugagcccaaauacagauggcauaugcuuuugaucuguucaacguaccuguuauuaguuaaguugauuaaacaguuguuagacuaggaauaugcaaaauagugaagcuaaugcagauuacuuuacacugaaccuaaguugaaagaaauaugacuggauaccuggguagaauuaagaagaggaaaguaaaguggucugauagaauaccauguacacuaaaaucaauuuaauucauaaaauaauauccuuuuaauauaauuauugaguucagaaauauaaauaaauuuuauaacacucaguuaugaguuuuggauccuaacugguuccugucuuaugucuuagcguguuuuuauuugucuuugucguuuucaacauuccuuucugauuugcacuugagucacuucuuaauuauucuuuaaacuccuaauacuauuggagaguuaauuagauaugcuuuuauaacaagaauaucauauauugcugagaagcauccauugugguguguguguguguguguguguguaucauauugcugagaaguacccacugugauauauauguguauauugugugugaguuuauguuuguaugguauauacauacacacauauaugcaacaacacacaucuacugucaggccacaguuguccugacuucauaucucugagaccuaugaccauuuuccuaacaggucuagggauguuuccucaucccaaauauggaaaauagcauguuuaacauaaacugcaauaguaguuaugaauaaaugggaaaugaaucaauauccuguacuaaugaauacauuauuuguuuuaaaacguauugacuaguuuuuacauauaaauaucaacuguaacuuugccauuuuuuguagggagcagaggaacccccaagugugugaacuccuggauggaugugcauuguugacgugagccauccaugucaaggaccaaagccugagacucauuagagaucaguaaagcccucccccauggugaggcauagagugguggcaaaaaccuucauauagucuuggagcaaauguggacauugugagcacaaaguauccacuguagcuuuuuuccccagacauuuauagucugaagacugcuguccuccagagacuuaauuccaagauuagcuaaacuugccuucuugccuuaacuguucaauggccauauauuugucauuucuuuguuccuuaacacccuacuagguuaaugcuuagagcuguguaaggacaugacagaacauagcauuuuaagccauggaucauuaggauguuaacucuaugagauauuaaacucuuuaucacuucuguugaacuauucugaaguuguucugaacugaaaugagauaucauuguuucuuucuaaaagacuguuauagauauuaaauugaucuuaggugugauuguccaaaggaauugcuuagauggauaaauacccauaguucaucaagaauauguuaaacauugagauuguuucuuagagauuaaggguccuauugagauacucaugaaagcuauggaucauugccuaaaagaguacuccuaaguaauaugaacauaauuuuuuaguguuuacaugaauggauuuaauuaaauaccauuauguccaucuuagauuggcauguagaacuucaaugguaugucuuuuuccuuuucagauuucuagaaucccagcucacugcuauguuauaaaugacacccuauaacuuguuuuccugccucucuacuacacccauuucuugccucacucuauucuaucuaaaaucugcuucuuaaacauuccugaucuagguuccuagguaguaguuuccacuuggacuucccagugucuuugcaguaaccacacagcauuguggaaguaaagagggaaaggagaaagacuacagcaggccagcaacacauugaacaguggcuuugcaaaagaugacagccacacgaggucccaccagugcugaaguuuuugaaacauaaguaaauugacuuauaacgauucuuuuuauugauucacugccaucuaaggaucaaacauuugcgauucuuugacgcgggguucaucacagaugaaucuuuaaguuucacaaauugcucguuaaguucuuugggaauuuggcuauucuagacuucuaaauaugaacuaucaaauugauuuuuaaaccgcaaaguuuuauagcacuauuuggcuguaucauaguggacuagaauaugaugugaagaacaguuguacaagacacaucaaguguguaaaguuucugucagcuagauggucccaggucauucaucuagcaguuccgugucauuccugcuccuagaaucuuaauccccagacaguuaguguuugcaccaagucuguugccuguucgucucuuaauuuuauuucaaaaauggcuaucacgauuuaaugucuucagauaacuaaguaaauuugcauauguuagaaacagccauaauaaaacccagagccagaaguuuuuagauuacccgaaaauguuguucuucaauuguaacuuuaucaacuguaugacccucuguauguuugcauguuaaggaaaugagagcaagggcaugaaauuucuuccuuagccagauggauuuacucuugugggauuuuuaaaaauuagaugauguuaauguauuguuuaauauucuagugucaauaguggcccaauuagaauuuuuuuuuaaaguuaaagaaaauagauacccauuaguaugaaacauuuaacuggacuguuauaugccuuagagguuauagacauugcuagagcaggggaggguguuuuuauguaagucuuugguacugcauaucaauaucaauuguaguagcucauuauuauaugagcagaaaauacaaguucaccaaaauacaaaguuauaggugcaaaaaugcuuccaaggcaacauuagcagugaguugaaugcuuuuauguaguacucauuaauagacaugaaaaugcagaguuuaaucugagagaagaauugauuuugagauacuuaguucagaguaugacaaguaucaucugucuagacaugugacuuacggugucucugcaugagcucuccaccauuugccgcuauccccuuuguuaagugcacuauuauguuucugauggacaauucauugaaauuaaacacaaaugguagagaagagaaagugcccuuuuucuucaguauagggucauugguggaaagaaguacagcauuaugacagaacaugggcuuuaauuuuuuuguuauauuuuauauauuaauaugccacaucaggguguccaguauucacagauugaaauagcuuuugcuucuuuugauacuacaauuuuuacuuuuccauuuccuuaucuggcuagccacugagaaaguaucuuuucagaagauaguaaauuuuauagacauaacauuguauagagagcaguuaaaguguaauaauuugccaacauaaagaaauguaucagagaucaaaauaguaucuguagagugaaugagagugugugugugugugugugugugugugugugugugugugucuaaaucaucgaggaauugcguagccaugguaaagagcaggcuaguuaaauuggagaacuaaagcaagaugcuuuuuuucaccagugugccaccaccugaaaauuaguagaagacagucccgaguagcuaacagugagccccaggugcuaacuucucugaagcacugaaaugggaagugauggaagaaauuuauaaaagaaacccucagggauuccccugugaucccuuuaauccuugaauugucaagccacauggaaaauaauagagcugugucguuccaggacuuaaguaguauuagcuuuuugaaagaaaauguuggccuuuucauauccauguacaggaauaggauauguauucaaauagaaaggaguaacuuggagccaaagaugcauguuuuuuuuuuucauuucuaauauaguauugccuaugacuaagcaggcuuuauugggaagaaaaauuagagucaauggcuuauuuuguucuuuuuuuaaacagaugauucaacgagaagcagauguaaaaaguaaggugacugcuguggcauugacagacucuguucacaauguguggcaucaagaagcuggcaaaaccauccgagaauggaugagagaggugaggcauggcuugguuuggugcugagaugaaugggaaugagccuuuguauuuggagaccccagcaacuuauauugcugcccauccugcauucucuagagacagaacacucagaaugaaaagucuagauacaguuaaaauaauaauagaaaccuucuucugaagaacaauacuugcauccuuuccuccauuacugaauagaauauuaugcauguauacacuaugcauuagaauuuuaggugauaaggucuugauauuacaauuuauauucccuaauguucaauuuuucuagcuauuuguuuuugcagcugcauaauuacaagaaagaaguuuaauguacacucagucuugucucuuuuuuucuggaaauaugauaggauaugccacuaugacagugauuggcuaaguacugccauagggcuggaagugguaaaaagcugacuugcucuuacagauguuugagcuggccauugccccaccuccaucugggcaagcuguuuauugcaugucccuggugacucugaaaacuaaccaggaucuacuccucaacauggcccaugucuuuuucuucaguccauuauucagcccauugauccuauuacagacauccaguugaaaguccuuucuaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguagacacuaugccccuccuuagaagugggaacaaaacacccuuggaaggaguuacagagacaaaguuuggagcugagauuaaaggguggaccauguagagacugccuuauccagggauccaccccauaaucagcauccaaacgcugacaccauugcauacacuagcaagauuuuaucgaaaggacccagauguagcugucucuugugagacuaugccggggccuagcaaacacagaaguggaugcccacagucagcuaauggacggaucacagggcucccaauggaggagcuagagaaaguacccaaggagcuaaagggaucugcaacccuauagguggaucaacauuaugaacuaaccaguaccccggagcucuugacucuagcugcauauguaucaaaagaugaccuagucggccaucacuggaaagagaggcccauuggacacacaaacuuuauaugccccagaacaggggaacgccagggccaaaaagggggagugggcggguaggggaguggggguggguggguaugggggggacuuuugguauagcauuggaaauguaaaugagcuaaauaccuaauaaaaaauggaaagaaaaaaaaaaaaaagaaaguccuuucuauuuacauuaccuuccugagaccauaagaauuugacaugagccacaugguagaauaucagcaaugaucauauaagucaguaaucacucaauuaugguacuuacuccugggcauucuuuuucuauuauagacguucuuuaugaacaucaaucuaagugacaaauaagcacaugcaugcacauaugcagacauacacacaccugugcacacacagaugcacucacauaaaccuacaaaaaaguuaaaauauuuggaaguauccucccuccuaauaaagacauuuugugagcuggaauaaucuauaaacagucccgcuacagaaaacaguacuucuguguucauauccuguugauuagcuuccuuauuguaccaaauaguggccugaauuuggaauuaaacagugccagcaauugcuuagucauucuuauuauauuaaagacugguaaugccaugguuuuauuucauaagcaacaauuuaaugugauaaaguuguuuguauuaaacauuuuuaccggaaaccccuuaaauauuucaagccuaucaauuuagcaaacagaauagacuaagaauuaaauguguacaguaaauaauuauaaaauaacauuuucucauagagaaggcuuaaggaggacuacauuaauagucccugaaaggaaaccugcccucugcuaaagggcucuugucauaccaugucccaguacaguccaugcuuaauguguggcacaccucggccauagcccugacgugaagucuguagcacccucuuugauacccuuugacccuuaguauaggcccuagagacauggccuguucaugucugaggagcaaaaacuccaucaaaaauuagcccuuaaggccuuaauuauuuacaacuuaugugaggguaauuaauaaaugugaguaaaaccuagaaucaagcaauaaaggaagcuucucuaaaaccuugcacaaaaugaucuucuuuuucucuucgauauaccaaacuuuacauucuucuuaauaauacuuuacuaauuguuuuagaauuucauagaauauauguugauuacucugccugucucugucucucugucucucucucucucugucucuaucugucugucugucugucugucucucucucucucucuuuccucuuuccucuuuccucuuuccucuuuccucuuuccucuuuccucuuccuuuccccuugcccauuuuuauugggauagagagaugacucaaccaauaagagaaacucacaacuagcuauaauuccagcuccauccaauggaucuggucccuucuucuggccucugugggaaccugcacucauauggcauacacuaaagguuuuuauaaaaaagauugauugauugauugauugauugauugaaugaaugaaugaauguauaugaguacacuguagcugucuucagacggaccagaagagggcauugaauuuuauuacagaugguuguaagccaccaugugguuacuggaaauugaagucaggacuucuggaagagccgucagugcucugaacugcugagccauuucuccagccucaaauuaaaauuuuuaagguaaaauuguauuucaugacaagauggcucaguggggauaaaaacgcuuacugcacaugacauccugacuucaaccaguagauuccauaacagaagaaaagaauccacucuugaaagcccucacaugcccagugugauugacuuacacacacacacacacacacacacacacacacacacacacacgcauguacacucaauaaacugaaaauuaaguaagauaaaaacaaaaauuauuuucaugucuacccuaggcacaagacaaagcaugucacucuucacuguggccauuaggcacuucuuguuccugugacuauguccccuauguccccaaacuauggguuuuacaaagagaaauucucaagcacaaaacuacaagaucauagucacagcauaaggagccuuucacauuggaacucuuuauuuuuucuuuauuuuuuacagaccauauuuugucccacccaccccaauccacccuccaacuguuccucaucccauaccuccuccccccacccccacaugaccucuaaguucccuggggccuccagucucuugaggguuaggugcaucaucucugaaugaacccagacccagcagccgucuacuguguguugggggccucacaucagcuggugucugcugucuguuuggugguccagcguuugagagaucgcaaggguucagauuaauugagacugcugguccuccuacagaaucgcccucuccucagcuucuuucagucuuucccuaauucaaccacaggggucagcugcuucuguccuugguuggguucaaauaucugccucugacucuuucagcugcuuguugggucuuuuggggggcagucaugauaggucccuuuuugugagccuuccauagccucaauaacaauaucaggccuugggaccuccccuugagcuggaucccacuuugggccugucacugaaacuuuaguaaacauuuuuuuucccuuuuggacaugaagauaugugagguaagugauccauuccaauccucuggcucugcuuucuucacguuugcuuaaugagacaagcgagugcuggaccagcgucuccuggaagaacugcuggaucugugcuguaacuuaccgucuuggccacucuacaucaaagacugagauucaggacacugcugacaacaugucacuagggcugaaggucagcuagguuuccgaauguguagccacccgagauaccccuauccccugugaagaacuggaauuaagaggauaaucggggaaauaaggagaggggaaaaaagcauuagaacaauuugaaucaaauuugguuuuuaaaccauagaaacacaucucagggaaguacgugugagaagguaagguuuaacacagauuaaauacaugagaaaguucuauaugucuuuauuuucguauugcaagguuuaugccacuuaauuucacuucuuucaauagcaaacauuuuaccuuguaccugcuuucucuguacccuucccaguggaacuacagugccccaugagagagcauggacauucugccugccccucccugccugccccuccccacccuucaggcuagguuucuuuucuuuccagucauaaacagggauugcaggagguguuugacaucgucacauuaacuaugugcugcuucacuugucccugauuuuuuuuuuuuuugcaugugagaucaaaggauucagcauguccuaaaagaacuaaaauuucagaaucauaaaaugguacccuuuauuuuccuuuuagucucugaaccaaaggugaucuuuuuuuuuuuuuaauggacauaagguucauuuggcucaucuuuauaagucaagaugaguuagaaaaaugauuaauugcuuacagauuauaaugugccaucacuuuuauuaauacuagaaaauucuguaagacauaguuuuacaugugugagauguaggugauccguauuaagacugacauaucaccuggguaauagccaacuuucaucagauuuggaggcacuaguaagaugaauaauaauuaaaauauagaccuaaucgcugccugucuguugguagugcuaauugcugucauugaaaagacugaauuguuuaaacgugggggagagaaagagaaagucauucuucacugaagcuaucucccuguaucauaggaagccuauuuuuaguaccuauagaagucaugauuuuuuaauuuauuaggggcugugaugaaugauaaaacaaaucauccauuuacauaucuugacacugcuuuggagaauacuuauuucuuacaagcgagugucacauuguauauaaaagcuggcuaauugugugcuaaucuucugcauuaucuagaauucucugaaguggucuucuaucaaugguaauauuaauuguacuuauuucaaauguaugaaauaucuucuaaaucccuauuucuuuuauaauucauauuccucuuauauugucuaauuuuacuuucagcugcuaauuaagauuaggagugcacauuauagaauauauauccauuccaaacuaucaagcuuuugucacacaugaaaaauacuaauuuuuaucuguuuuaaauauaaaaagugugaaagcauuuaagaacauuacuagauguguuuguuuucaugguuuuuuccaacacaguucaauagcuucauugauccacuguuucuuacaaaaaucugccaugcuuugugagccucacuuucuaaucucauacagcaacccuuccuuuauauuaucgcugcucucucuggucccagaacaguaggguugccuugacaaaucuauucaaaagccauuccucggccuuuauugguggggacuggggccuuugaaauucucuccucacugcagcacagcugacaucuucuuccagacagaaugaauuaaggaaauacaauaagacacuugaucuaccagucaaggacccuuccuuagugagaacagauuccauggugcacagccagggcagcaagcaucgaaaaugcacaagacauacuguuuaccagaauagcagucacagauuuuucugacaugauugauggaagaauuucuuuuaaaauaaacucugucuauggaaauucuuuguguguguguguguguguguguguguguguguguguguguguguguguguugguguugggaauauuucuaaaacuauauaaucacaucuuuaaacuaguauuaaguauauauuuaaguguaugaaagaacuagaauguuauuucauuuaugugacuugccagucaccaucaccugcaagacugaauauuaauguugaaguuuuguguccucagauacagcuacaguucaucagguuguauuuguauauaauuuugauauaguuuucauugaagugggucagaguaaacauugaaaggaauuacaggccagaguugaagccuuuacaucuaacuuuucuuagaaauauauugcaccauaguuuacuguuuaugugucuuagcaucaacauggauuauuugcugaauuauaaaagguaaaguuuucuauaaucauuaauaauuacugacuguuuaaauaaguaaaacaauuuaaaauguauaaaauauaaauaugccacugauuuauuuuauaggacaaauuuaccucuucaaccuagaaauguagcuuucccuuuaauuauauguaaucagcauugugucuguuacauugcagaacuguuguaacugggucuccagcucagaaccauuagauacaucgguggaauccaugcugccugacugucccagagugucugcagguauauguuugaugaaaaggggaguauacauaaaagucauacuggugaaguguagaauucuguuuugugaauuaaauacauuauugcucuaucucaaacuguuuauaauauauuccauaagucuaaaacaauagcaaaacuuaguuaaauagcuuaaaaugcuuaucaacaaacaugccaagaauaauauagagaguuucucuuggagcuuagggagaugaaacugugcuaaaagacaagaacucaguagccauguagaauuucagaaaaauguuugucucugaguaccaaucccauaaugucaguuaggcauaugaucuagagauaauguauuuucaugcgaagauuuuuaaguggaccuugugugugaauccuuauuggauuuggauguaggaaguuaugcaagguggcauccuaggcaaaagaaacagcauuggaaggaagagagccaaaaugguucuaaagacauucagaaauaguaaaggcaagcauguucugcccguugaaagaagaaaggcaguaaugcuuccagaagcagcuggacucugggacaugguaggacaguguucauuucuuuuguaucugaguaucuagguagaaagugacauuauauuugucauugcuuuuuuaguuuggcuuuuacagcucccaauaauucucuaugauaacagagagugagcaguagugauaacuagugacagcagcugacuugcuauggcuaugaaugcuagaaaagaaacaggaauuuggaacagagacuauuccaugucucagucauagaugacagcuaaucaccaaguaaauguguuuauuauuugauggaaaccauuuggugacugguucaaauuguaggugauaacugcugauaguuaaauaucacucucauuaacacauuaacugaaauucacuguuauuacaacuaaacuuuuuguuugucagucaaggucuaaucagagaaauagaacuaccaagggguaucuaugcuaugauacauuuguauauguacuuuuuacaaccugcuugguugcucgugguagcuauaugcuaagaaaucucaaagcuggcaaaugcugucucaguaccgauggagaaaugcagaguuaguuuccugagagccacuggccauauuuuuuuaucaaccaauaaucaaaacaaauuccuuguuuuauaugagauucuacuuaaauuuacauccuaucacguguguuguucaaauccaugcccaacagcacaguaauucaugccuguacauggcuuacacauacauuucuucauagcaugugucacagcuaucuugcauauaagaauaucacagcugccuuggaugaaagaauaucaauuugacauucccauaacaccauauucaggguaucauuugaaaugugaaaucaaaacacaaaaaugugaaaaacaugauacuaaacaguccaugaaaagccacuuguuuacaguauuaaaacugaaacaagaagauaaaccaggaccuuguugaaacauaugaaugaugaugcaaacuuuaguaacucgguguauguauguaaugacuacaaauguagcauaaauguugauuugggguuaucaauaaguuguagugagcagaugaguucaaaagucuaggauacagaaagaauuaagacauuauuuuaucuguauagaugacagaucuuuuuucuuuacugauauuugacuagagcuaguuaaacaggcuuuucaaggacaaaaauuugcauuugaugcugugacuuuaggaccuagaacagauacuuaccgaaguuugauauaaaguggaaaagaacaaaaaugggcuagaacucauaaaagcuagcuuccacaaagauggauucauuucagugaaucuugcuuggguugucugugguacacauguccuguggaauuccaugucccuuguuauggacuuaaguacacacauacuugcucccaugggcagaggugcuaaaggaaaaacagagcaaguaagaacagaagcuccuagcuacugccucccacuacaagauauguccagauguuguaugcuaggaauggcugcugcucuguaguguauggguccaugacuuaccccacccccaaacacacacacacacacacacacacacacacucccuuguaugccuucuuaaugagaaccauagaaacaaauuguaagcuaucauucagccuagacaaauuuacaguuuuacacucauuuucaucuccuuaauauaucguuugaccuagcagaugguucauaucuguaacccuuauacuugacuuagauaggaggauuacaaguucaaggacagucuagauuaguccuugaguaagaaagugagcuccaggccagccugggucgugugugugugugugugugugugugugugugugugugugugugucugugugucugugugucucuguguguguguguguguguguguguguguguguguauauauauauauauacauauauauauaauguauauccauaccaaaauaaagaaaaaauauuacuaucuuuuugagucuuugaaacuguucauguaauuauagcugguguuuacaaccaucuucuauguauucaguaccuguaggcuuucagcugcuuaguauucuucccuaguucaaugauguaccccuuuguuccuggaaggucuccugccuaaauuagaguuuuauaauccccuauugaauauaauugcaggaaguaauaacagccuagagaauuucgggauugcugauugucuuacuuauuugccuauugcucugaugaaacucuaugaccaaggccacuaacacaagaaauuguuuauuuaggauuuucaguuacagaggguuagagcccaugaugguggagcagagucaugguggcaggaacagcuuaggucuuacaucuugauacucaaguaggaggcuagaagguagagagaggcagaaagaaggggaaggugcaagucuuuugaaaccucaaaguuuugaaaacauagugacacacauccuccaacaaggccauacccccuaauccuucccaaacaguucuaccaacugagaaucaacuguucagauauaugagcccaugggaaccauucucauucagaccaccaaacagauaaauucuucuuuaccuaucauauaggagcaacucuguuuucacauagaaauaaggauaugucauccacauaguagcauaacaacaacuauuuccuguaaucucagaaauaucagguaauuaaaguagaaagauagugguuucaauuuucuauggaauccuuauuauaaaaccaacacacuauuccuuuuuguagaaccaagacuuuagaccagaagaaacuggagucaccaccagaagagugggaaacagcaguuuuauuaauagaucauuagggguaacagagagguuagucacucuucuaucccucacucacacaucaauaguaaauagcucugucuacuaaacacucgucuagaggacacuguuucagcuccacuggguucugccucucagcaggcaucauaaguuaauuuuuagaagguauuuccacuguuuuaucaagcuugcuguugagggacaauagggaacaugguaaggccauggagugcuggcagaccucaggcuccaccucgucuaucacugguccuucugaugaaaacuagcugcugugcuacaagcugcucuuuggagaaacgggcauggugaggaacaggggugucucuggauaaaagcuaaugagaacuugaggucuuccaacagccccaugaaacauccuugaaagaggaugcuccacaaguugagccaugagugaacugcagccccagcuugacuguagccuugugagagaugccaccaagaugacucagcuaagccauguuaagaugucugacccacaggacugagaugauaaaugaguacugucuaggggaugacguauuacucagaaagugguaguuaaugcugcagaaugaaacuuugacucugggagucacuguacccuguguagcaacaccacaaugcacuuacuuaaguaaguaauaaagcuuuaugaggcucacuuucuaauauugugacccagcagggaaacccuuucuagaaagacauuuaaguacucauugaagaucaucuguuucuaccuuugcuccacuccucacuccaacuccccaguuagaccaacugucaaaguauucaccuauuuuuugaccauuuuccccucccuuaaagaagaacuugcuccucuguaguaacuucuuaagggauugaguccagaaaaauucaaaauauuucuugccagaugcggcaacaggaaaaucacaaauucaugggcaggcugggcugcaaagcaagcucuugaauaggcuagacagccuguacaucauagcaauagucuuguucaggggugggcauggagggauuuuauauagucugagcaguacacauauauauauagucuucacauaauaaauacuuaaugaguucuggguacuauuugggaccugaaaacagagcaguuaguagagccuaccuuaaccguauuuccccuuggaguuaaaacaagcaagcaagcaagcaggagaaggaggaagggaggaaggguggaagggaggaagggagggagggagggagagagagaagggagggagggagaaaagggagggagggagggagggagggagggagggagggagggagggagggagggaggaagaaagagagggagggagggagggaggaaggaaggaaggaaggaaggaaggaaggaaggaaggaaggaaggaagagagaaaagagaaagaaagaaagaaagaaagaaagaaagaaagaaagaaagaaagaaagaaagaaagaaagaaagaaagaacggaaggaaggaaggaaggaaggaaggaaggaaggaaggaaggaaggaaggaaaagagagggaaagaaagaccagaaaagaaaagaaggaaggaaauaaaucuucuaucuugcugaugucagauguguuuuuccuuaaaugcugcauaugguaucaaauugguguuagggcuggcaucccuaacuccucucauucauaugcacugacaaaagagaaauaguuuuuccuccaaaaucaaugauuucccacuuuauuuaacuuguuaacaaaaaguauccaguaaaugcauacaagaaacaagaaagaagagaaauaguuuggggaaggggaggcaaaaugaucaaaaccaguuguaaacauguuuaaauaaaauauacuuaugucaagacauuuuaccauacuucauaaauaucucaaaaguaaagaacuucucuagcagaggaccuuaacgcaguccaaagcaccuguauuuggcagcucauaacagccuguagcucuccuucccagagaucuacacacacacacacucauacaaacacauauaugcauacucauacacacauauacacacacuuuaaaaaugauacuuuuuuaaaagaaaagaacaagaagcuagaagccacaaccucggccagccagaugaaaaggcagguauuugggguugguuauggaaguuguaauggugccaaagggaaugugaggauagaaggcuaaacagagaggacccacacuucucuaugaugcccagauuuauauggaaagggagaaguagcaauaagcuccaguagaaauaccuaguggguauuuaagaaaucuuaguucugugucagaugaucucuuuccuacucuuuuaauuguuucauacuauucaaaucagucaguuauagccacugcuucucagacaagaaugugagcaaguucuguagacucuggagaagugauuuuaauacagcagaaagaaaacauuauuaaaauauaaugaaauacaauguauucuuuguaagcuuucuuuuuaacuuugaagguuuuucuuaguuuuuaaagcuaugauuucauugauauuuuccuguguucccuuaaguuaguagguucauaaaauaucauauggaaccuagacucuuagacagaaguuugaaaaaggaaaaagaauaguuggauaaaaaguguuccauggacauagaaaucuggauacaauaaagucugggagagacauaauauagagguaaaguugaaaugagauacuaucuuggguacuguguuguauguuucaaaauaauaaaauaacaaaacuuucuuuacuguguauggaacagcauuaucucagggcaauaggacaggaagcuguaaauauuugaaaacagacuauaauaucaaguguugcugucuucugacuucugagucuggcaaagcuugcucuugcuagcccaauacugacaggauauucuuugucuaccugggguuguaguuggcuaaaugcugguauguggucuucuccaaggccccucucagcacacugaugucguccacguguaucauucagccagucuacaccaugcacccaacacugucucuagugcugggaacucugugucauuggaacuauaaaggccucacacagaauguccauucuaauauguaagauugaaaauuaaaugauagauaagccuccuuuagugguaggauaaaauauaaaguaggaaaagaaagcgugaacuguguguauguggaagaaagacgauggauggacaaacagaaaggccuagcugaggagguggcugacacuccuagggcaucccuucuaauccaaccuuccucccacuucaagggugcuucagagugcuugcuaacucagacauucuuuucuagauguuaaggcucagagacgacaaguauucucuacauugucuuuucuuuugaguccuuaaaaauaugaacuuuucccuaagucaugcuuuaccacuuucuuuuucugaaauucaggacaacaguagggcacauuuaccacagcguuauuagaguuuggccuacuguuccuaaagcagcuuaaccucuggucccagagccagugacauucugagaagagaagaccgugcuaguucaugcaccuccaggguagccugaaggaucaggcccucagcaugcuugugaacauguuguacuaggcacccaggagagaacugggucuacuuaacgacacugcucccuauguauucuucaggaagaccuuaagcuauauucuaggucccauguccauuagcagguccuccaagagccuguguccacccuguuccuugacccuguaauaacugggacaggcuuuccucuauccuuucggucuauucagaguaccuuauagaggcugaugauucaguguaaaaaggaggaaagggaaaauacuacguggcuaucuuguucucuaaaaauugcaguugaaaacugagcugcauugggaugaaccauucuuuaaguagaaggagacuguugauaaaaugcaucuaagugccaaaccacaugaacaccaaguggaaugucagcaauuacuacguaaauuugaauuggagacaaccugcuacuguaacccuaacuuuucuucauucaaauggaccauguugauuguuuggacugaauauauacaaguauucacuucacuuuauugcugaaaauaccucuugagaugacacucugaaguucaucucuuuuuuguuaguaaauaaucgcuuccuuucaaaaaaaaauagcaugaaaaaucaacaggaauugccucuggaaaguagugucauacagaacaugcagcuaagcuaucuguuauauuuucagacacaucucuaauuaauuaaguaauugaaagucuauacugcaucuuguaaccaucuuaaaauucaaagcauucacauguguaauacugugucaguuuugacugugugcacugcugaaucuucucagcauuccuccuuccauugaaagagucuaaucugcuaagugauguuuucauuagcuaauagcauuucaggcaguuguuuauugcuguggaacuggccuuguggcuuuuacucauccauuucccuauucauuguuuugugcuaccuuauaauuauaagugaauguaaggcaggaauauucuacaaguugacccccuagaauucuguuuucagugacucauucauuacaaauaaccagaauccgaaccuccgagaaaaucacugaaggaaagaauaucuuaagagaccuauccaaguaugauuguuacuuuuuuagaucagaguuuguauccucugauuuugaucacaguggauauaagcagucuuauuucagaaguaucacuuuuuaaaacuaaauuuuaaauagucaccacauuuguuguucguuuaccacuuucuaagauaauuugugaaaaaacuuccuucacagaauuugguauuuaguaaagguagcaacuuucguuuuacuaaaaucuccucguuuuccuccagacuugauuuaugaagauggggggacugggguagggguugcccucucagaggugaaggggagagggaguggaggagggauucugugaggcaggaccaggaggggaggcuguggagucugcgguguaaauaaauaaauaugcuuaaacaagaauauuuaggauacuuuuggauaaguaacugaaagacaugaauauaugaauauuuauuuauucuuuaaaauuaguuaugauuguuagaaaguuuaaauugacccgggcuuucagucucccuaccuagaaauccuuguuccucccaggccuuagaacccucuuccccuagccuacauaucugucuuccucugccuaccuuuuuaguucucucaguuuguguggcuguguuuucuacaguacaaauauguuucuucccaaguauauguuuucucauccuguuucacugccugguaagagacacauagcaaguccacagugaucuguccacagggaaaauuacuuucaaaauaggcuuuuccagagaaacagcaucgcuuuguaggagugauucagacaucuaaagucaaaaauccuugaugcuaaaaugaaaaucccaaguguauauuagucacuagauauagugcaaauauuuucuacuuauaaaaaucucaagacauucaaagauucuuaucaacaugcugaaagagggaauauaauuuuuaguuuuuaguucaucacauuucuuaaaauaucauuuuuccaaaaggaaauuacuucuauuuauaaacuuugagagauuguuugaucagaaacuuaaguuuauaugugugaaaacugauauugaaagaguauuugacacuuugcacuuguauuucuguccaaaguaucugcuaauaucuccuucagcuguacacaucuccccccacucuucaaccugcugugcugguaaguggggaaacagacagcggcuaguuuacacaaacuugggaaccguauggcauagcuaacugugucuagugggcuuguacaguuucagucucuugugcaugagaaguaacucaguugguaaaaugguuguugaacaagcaagagcccugugcuuagauccccauuauccagaagcugggcaugguaguaugucuguaauccuagcaauggggacaagggaccaacagauucuugacacuugcuugccagccaaccuaguccuauugagagacccugacucaaaaacuaaagugaaagcaauugaggaaaucagccaacauugaccucugaccuccguaugccugaguaggcaaaaacaaugcacacacacacauccagcaaacacaaaauuucuucauuuauaaaauacuauggaaauauuaaauacuuaauauuuaauaguacucugccacauuaagaaauuaguaugucuucugaggguauuuacccuacuuccaagcuaacauaaaagccuugcuuuuuacucuagguauacauuccaacugugugcugcuuguauuuugaaacuuagguggggugggaggggucaggggaaaggaucucacucuguagcauaggaugaauugggccucacuauguguacauagcccagucugaccuccaacuaggaacaauccugcuaccuuguuaguguuaguaauaggugucuuaguaccacaaccaacucaaauaugucuuuauuaacccccuacacacugaguaugaaaugaggccaugcuaguauugcuagcauuguucuguagaguccugcugugagugaagugacgucauucauguggaucacuuaaaacagugccuggccaaauggauggaccuggagggcaucauccugagugagguaacccaaucacauaggaacucacacaauauguacucacugauaaguggauauuagcccagaaacuuaggauacccaagauauaagauacaauuugcuaaacgcaugaaacucaagaagaacgaagaccaaaguguggacacuuugccccuucuuagaauugggaacauagcacccauggaaggaguuacaaagacaaaguuuggagcugugacgaaaggauggaccaucuagagacugccauauccggggaucuaucccauaaucagcuuccaaacgcugacaccauugcauacacuagcaagauuuugcugaaaggacccagauagagcugucucuugugagacugagccggggccuagcaaacacagaagugaaugcucacagucagcuauuggauggaucacagggcccccaauggaggagcuagagaaaguacccaaggagcuaaaggaauccuauagguggaacaacaaaaugaacuaaccaguaccccccuggagcuugugucucuagcugcauaugaaucagaaaauggccuagucggccaucaauggaaagagagacccauuagacaugcaaacuuuauaugccucaguacaggggaaggacagggccaagaagugagaguggggguggggggagucagugggggagcgagugugggacuuuugggauagcauuggaaauauaaaugaaauaaauacccaauaaaaaaaaaggugaaagaaagaaagaaagaaagaaagaaagaaagaaagaaagaaagaaagaaagaaagaaagaaagaaagaaaacagugccuggcauguguguaauaagccaugaaaaguaugugagguucuuguuuggaauaguucugauaaacacaaguuucagugacccuaauuuuuuuaaguaacauggauucuuucaaaaugguguuaaacuuuucuuaccacaguggaagcacaaugagugcuugaccuuugccacuagaccuuccagugcucugugggaauaacaggagcagaguguacucaguagucaugauauugcuuccuaucaaguuuuucacaggauuggguuaugcuuguugaggucacaaacaguacuaucuucuccucuaugccaguggauggccaacacauucggaaaucagcacaggaagaaagcaguaagagaaaagcugaaagguguccaugaaaaaguuagaaaaggaugcaaaccuauuugacaaaaaccuguacgacacuacucagacugcuuugagcaagcuuucuggcaggauagcaagcucugauauuuuugaucuccccauuuuaaauuuccauacacuaagcagcaagccccaccuucucauccaucuauuuauagucauccaaagaaauggcuucccggcuuaccauuuuuggugucucuuugucuagcaaguaccauaguuuuggagcaaauacuuacuucucuugcuauuugagaauucaaaacaucugacauuuccuuucugcucuagguugccucuguccugauucugguuccauccugaucaccaccuuuaccaggacaauuuuuaagcucuuuacuugaguguucuaaaauauucuaccuuauuucuccagccacuacgucuccuuuuaaucugaugcuggcacugucucuuuuacucuuuuucuuccugcccauuacuuacuagcccuuucucuccuucagucccugaaagucagucgauuuuucuuaauauuuugucuuccuuucaaaaucauccuaauaacaaacuuaugcuuguugguuucauugcacuucaucuacacuuuugacagucauaacaggucaaugucuucuugaauuuaaauuauaggaaauguaacacaagugaacuaugaaguucuagauggaaauuaacagguuaacaaacuugccacugaugcccugacugcugacagugugucagugccaugcacuugugcugcgucccuuugcacuuuucaccaggugcauauagaauaaauauucaaaauguaaaguuuacauuuaaauagguccugauaaucaacaauggugauagaaaucuugcuuuuacuuuccuagcccuaauuagauugauagaauuguuucccagagaucauaugccccaguacaggggaaugccagcgccaggaagccggaauggguggguuugggaucagggcaugagaggguauagggcacuuucgggauagcauuuaaaauguaaaugaagaaaauaucuaacaaaaaaaaaggaaaaaaaaagaauaagaauuauuucccagaguuuagagucauuuaaaagauguuuuuaucuguuuauauuuucuguaugcaaagauuguaugcaaagcagacugcugggaacucaaagaaugcacuauagacaguuugauuuagacaugacucaaaagaagaucucagaagacggaaagaucucccaugcuuauggauuggcaggauuaauauaguaaaaauggccaucuugcugaaagcaaucugcagauucaaugugauccccaucaaaauuccaacucaauucuuaacagaguuagaaagagcaacuugcaaauucaucuggaaaaacaaaaaaccuaggauagcaaaaacucuucucaacaauaaaaggaccucugguggaaucaccaugccugaccucaagcuguacuacagagcaauugugauaaaaacugcaugguauuaguacaaagcaaggcagguagaucaguggaauagaauugaagacccagaaaugaacccacacaccuauggucacuugaucuuugacaagggagcuaaaaccauccaguggaaaaaagacagcauuuucaaccaauggugcuagcucaacuugcgguuaucauguagaagaaugugaauugauccauucuuaucuccuuguacaaagcucaauucuaaguggaucaauauucucaacauaaaaccagagacagugaaacuuauacaggagaaagugggggaaagccucgaagaaaagggcacaggggaaaaauuccugaacagaacagcaauggcuugugcuguaagaucaagaaucgacaaauggggccucauaaaauugcaaagcuuagucacuggagaggagggagcaucaguugagaaaaugccuucaugaaacugggguguaggcaagucuguaaggcauuuucuuaaucggugaucaauagaagaaggccuaguacauuguggguggggccaccccugagaaagugguacuagguucuauaaaaaaaucaggcugagcaagccacugggagcaagccaguaaacagcauuccuccauggcacugaaucagcuucugcauuguuuucguuccuguccugacuuccuuuaaugaugaacaguaguguggaagcauaaaccaaauaaacucuuuccuuucccaaaaaaaaaaaaaaaaaaaaaaaaaaacugcaaagcuucuguaaggcaaaguauacuaucaauaagacaaaaaggccaccaacagagugggaaagaucuuuacaaauccuacauucgauagggggcuaauguucaauauauauaaagaacucaagaaguuggacuccagaaaaccaaauaacccuauuuuuaaaaaaaugggguacugagcuaaucgaaaaauucucaacugaggaauaccaaauggcugagaagcaccugaaaaaaaaaauguucaacauccuuaaucaucagggaaaugcaaaucaaaacaacccugugauuccaccucacaccagccagaauggcuaagaugaaaauuucaggugacagcagaugcuggccaggaugcgaugaaagaggaacacuccuccauuucuggugggauugcaagcugguacaaccacucuggaaaucagucuggcaauuccucagaaaauuggacauaguacuacugggagauccagcaauaccucuccugggcauauauccagaaaauguuccaacuuguaauaaggacacaugcuccaauguguucauagcagccuuauuuauaauagggagaagcuggaaaaaaaccagaugucccucaacagaggaauggauacagaaauacacaauggaguacuacucagcuauuaaaaacagcaaauuuaugaaauucuuaggaaaauggauguaucuggaggauaucauccugagugagguaacccaaucacaaagaacucacaugauaugcacucacugauaaguggauaguaacccagaaucuuagaauacccaagauacaguuugcaaaacacauuaaacucaagaagaaggaagaccaaauugugaauacuucauuccuccuuggaauggggaacaaaauacccauggagggaguuacagagagaaaguuuggagcugagauggaaggaccaucuggagacugccucacuauugcauaugccagcugacaggacccuauaauagcugucuccuaggaggcuaugccagugccuggcaaauacagaaguggaugcucacagucauguauuugauggaucacagggccccaaaggaagagcuagagaaaguacucauggagcugaaggggucugcaauccuauaggaggaacaacaauaugaacuaaucaguacccccagagcucaugucucuagcugcauauauagcagaagauggccuagucggccaucacugggaggagaggcccuuggucuugagaagaucauaugccucaguacaggggaaugccagggucaggaagcagaaguggguggguuggggagcagggcggccaggagagguuauaggggacuuucgggauagccuuugagauguaaaugaaaagguaucuaacaaagaaaagaaaauaucuaauaaaaauuuuaaaauaauaaagaauaaaaguccucauagaaauccaaauacaaaugcauuuauauuucuacuuaaagcaucugcuucagagcauacccuuaguuccaaagucugauaauagacagcaacuuccccuugggucaguguggcugaacugggcaucuaucaauuuagcuucucuucucccuuuuucagaugcuaaguaccuagaaaccugugcuucucguccuuucucugugauuccuguggauaagcgugaccugguucuuacauuauagaccagucacuuaggaagguuuccaccuuugcugaaggugauaguuuugacuuucaagcucuacaguccaugcaguacuguugucuagggcauuuccuucugcugcuuccucugaucucuguuaugucuuauuuccucugaucgcacuauuacuauggugcauuaaacauuuaaauagauaucaaaaucuuaggucuacaaguucaguuucacuuuguagucccuccccuccaccccauaugcaaaaaccaggauaugugcacauuggcaaaugagaguaacugaguauaaagaaagccuuaauugagaacacccaaguuaauuuuaaaacucgucaagcuaauauagccucauuuuuuaauuuaauguuuuuagccacucuguuuuaauucguguaauauaauaaagcuuaguucaaauucauuugaacucaucagauuuuuuuccaauucacugaaauguuucuauucagcuauuguuuuuaaacaacuaaugaaucuuuuuucucugcuagugagacauuuuuuucaaugcagaucuuaauauauaauugcccugucucucuuuuaucucucuuuguguuccaccuuagcagacacugguugcuuugugaguuauggguugggggagcauacauauauauguggaaagaauagguaucaguccaguuauucuuuaaugaaauuccuuacauuguaagcugcauuuuagaagcugucauccaaucugagacaaacuggaagucuuuucagcacuagugccaaggagguugguucguuuaucuaucauuuauuuuccuagcaacacaaaaauaaaugaauaaauaauaaacauaucuucucuuuguaccaugugucagguauaguucuggugccagggaucucgcagugagugagacauggcuccuacguuuaaccuauacuuauugcauaaauugauaucuucagauaaaaucagauacucagccugcagauauggcaguagauuuacagcugauuuacaacuucaaggccauaucuacaauuucaauuucuguaauuuugagucugauuucuccucaagguccuccccucaccaagagagagguaccugacaaguuccuuguuguaauagaacagauggaagaugagaagcuccuaagguccaucuucuugguguuucauuggcauuacguuacguuauuagcagcguaauauucaccauucagcaaaaagauuauuagucaggguucucucauguuguagacuuacugacucuuccaugaauguccuuaaauugaagagaccgagacauauaagauuuguugcuaucuauuccaaugaugaagugaaaaaauaaugauuaaauaugggaggaaugcuacagaagcaauacagaccucuuuucugccuggggaagggagggucuccacgaggggauaucuaccccgagucucauaggugacaggaaaugcagcaugguucuuuuauucugaguucuuugugucaagaaacauacaguggacacauagacaaauauuuauuagauagcaguacauacuaagcacaaaguaaaauaugugagaggggaaaccagaguuacaaggacugugguuugcaaagagugaugagugguguccuuuucuccugggcugucugagcacccucacaaacaguaaugggaaagaugcagggaaaucauuucaagcaggaacagggguacacagggcacaaaugauauuuaggagaaaacaacagguuuucuucuugaccacuaauuaagauaggggagaguguauaaugaggcugaaucagguaguuuagaggucugugagcaucccuccaugucagcugagagaagcgugggggcugggggagaguuggggcuggcuuuggaagagguuugaagagugaagugauaugauuagauuuucugugguuauuugcgauuagguuuggauugcuuugacaugauuauggaagguuaucuguggcagcacuaugaaagaugaaccugaaagggaagcagaagaagacccuguggccuaaguuaaauuaguagggaaggcauggcuaagacagcaaggucuaguguacaggggccggugccuuauugauaugagaaaacugaagaucaacuggugucugacugaugguaaugucaugagccggcccuguggccucuggagaaagggcacaaaacuaguguaauuugguccagcagaaauacagauguggaagucagaaaguccagucagagaauacuuggcugauacucgcacauacauuuuuaaagaaagaaagaacaaaaauuauauuuguucuugcagauacugcagagaacauuaguagaauauagaauuuuaugacccuuuggauuugguagcuggaaggcaagaagaccaauuucuuuagacacugggagagacagagcuguauuguaguuggcuuaaagaauuauaaggcaugaggcugagaucuucaagucacuucaucaucuucuuuagaagcuuugaaucugauguuagaucuuucuuuucuucauuuucccuaccuggggccuagagcuguaaaccugagcuaggagcaugguagaaagacuuaauaagaucuuuguauaucuggagggagaggccuuggcuagaaaagcuuuguguugcugagucgguagugcaagugucauucucagugcacaacagcaggucaugucuccagggaggaaaagaugacagaguuugcuuuccacugagugggaaagcuuggcgugggaggcuggguuggaaugcgugucuacagaaaugcacagggcauacacaggauguacuguuaucaugaagauuauagagauggaaaucauagaaguggaugaacaaguacugucaacgaugcuugaaauauacauggcuaguugguguccgugaagcuaagauggugguucaaagggugugaguggaaggaaggggacaccugaguuuuugagagcuuaaagucagugauugcgucccagucaaggauaagauccagguaguuaagaguugaaaacaacggucaggacaggaggcuccguguuuucaaacccgaggacugacuaaguuaccucagucuccaagccccagcuuucaaacacacuuuguuccagugucuugcuugcagugcugucuccgcccacuggggggcggggcucgagggcgaggcuaguggcuguucagaagccucgagagcuaucaguuccuaccagacuccugcugggggucccauccaccccauggccgggcggaggucuucaaacgucuucccucucucaggcaauaguggugguggccuggaaguugacaccccaacaugguugagcagccaggcagccacaagcagauuaauggugcgaccaaguauggguccaggcaucuguccaggcccugagguauggggagugccucugggcuccucaccuuaugaauuccgaggugggauagcacccuacagagcuugugaggcaagggccuggucccagaguuccucugaggauaccugcccaggaccuuacaucgccuugagauacaugccaaauuuggcacugccagaggacguuucagccauacagaaagagauggagcagcuagccaaggaacugagacaaaagaggaugacccugggguacucacaggccgaugugggauucgcugugggagcuauguuugggaagguucucagccagacgaccauaugccgcuucgaggcccagcagcucagccuugccaacauguggaagcugcgaccccugcugaaaaugugguuagaggaaguagaugagaagaaccuucugggcauaugcagaauggagaugauccuggagcaggcccggaagcggagacgugcaagcagagagagacgcauugggagcaaucuggaaaaacuguucuugcaauguccagagccuacgccccagcaaaucagcuauauugcugggcgccuccggcugcagaaagaccugguccaagugugguuuucuaaccggagccagaugggcaguuggccaaccaaugauaccucccggagggaggaugugggggcaacugggucuccuuucccagguccaccagugugcuuucccauggcaccagggcuccauuuugauuucccccacuaugagggaucaugccuuacaccccuguacuccucuaccccauuuccuguacgaggagcccuuuugucugccccaaccaccacucugggccuccccaggcugucaagcugaggggccuacccugcaggggaauaagaggcuagagagaagaggguuuuguuucaggguuagcguucaguucucugacuuaguggguaugggugggaguuguuuacagaaggcuugggagggaaguuaaagaguaucacuugcuucuuuuuguucuuaccuugguuuuuuuccccccgguguuggcauugcaauaucuuuauggcuauaauguuuuguuucucuuuuuauuguuaauuaaagauguccauuguuccuuguuguuaucaggaaacacaguuucuuuauaaacacaguauaaaauuagaagcacaagucacauaaaacuacuguacuaguguuuauuaaaaacaagcagaacccugucucaaaaaaaaaaaaaaaaaaaaaaaaaagcagaacuuuguacaaacacaaaauccaggcuaacaguuacuucucagagaggccccaaaccaacugaccuuuucaaguuccacccaguugcuagccugcuugggacuccggaguguugcuccagggugaguacacacaugagcuucugcuguccuucucuucuguucaucaguauuccaaaggaugugucaaggauaguuucaaagauaccccuuauuacacuuaggaauuuguuuuccaaguugacuuuggauuuuauuuuuguucauggccuuuuccuaguuccuucugguucuuuucacuauucuuuuuucuaaugugauuuugaaaugaacacuuugucuacaugauauuuucuugucuuguuuuguuuucugguguguaugugagaugccucuguggagucaaaaguagaacccugcaaaacgacaucaugacccuuuguucugcaaugacaggacugauuuuaucagcacacaugagucagacagcucuauugcauccacuuaggauuuucuuccauucacuguagaaacugauacucuacuguuaacuagaauaccugguuaaauuugccauugccaucguuuucuaagugcaaauucaguuuguacaacuaaauuauauuaauaauauguaacuaucaccauccuauuccaacucuaugucagaauucuaaaacggaaagucugucaccacuaagcacuaaguccuuuccuccuccuccuagcccaucugcuuugugucucucugaauuuguggacucuaggcauuuauauucguaggcucaccuaauaauuguucccugugucugacuuacuucaccuggcacacuuucaaggcucauuuauauugcaguauuuaucagacuugauucuuuucuaugauugggcaagauuccgcugcaugagugcacgcugcuuuguguagaacucagcauuuguuuagccccucgucaguccacugagaagagugcuguaugaagaccuagaggagagaaucuguugaucccuguggucaggucuuuugaauaaacaccuagagauggaacugccgaaucaggugauucuauuaacuucuuauuuauuuuauuuuaauaacaguuuauuaauucuuugagaauuucauucaauguauuauucacauucccaguacccaacuccuccaaaaucuauccccaucucuccaccugcccaauuggguguuuucucucaaucuacuuuuuucucaccccaucccaguccaguuuuuguugccccaauagucuuugcguguagggccugcccugaagugaguucaaccuacacaaggucagaucguuaaagaaaacugacucuccuucuccuagcagcuauagaaugcccagagcucaugaguuagggguaagaaucuuugguggucucucuuucuccuugcuggcauuuuaucugcuuaagcuucaaggauccugucacagucacaugaguucuucugugcagaugcccugugauguccagagaacauucuuuccuguagucauccacuaccccugacuuuuaaagccuugccaccacacccccucuuccacagagacccccaagccuuuggggcagggguuuaauauaaauguccuauuuaaagaugagcacucugaagucuauuauucucugcauauugaccagucaugggucuguuaauugccagcuauugcagaauuguuaacuuguuuacauauugccaaaggucuuccucagcagguaugucauucugaauccucuugaggaauauauaggguucaguucuccaagucccugccaacacuuguuacccccaccacuuuuccauuauucucauccuaguggauaugaaguaauagcccaucuugacuuaguuugcauuucuccaaugaaugacauuccauaaaugguauuaugcucauaugccaauugcccauuuauauuuuucuucuuucaagaaauguugauucaauuauuuugcccauuucuaaauugguauguuuuuccuuacauauuguaaauguuaaaaucuuuuuuuuucuuguaacauuuuuaauuuacauuaaguagcauuuacuuacauuuagcagauaugcauguaaguauuucccuuuacagucucacacuugcuauuuaauuuuuuauugguuauuuuauuuauuuauauuuaaauguuacuccuuccuucccaguuuccccuccauaaaccccuuaucccauuuccuuucccccugcuuuuaugagggggcuuacccacccauucacccacccaccuccaccucaccacccuagcauuccccugugcuggggcauugagccuucacaggaccaagagucucccaucccauugauaccagauaagaccauccucuacuacauaugcagcuagagccaugggucccuccauguuuauucuuugguuguuaguuuagucccaucaaucaaaguucugggaggucugggugguugauaauguuguucuuccuuuaggguugcaaaacccuucaauccuucuccuaacuucuccacuggaguccccgugcucaguccaaugguugguugugagcauccacaucugaauuguggcagagccucucaggggacagcuaugccaggcuccugucagcaugcacuucuuggcaucagcaauagugacuggguuuggugucugcauauaggauggaaccccggguagggcagucucuggaugaccuuuccuucagucucugcucaacucuuuuucccuguauuuccuuuagacaggagcaauucuggguucuucucaaaauuuugagaagggugaguggcccaucccucaacaaggggccuugccuacccucuggaaauguucucugcaggaucucucuucccuuuguuguguauuucagauaaugucaucccuguuggguucugggagccucuugcuuuccuggcaucugggucuuuuugguggcuaccccuaguuccccaucucccauugcuacauaccucuguucaauuaccugacucucuuuacaucccccacuccacacccaucuucucccauaccugauccuggcacccguuuuccccuccuccuccucuuuucgucccaagucccucucacccucuaccucucaugacuauuuuguucccccuucuaagugagacagaauaccuacacuuuggucuuccuucuucuuaaguuguauuguggauauucugaacuuguucccuaauauccacuuagugagugcauaccauaucuguucuuuugugacuggguuaccucacucaagaugauauuuucuaguuccauccauuugccuaagaauuucaugaagucauuguuuuuaauagcugaguaguacuccacucuuagugagguaauaugaaauaucaauguaguuugauuugauuucccugaugaccaaggauguugaacauuuauuucuuuaaaugauucucagccauuugaguuuccucuuuuaagagucuucucuuuagaucuguaccucauuuuaacaggauuauuuguuuucuugauguccaguuuuugacuucuuuguauauuuuagauauuagcccuauaucagguauguaguugguuaaaacaaaaacucuuacuauguaaucugcugcuuuguucaaaugacaguguauuuugccaugcagaagcuuuuugguuucaugcacccccauuuauugauuauuguucuuagcaccuauacuauuuaaaaaguuuaaaacuaucccccacuuucucuuguauuaaauucuguguauuugcuauuauacugaggucuuugaucuauuugaaguugaguuuuguacaggauaauaaauauggguuuauuuuccuucuucuacauucagcaauccaauuugaggagcauuguuuguuuuuccaguaugaauuucuggcuucuuucucaaauaucagguguccauuaaauguguacacuuuuguagaggucuuaaauuauauucuuuugaucuauagauugcuauugguaggauggcuauuuucacaauauuaaucuuaccaauccaugagcaugagagauauuuccaucuucuuauaacuucuuuaauuuauuucccuaguauauuaaagguuuuaaucaagccuguaacguugcugaaaaguguuuaccaucgauauaaguuuucugauggcauuuuagggucuuuuauguguaaaauuauauugucuguaaagaaagauauuuugacuuugccuucuccuauuuguauacauuugauguccuucacuugucuuauugcuuaagcuaagaugacaaguacuauacugaguaggucuggagagaguguacauccuugucuaguucugacucuacuggaaaugcuuuguguuucuccuugugugggaggaugucaucucugggcuuacuguauauuuccuuuaagauuugagggauaguucuugucucccuggucucugcaggauuuuaucauggaggaaugcuugucagaagcuuuuucugcaucuaaugagauggucaugugguuuuugucuuucagucuguuuaugugguagcuuacauuugucaauuuacauauguuccaacaauauuucaggaaaaccuguaagaaauuugauguuccagaauuaccccagucauuuuuguuucuaaaauaguaauuuuucauuggaaagcacuuuuuuauuaaaguaauuuauuuuuuacacuccauauugcauucccugucccccucccccaaaccacccuccaacugcuccacauccuauaucuccuuccuacccuacugucuccacguggauuccccgaccccccaccccaccugaccucuaaacucccuggggccuccagucucuugaagguuaggugcaucaucucugaaugaacacagaccccggguccagaugaauugagacugcuggucguccuaaaggauuuacuucuccucagcuucuuucagccuucccuaagucagccacaggggucagccgcuucuguccauugguugggugcaaauaucugccugugacucuuucagcugcuuguugagucuuuuugggggcagccauguuaggucccccaaaaagcaugaguauuccauagccucggugauagugucaggccuuggggccuccccuugagcuggaucccacuuugggccugucucugaaccuucuuuuccucuggcuccucucgauuuccaucccugucauucauucagacaggaacaauugugacuaugggauggcaaccccaccccucacuacauagccugucuuccuguuggaguugggcucuuuaacuucccucucacuacuauagggcauuucaucuaaauacccucccuuugaguccugagagucucucaccucccaggucucuagugcacuccgggguguccccccaaccuguuauuuccugagguugccuguuuccauucuuucugcuggccuucaggacuucaguccuuuuuccucacccaauaccaaaucagguucuccucucccucauccaaccuguccacuuucccucccagaucccucccuccucacuuguguuugcuuucuucucucucccaagugggacugggguguccucacuuaggcacuucagguuguugaccuuuuugaguucuguggacuguaucuuggguauucuguaccuuuuuuuggggggggggcuaauaucuacuuauuagugaguacauaacaugcacguccuuuugagucugaguuaccucacucaggaugauauuuucuaguuccauccauuugccugcaaaacucaggauguccugggucauaauagcugaguauuaauuauuccacuguguaaaugagccacauuuuuuguauccauccuucugucacaggaccucuagguaacagaagugugacuuuuucaugaaaagugaaagggucuuauucuuucuauuugggguuccagauaaugguacaauccauuuaaaaaugguaucauuuuaauuuucaaacugacuuccuacauuagucaguaaacaauuuauuugaugaacauucuuugucaacacauauaugccauguggaugucugacaaacagaagggacuugaauuugugauguaaauauuuucucacacuugauccagugaugcuacugcucaaauaaaccauauauaaaugaaauaucacuuccuacuaagaggcaagucucgauuuucacucauuauuuuagugacgacaguaaugcaucauuugcuuggaggaauaucacauaggcauucugagauucacuguaaaaaucuaccuguccuauucgcugacaaauguuuauauauuauuauauuaucugacuauacauauuuaugucauuucccauagaccuuaaaguuuaaaacuauauuuaaguaaugauuugauuucucauauuauucuuaauaccuaugcauauaaucauuaauuuuaaauguaucagacaaaauguuauauaugcaguugguaauauacuagaacauggcgagcaacguaaaaauaaccagccccacacagaugugaaagucccccaaacuguuauagaucaaacaguuuugacuaauuccuagcaaguuuucucuggccccuaacaucuguucuuucucacauucuaauaaaccucaacauugucucucucucuacuuguucuucagggaucaaauaucuaaagggcaaaauaaugagaaauagacagggagugcucauguugagucagagaaaggaauccagaggucaaggauaacuaccaagugacucguuuuagaggaagauacacuuagcucuacaaaagaauaagccuggaacucagugugaaauaguuggaccauugugaauauuuaacuaaccagcagguaaguggggggacuaagagagacagaaaaucaaaccagagcagacaaaauaaaacaaaacaaaacacagacagauugcuguguaugccuucuaugugguaugcugguuugaauaaaaaugguucuguugacccauuauguaguggcacuauuaggaaguguagccuuguuggaguaggugugaccuugaugaagaaauuccaucucuggggccaggcuuucaauuucagaucucagaugcucaagcccaggaucaguggugcauaguucuuuucuugaugccugucaaucaagauuagaacucucagcuccuucuccagcaccaugucuucaugcaugccaucauguuccuugccaugauuucucccucauucauuuuugucuuugugguaauguugaucaaacccagggccuuguuacuucuagacaacugaucuacccugcauauaucccaggaaaugucccugcuaaucccuacugguauccauccuuuaguagauaauaagagacuguacugaucaacuugacauuuuuuucuggaacuuucaagcuuugugucucuuucauuuuauuuguuacugugccucacuaaaaguaaucccuaagucucauacauaaauacaucuuuugugggggcuguaagugggguucaagacagagucuaaguagguagacucugcguguccuggaacucacuauauauaccaagcuggcgucuuaacucaaagauaucuguagucuaucuuauuacucauaaauuauuuuauaugugauuuuaaaauauggaauuuuaucauugucuucuuuuaguucuuuuuucuaauucugauuuuuuaauguuauuucucaaaucauuuugcuauauaagaacuuuuguagucuguguuauaucacuuugaaagacauaguaaucaaaucagucaagaaaacuuuuuuuuaaaaaccagcuacuauuuauccucuucugucuucagagacaauaagaaguagcuggucaguguucacucacaguuucauguauaguaauacuauuuaaugacacccuaugacaugucauuaugguucucacaaugaaaaaccuuccuagauaugcugaaaggcaaacuguuauaaaauaucaauuuuuauagauugcaauacuauuuuaauuggccaaaauuugaugcaucuagcaaccagugugauaguaaaggaaugccauaaacuuaauuugagacauuguuuccuuaaggggcaauaaagugaugacaagucuugagauuggcaguugucuuguauuuaacaagauuaacagguccucauuucccagggauucaccuagaucagauucuuguuagugaacaucuuauaagaauauuauauuugauuuaaaaauauaaaaucuucuucuuaggacauuagacaucauuccuuaaugugcauauuuuauaaaaucagguuuucauuaccauauuuaccugagcauccuuaaauuaccuugguuuuuuuuuucucuuucuuuuauugaauaacaaguuuuuuucucauaaaauauauccugguuauaguaguuuuugcucacucuacuacucucccuuucuaucucucauuaggaaaaaaaaauagacuucuaagaaauaacaaccaaagaugauaagauaaaaaaaaauaauaagaugaaacaaaaauuaucauaucaaaguuggacauuguaaccaaaccugaggaacagagacccaaaagaagacaccagagccagagaaacacuuguucucacaguugggaaacccauaaaaauacuaaguuguucuuagcuuacguguucauuccagcuuucuauuuuuuaaucuguauuuucauaguuuuuauauuuuugauaccaaauuauuuuuuaaauuuaguagaaauuuuauagaguucauucaaaguauugagaaccugcaguuccuaucuaugaagcuagucauauuaguccugauaauucaguuacgguucucugauuggaaaucucugugguauguuccuguucugauuaaaugccuugcuuaaaauuuacugcagcaucacagaugguaauuugaaucuucaugggcuuuggaauccuaugcccaccuccauauaaucuuagguuaacauuaauaaaaauguucagcuuaaaauaguucuuuaaaaucuugguagaaauuucauuuuccuuucuaaaaaucauaaauuuuggauagaucacuuagcuaacaaauuuaaaguaaaacauguuccuuacggucaaaaucacaagccacuuuuuguugaacauaagcauaaaaggucuaauauaauugauuuuuacaaagcauucuaaagauccaguuacagaagucccuguucauacuuuuacagcauccuuuaugaaaagcuuuauagaauucacaaacacauauugcuuuuagugucuguccuuugauguccauaaaagacucuuucaaagcuggauguaaguguuccuaacauguacggcagaaucugacugaaguuauuugaagcuauuagagauaacauuucucugcauauguuuuggaguagagacuggugccaacaacaccacuaagccaugauucgugugacuaacaacuaauaugagagagcagagugggggucacucuuaaaaaucuagagguauuaacagguuaggguuguagggcguccuacccugcagguuaaucuguugccuuagcuggugagauuuguugaagucaucagugcccucuaacccccagguguugcucucuugcaauuuguugguaacaugccaaguucuucuuuccuaccuagugagaugacuuugggaauggcuaauacagcuuaaaggccuuauuacaaauguccacagauuuucaacccuuugcuguaggguuguuauugucuuacaacccuuagaauccauuggaguugccauuuuguuaccuuauaaaaauugacacauuguaccuguuuaacaagaauuauaagaacuuaaaaucuaacuauuaaaucaggugcuguauaagaaauucuaauacgcaguaaauauuccacuuuuaugggcuauuucuaagaauuguauugcuuagcaguggauuugguguacguucacagucagcucgaaugcacauaagaguuucagagaaugacuuucacuuuccugcacuguaguucacccucuucagugucuggauuccucuucuaccucaucucacuuugagucaccaacacauaagcaaagguaacuccugucaugucccccuacccccauuaaaggcguuccuguaggacgauuucuuucguuucuauucaggaaacauaacauccuuuuuuucuuuuuaagcaauaggcagcugguuuauucugcugugaaagauucauaaggaaauaguuguucuuuuaacuuuuuagauuacuacuuuagucucaggaguccugauauuuuauguuauagcuuuugcuuuuuuuuuuaaccuauggauuuuuuugguguuuauaaaguaaccagggccaugucacaauaacugauguuuaagguggcaauuaucaagccuuacaacuccaaauaaaauagcuuuuucuaauaauccuaccucucugaacacauggacauuuaacuauuuuaagcacauuaauucuuaguuaaguacaagaaauuacuagggugaggaauugccucuacccuugagcagaaucuuuuccacauuuuauacacaaagcacaaguaguuaaugaaugaacuguaguuuguauuguaauuguucuuauaauauguauuagaaaaggguauguauaacacagaaaaguagauuaaauuuguuugcuuuuaacuuagaaauaagcaaauaagaaaguauguugauguagggaaauacuaaagcaccaggaaugcagcccagugguagagcacagugagcuaauacaggguccacaugagguucauaggaggagagggggagucaguggggacacgugugcucacagacacacacacacaauauaucagcaauuaaagaaaaugaaaaggggagcaugggaggaguugaaagaaagaaaagcagaggggaaauggugugauuguauuauaauuucaaaaauaagcuauuauaaaaacaugauuauauuugcaaacauagcaaauauuugaaacaaggugaaauuuguaacuuucuaaaacaaagugcugaaugucuugguaguugcugacagcuuaugcucacagcacagugugugggaguuuggacaagugagugaaacuagagaagcuguugucuaccaaaccgcacagucugcugcucauuuuccuuuaucagagaauguaugagacaucuuaugccuuucucuugaugauugcuuauuugauucauauguauucuugguaguagugucuuuuguuucuugugcaagccagcuuucuagacuuauguaauacauuaugucuauagccuuuuguaaguuuuuaguugcuuaucaaaaucucacugaccuuguuauugacuuucucaaguuuagaaaucccauccacuuccuuaagugauacauaacauacuaagaaaguaaaaucaucauuaauguaauccccacuaauugauucacauauucugaugauuuuauacauguacauauacucaaaugaauaaagcauguuggccacugcaucaguaauugaaucuuuaaaaagcuaagugcaggcucgagcugugguuaaagcucacagaagcucugcucucuuuucaugcuaagauuuccugaguaaaagugccaaggacagaacugagaagucuuauccccucuuccacccugucuucugauggaugacugugagagugcaucaaagcugagcugacuucaaagccuacaacacuuacugucuccagccaguucuuuaacagccacuucacccucacagcagaggccuggcaaggcugcacgcaugugcuucccaucauccccucguccauacuaucaaauucaaaacuacucccuaaauaagccaguccagggcauuagcaaauuuacuuaauuucaagauuugccauugaacuuugcuggaucuauuacuuauuuacuccuuccaugacuuugcauuuggcucuaaggcuuuggugcuuguugacauuaaauauaauguuucuuacuauguucacuucaaaaauaaaacauauguagguagauaaaauaguauauacaccuauuagcuuauguuaacauuauacagugacauggggugugguauuuggaucaaugaaucaugaaaaaaaaaaacaaaaagagacaauccaagacauauauaagugucucagauguuaaaaauacuuggaagcaugugcuuucuuugggaaaaagaaaugaaaauucauguaucaaacauuuacaauugggauuuaaauauuuugcaggccauuuuuauauauuuaaaaaaaacuugauagaauuuuauuuaccuuucucuuugacaauuucauguauguaaagaaugacauguaucucaguucgcuaucauacuuggcuuaggaacuccucccucccacucccgcaggcacuccuuacacccccgcuuacccaaguccuauguugguaagaaagugcugccuccauuuagugcagcuguuaaaauuuugacugucuucaccaacuuggucuuuugcagguaaucaugacugcaguuaaguucacagcaguaaugaucaugucaugucccaaagacagcaugucacagcguuccucaccauccuucagcucuuacuugccuucuacucccuuccaguaggucuccugagccuugagauaggaguuguuacagaugacccguuuagggcucaauagacuauucuuagcaauuugacuaguuaugagucccuacauuaucuauugaucacaacagagagaaguuucuuugaaggccagauuuuucauguaugguucauaucaaugaagucauuaaguucagugggaggagaggcccuugggcuugaggguguucgauggcccaguguaggggaaugccaggacuggagaacuggaauggguggguggguugggggagcacccucauggaggcagggagagggagaaugggaugggggucuccaaaggggagaccuggaaaagggaaaacauuugaaauguaaauaaaauauucaauaaaaaaagaaauuuccacauuuuuauuuuaaaaaaaauucuaaaacuauuuccuugaauuccucuauauauuugaugguagauauuuugaaaucauugggagaaagcaucucuugagaucuugaauauggugcacauaacuaaaagauaagcuucccaaagaauucaaaaaagggacauagugauuuagucagcauccaaaugcugacaccauugcauacacuagcaagauuuuaucgaaaggacccagauguagcugucucuugugaaacuuugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuaggugcauauguaucaaaagauggccuagucagccaucacuggaaagagaggcccauuggacacgcaaacuuuauaugccccaguacaggggaaugccagggccaaaaagggggagugggugaguaggggagugggaauggguggguaugggggacuuuugguauagcauuggaaauguaaaugagcuaaauaccuaauaaaaaauggaaaaaaaagauuuaguuguuccuaaccccaacuagacaugaaauuccagauagacaugacauuaaagacuuugauuguauauuaugaaaauuaaauagguucgauauagucauguccaauugucuuaaacagaauugacuacauuguaaaacccaagcuuucuaucuuuuccaguauccaagugaaggucugacaacugcuuuuuaaccuuuuaucuuggugcugguacuuaaccccggggccuguugguaucacugagcagaauccccagccacuuuugaagaaccugauagaggaaaucccucuaccuguucuuuuagagcaaagaaucuuuaauauguuuuuguuucaguacuacaucguauguuccuuaaaggguaugaguaaaaggaauugaugauuaaaugauaggaaugauguaacugcugacugaguccaguaauuugauuucauuguuuuacaaaacaauagaaguuagagggacuuaaggaagaaaagagucauccauuucuggaggguaucauccugagugagguaacccaaucacaaaagaacucacaugauauguacucacugaugaguggauauaaguccagaaacucagaauauccaagauacaauuugcaaaacacaugaaacucaagaagaaugaagaccaaaguguggacacuuugccccuucuuagaauugggaacaaaacauccauggaaggaguuacagagacaaaguuuggagcugagaugaaaggauggaccauccagagacugccaccaaacgcagacauuauugcauacaccagcaagauuuuacuaaaaguacccugauauagcugucuccugugaggcuaugccagugccuggcaaacacagaaguggauacucacagucagcuauuggaugaaacacagggcccccaauggaggagcuagagaaaguacccaaggagcugaaggggucugcaacccuauacgaggaacaacaauaugaacuaaccaguacccccagagcucaugucucuagcugcauauguagcagaagauggccuagucaaccaucaaugggaggagaggccccuuggucuugcaaacuuuauaugccccaguacaggggaacgccagggccaagaagugggagugaguggguaggggagcugggggguggggauuggggaggggauuguauaggggacuuuugggauagcauuugaaauguaaaugaagaaaauaccuaauuaaaaauuggaggguaaaaaaggaggaaaagagccaugauugcuccagcagaccaaagagaacagccgaagccaggccacagcaccauucagggcuaaagaauggugaaguguccaagucuaaaaugcucagaacgcaaaccuaaggaaagugagaaaagaacauguuuuguuuuugauuaggaugccauaugaauuuucagaaaccaaaguauuuucuguuagccuuacauaaaaggagggaacaaaauagauagggaacacgaguuuuuuugguuuuuuuuuuaaauuacgguuuucagugauaaaagcuaaugacaguuuuuaauguuugguuugacuuaggaagcauacuuacuaagcaguuccuccaaggagcagaagccugggagcaagguuccuuugccgcaaaccauuuaacaggcauaaaaggguaaacuggggaaauagaggacacaaaaguuacaguagaguguaaugagaaaguacacagaaaguguaauaauugaaaaaugaauauguuuauucaaaguaguagaaauauuguguguagacagcuuccuaauuggcaguucuccacauuggcauugguguuguaagacaagcccgugaggacgagggaucuggaaaugacugauauguacaguuggucagcugaugacucuguuucuuucucauucuaaguucugugaccaaauccauuguuuccaugauucuuuccaggccaaggguauuucuaauguccuuuuuauuuacauaccauugagucagcacuguacagccaaagauuuuaaccagaucaaauuuuucaguugguaagagcuguuuuauuuugaucuaaggacaugacccaugauaggaacucaggauaacuuggcaaagaucuuuaaauuuaguguguuauuuugagacauagaaauuuuuaaagaaaucuccugugaaugcaggugugacgugaggagaguguugcagaaaugaguuagugcuugcagaaguaagcagaagacccuccccugucaacuuuaacgaaaugacaggcaaaggggagguccaaugacaagcaccuaaacaagacagccaaagauaacaguguugccuccaaagcacaccagucaucuccaagggaaguaagacgguaggcuugguccccugggaauauaggaauucucauggguagaugaccuguaggacagaugcuaccaagagccacuauggagauauggggagaauauuuaccauaugcuaaauuuguaugaauugucauuuuacauaaauucaguuauacauuuaggucuuuuucucagaaaugcaggaucucccaagaauaagggcauaucccuucuuuguuguuacagugugauuaggcauuuucuaacagaguuguucccaauguccugacacuaucuuuaggccauagcugaaauuguuuaugaccauuguuguaucagaaauuuuuauuuugugucauguauauacagaugugcauguguaugugugugcauguuuguaaaguaagccucagccagagguuuccuuccucaggaaccauccagcuuauauuuugaaaacauaucuuguaagaguuuacuucaauaugcaaguccuuuaugcuguaggauuauuuucuggauuauuuucuauuauucuggauuucuaguaucaaacaaguuucauuucacugcugugaucuuaucaguauuggagcuauaaucuauuugaaacaaaaguaugaaugauacuaaaguggugauuguuucuagcaauauuagcauucuccaguaaauaaaaucauuccaguguuaguuucugguuaggaauauauucuuguccuguuuuuaauggcauguuaaucaauaaauuaaauuugucuucgaaaguuugggacaaguguaguuuucugacuguauuuuuauaguagucacuaccuucagcacggaucaguaacacccucuacucuguucugcgacccucauccauuuacaacuucuuguuagaauauagagaaauuaccaaacgaauuuccaaauggauauguguaugucucuuaacagauauguuacuuugauuucuuguuucuuuguaucuggcccuuuuuacaguuccaaagccaauuuucucuuuacucacaguagggcuggggguggggagcaacugugagcacagcccugaguuccuuggcugaagugcagcgugcugcuugcuuggccacaguuagauccacaucacugagcugagaaggcugggguggcucugcucuguguggaccucguggucgucaucccucccacuucgugcucaggguuuuccuccuaaccuacuucugcuucugcguuaguaugagaagauggcgagguuugcacuccacuaacugcugcuguagaucagcagccucugggaauuuacccuuagugcuauaguauauguaagaaaaucacuauaucacuuguaagaaaaauuucacagucucuaacacauaaauuacguauguauuucaaaauauuaucauaaauaaaauacauuuaucugaccuagagaaaacauucaagccuucaucaagaaaaauagugcccuauaaauggcugauuauacugugugcagggaaugaaaggguccucuucuaaauaaacucgauuauggaauaaggcagaacuucagguccauacuuauguacuucagucuauuguaguuucuuuccauugaagagugcauaucucugucauaaauguacugaggaugaacaacagagucauuugagguucauugaaaauauagggaacaucauguuuccuguucuuuuguuaaaccuggcauauugauuuucuuuugcacagcuugcagcacagagcugugauauauagcuauggcaagaaaagcucaccacgugugaauuuguuaagcacugcuggauuagcagaaauugucugacugagcaaauagcgaggguugacuuccucaggaacucuauaacuuaaccaguuaaaauaacaaguuuugguuuucaugcuuaaaauaaaucauuagcaaaaaucauuuccucuugaucacuuguuuguuugaauucauuuuugcuucuccauuuuaagcaaacuaaauaaauauguagaaucuaaacuaaaaacucagagucaaauauaggaagguacaaacacaauaaauguuaccuaguaaauuuuauugaacuaauuuucaguuuuuauuuaauuuuuccauugcauuucuuuccuaacagcccuucagugucuauuuucuguuuccuugagacucagaguaaacaagauuuagacuugacuuaccguugcuuaaguauggaaccuguuaaaaaaaaaggggggggggggguucagugaugagcuguucuucuucccuuacauuauuuuaaaaacaaaaaaaacaaaaaacuuucuugaauauguccauuacauaguuggcuucuaugacuucagaguagagagggagaaaggagggccaagcugggccaaguggauuccugagcauccuuagagaugguaauguaucaucugcugugcuuaugaguucuagaaacagauacaguugucaguuugcuacagaauaaagcugucuuuugaaagcuagaaagacuucauaauauuuauacuagguaauguugucaccuguguuuucuaaaaauacuuguaugucucucuauauagaauucuuuuuuaacgagauuuggcuaugcuaacacucggaguucauugaaaaguguaggcuucggguucaugcaggugcuucuuuaauuggccauguuagcccagcugugguauuuuguuguuguuguuugcaaguucuuuacaaugaagugauuuuuguguuuaaaaauaacauauauuuucuccgcccucaaaaaguuauuuagaagauuuucauuuuuaaauauuguucaauauacuuuuguuacauuuaaacagguaagcaucuuaggaaauuacaugccaaauucauuagaaggcagucuuuuuuaaauugucugauagaagcauaaaacaugaguuguuucuaugauaaaguguacaggguggaggggagagcagggaagaaagugccacugguuuguguuaggugacacugugcccugcuugucuaauuugauuacacagagcccccgaagccucaggcaaagcugauuuuagcuauaaucagcuucuuaaccuuuggagaaccaacguaaacacucccuagcaguggugauuacggugcucuguuacucacuccaaagugcaaagggaagaauguacaagucggggaacacauguuauggccaaaugucacaacaugacuuaagggguuugccacagaacgcaguccauauuggaagggcauuugaaaucaauaacuuacgagggcauucucuaaaauauuagcauaguuuucaaguuuuguucauaagugauaaacacuguguacuucaacuuugcuagcuucacauguacacuucucuauaaaaucuuguuauuuuauauauauccauauauaauuaaucuuagaauuauaagagcauuugcagauuucuuuuauuuuuuuauuuuuguuuguuuuuuguuuguuuguuuguuuguuuguuuguuuuuucaagacagaguuuuucuguguagcccuggcuguccuggaacucacucuguagaccaggcuggccucgaacucagaaauucgccugccucugccucccaagugcugggauuaaaggcaugagccaccaugcucggccugauuucuuuuauuuuuaaaauaaagcugaugcaauauccauguaaguaaaaugguucacuuuuuuuauuggcaguaaaaauuuauuagggaaggaguacaauuuuuuuuauaguuaaguagaguacuguaguuauauaggcaagagccuagcuuuuuuuuuauuuaaaacaagaacucuuaguacaacaaugugaugugccaugugggaaauuaauauguaagaugauuucacucccuauauaguugguaugacucugguuuaaugauauaacuaauaagguaaaggaccauaaaaagggaauaguauacuuuuaaaggcuguaucucuaaaguuauauuugauggggaaauauaggaguguucuucugaaguuccagaugaccaagaggagguauggugcuguaagccauagucuauauugacaggcuucuguacuagcagaucuaucucaaauuucauauucugugaaggacagcaucuucaaccccagcagugcacauuauaaacuguuucacagugugcaguaacucaaauuaaggaaggaauaguuuaagucagaaucuaauaugauguaugaauaucuaagucggugacccaugaaccacccaugcacguuauagucuguuaugugguaugauuugcacugugcuugcacuugcaggcaaagaagcagucuuaggccugggccccucacagcuugcaaggcaucagagaacacucauggguagcauggcuagugccuuugaccagauuggcagugcccucaauuuguuaauauauauauauauauauauagcuuuuuuauauauuauaucauauauauaugauauuaauauaauauaaaaagaauaaauaaugcuuuguaugcauagcacuaugagacaagugaagccagcuauuaaacagccagauaucuuuuggccccuuauagacauguuugaauugauuuucuaucuugaaaucaguguagugggccucuuuucagauuauuuguguuuuauaaaauuucugauucuguuuuaagugaccuuuuauucaaaaugcuauugauuuuauaacacaaaaugcaguuguccagcagcagccugacuuagauaagaagggguugcugaagccugagaucacuagcacaggaguuccaauugaccuuggucccuugugccacccugggagccaagggaucacugucucugcacuccuagaacacucacuagguccaucacuaugugcauaacauuuuacagaaaguggcacaugacacacuuuuuuuuaaagaaaguucuguaguaagaaaaaaugcuucccagaauucauuucuuuugauguuaucaacaaagaaaauccuaaaauguguuguggcaauagcuccuaaacuuuauuccuuaacaguauaacuuaaccagccaauucccaucuaaauuaauucaauucaguguucauguuaaaagccaggcauuagacuuguucaaaaaccccagauucuugcuugccacaucugggaauguaccaaaugccuucucugagcauuugcaagcacagagcuaaauaugcaucgcauuugcagcaagcaacuaagugggaauaaucaugcccauuccuuagugucuuaacgacuuuuugacuuuuucaaaacuuuucgcaguguugacaagauuuuguuguauuacuuggaacacuaaugagauauauuuacagagacaagauauaccaauucuaaguauauaguucacugauucuuaguaaauuauaccuauguagucacuacuguguccaacuuuagaacaucuccaucaucccagaaacuggagcacuccucucugcagcccucaccaugcugcuccaaccaccaauuuccguuugugacaaaaccauaaacauggaaaaaaaaugugguuuugguguucagcuucuuuugcuuauaguaauguuuaugagauccuucaguguuguaguguguauuaaucacguuccuuguguuacuaaauaaccugcccuuguaugaugauucugcauuuuguuaucccugcuuaaguuaaaggguauguaagcaucuucaguauuugcuauaguaaugaacuuucauguucagaucagugcaggcauaugcuuucauuucccucggauuaccagauuaaaugacauccagcuuuuuaagaaucuacaacaucguuucccacaguaaacuaugucacuuuauguucacauaaaaaaugcaugccaguuucagucucuccacaccuuuaccaacaguuagugucugccuugauaucaaagucacucuagugauguacauuguuaucccauuaucguucuuaauuugcauuugccaauaacaacuuuagcauugauuauauauauaucuuucaugaguaaucuauaauucugaugaaguuuuaaauucuugauuguuuuauuauugaauuguacuucuuuguguggcugcaacuucuuuauccgacagaacgcauauaacucuaaacccugauuguccuacguuggggguuaucugaugcugagagguguuuugguucugauuuuagguacuugucugaauuuaaucuuccaaagcugucuccccaucagagugcacacacucaccucucuguuuugguuuauuuccuagagaauauccuuugcuuauaaggcauaauggucagaguuuggcucaaucuuccucaagccaagaagugaauccaugcuuccuuuccuuucuccugugcuuucccaccguugacccacuguauagcucucuccagucagugucuuuuucccacugaauuucugacuuguccuagccugccacuaaccuacauccuacauacaaggaggaccagggacuuuuaaagauaguucccacugagacuugcucuauuugcuaaucuugccauugaguauugguuucuuuccuuguacuccaaaucaguccaucaacaugcaguucucaaguuggacucuagcuucuccagugcuggaauuguuguuuuugacaauuuugucaacuuuuaucaugauuuuagggaucuguuuuauuucuucacuugcuaucacugggaguccagccucaauuugucucugugugauucaaauucuuuuucagagcaaaguaaagauuaaauuaaaagcuaaauaaaaguaaaauaaauauaaaaauaugaauguaacuucccuagcaauuaaaaguuuuacuauuggaaaaaaauugguaucacuuuuggcgacuuuucaauuaggaaauaaagcaaacaaauagguacaaaaugaauguaugugaguuaaaaaaaaagaaguagugagaguuugauucuauccugggguuccacacauugguuucauuucauucugucuucucucaaaggucagguuucagaaguugugcacuacuuuuuuaugcuuugggagugcuuuagagaauguguggugagaaaccuaccagauugaagguuuccugagugccccuguccagaaucacuaggugugcuugaaacuagucauucuuguuagaaugcacucucucggugccugacuuaucggcaggugccagagcauauguuuuagcaccgagaaguguaagguaacagagggaggguauuugauugcuguaaccuacuuuuuuuuuuccuuguagcuacuuaagucaggucgaaaguggguuaaaauacaugcagaaugaaucaaaguguuuaaagaaaaaauauuccaaauaagguguauuauuuuguuuuauuuaauauacaggucaaaccuauuaaauuaguaucucucauauaggaaauaaacuccaggaaaauaguucuccaggaacuccagaaaacaauuucuuuuucauguuuuuucuguccaaauuauaguuaauccucugaacauugcagcucccuuuguuuuuauccuuacucagaguccucauuuaguaauagcauguguguagcaaucagugagaugcagcuaacaaaaaccaguuaguguuuucugauuaauauaagcacucuugcuacuugauucuguguuaucauucugucuuuaaucauuacuagggccuaaguuacacgauaaacucaaaccucugcugauuaccaacauagagaaauacagacccaaugucaacuaguuucucagaggagccaaacucuguauaacuauuugaaauuuauuugacuuaagaauugcuauggacucgaccccugggcuaccuugccagcagagucuugcccaacacccgcaagggcccacacgggacuccccacgggauccuaagaccucuggugaguggaacacagcgccugccccaauccaaucgcguggaaccugagacugcgguacauagggaaccaggcuacccgggccugaucuggggcacaagucccuuccgcucgacucgagacucgagccccgggcuaccuugccagcagagucuugcccaacacccgcaagggcccacacgggacuccccacgggacccuaagaccucuggugaguggaacacaacgccugccccaauccaaucgcgcggaaccugagacuucgguacauagggaaccaggcuacccgggccugaucuaggacacaagucccuucugcucgacucgagacucgaccccugggcuaccuugccagcagagucuugcccaacacccgcaagggcccacacggaacuccccacgggauccuaagaccucuggugaguggaacacagcgccugccccaauccaaucgcgcagaaccugagacugugguacauagggaagcaggcuacccgggccugaucuggggcacaagucccuuccgcucgacucgagccccgggcuaccuugccagcugagucgccugacacccgcaagggcccacacaggauuccacacgugauccuaagaccucuagugaguggaacacaacuucugccaggagucugguucgaacaccagauaucugggcaccugccuugcaagaagagagcuugccugcagagaauacucugcccacugaaacuaaggagagugcuacccuccaggucugcuuauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaaaucauuaacgaaaaacgggaaaacacauccaaacaggugauggaaaugaacaaaaccauacuagaacuaaaaggggaaguagacacaauaaagaaaacccaaagcgaggcaacgcuggagauagaaacccuagguaagagaucuggaaccauagaugcaagcaucagcaacagaauacaagaaauggaagagagaaucucaggugcagaagauuccauagagaacauagagaacacaacagucaaagaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaauaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacaauaucuuuccacgaauccagcccuucaaaggauaauaacagaaaagaagcaauacaaugacagaaaucacgcccuagaacaaccaagaaaguaaucauucaacaaaccaaaaagaagacagucacaagaccagaaugccaacucuaacaacaaaaauaaaagggagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagaaugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggacuuaacagauaucuacagaacauuuuauccuaaaacaaaaggauauaccuucuucucagcaccucacgggaccuucuccaaaauugaccauauaauuggucacaaaacaggcgucaauagauacaaaaauauugaaauugucccauguauccuaucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagacagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaucaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaaggaguuauuaauagucucccaaccaaaaaaagcccaggaccagauggguuuagugcagaguucuaucagaccuucaaagaagaucuaauuccaauucuucacaaacuauuucacaaaauagaaguagaagguacucuacccaacucauuuuaugaagccacuauuacucugauaccuaaaccacagaaagauccaacaaagauagagaacuucagaccaauuucucuuaugaauaucgaugcaaaaaucgucaauaaaauucucacuaaccgaauccaagaacacauuaaagcaaucauccauccugaccaaguagguuuuauuccagggaugcagggaugguuuaauauacgaaaauccaucaauguaauccacuauauaaacaaacucaaagacaaaaaccacaugaucaucucguuagaugcagaaaaagcauuugacaagauccaacacccauucaugauaaaaguuuuggaaagaucaggaauucaaggcccauaucuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuaggaaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuuaaacgaauuggaaggagcaauuugcaaauuugucuggaauaacaaaaaaccuaggauagcaaaaugucuucucaaggauaaaagaacuucuggcggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuauccuguagaagaaugcaaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucaauaagacaaaaagaccaccaacggauugggaaaggaucuuuaccuauccuaaaucagauaggggacuaauauccaacauauauaaagaacucaagaagguggacuucagaaaaucuaauaaccccauuaaaaaauggggcucagaacugaacaaagaauucucaccugaggaauaccgaauggcagagaagcacuugaaaaaauguucaacauccuuaaucaucagagaaaugcaaaucaaaacaacccugagauuccaccucacaccagucagaauggcuaagaucaaaaauucgggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaaccuagaugccccucaacagaggaauggauacauaaaaugugguacaucuacacaauggaguacuacucagcuauuaaaaagaaugaauuuaugaaauuccuagccaaaugguuggaccuggagggcaucauccugagugagguaacacauucacaaagaaacucacacaauauguauucacugauaaguggauauuagccccaaaccuaggauaaccaagauauaagauauaauuugcuaaacacaugaaacucaagaaugaagacugaaguguggacacuaugccccuccuuagauuugggaacaaaacacccauggaaggaguuacagagacaaaguuuggagcugagauaaaaggauggaccauguagagacugccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucacagggcuccaaauagaggagcuagagaaaguagccaaggagcuaaagggaucugcaacccuauagguggaacaacauuaugaacuaaccaguaccccggagcucuugacucuagcugcauauauaucaaaagauggccuaguuggccaucacuggaaagagaggcucauuggacuugcaaacuuuauaugccccaguacaggggaacaccagggccaaaaagggggagugggugggcaggggaguggggguggguggauaugggggacuuuugguauagcauuggaaauguaaaugauuuaaauaccuaauaaaaaauggaaaaaaaaaagaauugcuaugaaagaugggugugaugguguacaccuuuagucccaacacugaggaaacagacuugggugaguuggagcucagccagggaucucuauguagaugaaggaucuacauagugaguuacaggucugccaggcuacaucgugaggcccaguccaaauauauaaauggaacuguaacuaacuagaaacuucaaaacuguaauauagaguaaauaacguaacugucauaaaacaaacccguaggcuggcaacuuguaaaaucugacaggaaaaaauaaucaggacccauugugaugacagugucugccuggcuucuuauccugugucucuugcacgugaaagagugcauccugugcuccccaggggccucuguucacugagccacuguaaaacgcuaagguugcaugcuuuauugggaauugcgcugaccccaacaucugugaacugugcuucccaagcccgagucuuacaccucucacagguuagccaggcucguggcucaauucuucauauguacagauucacuaaaugacuuuagguauuuuucuuuauaaaauugagguaggucagccauuuagcuuauuuauuucauuucuugaaaauuauagacaaagcaaauauauccccucauucuucuccuuuauuauuaugucagaauuauaaauguaugcuuaugagaauaucuauagcuauucagaugacuggauaauguccaccucacagaggcacagccuaaucaacacauauuggauugaacuauuacaaguuuuaagcaaggguaccauguaauauucaguuuucuuuuuuuguuuuguuuuguuuuuaaauuuuuuauuagauauuuucuucauuuacauuucaaaugcuaucccaaaaaguccccuauacccuucccccacccugcuccccuaccaacucacucccaagucuuggcccucgcauucccuuguacuggggcauauaaaguuugcaagaccaaggggcuucucuucgauggccaacuaggccaucuucugcuacauaugcagcaagagacagaagcucugaggguacuggcuaguucauauuguuguuccaccuauagcgucgcagaccccuccagcuccuuggguacuuucuguagcuccuccauuuggggauccuguguuccauccuauagaugacugugagcauccacuucuguguuugccaggcacugggauagccucacacaagacagcuauaucagaguccuuucagcaaaaucuugcuggcauaugcaauagugucuguguuugguggcugauuaugggauggacccccagguggggcagucucuggaugguccauccuuuugucuuagcuccaaacuuugucucuguaacuccuuccauggguauuuuauugcuuauucuagggaggaauacagcaucuacgcguugaucuuccuucucuugauuuucuuguguuuuggaaauuguaucuuggguauucuaguuuucugggcuagaauacccaguuuucuauuucaguagaaauaguuuuuauucaugucuuucacucagacuucuaauagaaucagaaaaacucacgaugauauuuguauuaguguagaacauuacauggcagagaaugcacuacuguaacuccuugcacugccuucacagcaucaugcacauacuguccccucucaauuucagacuucuuccuauuaacaccuaaacaaaccugaagcccugugcagucacucaggccaucacccuuuccucccaggccugggcaggaaucaucgaccuugugaucugagugcacuaggugggcauuuuauagacauggaaauacauauacacuaugcgggcauuuuauagacauggacuuacacauacacuugcuuuaccuccugacaucuuucucuucauguccucaaggccuuauaauuuuucaauuccucauuguguuuugugcugaacaauguuguuuuguaagacuauaccacauuuagauuguuuucguguuuuauuguuaaagaucacauggaaauucauauuuuucuuuaaacuauauccaauuuuuuucagaaggaauugauccugugucauauaauauuaccauguauacuuuuuugaaaaaucuauaaguauuuauucuguacacauuuuuuucaauuuuuuauuagauauuuucuugauuuacauuucaaaugcuaucccaaaagucccuauacccuccccaccacccugcuccccuacccauccacaaucccccuguccuggggcauaugaaauuuacaagaccaaggggccccuucccaauaagggcugacuaggccaucuucugcuacauaugcagcuagagacaugagcucugggaguacuagugaguucauauuuuuguuccuccuauagaguugcagaccccuucagcuccuuggguacuuucucuagauccuccauugggggcccuguguuccauccaauagcuaacugugggcuuccacuucuguauuugccaagcacuggcauagccucaccagagagagcuauaucaggguccugucaucuaaauccugcuggcauaugcaauagugucugcguuugguggcugauuauggaauggaucccuggguggggcagucucuggauagucuauccuuucaucucagcuccaaauuuuaucucuguaacuccuuccauggcuauuuuguucucuauucuaaggaguaauaaagaauccacacuuuuguauuccuucuugauuuucauguguuuuguauuuuguaucuugaguauucuaaguuucugggcuaauauccacuuaucaaugagugcaugucauguguguucugucgugaucagguuacuuaacucaggaugauauccuccaaauccauccauuagccuaaauaaauuguuuuuaauagcugaguaguacuccuuucuguaaauguaccacauuuucuguauccauuccucuguugagggacaucuggguucuuuccacauacuggcuauuauaaauagggcugcuaugaacauaguggagcauguguucuuauuaccuguuggaauaucuucuggauauaugcccaggagcgguauugcuggaugcucugauaguacuauguccaauuuucugaagaacuaacagauugauuuccagagugguuauacaaucuugcaaucccaccagaaauggaggaguguuccucuuucuccacauuuuugccagugucuccugucaccuaaauuuuugaucuuagccauucugacuggugugagguggaaugucaggguuguuuugauuuucauuucucugaugauuaaggauguugaacauuuuuucaagugcuuccuggccauucgguauuccucaggugagaauucuuuguuuagcucuguaccccauuuuuuaaugggguuauuuguuuuucugaaguccaccuucuugaguucuuuauauauauugguauuaguccccuaucugauuuagaauagguaaagacccuuucccagucuguugguggccuuuuugucuuauugacagugucuuuugccuuacagaagcuuugaaauuuuaugagaucccauuuguaaauucucgaucuuacagcacaagccauugcuguucuauucaggaauuuuuccccugugcccauaucuucgaugcuuuuccucacugucuucucuauaagauucagugucucugguuuuauguggaguuccuuuauccacuuagaauugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucacuguaccaguaccaugcaguuuuuaucacaauugcucuguaguaaagcuuuaggucaggcauggugauuccaccagagguucuuuuauccuugagaagacauuuugcuauccuagguuuuuuguuaauccaaaugaguuuacagauugcucuuucuaauuuguugaagaauugaguuggaauuuugauggggauugcauugaaucuguagauugcuuuuggcaagauagccauuuuuacuauauuaauccugccaguccaugagcaugggagaucuuuccacacucugggaucuuuuuugauuucguucuucagagacuugagguucuuaucauacagauauuucucuuccuuaguuagagucacgccaagguauuuuauauuauuugugacucuuguuaaggguauuauuucccuaauuucuuucucagccuguuuauacuuuguguugagaaaggccauugaucuguuugaguugauuuuauauccagcuacugcacugaagccuauuaucagguuuaggaguucucugguggaauuuuuagugucauauauauuaucauaucaucugcaaauauugauauuuugacuucuuccuuuccaauuuguaucucuuugaccuccuuuuguugucuaauuguucugguuagaacuucaaguacuauauugaauaaguagggagaaagugggcagccuugucuagucccugauuuuauugggauugcuuccugcuucucuccauuuacuuugauguugccuacugguuugauauagauugcuuuuauuauguuagguaugggccuuaaauuccugaucuuucuaagacauuuaucaugaagggguguuggauuuugucaaaugcuuucucagcaucuaaugaucaugugauuuuugucuuugaguuuguuuauauaguagauuauguugauagauuucccuauuuuaaaccauccaugcaucccugggauaaagacuacuugaucaugauggaugaucauuuugauguguucuuggauucaguuugugagaauuuuauugaguaguuuuugcaucgauauucauaagggaaauuggucugaaguucucuuucuuuguuggaucuuugugugccuuagguaucugaguaauuguggcuucauaggacgaauuggguagaguaccuucuguuucuuuuuguggaauaguuugugcagaacuggaauuagaucuucuuugaaggucugauagaacucugcacuaaacccaucuggucgugagcucuuuuuuuugaggggggggaagacuauuuuuuuuauuauuauuaaugacugcuucuauuucuuuaggggauauuggacuguuaagaucauuaaucuuauccugauuuuacuuugguacuugguaucugucuagaaauuuauucauuucauccaaguuuucuaguuuuguuaaguauacccuuuuuuaguaggaucugacaauauuuuggauuuccucagguucuguuguuaugucuccuuuuucauuucugauuuuguuaaucaggauacugucccugugccuuuuaguuagucuggcuaggaguuagucuaucuuguugauuuucugaaagaaccagcuccuaauuugguugauuucuugaaucauucuuuuuguuugcacuugguugauuuuugcccuaaguuugauuauuuccugcuguccacuccucuugggugaauuugcuuccuuuuguucuagagcuucuaggugugcugucagacuacuaguaugugcucuaacuaguuucuuuuuggcagcauucgggcuaugaguuuuccucuuaggacugcauucauugugucccauaaauuuggguauauuguggcuucauaucauuaaacucuaaaaagucuuuaauuucuuucguuauuucuuccuugacgaagguaucauuaaguagaguguuguucaguuuccacgugaauguuggcuuucuauuauuuaugcuguuauugaacaucaaccuuugucaguggucaucugauaggaugcaugggauaauuucaauauuuuuguaucuguugaggccuguuuugugacugauuauaugguccauuuuggaggagguaccaugagaugcugagaagaagguauauucuuuuguuuuaggauaaaauguucuguagauaucuguuaaaucuguuuauuucauaacuucuguuagugucuaugugucuauguuuaguuuuuguuuccaggaucuguccauuguugagagugggguguuaaauucucccaguauuauugugugaggugcaaugugugcuuugagcuuuacuaaaguuuuuuuaaugaaugugguugcccuugcauuuggagcauagauauucacaauugagaguucaucuugguagauuuuaccuuugaugaguaugaagugccccuccuugucuauuuugauaacuuuggguuggaagucaauuuuauucgauaagagaauggcuacuccagcuuguuucuucggaccauuugcuuggaaaauuguuuuccagccuuuuacucugagggagugucugucuuuuucccugaagugaguuuccugcaagcagcaaaauguuggguucuguuuguguagccagucuauuagucuaugucuuuuuauugggggauugacuccauugauguuaagagaaauuaaagaaaaguaauuguugcuuccuguuauuuuuguuguuaaaguuaggcuucuguucuuguggcucuauucuuuuagguuuguugaaggauuacuuucuugcuuuuucuacaguguaguuuccaucuuuguguugguauuuuccaauuauuauccuuugaagggcuggauucguggaaagauauugugugaauuuuguuuuguuguggaguacuuugguuucuccaucuaugguaauugagaguuuugcuggguauaguagccugggcuggcauuuguguucucuuagugucuguauaacaucuguccaggaucuucugagguuucauagucucuggugagaagucuggaguaauucuaauaagccugccuuuauauguuacuugaccuuuuucccuuacugcuuuuaauauuccgucuuuauuuaguguauuuguuguucugcuuauuauguguuggggugaauuucuuuucugguccaaucuauuuggaguuuuguaggcuucuuguauguucaugggcaucucuuucuuuagguuugggaaguuuucuucuauaauuuuguugaagauauuugcuggcccuuuaaguugaaaaaucuucauucucaucuacuccuauuaucaguagguucggucuucucauuguguccuggauucccuggaugcuuugaguuaggaucuuuuugcauuuugcauuuucuuugauuguuauguccauguucucuauggaaucuucugcaccugagauucucucuuccaucucuuguauucuguugcugaugcucccaucuaugguuccugauuucuuuccuaggguuucuaucuccaaaguugucucccuuuggguuuucuuuauuguuucuacuuccauuuuuagaucuuggaugguuuuguuuaauuccauuaccuguuugguuguguuuuccuguaauucuuucagggauuuuuuuuuuuuuuugcuuguuucuucuuuaaggacuucuaccuguuuagcaguauucuccuguaauuccuugagggauuuuuguacuuccucuuuaaggaauucuaccuguguagcaguauucuccuguauuucuuuaaguaaguuauuaaugcccuucuuaaaaucuucuaccaccaucgugauauaugauuuuaaaucugagucucgcuuuuuggguguguugggguguccaggacuuacuguggugggcauacucgguucugaugaugcccaguguucucuguuucuguuaguaagauucuuauguuugccuuuugccauccgguaauccugguguuaauauucaagcugucucuugcuggagcuuucuccuccugugauucuguuagucucugucaacacuccugggaguccaacucucaccugaguuccaguggucagagcacucucugcaggcaagcucuccucuugcaaggcagguguccugaagucuggagcucugauccaccuccugaguccugggucagagcccucccuguaauccagcucuccucuggcaaggaaggugcccaggggacugggucuaagcucugccuccugguugaggaugaaggcacaaagggacccugucuaagaagcucuguuacuucugucacccacgugcucucuggugaucaugagguccugggugugcuagggguccugcagcaugaagaguacucuagggccccugguggccuccagcuggaaacauuucuuuuucuuuuucuuuuucuuuuucuuuuucuuucuuuuuuuuuuuuuccucuuucaauuugaggcagguuuucccugcauagcccuugcuguccuggaacucacucuguagaccaaccagacugguucucaaacucauagaaauucacgugucuuugcuucucaagugcuggguagaauuaaggcaugugccaccacugcccaacuuucauuaaaaaguuuaaagccaauuuaugggggcuuggggagagaauaguuuagcuuaagaacccccaaacuccuaaagcucacacccaaaacauauauacacagaugcagaugaauaguuauuugcauguacauacauacggagaauaucuauagguuuaauuagauuuucauuccaggucugguauuagcuuugaccuauauuuucuuaauuauaaauagaaagauacggaugguuagucauuaggauuugauauuuuuuaauacaccugaacaagaaguucucacauacacuuacacacauacacacacacacacacacacacacacacacacacacacacaguuuugcuaaguuuugucuucaguugaacaggacaaaugcuuuacccuacaauuuagaagcaugauaccaggaaaugucagacccugaucugaugugucuuaaaauagcuguaaauuauggagguaucauccaaguucucaauagcuauguuuuagauuugcuaguguguuccugaaaagaucaacaaaucuccauuaggacauguuccaauaagcuccucaauaauuuccagcuauuuuguuuaaaaugauuauauaauuaaaauauguaugcuaugaaauuuguaaaguuuuugagaaauuaaauauuuauaaaauacaaaaaauguuuuagccuauuugguuuauguuuuaagaauuuagccuaugauuauugccuucauggagcuaaaauauuuuuagcuggaauuaagccaaauccacuaggagcauguauuuaacuuagauuguaugcauuccagucuugacacuugcauggucuuuucauuuaucugaaauccuucuggcauaaacaacaguaauauuuaacaauagaaacuuugcucuccauucaguagagucuacugggaagccaagcaagaaaguguauggcugccugugggugaagacauguucugaccucuuccugguauguugaagaggccaugccaucucagagugaaccuggguaaggaagguagcugccacugcauugucuccucaggaagccaaggauaaccuaaagcagacucucugaauaggagauguccguucacaggaauagccagagaagagccaugggauaacugccagaugccucuaucaggacaaaacaagaggugccuaggguuacaaggguuuuugggggguuuuuuugcauauuuaauuuacuuacauuucaaauguuauacccuuuucugguuuccccucugcaaacccaguauccuauccccgcuuacccuacuucuaugaggaugcucccacaugcaccuacacacuucugccucacuacacuagcauuccuauacacuggggcaucaagccuuuacaguaccaagggccuccccuuccauuaaugccagauaaggccccuucagaucauccccuaacuucuccauuggggucccugugcucaguccaaugguuagcugugggcauccacaucuguguugcucaagaucuagcagagccucucaggagacagcuguaucaggcuccugucagcaagcaggucuugacauccacaauagcgucuggguuuggugucugcaugugggauggauccccagguggggcagucucuggauagccuuuccuucagucucugcuccacucuuuguuucuguauuuacuuuagagaggagcaauucucaguugaaauuuuggagauggguugguggccccaucccucaagcaggaggccaugccuaaccucuugauauugucucaacaaguucucccuccccuuuguugaguauuucagcuaauggcauccccaugggauccugggaggcucuugcuuuuuuggcaucugggacuuucugguugcuacuuucaguuucccaugccuuguugcuacacaacuauguucaauuuccugauccucuauacaucucuuccaucuccucccauaccuacucuuccccuguuuucccccucccccucuucucuuccucccaagacccucacacugacuacuucgccugauuauuuuguugccccuuuuaaguaggacugaagcauccacuccuuggucuuccuuccucuugagcuucaugugguccauaauuuuaucauggguauuccauguucuuugccuaaucuccacuuauuagugaguacauaccauguauggucuuuuuugugacugaguuaccucacucaagauauuuucuagauccauccacuugccuaagaauuucaugaauucauuguuuuuaauagcugaguagcacacuacuguguaaauguaccacauuuuguguuuccucuuuaagggcuucuagcuguuuaccugugauuuccuguauuuccaucuuaaaguccuccaucaucaucaugagaagugacuuuagauccauggcuugcuuuucuggugugaugguguagccaggacuugcuaugguaggagaguuugguucugaugaugccaaguaaccuugguuucuguugcuucuguucuuacacuuuacuccugccaucugauuaucucaagugcuugcugcccucaauauaucugauuggagccuguccuuccuauaaucccaguugauucaggauuccucagaguccagcuuucucugugauccuuugauuguaggguucuguggaccuucugggugugucagaguucuuggcagucaagcuuccucugagacccugaaauacuagugugacccagcuccuguuauccugaauccuguugcucuaagauccugggcguguuacagugccuggaaguggugucucccuugaggaccgaggagcugucuggucuguucaaaaccaauauaaaccaguaccaaucaaaaggaacccgagccucugguccgguagggcucugguguccuuguuccugcugucacaggcccgucacaauuggauuggaaccaauguuguguuccgcucaccagugaucaugagaucacguggugaguccucuagggacaguggggguguccaccaacucugcgcccuaggugacccggugcuggugccuacuggaaggaggaugauauuuucuauuuccaucucauccauuugccuccaaaauccaugauuucuuuguuuuuccaugguugaauacuauuccauugccuaaaugaacuacauuuucuauauccacucuuugguugagggacaucuggguugcuuucaguuuccagugauuacauaaagcagcuaugagcaugguggagaacacauccuugugcuguaggagagcaucuuucggguguauacccaggagcaguauaacuggguccucagguagaacuauuuccaguuuguaccagcuuguagucccaccagcaauggaaguguguuccucuuucuccauauccucaccaacauggucgucauggggaauaauauuuuugauguguucuuggauucggucugcaagaauuuuauuuaauaauuguugcauugauauauauaacuaaaauuugucuggaguuuucuuucuuuguugagacuuuuuguggugguuuggguaagggguaacuguggcauaauaaaaugaauuagguauuguuucuucuguuguuauuuuguggaauaguuucaggaggauugguauuaacucuucuuuaaaauucugauagacuucugcacuaaaaccaucuggcccugggcuuuuuuuuuuuuuuuuuuuuuuuuuuuugguugggagacuuaaugacugcuucuauuucuuuagggguuaugauuuuccuuagagguuugugggaaaauacuguguaaauuuaguuuugucauggaauacuuuacuuucuccaucuaugagaugagaguuuuucuggguguaguagccugggcuggcauuuguguuuucuuagggucugcaugacauuugucuaggaucuucuggcuuucauuguuucuggugggaauucugauguaauucuaauaggucugccuuuauauguuacuugacacuuacugcuuuuaauauucuuucuuuguuuugugcauuugguguuuugauuauuaugugacaggaggaauuuccuucugguccaaacuauuuggaguucuguaggcuccuuguauguucaugggcaucucuuucuuuagguuagggagguuuucuucaauaauuuuguugaagauauuugcuaguccuuuaagauugaaaucuuccuucucaucuauaccuauuauccuuaaguuuggucuucucauuguguccuggauuuccuggauuuuuguggcuaggaucuuuuugcauuuugcauuuucuugauugcugugucaauguuuuguauggaauccucugcaccugauauucucucuucucuuguauucuuuuggugaugcuugcauguauggauucugauaucuuuccuagauuuuauaucuccagaguugucucccuuugagauuucuuuauuguuucuacuuccauuuuuagaucccugaugguuuuguucaauuccuucacauguuugguuguguuuuccuguaauucuugaaggaauuuuuguguuuccucuuuaaggacuucuaccuauuuugcuguguucuuuuuuauuucuuuaaagaaguuauuuauguucuucuuaaaauccucuaccugcaugaugagauaugauuuuaaauccaaaucuugcuuuucugguguguuggguuauccuggacuugcuaugguggggguacugaauuauguuaaugccaaauagucuuaguuucuuuuuuuuuaauuuuuaaaauuuuuguuuuuuauuaaaaaaaucaaaaccugucauuaugaaauucaaauucuucaguauuuuacagucuuuuuuuuuuauuacguauuuuccucaagacauuuccaaugcuaucccaaaagucccccauacccuccgccccacuucccuauacacccauucucauuuuuuuggcccuggcguuccccuguacuggggcauauaaaguuuguguguccaaugggccucucuuuccagugauggccgacuagaccaucuuuugaaacauauguagcuaaagucaagagcuccaggguacugguuaguucauaauguuguugcaccuacaggguugcagaucucuuuagcuccuuggauacuuucucuagcuccuccauugggggcccugugauccauccaauagcugacugugagcauccacuuauguguuugcuaggccccugccuagucucacaagagacagcuauaucuggguccuuucagcaaaaucuugcuaguguaugcaguggugucagcauuuggaagcugauuaugggguggaucccuagauaaggcagucucuagaugguccaugcuuuugucccagcuccaaacuuugucucuguaacgccuuccauggguguuuuguucccaauucuaagaaggggcacaguguccacacuuuggucuucauucuuuuagaguuucaugcauuuggcaaauuguaucuuauaucuuggguauacuaaguuuugggcuacuauccacuuaucaguguguacauauugugugaguuccuuugugauuggguuaccucacucaggaugaugcccuccagguccauccauuugccuaggaauuucauaaauucauucuuuuuaauagcugaguaguacuccauuguguaaauguacgacauuuucuguauccauuccucuguugaggggcaucuggguucuuuccaguuccuggcuauuauaaauaaggcugcuaugaacauaguggagcauguguccuucauaccgguugggacaucuucuggauaugugcccagaagagguauugcuggauccuccgguaguacuauguccaauuuucuaaggaaccaccagacugauuuccagagugguuguacaagguugcaaucccaccaagaguggaagaguguuccucuuucuccacauccucgccagcaucugcuaucacuugaauuuuugaucuuagccauucugacuggugugagguggaaucucaggguuguuuugauuugcauuucccugauaauuaaggauguugaacauuuuuucaggugcuucucugccauuggguauuccucaggugagaauucuuuguucaauccugagccccauuuuuaaaugggguuauuugauuuucugaaguccauccucuucaguucuucauauauauauauuggauauuaguccccuaucugauuuaggauagguaaagauccuuucccaaucuguugguggccuuuuugucuuauugacaguaucuuuugccuugcagaagcuuuggaguuucaugaggucccauuugucgauucucgaucauacagcacaagccauugcuguuauauucaggaauuuuuccccuaugcccauauauucaaggcuuuuccccacuuucuccucuauaaguuucaguggcucugguuuuauguggaguuccuugauccacuuagauuugaccuuaguacaaggagauaggaauggaucaauucgcauucuucuacagcauaacaaccaguugugccagcaccauuuguugaaaaugcugucuuucuuccacuggaugguuauaccucccuuguugaagaucaaguggccauagguguguggguuuauuucugggucuucaauucuauuccauuggucuacuugucuguugcuauaccaguaccaugcaguuuuuaucacaauugcucuguaguaaagcuuuaggucaggcauggugauuccaccagagguucuuuuauccuugagaagaguuuuugcuauccuagguuuuuuguuauuccacaugaauuugcagauugcucuuucuaauucauugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaauuagagucacaccaagauauuuuauauuauuugugacuauugagaaggguguuguuucccuaauuucuuucucagccuguuuauucucuguguagagaaaggccauugacuuguuugaguuaauuuuauauccugcuacuucacagaagcuguuuaucaggcuggacuucaagaacaauguugaauagguauggagagaguggacagccuugucuaaucccugauuuuagugggauugcuucaagcuucucaccauuuacuuugauguuggcuacuauuuugcuguagauugcuuuuauuaugguuagguaugggccuugaauuccugaucuuuccaagacuuuuaucaugaauggguguuggaucuugcccaaugcuuuuuccacaucuaaggagaugaucaugugguuuuugucucugaguuuguuuauauaauggauuacguugauggauuuccguauauuaaaccaucccugcaucccuggaauaaaaccuacuuggucaagauggaugauugcuuuaauguguucuuggauucgguuagcgagaauuuuauugaggauuuuuguaucuauauucauaagggaaauuggucugaaguucucuaucuuuguugaaucuuucugugguuuagguaucagaguaauuguggcuucauagaaucaguuggguagaguuccaucuacuucuauuuuguggaauaguuuaugcagaacuggaauuagaucuucuuugaaggucugguagaacucugcacuaaacccaucugguccugggcuuuuuuuugcugggagacuauuaaugacugcuucuauuucuuuaggggauaugggacuguuuagauuauuaacuugauccugauuuaacuuugguaccuaguaucugucuagaaauuugucuguuucauccagguuuuccaguuuuauugaguauagccuuuuguagaaggaucugaugguguuuuggauuuuccaggaucuguuguuaugucucccuuuucauuucugauuuuguuaauugggauguugucccugugcccucuagugagucuagcuaaggguuuaucuaucuuguugauuuucucaaagaaccaacuccucguuugguuaauucuuugaauaguucuucuuguuuccacuugguugacuucaccccggaguuugauuauuuccugccaucuacuccucuggguugaauuuucuuccuucuuuucuagagcuuuaaauguguugucaagcugcuaguguguguucuuucuaguuucuuuuuggaggcacucagagcuaugaguuucccucuuagaaaugcuuucauugugucccauagguuuggguauguuguaucuucauuuucauuaaacucuaaaaagucuuuaauuucuuucuuuauuccuuccuugaccaaguuaucauugagaagaguguuguucaguuuccacgugaauguuggcuuuccaauauuuauguuguuauugaagaucagccuuaguccuugguggucugauaggaugcaugggaggauuucaauauuuuuguaucuauuaaggccuguuuugugaccaauuauauggucaauuuuggagaaggucccgugagguacugagaagaagguaaauccuuuuguuuuaggauaaaauguucuguagauaucuguuaaguccauuuguuucauaacuucuguuaguuucacugugucccuguuuaguuucuguuuccauggucuguccauugaugaaagugguguguugaagucucccacuauuauugugugaggugcaauguguguuuugagcuuuacuaaugugucuuuaaugaauguggcugcccuugcauuuggagcauagauauucaggauugagaguuccucuuggaggauuuuaccuuugaugaauaugaagugacucuccuugucuuuuuugaugacuuuggguuggaaguugauuuuauucgauauuagaauggcuacuccagcuuguuucuuuagaccauuugcuuggaaaauuguuuuccagccuuucacucugagguacugucugucuuuuucccugagauggguuuccuuuaagcagcagaauguuggguccuguuuguauagccauucuguuagucuaugucuuuuuauuggggaauugaguccauacacucggcagggucccggaaccgagaugucugcugcggaugcucaggcaaugugcucccgcgcagggcagaucccaauccucagaauucugaagaucucguggcugguguuguggguaucuggcgguagucagcugacugugcgcccuagcuacccuggugcugcucacauggaaaggggcuugugccccuacuccaaccgggucucaagucccgggcgauuggauuggagcagaugcuguguuccacucaccagaggucuuaagaucgcuuggcggguguuguggguagcuggagguagucagccgacugugcgcccuagcuaccccgguacugcucggaccggaagggucuagucuugguuucuuuugguaugagucucgcuuuugccuuucaccaucugauaauaucugguguuagauguuccugcugucucuggcuggagcuuguuucuccuguuagucuguaagccugugucacauuuccuggaggcaagcucccccuuggcaaguccagugcacagagggcuauaaaauagccacaucucuugggugcagaugaaagccaguaggauccuguaccagcugcucugcugcuucugugaccugugagcgccugacuggucugccuuagagggucaccagagagaaaauggcgaucuccccugaaucccaggucagagcacucccuggaggcaagccccccccccaggcagggaauguucucagagggcuacagacauauagaagacuuuaaacaguaaacaaauaaauuccuuaaagauauacaaggaaauauaaucaaacaggcaaagaaaauaaauaaaacaguccaaccuggaagugaaaauagaaacaauaaagaaaacacaaauagagggaacccugggaauggaaaaccuagaaaauagacuaggaacuacagaggcaagcaccaucaacagaauacaagugauagaagggagaaucucaagcauagaagauaccaugggagaaauugauacaucagucaaagaaaaugccaaaugucaaaaguuucuaauuuaaaaauccaauaaugaaaagaccaaaccuaaaaauaauaggaauagaugagggucaagauucccaguucgaagguacaaaaaaauacaucuucgacaagaucauagaagaaaauuaucuaaacuaaagaaauaguuuuaaaugcacaagaagcuuagagaacaccaaauagauuggaucagaaaagaaaauccucccaccacauaauaaucaaaacauuaaaugugcaaaacaacaaaaggauauuaacccuaucauaccauauaccuaaauguaaaaaaucccccugccuucuuuccugagcuugguucauuacuuauucaguucauggucaauuuuuccugaaauuacccaaacagacauuugcaauaggugaccauuugcaauuaucugauaucaugcuagaaucagacuuagcagugaugggguaaugaggugucugccauucacacuauaccaggaacucaguauuauagacacuaaugccauuguugcuauagcagggacuugaucucacaggguuaaaaguugcaagagaaaaaggccaaguaacauauaaaggcagaccuaucauacaucugauuucucaaagguauucuaaaagcuagaagauucuggacagaugucuugaaacccucagagaccacagcugccaguacagacuacuauacccaccaagaaauucaaucaccauaguuggagaaaucaagauauucuguaacagaaccaaaauuaaacaauaucuuucuuguaauccagccauacagagaauacuagaaaaaaaauccaacucauggagaauaacuacacccacaaaaucacaagguugacauggacaugagcuuugugcaagaugauaaauaugaaucuauuuuccuuuuccuacauauaggcugucaguuagaccagccccauuuauugaagauguuaucuuuuuaauauuauauauuguugacuuuuuugucaaagagcaaguguccauagguguguggguuuauuucuggguuuucaauucuauuccauugaucaaucucucugucucuguaccaauaccaugcaguuuuuaucacuauugcucuguuguacaguuugagguuggggaaaaaguuaauuuuauuaaugagaauuguuuccaauauccuggauuuuguuuuuuccauaugaaauugagaauugcucuuuccaggccugugaggaauucuguuggaauuuugauagagauuguuuugaauauauagauugcucuuaguaggauggacauuuuuacuauauuaauccuaccauuccaugagaacaggagaucuuuucauuuucugaagacuucuuagauuucuuucuugagagacuugaaauucuugucauacaguuuuuucacuuguuugguacagacaaaaguuaccccaugauaguuuauauuauuugugacuauugucaaggguguuaucucccuauuuacuuucucagccugucuaucauugggauaaaggaaggcuauugacuuguuuaaauucauuuucuaucccaccaguuuguugaaguuguuuaucagauguagaagugcucugguagauuuuuagggggguugcuuaaauauaguauuauaucauccacaaauagugauaccuugaauuuucuuuuccaacuuguacucccuugaucuccuuuaccacauacauugaagcaaauagaagugaaagugggaaagagccucuaacacaucagucagcacaggagaaauuucccgaacagaacaccaauggcucaggcuguaagaucaagaauguaaaugaagaaaauaucuaauuaaaacauuguuuuaaaaaaaaaagaaugauaaaugggaucucaugaaacugaaaagcuucugcaaggcaaaagacacaguuaauaggacaaaucggcaaccuacucauuggaggggaaaaaacacuucacuaacaccucauccaauagaaagauaacaaaaaaccuagaauaacaaaaacuauucucaacaauaaaagugcuuccaguggaaucaccaugccugaccucaagcuauacuacagagcaauugugauaaaauacugcaugguacuggugcagggacagacagauagaucaaugaaauagaauugaagacccagaaaugaacucacacacauaaggucacuugaucuuugaaaaaggagcuaaacauucagugggaaaaagacaguauuuucaacaaauggugcuggcucaacuacagguuaucauguagaagaaugcaaauugauccauucuuaacuccuuguacaaagcucaaguccaagggaaucaaggaccuccauauaaaaccagagacacugaaacuuucauaggagaaagugggaaagagccucgaagauaugggcacaggggaaaaauuccgaacagaacagcaauggcuugugcuguaagaucaagccgggcacugguggagcacuuggcaggaagaggcaggcagauuucugaauucgaggcuagccuggucuacagagugaguuccagaacagccagagcuacaucuagaaacccugucucaaaaaaaucaaaaaaagaaaaaaaaucaaggaucaacaaaagggacuucauaaaauugcaaagcuuauguaaugcaaaggacaccgucaauaagacaaaaaggccaccaacagauugggaaaggaucuuuaccaauccuacaucugauagagggcuaauauccaauauauacaaagaacugaagaaguuaaauuccagagaaccaaguaacccuauuaaaaaaugggguacagagcuaaacaaagaauucucaacugaggaauaccaaaugacugagaagccccugaaaaaguguuccacaccuuaaucaucagggaaaugcaaaucaaaacaacucugaaauuccaccucacaccagucagaauggcuaagaucaaaaacucaggugacagcagauacuggcaaggauguggagaaagagguacacuccuccauuucugaugggauugcaagcuuguacaaccacucggaaauaguuuggcaguuccucagaaaauuggacauagugcuacuggaggaucuagcaauaccucuccugggcauacacccagaagaugcuccaacugguaauaaggacacaugcuccacuauguucauggcagccuuauuuauaauagccgcaagcuggaaaaaauccaaauguuccucaauagaguaauggauacagaagauggaguacuacagagauauuaaaaacaaugaaauuaugaaauucuuaggcaaauggauguaucuggaggauaucauucugagugagguaacccaaucacaaaagaacacacaugacaugcacuaacugauaaguggauauuagccuauaagcucuuaauacccaagauacaauuugcaaaauacaugaaacucaagaagagggaaggccaagugugacuauuucuauccuucuuguaagggggaacaaaauacccguggaaggaguuacagagacaauguguugagcagagacugaaggaaugaccauccaaagacugccccacuugguaauccuucccauauacaaccuccaaacacaaacaccauuguggaugacaacaugagcuugcuuacaggaaccugauauagcugaccccugagaggcucugccagugccuaauacagaaguggaugcucacaguuaugugagcacgggguccccaaugaaggagcuagaaaaaggacccauagagcugaauggguuugcagccccauaagaggaacaacaauaugaacuaaccaguaccccagagcucccugggaguaaaccaccaaccaaagaaaacacaugcugcuuaucuagcagaggauggccuaaucggucaucaguggggaagaggcccuugguccuguaaugguucuaugucccaguauaggagaaugucagggccaugaaucuugaguggguggguuggugagcaagcaaaaggggauggggauagggggauuucagaaaggaaucuaggaaaggggacauuugaaauguaaauaaagaaaauaucucauuuaaaaagucuggcugacacagcuacagaaguaaguuggcaaagaugugucagaugagaagugaugagacuacaucuggaacgcacucaacucagggccgguugucccaggauacggccaugcaguacugaggaagacugauccaugcaugagauuccugucaucgagaguuugcucugaaacaugugccuaaggaucccaaguucaagcugguugcucagcugaacaagauugugccccauauccucuuagagcaagggaaggcuaagaacccuuggcccaaaguagacgcucacaguggggugcugcuccaguacaauggcauguuggagaugaacuacuacacaguccuguucggagugucucgggcacuggguauucuggcccagcucaucucuagcagagcccuaggcuucccucuagaaaggcccaaguccaugagcacggauggucugaugaaguuuguggacccuaaguaaggguaaaaugggagacugggggggaaacugacuauaagaaaaugaggaagcuuaaaaauuaaguguaauuuuguuucaaaaaaaaauaaaaaaauguucuacauguuugauugugguuuccuguauuucuuuaagggaauuauuuauauccucuuuaaaggccucuauuauuuucaugagaugggacuuaagguuaaaggcuugcucuucagguguguaguauaucgagggcuugcuggaguaggagcgcuggguucuggugaugcuguauuguaugggcuucuauugacugcauucuugcacuugcauuuugccaucugguugucucugguauugccuggccaggguguucuggguuagagaagaccuccugggagcagucagagcugugggugggucacagugugccuauccgugacugcaaguguauguagacuagaaggaagaugaagcucugacagagcagggcagaggucauggcuacagcgcuugcuggagucccaguggucaggggaaagguguugggauggaccaggcgggguggggaguggcucucaccuaugugacucagguuugagcagaccuacugggaggcaggaagggcuguguagugggacucagugaacuguugggaaaauacaaucacuggacuacuuauuuauuuauuuauuuauuuauaccccauauuuuauuccccucccacccugguccacccuccaucuaucuguuccacaucuaauaccucuucccacccuccugucuccccaaggauguccccacuccccuccccaccugaccucuaaacuccauagggacuccugucccuugagggugaaguacaucaucucugaauuaacacagacccagcaguccucuacuguauguguguugggggccucauaucagcugguguaugcugucugucuggugguucaguguuugagagaucucggagguccagauuaacugaggcugcuaauccucuuacaggaucgcccuucuccucagcuucuuucaaccuucccuaauucaaccacagaggucagcugcuucuggccauugguuggauacaaacaucugccucugacucuuucagcuguuuguugggucuucugggguuugguuauacuaggucccuuuuugugagugcuccauagcccaguaauagugucaggccuugggaccuccccuugagcuggauccuauuuugggccuugccacuggaccuucuuuuccucaggcuccucuccauuuccaucccuguaauucauucacacagaaacaauuaugggucaaagaugaggcucugagauggcccccuucucccucauuugauacccugucuuccugcuggaggugagcucuauaaguucccucucccuacuguuggcauuucaucuaaggucccucccuuugaguccugggaaucucucaccucccaggucucuugugcauucuagaggguccccccaacuuucuaucuccuuucaagagaagauauagcaaaagauuaaugcaucaaaugaaacagcauucccugacacucuuaggccaccuguacuuauauagagucuccuugcaagcaaacuauguauuuuuuggcaugugaucacacaagucauucugugaaauaguuuaccuuucaguuugcuucucuuaucaauuucccaaaaaguacucgugaucuuacguuuaaacaucuaaaaagauuuuauucucuacacugcuguguaaauauaagcagacucaaauucuguuccucuauucacccaaguaaguaugcaaaagguaugccaauauugcuaucuucuuuccaccacuggugggagauaaagaaguaauacuuucauuuucucagugauuuuuuuacucacuaacacauuaaaauaagaaaggagcuaacccaggcagcaaccuuuaaugugccauucacacauuugcagcauauuuguuauuuguuccuuggggcucaucuuugcagugagacauaauaaauuaacacaucaguaaaucaaggacaauagaguuuauauguaagagcuggaauaauaaaucagcugguaguuguaaaccucagaccuccugacaccaaccagaacagaacacuggugggucuacaaggcugcuuguaaucauaacuuguagaagacugcguaccuugccuccacgcugcugaaaugcuuacaauauauggguguaggggcuuggaaagaaaacaguauuuauaaggaguccagaauuuccugaacguuugcacgauguuccuuagugaaagaacugcauaccagugaguaggcuagaaaaagaauuagcugaauuuuauuuaaauacuguucuuuauuucaaugaaauauuguuaaguaaaaugaaauaauaaauuuguaacaauuauguuuuagaaaauagagcaaacaaauagagucuaaacaaaguuuuaauaucuugaauaauaaaacuuuuaaacuugaaaauaauuaugaacuuugaccaaaaaaauacacagcagauauauacccaaauucccuuugacacuuaguuuugagaacucagggaaauaauaagagaauauuagaaggaacccuugaaaguuugaagaauuucucucuccaacauaacagagccaaacuucucuguuacuggguccauccuacaaucaucaauuaaguguguguguguguguguguguguguguguguguguguguguguagccuucuucuaauucagacaauauuguagauauugugcauuucauaacaugaaacauaaaacaccuauaguauagagcuuuaauuuuagaagaacaauuauaaauauguaaauguuguugaucaguguguucaaaauugaguaaggguuaaaaaaaaagcuuuagaaauggcaauuagcaaaaggcucaagaaggaaccauaacucugagagcccaagcucuuccuacauaaaauggaagcauggcuaguuaauugcuaagcauguaggggaggaacgaaccuuugguuuuuguuccuuguuguuuuauuuuguuuuguuucuuaagaaaaggucucagucauguagcucugacuguccuggaacucacucuguagaucaggcuggccuugaacucacagaaaucagucugccucugccucccaaguacugggauuauagacaugcaccaccacaccuuuuuaaaagggccuaucuuaggccagauaaucuucuucaguaaguguaaauuguggucuuuguuguccauugaucucagaauguaauaaaaauguccauugauccccaagguuaauuccauuuuacauuugaggaauuuaaccuaagaauaaaacaccaugcugaagguugcaugggaguaaaaggacuaaagcucccuauuccuacaauucuagcucugaacauucaaccuggcuauacuauguaaggagaaggaaaaauugaacugucagagugcuucaaaguagauuacacauguguaagcuauacuagacugaaauauuuauaaacaaggaacuagguaacuuuaucuaacugcccucacuuauuacaggcaaguaagcuauguaauauguguuaagcuaguaaaauagcaaacucuccaccuaaaaaaucuauaauuuuaaucaaaaguugguuucagucauugaaauucuguuauugcugcuuacaaacauuaaagucaaucaaaacaucaguagcuuugcaagaucaauauuuuuaauauguuugcauugcagugcugcaaauuuuuggcuaauagaucguacccauauugauuuccaugggaaguguuagucugauacugauauaauuaaaaaaaaacagggauuauugguuugaaauuuugaagaagauagaaauauaaaaauuggcuauugacuaaauuacuuggggugagugaaccuugugcacuugcaauaaacugguagcaccgaguccuuacugaauacuaccuuagucccuuaaacugaaaaucagucaauaaccuauuauaacaaugcagauuguguuggcaaagugccauacucuggauguaagagccacauuuuaucaaaaaaaaaaaaucuacauaaguacauguaugcaaauuguuuucuacuggaaugcaguggcugauuuugacuuugaaauucaugcugaacauauuuugaguagccuuuuuaaagagauaaacuacuucaaaauaaaagaagcaugcaauuacucuauaagcaauaaugaaaaugcaagcacuguaguauguuaagugacagauccuguuauuuugacucagagcaguauuacaguuguuacucuguucucagcauaugggagugauguaugcaagcaugagaucaaaugcagaugcauccccacaauauagauucaguguucauugcacuguuccugugugucagccuuugguuauuaggagaaccauauuuucaucuuggaaaucuccucuguauuucuauuugguuaccauuauacauuuaugaacucuuuaaaucuuggaggcaaucuaguauauuuggguuuuauaaaagaaccauauagauuuugccuuugauaauaauacuuagauauuagaguuauauauucucuuacacacuuuuauucacuggauuuuuuaaauuuuuagguuauuuacauaauaugggaauguuuguuugcuuuaaugggaccagaagauuaagcuauaagauaaaccuaaguauuaguagccacaacuguuguuuuuauugccaucuccauaaccccugucaauacuuuccuuucauaaccuagcucucuuuaugaagagaaaauugauugugauuccuucugcugcaugauauaguaaugccuacaaaguggaauuggauguccauugcaauuuaguauuacccuuuaaucaacauuuuugucaaauuucuuucauuauauucuaaccuuuccuaccuuuagucauuguaauuagcauuacccuaaauucaguuggaaaaaaaaaucacucuccuuauuguacugcauauauacuugaaucugacuuucuucuacuuucucaauuauuccuauucauaauuccucauuuaaaaauuaugguuuacuuaauauucccccuuuauucaagauggaguauucuuuuguaguucaagguggcuuugaacugaaauccuucuaccucagccuccuaagugguugggauuaaaggcauguaccugcaaaucuuguauccaauaaacauuuauugauuacaaagagagcuaguuauuacagcauuaaugaccauaagguaaaguuuuaccuucaugaaacguacagacgaauggaggcaaaacagauagcauuguauggcaugccauggugggagcggcacaggguaacacagaagugagaacaagaggaguucuagauuacaggaggcaggacuguagaaagaaaacuucugugccucagagcagauuauauguaaaacuaaauaauauaugcuagacauguagucauucuuacagcaacuuggugaaggaauuugaggucaguaaaguuaggcaagcuguccaaaggcagaggugggaaguggcaaaguaaugaacucagucaguauggauccagaccucagcucuucuccauccuuguaaacacucugacaugacaucuauuagaguuccauagcugcagcuuggucuagaccaccugaauaguucaauucuaggagcuuuuaucagcacaucauugaauacggaaagucuuuuugacucaaaauuaaaacuaaccauguuguucagacuauaugaacgucuuacaucaguauucacuaaccaagacugugaucaaagcaacucugugcaauucuuucuuuccccaucuucugauauucuucacaaaugaagaacuauguucuugauagcuaaguauugucuagagaaugaaacagauuucagcugauguucaguguccacaaaagauuuuuuaaaguguguauuuacuggagccucaacucuguccccagucaguauuucaguggagucucugaacuacuggaacacagaauggaaugauuuuaaagggagucaggguggauguuaugcuaggagcaugucuacaacuccagauauugcaaauguagucccuguguuccuggacauuggaaaagagaagaaagcauagaaauuuagacuugaaguuaaacugugcauucaaauguuguguuauuaaauucucugaagauucaguuaaugccaccaucuucuaagaucauuaaaauauuaagauuauccucucaaaggaaaggacuggucuuggagaacaaagucauuugggagccacuauagaaaagaagugacagacagaaaauuuguuaagugauaugacauauuuugauggggaauagguggagggauaaucagagugcaucuccacaccuuguccucuuggauacuagaggaguaucccaucugugucuagugauuaacgaguggugacaauuacauucugggcuuuaccaccaaauaccacuaugauuuuuuguguccacucuuugacuccauguucaguaccaaccgucccuuccuuaggugagaagauugacuaggucuauuucuuguuuacacaaaaugcaaaguuuuguuuuugcaucucccaaaggauaccagaaaauaaaaagaagacuaaguucuuaaaauguggccauguucucuuucugugugugugugugugugugugugugugugugugugugucuuucugucucucucaaaugcucaucauuuugugaugauuuggaaaauguaagaagguaggaguuaagacagaagaaaacuaaggcuguugcauagacuucaaagagaaauuucaguuauccaagccacuuguacacaguauucaugacauauuugugucacucaaaggcucagguuuauguccuucuacaauguuauagucauccuagugcuauguaggaagccagagugaucggaaugauuuuuuaaaagcaauuuuuaucaccucuuaguguguugcugaguuuucugagcucagcugguagagucuugcuuaagaucucucaugacuaagucaucaaaaaagcacuggccgcagacagacauccaguguucuggaucucacucauauggcugccaguugcugcucacuaucaacugaaauuaagcugagaaauucugcuguagugcugugaauuaccucucucugugggauuuccucaguauauucuggauucccauaagggacuaggcacgaauaaauauuuugaagaugccauaaagaaacuacauaagucaugacauagaauccaaagacaucaacagccuuuccaccuuauucuguguucaaaaaguuaugagauaccugcccaagauacagaaaauaagcaagagauaugacuccagcuaaauaaaucauguaaacuacccccucuaaagaucaguaaauguugccaaagacagagcaggaagcauguaaaagccaggagauaaggugaaggacuaugaaauuauguuucccagauucuguacaacuacuauaaucauuaacucacaucaacugaucaacugugguuaucagaacuggacccacuugacaccaacuccaucagcaucaguaaaggaaaggguucauugggucuuacccuuuacuucugaacuauugguuauagauaggagaaucacugauguguuuuauauauauauauauauauauauauauauauauauauauauauauauauauauauauauauauauauauauauauauauaugcuauugagcacuaaacaaaaaugaacagacaugaaccaaaaagaggaaugugaggaugguguggacccagaugguaagaagggaguuaagaguagacauugugaacaaaauacauauguaaaauuguaaaacuaauaagaauaguuuugucaugagauagaagcaaugguucagcaguuaaggaugugucuuauuuaguguuuuauuuagaaacaucgugcaaguaaaggauuaauggaaucuuccuccacuauuaaggagaguugcugaggccauugugcagcaagggagucuggacauggaggccuugaaaagccguugugugaagaugugagagugaagccuggaaguccgccaaagagagcuauagauaggcagcugauagugaaguguguugcaggcagcaaagcugugaaggaagaaacuccaacccucuaacaucaagcauagagcuauaggauaagaaacuuucccuacuggguuuugauccagucucccucacuauacccauuccucccuuuuggaaugguaauguauauauggugacaguggguauuggacguaugguuuuguuuuuuuuuuauuagguauuuucuucauuuacauuuccaaugcuaucccaaaagucccccauacccucccccccacuccacuacccacccacucccacuucuuggcccuggcguucaccuauacugaggcauauaaaguuugcacgaccaaugggccucucuuuccacugauggccaacuaggccaucuucugauacauaugcagcuagagacacgagcugggggggggggcgguacugguuaguucauauuguuguuccaccuauaggguggcagaacccuuuagcuccuuggauacuuucucuagcuccuccauuggaggcccugugauccauccaauagcugacugugagcauccacuucuguguuugcuaggccccugcauagccucacaagagacagcuauaucuguguccuuucagcaaaaucuugcuggcguaugcaguggugucagcguuuguaagcugauuaugggccaucccauaauccccagguauggcagucucuagaugguccauccuuucaucucagcuccaaacuuugucucuguuauuucauagguagcuagcauuaagagaaugccugaaucucagaaaagacuuuggucuuuuaaauaguguugagacugugaaacauauggaaacuuuugaaguuggacuaaauacauuuugcauuauguuauggucacaaaucuguggagugcagggcauagaacaugguaguuugaaugacaguggcugucacagggucauauauuugaauaugacccccaguuaauggaacuguuuggaaaggauugggaaguggagcuuaauugaaggugugucacugaacgugggcuuugaagcuugaaaagacugacaccauccccagugccucucucucucugccucucugucucucucuguaucucuguaucucuuugucucugacucucuaugucucugucucucucucccucuuccucuccuucucucuuucucucuuucucucugucucucucucuuucucucucucugucucccucccucccuccuaaauguggagcaagauguaagcucuccugccagcacgaauucgcuuugccaauauagacucugaaacuauaagcccaaauuaaacucucucuuuuauaaguugucuuggucauggugauauaucucaucaacaggaaagugacuaagacaaguagccaaacccaccaucugcagauucagugagagaccuugcuucaguaaauagagagggacuagauaggaugccuccugucaaccuuuaaguuccaccugcacacaugugccuagguuugaggcccucacuacaaggaagcauacaugucuguuacuguaaacccacuccaaaccccauggcuggggaggucacaguccauaagggaaccucacuguuguaguuuagcuaaauugacaugaccccaaacuguagucuagauauagcuauucaaggcaaccuugaggacuuacuguuccauuccuagcacugccaaaaauaugagggugggauauaacuugauuaacacuuuucaguggugggcauuagcuagcugugauaaagauuagcuaauuguaaaugcaaugaaguaacuuucccugaaaguucugcuguaguuuguaaaauaaauuccaaaaggugaaacuacuagguuacaaugucggcacauacauaguugugaacuaaguagccauacugcuuuguagauguguguauauuuauacaguauaugcuguuguuuuagucuuuacugaccuacaaagaaauccucauuuacauccauauuacuugucaagaagaaagguuaaauauuuuuuauaauuauuuuccuguuauauauuuuuaaauguauuuauuuuauauguuuugguauuuugccuacauuugucugugaaccacauacauuuacagacaguuuuaaguggucaugucguugcugggaauugagccaucuuuccaguuccuucuccaguuauauucauuuuguaaauuagcauaucccugucuucccauuaaaucuuuguuauuuugcuauugauuuuauaagaguucuuuauaagcaguggcugaugaucuauuugauggaccuuuucccuuuuaugauuguacuuugauaucguagcuccgaaagaguuacuaaggauuccguaguaacaauggcugagcagcauugaagcagaucugaugaugguguacuuuuaacagugguagcaggcucuuuauccagaaaguacaaguaccuuaaauagucuaugacaugcccaccuagaaaacacaaggaaauguucgaccauggacuccaaguacuuaagaagugaggacagaagagaacagaaaagaagguuuaaagguuguggaaccaugauaaaacuuucuguaaagguaagagaagggagaugugagucagaugcuuaaggacaagaguuuguuaaacucauaggaucgaucucucucucucucucucucucucucucucucucucucucucucucuguguguguguguguguguguguguguguguguguguguguguguguucuuucuguagaauacagcaguguccaaaacaaaauaucaaaucuggaugaaguagaaugggaaaauuaauuaauuaauugaagauuaaaaaugacagagucccaacuuauagccaagauuccucauuugacugccaaggcuucauccacucccagcccuggccuguggcugcacuucaacagaaaugucuuugaacagcuaggccuuuuuucacacacauucuggcuacugucauucaucccuaaagggcuuauuccuggauacuaaaaaguagaaagacaguuuguuagaacucacuaaaucagaccacuaucuuaaacauacagcuggcaaaauauacaacuuuauagcuuuuuauauauaaaaauagcuaguaauguauacaagacacuaaguucaugucagacacguuacuguacucaauucauuauaguuauuacuaugauauuucuagaagaugacuuuuaugaguuuuuaauuaauguuuaauauuccuuuucaacuuguguauuuauauaugcacauguauaugugguuucaugugcacauauauaugcaaguggaagccaaagguuaacaaugagcaucuucuauaaucacucugugauauccuugagacagcaucucuccuugaaccuggagucuauugauuuggcuaggcuggcugccagugaagcauaggggucagcuuguccuggcauccacuucccccagcauggguacuucaaagcuguauaccuaggcuuacuuuuguuuucuauuuacaaugaggcaguuaacaaacauauaucucuauaguuucuaaguaagccauuuugacuaugguuuccaguaagaaaguauaaucauccucacauuuuagaaucuuaaucuguaaaaacauugcaggaaacauaaauguugcaaauagauuauuaaaauaacaugaaauuuuaauuauuugcccacuuuaaaaaauuauguugguuugguuucaauuuuguuuuaugugauaauuuuaagcauaaaugauccaaaccucucugcuaagacacuacccaaaaucaacaaacaauuuaaacaaaaaacaaaaaacaaguguuacccaaggaacuauuuuuuuagcaauuacuauuuaucugaauccugccuaaaucuacacugauggcagucaaacauauuuguguauucgagugacaguuguucgacacauccuuuauuuaacaugcuuuuauugagaauaugcuaaggaucagaaauaggagauaauggugaccaagaaagauacaaaggaagaugguaauguugaaaucccagcuagugagcucccacugaauacuccagaaugaaagguuaugaguguggacucccucacaguaacugucugagggacagcucccugcugugcgcuguuaagaugaggacacaguuaaaggugaggacaaauuagcacauagugcagccagaauaucagcacugcacaucugacucugacaccagcuugccaaugagaacacugucacagauacucauugucuccagggaacauaugcuguaguaauucacuuacuuuauaagcgcuuguugucuacuguguaucagggagaguccugaauccugaguugcagggauggagauuggccgucagugcugggauggcucaugauuuccauggccuuuacuugggauacuuugaagaaagcaaauauaaacauuuuaaaacaagaauuauacauacagcagcaggaaucauaagaacuguuaacuuguugaccagaauacaugagucaaaaaauguugcaccuucaaaagggacaguguuacuuguaugccugaaguggaauucuuuuuaaucugugguuccaaaucuguaucacaguuuuuaaaaacuuucagccuaaucaaaauuccuuuaagagguguuuggcugauuucagcugcuaaagggagcauuuuaagaaaauuagaacaaaguagaaauccauuaaaccuuugaauuauuugaaauuaagauucuauccaaguuucaagguuaauauuucaaugaaaaauauugucauaaagcacauauuucucuuaguggauaauaucaaguagauaauaaagcauauuuuaacuguauuacuauaucccagaaguaagaugcaaauuauuaaauucuuuguuguuuugucaaauuaaaauauuaauuaaaacaugaccauuuaaaaccuuggucacagaauccaucucccuguuaaaaauaucuuuguuagcauagaaauucuaguuugaacuaaaagcauuuauguauaauguggugaaaccucuaucuaauagaaucucgauauuuuaccaguguuccaguuaaauuaaccuuaaauuauuaaaaauuaaguuaaaaacccauuccugaacagucacaauuugacauuuagaaaaaaaugauuaauauuuuuguaacauacuuuuguagcucauuuguaaugaacauuuugauccuaguuuaggucuuuuucuuucuugcacuuuuuccaguguuauaagucgucuuauuacccccauuugaaugacaccauugcagagaugagaacagguuagcuucugagaugucagaccugugccuggccucggugaguuugugcaaugccacagcugcuguacugucaaagaggccaaugcacaacuuaaaagaaaaauaccaauucuuaaaaguccuuccguaagaccuuuacaccauaugcuucaguccauuagacgucacauauuguguccauucacuaagcccauuccugcucugagcuuuaucagagaaggaauuugggcaagugggagcacucugcgauaggggaaguacuggggaagucucuuguuuggcuaguguucauuuaaggacauuaugaggggaaaauguuagagaaauuuguaagcagcauuuagaguaucuaguaagcuuaaauuuuaguuuacaggauagggaguuugaauuaucucugcaguacguguauaggcugggugguuagagaccagagacuagguagcauuuucuagaaggauuuuuuucauuggauauuuucauuguuuacauuucaaauguuauccccuuucccgcccccgcccagaagccucauacaccaucccccccuccaucugcuucuaugagagugugucccugaccacccaccacucccaccucccucccaccacccucccaccuuccuccccuagcauucuacauuggggcaucaagccuucacaggaccaaaugccauugaugucuaacaaggcugucuucugcuacauaugcagcuggagccaugggucccuccauguguguacucuuugguugguggcuuagucccugggagcucuggggugucugguugguuaauauuguuguucuuccuauggggcugccuucagcuccagaaggauccucuuaaaauaguaaccugacaguuggaaaagggacaaaaaucucuucauuggaggauguuuuucuugauaaaggaaaaaaaugaaauauuauauguuaaauuuccauuugugguuacaaucugcauuuaacaacauaaaagcauauacuauaauuucacaaaacuauuugcauauuaaagucuuuguucacugcauacugauuugcaaaacuauugaguccucugagaguaucaguugaagugauaucuuaccaguuaccuaguugugauaggaaauaaagggaaauggaaaguccuuuuuccucuccagaaagaacuaaggcaucacuuagcucacuugccuuuuauccagauaacccgagacugagucaucuucaguuuuauucuggggguggaugcuguaccugcauggguguuggugcacaauaugugugcaguuccuuugaaggccagaagagggccuugagacuggaguuaacagaugguugugauuuaccgugugcuugguggaguuugcauucugguccuccagggaaaacaaccuguguucuuaaacacugagcuaucucuccagccccauguuaccuuuauuuuugacagcuuucuaguaaauuacuuggugccuccaauauuuguuuacugauuuucucuuccucacuagaccauaaauaccccccaaaauaauauuaaaccauuuacuacaucuacaucugauugguacuagauuauaaaagacuguuuauuaaauugcacauacugagaaaacuagaaggaccacccugugguuacagcaaagcagccacagcauguacugaaagggaauaaaguacacggagugugugggacugcagcuauggaaaugcugaagacuuaaagaccaaauacucggucuacccuaaaccuaacuguaacuagcuuuaugaugcugaaacagcucucagacucugaugagcuaauugagcuaauccaaguuccagcuccaaauauuggagauccccauuuuuuuaguugaucaaaaauugacuaaauguuacuucuuguacauuggaaauauucuaaugaggggccacauuaaauacaagaguuuuaaguauuucuuaugauuuguacuuacauaacuucauaacuuccucccccccccccauaucugacuuauugggcaugaugaaaucuuugaaaacacagcagccugugugcuuauguaauauuugggcuggaaauuuaaaauugucagauaugaagacuccaguugucagaagaucauaaaaggcuuuacuguuaaggacuguuaaaaaucaccuucugugagaucucagcuuugggauuuuucugacauuucaaggcuuaaauuugaaaguguagaaucucuauaaauacagcauuaccacaagcccaaaaaagucaagaaaugcaaaagguuagauucuuacuaacuccucucccacauuaugcucuaaauugaguuauguauguuagaguuaaauauguaaucaggaauacuugaugugaaauauaguuuaaauuaugacauaucaaguuucucucugaauuuuggagaauaaaacuauguauguaaaucauucaauagcacauuuuuugcaugugcccuuaaggcuuuuuuauguuuuccucacauggucccucauuuacaacuuuaucuugcuguggacgaaccauaugggaaauccacuauuuuaaacuuuagcuauuuuugugguguuacugcauaagaaaaugccuugagaguagaaaaucauauacuuacauauuauguaaauaaaaauuaauucucuucugauagcaauuuauugauucaguucaagguacauaaguuuagucccuaaauauuucuggaaagcuuuuacuucuguggccaaguaagauagaaaauaguaaagaagagauaccauaagaccuggccauucuggauguguugaagacuuaaaguauguguaauuuacaugagacauauaaaugaaaggauagacuucacugggauuuuuuuucuugcuuuaaaaauagguuauuucuuuccugcagcagcaacucacaucucauacauaugugcauauuuaguuuucuauuuagcuuucagucccaagaacacuaauuauaauuuuaaauuaucaauaagauauagacuuguacaguagauguugaauuucuuaucucuuguaagauucccugucuaaagaaagcaucuauuuuaugucuuuauuuucauuuuuuaaaauucuuaugaacuuuauagucacuuauauuucacccucuuuaaaguugaaaauguagcuugaauuuguguacuaaaacguauauuacuuuaaaaaaaaaauacuggaaacaauuccuaaacguaccagaacagauggaaauuuagcgcagggcuucaguccauacuggaucaccugagaacguuuccuuguagccuaucucggugauacuuauaaaagggcuuccaccagguuguuaguguuaaaaaaaaaaaagccuucuccacacugcaccuagagcuauucgcaguucauuguuuuuguguuugucaugguuaucuuugaaauacuucugccugguuuggcuucuuuugccuacaacaacaacaaaaaaauugcccaacaguaguuccuaucaugcugaucuuuccaaaaucuguacccuaauuuuaucuguuucuuugauaagggaaggcugauuucuauaguuuugucaucuuagacauuuuauccuuauaaaaauuuuucuguacaagaaaaaauaucaucugggguuuggugccauauuaaagccauccucuaucaacuagucuuccacaaaauaugcuguucuuuuuauacagcaggaugauuuuuuucuuuuuaacaccucuuuauuauaucuuuuguaaaaauuuaauuuuuaaaaaauuuauuucauuuuuaauuuauuuuuuacacuccauauuccaucccccccauucacccuccaacugcuccacaucccacaccuccuccccaccccaccugaucuccucguggaugcccccaacccccaccccaccugaccuuuaaacucccuggggccuccagucuuuuguggcaucauuucugaacacagaccugggaguccucaaguaugugauaugggggccucauaucagcugguguaugcuguuuggugguccaguguuugagagaucucggggguccagauuaaauaagacugcuugcccuccuacaggggagggaaaucacccuucuccucaacuucuuucaaccacggggcuuugcugcuucuguccauugguuggguacaaauaucugacucugacucucagcugcuuguugagucuuuuggagggcagucaugauagaucccuguuggugagcucuucucagugucaggccuuggggccuccccuugagcuggauuccacuuuggaccuugucucuggaccuucuuuuccucaggcuccucucuguuuccaucccuguaauucauucacacaggaacaauuaugggucagaaaugaggcucugagauggcccuucucucccucacuugaugcccugucuuccugcuggaggugagcucuauaaguccccucucccuacucucaggcauuucaucuaaggucccucccuuugaguccugggaaucucucaccucccagaucucuggugcauucugugggguccccccaaucuccuauuuccugggguugccuguuuccauucuuucugcuggcccucagggcuucaguccuucucccucacccaauaccagauuagcuuucccuccccugcccacuuucccucccaaaucccucucucccuccccacuuguaauuucuaagacugguucucuugguccuagaugugcugcucuguccagacacaucuggauguuuuaagcauuuagacugagugccacaauaguuuucacuccucccacuguggcuucauuaauauugccugauacccagaggcauagaccuucuugcagggaugaugcagaugagagaugaagaccuagaacucagagacccaucauggguaccaggacccaguuuggucucuggcuaaauuccauuuuggacagcucuuuguuuuccuuugauauguaagguuucauugcuuaucucuaaacauaaggcucaauuggugggagcuugagcagggucaaccauuuacccuuuccuaaauuaaaaaccaaauauaguuaacuguuuauuuccagagagauacagaaaugauuuuuuuugccugacuaguuuugccagauuacuaucugacuuaucuuaugaucuuacuauagccccuggcauaaaguuuggaguuuuaucuuaguuggggauucaguguagcuuccaugcucguggcagcagaauguggcacuaugcccauucacaucucugagugacuauaaucagauuaugccuucucagcauuucuuacaucagcugccuacagugcucagagaggcuuaaaaucagcccuuaauagaagacaaaacaggaccuauaaggggguucauauaugucuauugauauguaagucaaaaaaucuaaauacugaauaucucuaucugcaaauaguuuuaacauaaacuuuugugcaucggugaguuuuucaacuucaaaauuauuuucucagcuaucagguuuuagcuuucggcucuuaggaauuucccuaauaucuucauaaugauagaaaaauuuuauuguucuauaaugaugauuucagaucaucagaauuaguaaagcacacuucucgccauccgugcuagguauucaugagaugugggauuacugcuccugcugacauuacaaaaggaaagcacgguguccagcaacacugugguaugacauggaaaacugagaacucuuccuguauguuucuuucauccaacacauaugguggucuagccacuauaauaugugggugcucagugagacacugauaacaagggugagauugcuaaacuuccuguucugggagccaagauuauagccuuugaaaauuaguccuuaucuauagaaacuuugaugagaaguuuuguuuuguuuuguuuuaaucuuuuuuuuacagucuaaaauuuaucccccucuugguacacccuccaacuguuccauaucgcacaccuuuucuccccacccuccaaccccugucuccaagaggauguacccacacccaccccaucagacuucccuacucccuggggcccuaagacucucgaggguuagguacaucuuuucugacugaguccagacccagcaguccucugcuauauauauguugggggccuuauaucagcuaguauaugcugucucguugguggcccagugucugagagaucccgacauuccaaguuaguugagacugguaaucuuccuauaguggcaccuuccuccucagcuuccccaaaugugagcugggaacuagagucugaaaagguuuuaccuuuacaucacccccuugguucuggggaaucuucccuguggucugccugcucacuuaagugggcaaaauaugcaauccagagcuccuuguucaaaaaugaaggcaucaugaccuuagauuaagauuuucugcaacgcagacaaagcacuguuaaaagaguuuugguuuuuaucauucauacaugcagugggcacaagaagaaagcuuggaaaaugaagcauaaacaauguggugccaguuugauuuaaaauccuaauacauguuuauaaacaaagcuuauaaaacuuaguaguauacuaauuaaauaaagauuuuuaugaauacaugaaaagcuggaauuuuaaaugccugcagggaacaggugcuguaaugacgucacugugagucacauagcuuucccccauugaguuuguguuuggucauaauggaaagaaauugauuccaaauguguuuuugugacccccccccuuucuccauucauguuagugccuaaccuuaaaugauguuucuacaaucgugguuguauuuacaguaauuauaugcauaauguagcauauuauuguccagacuuccuguuuaaucaguacagcgcuucuuacaagugcagcugaaaagggcaaacaaaauuaaagcuuuauacaccaaaacaaguuugauuugcuaagcucccagcauuccaaaguacacaaauuuguuccacuaaguuuuccuauggcuugcagaugggcaaugauuaaucagagagcuaacugugaaguaguuugcaauuaaacuggaaagcucugaagcaugcuaauugaaucagaaaauuagagacacugaacaguaauuggcuauuucucaugcagcaggugccaggccacucaucuguggaacaagguauuuaaggcacauuagcacuaguaaaaauacuucuugauauggaacaguuagauuuucugcucauuuucaccauggaugucaaaacauacagcugugcuaucugguacuugcaguuccuguuugaagagucggaguuagguaaacauauggaggagaagcggugggcaaccuuuaagcacacaggaaacauuuucaaagcaaaaccaaaaauaaggggcugggauuuuguuuuucaacucaaucacuuuugcuuucuuaaagugcauuuuuagaaguugagcuuucugcuuaguguaguuuaaagcagcauccauauauaucuaguacugcugugagcuucguagaugcauaagccaauucauaucaugucucagcgugaguuuauaucuucuaauuaguaccaccauuuuauagagugaucacaugcuaugaaaguuuguuugccaugccaacggggaccaggaugaguaguuuuccuuuagugcaacaauccugccauagaaucaugaacaacuguaaccuagccaguggguaaucaagcaagaauaggauuuaauaaguucaauuguugagguuuaaaaaaaugauuugcaucuuaucaaagcugaggcauaugacuucugccucugaauacuuuccuugggacucaauauuguuauuagaaagugaaaaguacaaaugaaaauaaaagcaugcuaaauuauacuguguugggaagcagaauauuguaauauucacaugcuaaucauauuacuuagcagaugacuguagaaaauaguaaguuugaaccaagaggcauaaauuaugaauuauaaauuguaaacagugcauaagggauguguuauaacagugcucauuuaaauuaaggcagggaguuuucucugcacaaagaauguuccuucauuaaguuuuaaaguuuccuuuauaugguuuuauuaagaacauucugcagcacuaagcuaaaagugguuuuaaguugagcaggcaguuuuuuuucuuaaggacaacacauuacaaacauaauacugcaggucuccaaagcuaugcauuucugagcaaaaacuguucuuugcuacaccuccuuccccacucccaaacaccgcguacauucugcuuuccuuaguuuuaaaggaguccugaagcauuuacaugaucaaugucuuuugcuugagggauaaaguuugcucuuccauggacaagugagaacguauugaucauucuauucuauuugcuauuucuaaauucaauauaccucucgagucgauaagcaagaucgagacuauauucuuuuugugugugugccugguuguagcuuguucucaagauccaagauacauuuuugauuaaucacaaaugcuuagaggucauggagagcaaauguguuuguggagugucagcugaugcugucagauaaaugucuuaagcuuugccaggguucaugccccagcuuuaggcuguaccaaaugucuccccuuguugaagaagauaacagcuacacuggaggcaacugaacuguugguuagcuucaaggguugaccuugccauauggggcugcaaucaggugaaagaaagaguguggauguuuuaauugaaacuuuauaaauuuaaacuucauuugagucagauggucuugguauuuacugacauucuaggccugugacuacucugauuauaauggugucacuuguuucuaauuagacuccuuaagauaaauaauuucucuaauauuguucuugguguauucugagagcauuuuggcaccaucaguguguuauuaaaaaaaaaaaaaaaaaaaaaaccucacagccaugaaaaguuuuugguuuuugguuuuacaauaaaaguaauacacaucuccuuggaaauaugugacagaaauuauucuugcuuugcagugauuuuaguuccacuaaauaaaaauaugguuuugggcaaagagaagucacuugugauaaugaccccaaccaugucccgucuuaucuucagaggccucacuucaucacagucaccccacuuacagucauuugucuucuuuuccuagacagagucuauaaauaggaaauaaugacaaagcuaaacuaacaccuggagaaugcucuaggcugaggcuuuguggguucuugugaaggaaauugcauuggucacaugugcaugcauaaagggacccaagauaggccauugguggauuugaaaguccuugucuccaucuuaucccaguugcuucuuuucuucggggaagcuggucugcuuuucuuuucucucaagaaguucacucugccauggguaaaaaucaucagugcuaaugagacacaauaauacuguuuaaaaaaagaaaaagaaauaacacaucugucaugaacucccaccagaucucuuggcaaugagacauuuuaaauauuuuaugcugaacacaagauauauugaggaaauaguuuucuauucuguaucccaaaacaaagccaucagcgucagugaggagcacgacuaaaacauuucacuuuaaauuacuucacuuaaaauugccucagacuuagcauauguauucuauuggagauauauguuuucccaauuauaaacuaggacaacauuaaaaacuuauaaaaaaauaggagauauucuauuaagugugaaagcuuuuaugauacuauaccacaauaguauuguauuuuacuucauuggcuagagacaaccuguguuuugaguauguuaguauuaaugaacaaaaugguuugguuuguuuguauauauaaaaaacugaacacuggugguaauuacggagaaugcuguccuuaccaccagugaaggaaagagauucugagguuaagucaacacaauuugagcagccuguuccugcucggugucgacuuccucagcacccuccaguccuucccagucacauaaggaagugugcucucucuucauauuagcuucugcuuuuaaucuuuuccaggauauuugggggcauaggggaggaaacuccuauucucuaggcaaagucuuugugcacauguccuucagugacuggcuaacauucuaaagauuuagaaaacaaagaaaagaauaagucuaugcauuaccaugguuucuuuccuagguuuugaacauuuugcacaguauaagaggguggguuuuuuuuuucaguuugaggugucacuuuuuuaaaucauagaaacaaguaauaaauguccaaacuguuuccuauaagucaaguucuccagcauuuaaaaugauaaagucuggcaauggucucagcaucuggcugagacauuaaauccugcuucccugcuuuuacuaaucagaugcuaaggaugguuucaguuacagaacaaagucucucuuaaggucguuaaccuucuguucuuaucugccauuuagaacaaacugcaccaagaacacuuaacauccaaaaugacuuuuuacauuugaauuuuaucugcauucuuuucuucauacaucaaaucuaugcuacuaaacugggugugugauucacucaaucccaguacucaggaggcacaagaaaguggauaucuguaaaguuuuaggucaggcuggucuacauaguaaguugcaagccagccacaacugcaucgucagaucugucuagcauccccccccccaaacccacacauauagaacagaaaugcagcuugaucuucaugugggucucccaacaaguggaacaggggcagucucugacuacguugccugccuauggaucccccgggccaccuugucugcccucagugagagaggaugcaccuauaaaucugcagagauuugaugugccaggguugggggauacccaggaggagcuuccagcuucucagaggagaagggggagaggaggagggacaugaguagggagccaagaggauaagggggaggggcugcaauugggauauaaagugagugaaugaauuaaugaauagaugagauaugaaacauaaacauaugaugcuggaguuucucuuuuguuuacuuauauucuacacccuuuacucaauuauacaaccaauaucaauccuuauuuaauaauagugcagcagggugacuauccaacuucucuuuuaaacuaacuugguuucuuuaaggaucuggaaaaaugugaaauuaguaguguccugucagauacaauuauguaaaauaccuuguuucaaagguuuauauugcuucccauagugcaggagaaaacaguuuccauuuucuaguguauaaucagugauagcauuuuguguauugcaaugacaguccugagacagugacuuauuccuaggaggagccaacacucuaguguaaggaaauugcuuccuucuuacacaauacuuuuacagaaauuuaaaaaaaaaaacacaaauuggagaauuauuuuaaauaguauacauauaaaugaaauuaauuuugaacucuucagcauuuauacaguguaccaaucuccaguacauuuuaccuaaauagaagauggacuucagaaagccugucucuucauagauauaauuuuuccauauuuaaacagaaggagguaacagcaccaugagcaaggagaggcugcaguccaugcagaggccugcacaccgcagucuuauccuaaggcaguuuuacagaaggaagcugucauguacuagagaguggaguaguaacagugcaaauguaagcagcugggugccguccaaaggcaagaaauccaggcaugagauagcagcacuaggagugaagauagagcugaaggggucugcaaccccauaggaagaacaacaauaucaaccaaucagaugcgcccccccccaggagcucccagggacuaaaccaccaaccaaagaguacacauggagggacccauggcuccagccgcauauguagcagaggauaaccuuguuggauaucagugggaggagagacccuugguccugugaaggcucaaugcccaguguagggaaaugucaggauggugaggugggagugggugggugguauaaggggaaggagaaggggauagcaggaaggagaagaggaagccaggaaagggaauaacauuugaaauguaaguaaauaaaauauccaauuuuaaaaaaaaaaaagugaagauggaaggagguaaccaaaacacagucucuuagauaagggaagccaucggaugagaagaacaaggaguggacccaaggggcuuggauucagcuucaggaugaugucacuuacugagauaaagaugucugagagaaaaccugcugugggagggaaaucacaacaaaauuuuuggcacuuagaaaugcuccuuaaacuuuuaugaaaaucaauccuaagcacauguacuuacuagcaacaguguguguguguguguguguguguguguguguaaauaaaguugugauuuuaagagaguggggggcacacaggaggagcugggaggaagagggauagugggaaugauguaaauaauuaaaguacugcauauaugaaauucucaaaaaauuaauaaaaugaaaauagucuacagauuuuuuaaaaauguggugaagaaagaaaaaauaacaguuuucucauuauuugcaugugaaacuugucauaugaccuagaaguuacuugacuagaauguacaucucugacaccaugagugaucauugacuaacaggagcuguaugcacaaucaaaucuccacacaccuuaccaaugcaagcuccacugaagaaugcagaucagccauuacuggccacgccaauguaggaaguuuggcaguagcacccauauggcaaugaccauaaauggaaagucucuugauagacucuuagaucuuaguaacacauuaagaacuuguaacuugaucuggagagaugcucagcaagguaagaugccugcugcucuuacauggaucacagguucaguuccuagcauccacaccauggcuuauaaccaucuguaacuccaguuccaaggacaugugcuacacauucauuccuuggguaaagcacucauagaucaacuuaauaugcuuuaaaaaacaaaaggaauucauaacuuaauaccaucuuauaaauugaggagcucuguuuaagaugcuuuuuuaaaugauuaacuaucuaacccuuuaggguuuucucuaguucacccacuucaaaugugauuuuccuuuaaaaagcacccauuauacuuuauccaucagguaugaacacccguuccuacauauuaauuuuauccaccuccugccauggcaaugguaugccaauuugcuguuauguuacaauugccugaaaauaauacccuugcuuauuuugucccuucuaucauaggugaagugugugugugugugugugugugugugugugugugugugugacagagacagagagacuaugugacagagaguugugugugagaaaguguaugugugugagaguguguguguguaugugugugugagagagagagacagaguaugugugugagagaguguaugugugugugagagagaauguguaugugagaaagaguguguauguguaucugagagucuguauguguguaagaaaguuauaugugagagaguguguguaugugugugaguguguguguguuuguauuuuauucuuuuguucacaagucacaggaacaaagucugaguugucuguuuuaacauccuguuuucauuuucauuuucuauguggugagaaacauagcuauaccaagaaaaaccauugggaauggauauguuuggcauuuuauguccaaaaugaauguuggaauggcauguaaaguuuaggaccuucaacuuaacuuggguguuccagacugauuaugaaaaacaucuaaggaucucagacuucuaaguaauuauagacuuauguuuaugcacaucaguaauaggccaguucacuuuccccccauucaauguucaugcaauguccgccuuuccugugaacucuggugaugcucuccauugucucuuuucucgcguggucugagagaacugacucuaaucccagagaaaggagcccuuccuacaagcugcucgccucaaagugugcuguaagagaagaucaaacacagaaaaauggcauuggguguagcucuaguuguauacucuucccguuucccucgccauaacugaaaagaaaagcuaugaaauagaaucuaaaaauuauuagccagaauggacacauucacauuuucuucucugucuugacugucugguauucugugauuucugugauuucucgugucucuguguugcuuuucaaaagccucugucacccaggcacuauccugcuuaucuugauuuucuuacacauaugggcuauauuuuaauuaauuauaaaauaaaugauuaaaauauaaacccaacccauauugcugauccuuacauccuugcaucuuuaaaguaacccuuacuaguaaacuaguauuaaaucaacacauuguuuuuugauuugguaguaguuggaggggcacacauggaggcccacagacaacccuuaggaauagguucuccacuauagguucaaaccaccauagguucaaagcgccaaccucaagucaccagucuuaugaggucagagcucuuacucucugagcaguuucacugaccacaccacagcguuuuuauauugccuuuuaaaaugguguuuccuuaacaauggaaaaagaaucauaagcacaagaagacauuuagagagugguacugguugucacagcugauaaaccugaugacaucauagguccuuacugcucugcugccauucagggacaugcaggcuaucuucuccaaccgugauaagaguuguauaccaaaaagguauacaacuaggacaucauuuuacuuacacacuugcuaaagacuguaguaaauauucugagcuaaauuguggcuugaccuuuuaaaaugcauuuuuaagaacaguggugcuacggccaucuagcaaagauagucugugcuuagcaagaucugggguaaugcuaucuaugguuguggguaagcaaaaugguggguaggguuccugugacuaagaucuuauagcugaaggaaaacacuuuuuguuguuuguuugucuugguuugggggucuuugucuuuuuguuuuuuucaagacaggguuucucuguguaguaacgcucacuguucuggacuuguucuguagaccaggcugaccuaaaacucacaaagaucuuccugccucugccucccaagugcaaauuagaaaacgcuaauuuuaaccuugaaaacgguugggaacaaaauaaggggaggcccagggaaggcccuggggaagaaggggaagggaaaaggggccaaaugucggggcagaguuccugugcucugggcaggcagacgcagguguugggguggcugcuaugacgcuuuccacucggcccugggugggcaugcaagccuucaacccaugauguggggggguggacaaggggcagcccucaacuggggacccugaggugacacccugucaucccgggguuauaggagagagggaugaggaaagagguucccaacacugaccagagugcacaguggaucuugauggagcagagacucucuaugguuuaagagcuuuauuauagaaaugcagggggaaagagagaagguaggagagagagagggagggauagauagauagagaaagcuagagagaaagcuagagagaaagaaacuaagggagagaggagaagacaaagagagaggagagagaagagaggagagaagacaaagagaggagagagaaggugagagugagggguaagaaguaagagcauaagagagcaagguggggcugaacacgccuuuuuauggucuucacaguugcuagguuacuggggaagaguuuagccugaaggucagaagcuugggccauugucuaugugacuacugaccaugcuucuguuguaggggcugugggaugugauaacuuaggcaggugcuagaguuccaggagcaugaagagaagagaccugagauggaagagguuucagcuuaaaaauguuggggagcagggugaggggaggguauaggggaauuuugggauagcauuugaaauguaaaugaagaaaauaucuaauaaaaaugaaaaaagaagauauauuuuaaaagcaagagagagaugagagaagcaguugaaaggauuaaaaagaaagccccucaugugaaaaagacacaaaaauaauuaagcacaucaaaaccuguuuacugccagaaugcugauuaugcaacuuguuacaagaacugcuaagacuuaaauccuauaacucuucguaguccugccauuucuucagucugaauugugaucuggaauuuacaaauuccauucuggacuccaagugaauaaaaauuugcaauuuccuuuuaugaaccacaaauuauacauuucuuauauuuacaacucaugaauaaaauuuauuuuuaagacugugggcuguuguugagugcuggaguccauguacagacuuagugcuuaccaaccaccuuauguauccaaugcuacaccaacaguaggaccuaaggcagaauucuuguaacaguagguucugaagaaaugugaaggcagucagagagcuuggugaguaagcagacaaacauguccugagguagagcugugguccacaugugacuuugaagcaauaauuaaaggacaaauguuaauuuuacugacuuggguaccugugacugacuaggaggcuacaguggaaugguguauuaauauuaauuugguaauggaucucuguuucuuugugaaaugagccaggacaaguguuguucauuuucuguuucugcaaaacaauuauggcaauauauguuuuccuauuuuugauaaauauuuaaauguugaaccaaggagcucugauuuugagaaaauguaacugguguauuuuuccaagugugaaagcuuuaccugguuucuuuauuuuuaaauccucaggacggauucuuaucaucaaagugggcaaugucugccauacaccauuuuuguguaguaacuguauucugaauacauucuggaugaaagagcauccauaagccugcauguaugagaaacaaggcuggaagacuuuaaggaucccaccuagguaucuuguguaaucuucuaucaggguuguaucuccauuucaauuuguaugacacucccuguuuugaguaggauaaagacucauuguugcugucaggccuauuuucacacuaaauauucaucuaguccuuuguggcugccauuuuuaucaggcauucgccacagcuucccuaugcugaccugccauuucucaggaaaucacuguuucacguguaugauuucuagugagacaagcuuggggcuggcugccuuucucccaagcucagagaaaaggaauaucucuggugccugugcuguagggaagcugauucauguguaaauuaucauuuggccuuuauugcacggccuauggagaguacacacacagauaaaaggcugcauaggucacagcucagugcgugcagguuucucagguggccacugugacagcgcuaggauuuugucaccacagauuaucagacaugcuaugaagguuuaucauuauuuauuugcaguuuucuguguacaauaaacucuaacaugagaaaugcuucuguguuaaucaagcacuguguaccugcucccuguauucucgaaguuaaagcuaugcuaucugggcuuucuggauaccugugccaacuguccaugaucuaucuccagucugucuucuccuacuuggacuucauauuuuuuauucuuccuuucuucuuauacuuuauuucuucagauuugauuguuguccacauguguuuucaaauuugguccuaucuucgugacauauuuguuaaccaagauagauacaaaugcuauuuggagaugggaaacaacuccugggauccauguggagauuagguauugugugugccgugagguguguucucacucaacuuguuuucugugaucaucacuccaugcagacucauucuuuccuucaccacugaaaagcauaaauaauggccuccauguucuaauauauuacaguagugcuaguuauuauggcuacaucuaauuaauuucauauguaugugcaugucauuccaaaacauauugauaacacuguaagugauucuuucugacuccuuccauaaggcucuauaguaucuguacuuaaggggaggcuaauaugccuucuuguacaacuuuauuuguuuauagaaaucuugcuaguauauuuguuaucauaguuugaucuauguuauuuuuaaaguauaucaaaaaccaagggaauauauuuuauaguuuuuguuaguuuuuauuagaacaucuuugauacaacucuguuuugauaagcuuuacgcauauauuagcgagauuaaauggguuuuuuaguuuuagauuuauuaauuuuauuuucuauauaugauuguuuugcuuguaucuuuguguguauaccguauccauuccuguuacucacgaaggccaguggaggggguuagaucccucggaacuggcauugcacauggcucugagccaccaugaguccccucgaaagagcagcaugugcuccuggccgucucuccagccccuuccaugagcuuguugucacuguuuuacuuuuguguuuccuagucaccuucccuggcugcccuggaacucacucuguagaccagacuggccucauucagaacucuucuugccucugccuuccaaaugauugaaaggugcacaaccacagccuggcaaaugaguuuuaaacaaaugaaguuaguaugauaaaauaauaccuucacuuacaccccagaaaaacaaaacagcacucuuuuaacuauuaaaguaaaaaugucuaaaaacaaauaucuucaguugagccaagagauuaauuucucauuguaauuuuugauauacugcuggaaaaaauacacccuucauuuagcaaauacuuguaauuacuaugaaaauuaccuuuggcaugugaaaugguguucccacuugucucucucccuucccacuccugauguccagcagugcaauggaaggggagcagagcuacucuguuuuuaugagcacauuucagaaguagcccugugcagucuauaacacauaugaaaaauaaauauguuccuuuaacuuagccuucuuaaggauuguuguaggaacaguauaaaacaguguggucaacauaagagaugagagcuaccaugcuguaaagauagcucugucacuugagagucuggcacacaugcauggugaccuaaauuugauccccuauauccuuauaaaaagcuaagcauggugguguaggcauguaaucuuggcuuggguaggucauaguggcauuuguuuguaauuccagcacuagggaggugaaggcaaguagaauccuguucucuagccagcuagccuagacuuaucagcaaaccucaggucccaauucucaaaaucaaugguagacagcugcugugggacaacaccugaggcugaccucugaccuccacugucagggacauagacacagauacucacacucacauguucacucgugcacaugcacgcacgcaaacacacacacacauacacugaggagaggaagaggggaguaaaguuaucaaggaacagaugugccacugucuauauagugaucagcacuaaagaacuggagggagaaagcccaauggugaaaaaagggggucacuaucucagggcugcuuacacaugcagagucgugugaaggguuacuuugcuccaguuacugcucucauugucgguucuguuuauuggcuuacucuguuauuugguauaauugguaucuuacuaaagacauuuaguuagguguguagguguauuugaauauauuucgucuguaugugucugguauauaauguacaaauauaacauuugaguguaaguaucaacauuuguggcaauuuuccuaagaacguaucccaugcaucuguguugagauaagagugcuauaauuaugacaauuaaagacauuuaaaaggagugagcagauuuguuucucuuuguagucauuuauuuacccugguagcugaacucaauacagucacuccuuuuuaguuuacuuuuauccaauaugggaugaccuguuuuaauugagccuuuuucccuaaaaaaagaaucgaaacuugcacagcuagcuagcucaacucuuaguucuuauagugaacaugaaauuuaucuccuaaagaaauucuuacaaaaauugcugaaaacuggauccugcauggaauuuauaauugaaggcauuuagacuuucuaauacuggucuaaugugaaaugugccuguuuucaagaauguaguuauuuccuugugauuggaaagucauagaaaauuaguauuguucuacaaaaaaaaaaaaaaaguuaaaaggucuucuuguucacugaauacauggcaucuuucuugaaaaaggucucuguuucucccucacucacucuggcuggcaccuguucugccuucauucucuuucugguagcaacuuuuggcaaaugcauggccucuagcuucccucaggauaguucagcuucaaugccacaagaauuucuuaguuucuucuacucaaacucuugaaaaugauuuauuuuauaagaucguaagugacaggccaauggacuugccguaucagcucaaucccuucccagauuuaaucagucaugagugaggaugaccccuuauuguccugaaguaugucuggcagcaauguagccucccaagaaggagcagauggugagaacgcauugugauugacacucucucaacaugcuaugccugguucagggcucccaacuacuaacaagaccauuauuuaaauguuauuuccucaaagaaaucccaaacucuacucugugugugcuaccaacauauguuccauuauacucuagggcuccaucauaaacaucuaugucucugucuugcgaucaagcccuuccccuguauuauuauagcuucucuguuuucucauaaucucuuaagccuguggcaacaggagcagcauuugccccacucauccuucuguacccucugaccuaaugccggguuuauuagcaguguccuaucauguauuaagucauugcuuauaaucauuguuuugauuuuuauuaaacuaugacuuuugcuguuagugauauuauaaggaugugucacacagaccuucugacuagccccucucuccaacuugucauguguucugugccuucuuccucucccuuugguuuguaaugucuucuuuauucucagggccaucauccuacucucacugguuucaccuuuccuuaucuggucucccugacugcugcuauauccuacaagacucucuagaaauuggcucuucauagcuuucucuguauauuaaaaaaaaaaaaaacaaacaaacaaacuuguuuucccucuucugccuaaagaagaauuguaauccaaauuuggucucuuuuauaucuuauuccugccagccuaauagguucuacuaauaaauguacaggagcacagcuaaguacaggguuuaaaauaaagaugucugacagcaggacaugaccucguuccugucuaccaauuaaacauaagacccuuguguucuauuccuucaguucauacauauuuauugagcaucuccuaucuucaggacccaaugaaauauauguggaauuacaagcagguaaaaaggaacuugugguggcuuagaaagaagaguaagaagauuuuagcauuaaggaaacaagaaguuaggugaggcgggggucgggggagaugcuagagaaaagagugaaaacuccaugcuuagaauaugggucuuucaggaccauuauaacuugcaaaccccauuguguuuuguacauggagagagcucaagaacucaauacacauuuauuggcaaguaugaacaggguagugaugaugauaaagccuucagaauacaaguuccagcuucuccuuagagcuguuaacuuuguuauuuagcaucuuaguuuuuuuuuucauuuucuaaugaaugaaugccagcaagucuuuuuaaauuuuuuucccaucugaucaagacuuagauaauuucugcuucuuugguagcuaacaucccacaaacucagcuucaugcuucagugugaagauauuaugguacugccaauggaaaccacuucacauuugggcaacaucaucaugucuaaauggcucagauucaaguuucaggauagauacagguuccuacacauuugcugucaaaaaaccacuuuguaggagccaaacaguggaauucuuccaagugguaggcacuauuagaagcaccauuaaaauacugcagaauuugaaagaugauaguuguuuuuuuuuuuuuuaacauagcaugaucugugguauuucuaugaaauguuaaucaguucuuguuucuguuguggagcugaagguaauagaaaguuccaacuuugacuuaucuuaaagccugucauuuguaaagacuaugacgggauuuaaagauaacucaaaguaggaacuuguauaaaaauuuuguguugcuuuauacaaaagugaguguguagaacaauucaaguguuaaaaugcaacuauaaaugcaacuuuaagaagacauuguggucaaugugaacuaaccaguacccccagagcucccugggacuaaaccaccaaacgaagaaaacacauggugggacucauggcuccaacugcauauguagcagaggauggccuagucggucaucaaugagaggagaggcccuagguccugugaagauucuaugccccaguauaggggaaugaaugccagagccaggaaugggauuggguggguuggggagcagggggagaggagaggggguagaggauuuuuggaggggaaacuaggaaaggggauaacauuuaaaauguaaaaaaaaaaauuuaauuaaaaauaaaauuaaaaauaaaauuaaaaaagaaagaaaggaaggaaggaaggaaggaagaaagaaagaaagaaagaaagaaagaaagaaagaaagaaagaaagaaagaaagaaagaaagaaagaaagaaagaaagaaagaaaaagacauugugggacuggagauaugagcaguuaagagcauggauugcuucaauucucagcaaccacaugguggcucacaaccaucuguauugggaucugaugcccuuuucugaugugucugaaggcaguggcagucucauauaaauaaaauaaaucuuuuuuuaaaaagacauuguaguagggugacuguaccuagaaucgucucucuauggccuuuccuuucuauuaaaguagaaacuaguucaagauaaaaguaauuggccaucagcauauaagaaaacaaucauauuauaucauaaaauuuaucuaugaguuuucuuacagucaagaccaaacaaagaauggaaaugauggcuggcaagcuugaccuugcuuagaaagcaaaagcaugcaagcucauauggaaagcuauacuguguauacuaaauaccaaaaaagucaccacauacaugcuguuuucucauaaauaaguuguuauuuauuaaauucuuagacugaugucucacuccuccuaagacuacaaaugccuugaagucagugaucucaucuuuuuuguuaaccucuuagccucagcugucuaaaguaaauguuucuagaaggaaaaaggaaagcaaaauuacauagauuacucacuauccaagaaauagaaacuaacacagugggagaugucuuucaccaaagcacuacaaaauagucagccucccuuacauuguugguguuuuauaucaaugauuaauaaaagcauacaguauaauauuggauuaugucuaaauuuuaggauuaagagacaaacuacauugauucuuaucauaagucacuguauaauggaagaaccuaaacaauauguaauguauguaccuuaaucucaacucuucaaugucuguuaguuuuucugguaggaaaugaaugcauaagaauaaggccuccaaugagagccugaaguaagcaucucuugagcuuuaaguaacaaagauccuagaaaaacugagagaacaguugcuguugcauuagaaauaauagaagcccaacuuaaaauccugagaaaggccauuuacucuucacagagagaaaacuuugcaaaaguccuguccaguguaaagaauagccacuuaccucacuaaaauauaugaaaauaagaaguauuaccuuaaaaacagugcccaugaaagcaaauuuaguugcugauguuuuuaauaagaauuuggacaaaaaaaaaaaaaaaaaaaaaacuugcaugucaaggaaaaaucaauugcgacauaucuuccauaaagucaaguguucuaauggaacuuucugcucaucucccuucucccuugcuaaugucugcccaaugggcuaacagguuguucucgucaaguggacuguaucucgguuuucucaguucuugugcugccucucacagaguggacaccuauaaaacaucaagcaaacugcagacugacuauuggcugugcucacagagaggcugcacacucagggcuccugauauucuauuccucuuaucugagaucugcagauaguaaaguguuaacuuaucccuguauacaauucuccaugcucucucaggcauaugggaagcacacucuuuacagaggcucaucuuccauagcuacaguucacauguacugaaaaacaauguaugugaggcaccuaaccccuggugagcagcaaggacagcauggaaaauuaaaaagauguagguggcccuggaaaagcuuuauccaucaagcauacaucuugugggguguuacuaacaccuugggggcucaggaagcagguucuuaccaugugagagaccgugcaggcauaaagcugcauccuuaccacacgagagaccaugcgggcggaaagcugcauccugcccaagccucaaaacucugccugguuuuguugugaguaauguccaucugucauuugguuggaccaaaaggaagaugugagguguucucuguuuguuucuuuuuuaaaugcauuaaguguggugagauauuaaagaucaaaauaauauagcaauacccuauuucuuccuuuuaugacuuuuaaauaaaaaaauaaaaguagauaaaucugaauagcauaugaauccauaaaauuauuucucgguaauagaaauaguucuuuuuacugagaacccuauuaaaacagaaaguagcauuaaauccaguuuuaaccaaauguauucuuuaagcuuuguuaucuguauauccaaaggcuucucacagucauauuuguaugaugagguuguugaagauaagagacuucuaaguggguuagaggcagacaugccuuagcucaucauuuuuacuauuuggaaccugacaccugcauuuuuaaagcauauauuuaugcuuagaaaauaaaacauuugcaguacuuagaacauuuauguuucuaguuuucagugagguccaauugagcuuccacuacuucauauucacauucauauucagucaacaaaugcauguuacaugcugacuuugcaaauucucacgggaagaagacacaacaggagccauggcagagccucugccuuaaaggaguagacauuuuagaaagaagaaaugaacaauaagcaugaggcaaaaugaaaucuauuacaaaaacuccccaacaaauaauugauaucacauauuaggaaguguguugacaaacacuuagaaaggcaacgagaucaugaauaacuaggacuggaaagcuuaggaaguggagacgugguucuccuuuggcuaaggauauguauguggacucucugcacuucucuguccauguuaaggcugugugcuuucacucaugcuguaucacugccuaagauauuuuaucuaggagacgaaaaagaaacacacuaagccacuuaaauuucuugucccuucccuuguaaauuaccgaccuucuuucaaagaugaaauuucucaccuauucgccaauaccacuuauaggcuaaguguuccuuuagccauugggagugaaucagaugcugugcagaagaacaucacaaauguccacauuaugugaaauuuaaggcuacaaagucaaagaacuccuaguaagacagugagagagagagguggauaggcagagcauaaaacucuguuucugaauuacuguaacuguaaaacuccuggaaguugguacaagguaguguguguguguguguguguguguguguguguguaacuauaaaugcuuccauaaauuggacuaaacguauauggucaaugcaacugacaauuuuaugaaaagaaauaacaaugcaucuagacuugagaauaaagaacacaaauagcucauauaucugacacugaaauuuauauuuccaucgggauggugcucuaggauguauaaaacccuuuuucauauauaauuuuauacauuccccaaaaaugacauaacaugaauauuauuguuucuacuuuguaagugaagaaauagagucucagcaaugugauuuucagagaaucauaaagcuaaaaaaaguuaaaaauugauaucuuauccaggaauuaucuguguaaguccugggcacauucuacugcuauaguugccaauguguccucaagaggagccacauagaaacagaagccguuagacgacuugugauaggacugaggacccgaagcugcgauugucaugugcaugggggcgucaucaguagcacccuuuaacaacagaaagcuaccaaaguaugaacaagaaaaaugguucccggauucagucagaaacauaauaaaugauuuuuauaaagaauguuucuaaacauaggaguuguauucauaaaaguugcacagguguuaaagaaagcuuugauaaaggaaaauggaguuugugugcugaucauacucaaauguuuuauaaacaagggagcauuaaaaauuaauguuguuuuauaguugauaggaacagggaagguacuguaaagugacucuagacacuaguaacaaacaguaauuucagcaggguuuaggaaggaucuugagagacuuuagcauagagaaauauaaaccuauuuaauucuuaaaauguaaaaacuacauuuuaaaauuuaguagucaugccauuaguuuuggagaauagggacuuucaaaagaaaugaaaguaaugccaucaacauggaaauaugugucuuuaauaugaugcaccauuacuaugguucuaaaguagaaagagcacucuggggcugaaguuucugugaguaguagagcugugcuuaauauagacagaacccugggcucaaucccuaauucuuuuaaaaaauucugucacucgauaacaucauuaaaauguacgucaaaguaaggaagacauuuccuauuaaauuauuucucugcccuuaccccagugguccuuucugucuuccuguucacuauugguacuccugauucaacauaugaagaccuuauagccaggauccacauguacaaggaacugugcagaaucuguccaucggggccuugguuaccucacucacagcuuaguucuuauccagcccuaucuuuuaccugcaaaugucauaauuccacauuuccuuaaaacuaaauaaaaggaagacuuccucucucucagugacagagccucuugguuccgucuacauuuugagccugggcagguaaauuuaacacaauggauuucuccaagcuacccaaaauccaugaugaagauaaagaaagcacauuuaguucugugcauggagacucagggccuaugauuacagccugugacauggcaagugcuacuauguaugagcuggugauaguggggcacagcaagcugguuggagagauuauucaauuggaaggugacauggccaccauuuagguguaugaagaaacuucuggugucucuguuggagacccuguacucugcacugguaaagcucucucaguagagcugaguccuggcauuaugggaaccauuuugucaaugagaacucacucaucaaacacaaaaucauguuacccccauguaacagaggaagcgugacuuacaucgcaccgccugagaauuaugaugcaucugaugucauccuggagcuuaaauuugaaggugugaaggagaaguucagcaugguccaaguauggccuuuucagugacaggugcagccugucacugaaaagcuaccugccaaucaucccuugcuuacuggccagagaguucucaaugcccuuuguccguguguucaggaaggaacuacugcuauuccaggugcuuuugacugugaaaagacugauuucccacucucuauccaagucuacaucagauucagugaaagaggaaaugagaugucaaaaguucuccaggccuucccugagcucaccauggaaguugauggcagucaaccaugcagaggacagugcagguagccaauaccuccaauaugccuguggcuguaagagaagccuccauuuacacuggaauuacacuaucaaaauauuucugugacaugggcuaccacaucaguaugauggccuacucuaccucgagaugggcugaggcucuaagagaaaucucuggucucuuagcugaaaugccugcagguagugaauacccugcauaccuugaugcccggcugacuucuuucugugagcgagcgggcagagugaaaugucucagaaacccugagagagaagggagugucagcauuguaggagcaguuucuccaccugggagugauuuuucugauccagccagucacuucugcaacucuugaguauucuucaaguguucuggggcuuggauaaaaaguuagcucaacgcaagcacuuccccucugccagcuggcucaucagcuacauacaugccuuggacaaguauuaugacaaacacuucacagaguuuguuccucugaggaccaaagcuaaggacauucugcaggaagaagaggaucugguggaaauugugcagcucguggaaaugcuucuuuagcgacgauggauaaaaucacucuggaggaagcaaaacuuauuaaagaugacuuccuacaaaaaaauguguacacuccuuaugacagguucuguccauucuacaagacaguggggaugcuguccaacaugauuucauucuaugacauggcccaccaagcuauggagaccacuguccagagcgacaguaagaucacaugguccauuauccuggagcagaugggggagauucucuauaaacucucauccaugaaauucaaggauccagugaaagauggcgaggcaaagaugaaggcugacuaugcgcagcuucuugaagauaugcagaaugcauuuuguaaccuugaagacuggaacugugauuucguucuucuucuucuucggcaagcucauaccuauauauuuuccugaauuucucaucuccaaccuuuugcuuccuuauugugcagcuuuaagacuagugccuauguguguucuuguucauuuugcuguuucuuugguaggucuuauaaaacaagcauucauuccuuuguuccaguguuuaaagggacucccugaccuuuauaugaagaggugaugcauaugauacacauguaacauaugcauuguaacauauauacuguaaacuuguauguagggugacuaccccuucucucuucuccaguaaacuguaagcaggacuauuccauguacucuguugggaauggaaggacugaucuccauaccguguaugggugcauacgaaacuacucagcguuuguagucagaccacuugcaacuuacuguuuuguugaguaaccauuuugcaggaaauauuuccauuuaaaaacauaaaagauuaauguuccaauuauuuauagcuucccuaguaucaaucaggacuguuuguggacacuugggaacuauuuuguuuuuuuuuuaacagacauuugcaaggcugaaaauaauagauaaaucaguucucucugaaaacgugaaagaaagaaaaagagccagguggucaaacuuaaauugacgucaauuaaaguauauuuuauuuaaagagaaauuuaauaucaaggacuuuuauauacucaauuacuaggaaaucuuuucuuuuuuaaauacaauuuaaaaaucauugaaaaugggauccacaucauagccauucuuuuccucagacuuagucagaugaacucagagugggggugggguggggacuagagucccacagacacacugcagugccugcaggcagucuuccccuggagaaccacuugcuguaggaguuuggagccagaguggcaugguuuucacaagguacaugugucacguguuuguuugccuuuugaccuucugaaaacagcaaguuuaccaauugcagaaaauauuuucucuguuucucuuucacuggcccagcaaguuucucaaagguaucaggucaacagcuuccuucccguugauagagaugaaaguuguucuuguauuuaacugguaacaaaaacaaaagaagaaagaaaagaaaagaaaagaaaagaaaagaaaagaaaagaaaagaaaagaaaagaaaagaaaagaucaauuuuugucucacuguuucaguguuuaaauaauaauucccauauuugcauaauaagacucucuucagagagcuuggagagcuagcucccuguucacucucuccagcugauugugcuggcgccaugcuuccucuucaggagggggaaagacuauuggaagauggcuaacacucucaaguacacaaguguaauagcaugaaguauuuauuuuaaggcuugguauguuguuuaaauuauuaaguagugcauuucuuauggucuuuuggguagacacagucaguaaacacuucagauguaauguguaaauccuugcuagugcaugucuacacgguggacugcuauugaagaaggcuauucuuccaacuauugaacacuguugacagauauggauuaugcaauggcuuguugggagguggauuagcggugcugcuuaauugguuugcuuccaauguggcuucguaucaagaagcccugacuaguggagaugagaaagauuucaaaaucugucugcuuauaccuaccagcaaccuaggcuugugagcagaacgaaugaucccaagaaacuacuugaucaaguuuguuuuuguuguccuggauucaagaugugcauucuuccuugaucuaagacuguuaauguaugaggcuauagaaagaguccccagauuuucacuguaacuuuccauuugcacacacuguagagcuucagacuguucacugauagugcaucuuuaguggggauguguucaacaacacaguuuacugcuucuguccauugguuagguacaaauaucugccucugacucuuucagcugcuuguugggucuucuggagugcggucaugcuaggucucuuuuugugagcacuccacagccucaguauagugucaggccuugggaccuccccuucagcuggaccccacuuugggccugucacuggaccuucuuuuccucaggcuccuuuccauuuccaucccuguaauuuauucagacaggaacaauuaugggucagaguugugacuguggaaugccccccucccccccucccucauuugauucccugucuuccuguuggagauaggcucuauaaguucccucucccuacugucaggcauuucaucuaagguuccucccuuucaguccugggaguaucucaccuuccaggucucugguccauucuggaggguccccccccccccaaccucuuauuucucgagguugccuauuuccauucuuucugcuggcccucagggcuucaguccuuuucccucacccaauagcagaucagguuccccucucccccacuccaaucccucaacccccuccacuuucccucccaggucccucccaacuugauugcuuucuucuaucucccaaguggaacugaggcauccucacuugggcacuucagcuuguugaccuuuuugaguucuguaucagguauuuuguacuuuuuuggggagggguggcuaacauccacuuauuaguaaguacauaccaugcauguccuuuugggucugaguuaccucacucaggaugauauuuucuaguuccuuccauuugccugcaaaacccaggauguucucguucuuaauagcaaaguguuccccuugcuccacauccucaccaguaugagcugucacuugauuuuuugaucuuaaccauucagauagauguaugaugaaaucucagaguuuauuuaauuuguguuucccucuuggcuaaggauauugaacauuuauuuaauugcuucuuggccauuagagauuacucuguuuagcucuguaguccauuuuuaaauuggauuauuugguuuguugaugucuaguuucuugaguucuauauauauauauauuagauguaaauccagaaguaauuccauaccccuauugacacuugauuuuugacaaaaaaagccaaaauuauacaguguaaaacaagaaaguaucuucaacaaauguugcuggucuaacuggauaucuguauguagaagaaugcaaauugauccauaucuaucauccuucccaaaacucaaguccaaauggaucaaacaccucaacauaaaacuggauauacuaaaucugauagaagagaguaggaaauagccuugaacgcacuggcacacaaaauaacuuucuguagcucaggcacuaaaaucaacaguaaauaaaugagaucccaugaaaugaaaaagcaaaggacacugucaauaggacaaaacaacagucuacagaaugggaaaaaauaucacuaacacuacauccuguacagggcuaacacccaaaauacauaaagaccccaaacccuuucauuauuuugucauuguuuuguuuuguuuuguuuguucauuuguucauucauucauuuguguguuuguuuugauaauagccauuuuggcuauguuaaggugaacauaguuuauaauauucauuucccugaugaugauaauaaggauguuaaacacuuuuuuucuuuugagaaaucuguuuacuucuguagccuguuuuugaauuggcuuuuuauuuucuugguguuuaguuuuuguuuuaguucuuuauauauucuagacacuagccuucuauauagcuggcaaagaauuucuccuaugcuauagauaaaucuucacucagcuuauauguuucuuugcuguaugaagcuuuuuaauuucaugaggucccacuugucaauuucugcccuuauuucuggaacaaaugagauucuauuaaaaagaucugugccuauuccugugucuuuguagcucuguuuuuuuuuuuuguuuguuuguuugguuuuuuuugguuuguuuguuuuuccucuaggucgaggauuuuagauuuuagauugagaucuuuaaucuauuuagauuuuauuucugugcaugguaaagauaagggucuagcauuauucucauaccuaugagugcccaauuuuuaagcacuguuuguuugaguaaacagaucacuaaaggacagcagucuuaaacuaauguagacauuucuacuuagagugggccacuaguaguaaaaacugcuucuuccuguuuucuuuucauccaagaaaauuuugaagauuaacuuauuuagucuucccauagcacaauccuccacacuguuaccuacaacuuuuuguucaguaccagccaauuuuaaccauauuccccuucauucuuugagaaucucguacauacuuggcauacucacaauuuuccccacaguucuucccauaaccaaccucccaacauuuccucccaaucuuaagauuccuuuuucccccaucaaguucaguuuguguugcucagcuagacuugggggccagggaaaagaccugagucaacuuaucagggaucacaucauuaaugaaaaacuaacgcucccucucccgacagcucucaaaugccaauagcuccucaucaaaugguaggauuucagguccaccuucucuccucuaugcuuugauuuugugcggcugcagggugcacaggucuuguguguacacucucacaauagcugugaguucauguguguaaccacuuugcuauguaugauguauguuguuuccuuaaagucauucuucaccucuggcucuuauaauuuuucacccccucuuucaugaaaaucucuaaccuuugcagggaaggugauaaauauauacaaauaaauguaaauauaaauauguuccauuuagggcugagcgcucuacaaucucucauucucuucacauugaccagcugaggcucucaauaucugacuaguuuugaacuucaaguaguuuuugcucaaauaaaaauauacuacauugucucuguuuacucugagaaaaacaguacauacuugccaggcuauguucuuaccucauggucagauagcucacuaaaaugucagagaguuuaaguuauucuauaugcccauuaguucugcugcuuugggauguaaugacucauauuaguaaucuacauaauaaaaaggguugaugaauuuuuaccagacuguccuuuugggacuauaauuuucaacacgauggaagcuuugccaauccuucagugcucaagcauugccugcacugacugacagcagcauaaguacuacaacuuuguguuaucugcaaagucagacaucacaucauauagaucgggcaaggccuuuucuugaagaguuaccaaauauacuugauuaaaacaucaccauccuguaggcaaauauagugacuuugaaaucucauuaaaauugauuucagauuuggugcuauagauuaguugauaagucuauucuuuucagagacucuaaaucaauuagagccaaaacauaagaagaaaauccuggucuucacagguugguuugauuuuuagcacuuucagaaugacugaauuuccaaauaggcaaugaccgucucugcaucuuauugggguagggguggaggaguuggacucccagggauuauaacagcauauacaaguuguaaucagacaaaacucccagcagagagaggggaagugagcaugaagucucaccccuaacugaggagcuauuggcaacuaauagcuccagcgggaggaagagucaauuuucuuuacuaguguagucccuggucaauugaccacuaugcaguagaagaacacacucgagaauauuggcagcacaaacgagacucaguagguuuuaaaaagggguuggagaacacacaguugugugaacaggaaagggaggguggaucugggaggagcugggaggaugaaaaugaauauaucuaaugaaaauacaucauuugaaauucucaaaagaauuuuaaaaaacaggaaaaucaaugaagugagcuuauucacugauguaaacugacuguuauucuauauguagcugagguaugauaccuugguacauuuuuguaauuuuuuauuuugauuuugauuaauuuuuuauaauuuagguauagguuuuauaucagauuuucuauuuucaacuuguugggcucaaaaaaguacauauaccuaugucucagugccuuuugugcuaaguaguuuauaaugcaaaaacauauugucccguaggucuggagaccaggaaguugaaggccagauucuacagcucucucucucagauccugucuugccuucuguaguucuuaacuuuucuuucuguuuuuauguuuguuuuacauuuugucuuuuguuucuaugcugagaauuguuucuuuauuggaauugguauauuuuauaauauaugauggucucucucuugauaauguaucuuggaagggauccacagaacagguuauaccuguacuuuucauaaucucaaggguaauuacccaucacauucuucuccucacagaccccuagcagcgagcuaaaauuugaaaguggugaacugugaccuacuggccacacagaccuuuuuuuuuucauuucuuucuggugaguccuccccugccaaaauccccaucauacucuucagacuuuauucugaauucuaucaccguauuuuuuuccauuuuuaauuucauauaaguagcauauacagccuuuacucuguguuugguuuuauucaccuaaucagauguuuucaaacuaucaaguagaucacugucuuauuuuaacaacugcuguauuaaacacucugauaaaagcaacuuaaggaagaaauggucuauuuuggaucauaguccaaaguacaguccaaaguacagaaagcaaagaaucagaagcuuuaaaaagcugguccauccugcauccacaaucaagaaauaaagacagggcuggaaagauggcucagugguuaagagcacugacugcuauuccaaaggucccaaguucaaauuccagcaaccacgugguggcucacaaucaucuguaaugagaucugaugcccacuucugggguuucugaagacagcuacaguguacuuacauauaauaaauaaauaaauuuuuuuuuagaaaaagaagaagaaguaaagacaagugauuuguaugcuggugcuguuugcuuucucuauuuuaugaggugcaggacccccccccccccacacacacacacacacacacccugcccagagaaugaucucacccgugguaauggacccucucacaucaguuuaucuaaugaagauaauuccuaacaggcaugaucaggggcaaucucccuggugauacuaagucuauccaguugacaauuaaaacuaaccaucauauucacugauuuguaacugcuaaguaguauucacauggugaguuucuuacaguucacccauuuuucuauugacgggcauuagaacuauacucaacuuggagauauugugaauaaacagcccauaacaagaauacagucauauguguauuuugcuuuacuuuucaaauaucugacaagugauuucaaaaaauaauuacacauuuucaccuguucaugagugauauauaggcauuuguccuaccugaguugcuguaccuucauggauguucauuauuaugguauuuuuaauuauaguuuuaauuacaguaacuagaccauguaaguaucaugucgauauugauaauguugcuuaugcuacauuuauauuucuuugcuauuuuuccagucaauauuuuguucuuucguucuccuuuuuaguagccauggcuugccucgaacucccucaaacucauagugauuugccugucucugacucccaaaugcuagaauuaaaggugugugugcuaccauacccagcugccucccaccucagcuuucugagugauaaguuucaaguguaaauugccaccauucuugacuugaugcucagcuuuggcgauccuauuguucaguuuuuaacagugcuuugcucuuuuucagucuuuuucugauuugcuauuaacauauuuuauuguauuggauugugaaugauaacuuguuucaucguugaacuauauuauccucucuuggauauuuguuaugguaguuauuuauuuuuaauugaaaauucauauaauguauucuaauucccccucccccaucaccucccugauucuccccauuuacacguccauccaacugcaugccuucuuucucuuuagagagcaaacagacaauuaaaaaaaaaucaaaaaaauaaagcacaacagaaaaaguaagaaagcugaauaauuguauuccauuguguaaauggaccacauuuuguguauccauucuuccauugagggacuucuggguuauuucaaacuucuagcuauuacaaauaaggcuguucaugaacaugguggagcacacauccuuaugguaugguggggcaucuuuuggguauaugcccaagagugguauaacugggucuucagguagaacuauuucuaauuuucuaaggaacugccagauugauuuccauagugguuguaccagcuugcaaucccaccagcaguggagaaguguucuuucucuauauccuggccagcauguguugucacuugaguuuuugaucuuugccauucugauugaaguaagagggaaucucagggucauuuuugauuugcauuucuuuggugacugaggacuuugaccauuucuuuaggugcuucucugccauucaaaauucuucuguugugaauucucuguuuagcucuguaccccauuuuuaauuggguuauuuuggguuuuuuggaaguuagcuuccugaguucuuuaaauauuuugguuauuaggccccugucagauguaggguuagugaaaauuuuuuucccagucaccugcagguugcuguugauggugucuuuggucuuauagaagcuuuucagcuucaugagaucccauuuauugauuguuugucuuagagccugaguucuucacacauuguaauacuauucagcuguuaaaaacauggacaucaugaauuuuguaggcaaaugcaugaaacuagaaaauaucauccugagugagguaacucagacccaaaaggacaugcaugguauguacucgcugauaaguggauauuagccuaaaaguacagaauaccuaggacacaacccacagaccauaagaaauguaacaaguagaaaggcccaagugaggauguuuuaaauccaauuagaagggggacagaaauaaucaugggaggcagaggguuaccugugcucuuuugcuacauuuguacuguuaguucaguagguuacucugugagguccucauguggaaaacaauacucacucugccuuaaaaagagagaauuaagacaacaaaguuuaaaagcuuacccagaauugcaagcauauugguagaggagccaaaaauagaacuuaaucauuaagucucucaguucagcuguguacacuauuucuaagcccucagcauaaguauauguaguuaauuguacauuuucuaaugaguuuggggaaauuaucauaguuaaauauaagucucaaauauuuuggaaacuuuagcuacugauuucagucuucuguaucaaacaucuuacuaaaacuccuagcaaguacaaaauuugccugguuuuaauuuuacuacaguuaacccuccaaggaccaccaucaaaagagcaguaaggcucgcacugacauagcaaaugguuucuuucuuuacugcuugucaguuucuuuauauacaagacccagucaacaaaugagaauuuaauauaguuauucacugauagauauagaaauuuagcuaggcacauuuuaaucauaguccuaaauuuucuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcgugucuaaugggccucucuuuccagugauggccgacuaggccaucuuuugauacauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacaacuauaucaggguccuuucagcauaaucuugcuagcguaugcaauggugucagcauuuggaagcugauuaugggauggauccccggauaugcuagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugauuuccauagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugaauaaggauguugagcauuuuuucaggugcuucucugccauucgguauuccucaggugagaauucuuuguucaguucugagccccauuuuuuaaugggguuauuugauuuucugaaguccaccuucuugcguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagagcaagccauugcuguucuguucaggaauuuuuccccuguacccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguauagcuuuaggucaggcauggugauuccaccagagguucuuuuauccuugagaagaguuuuugcuauccuagguuuuuuguuauuccagaugaauuuacaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuuuacuuccuuaguuagagucacgccgagauauuuuauauuauuugugacuauugagaaggguguuguuucccuaauuucuuucucagccuguuuauucuuuguauagagaaaggccauugacuuguuugaguuaauuuuauauccagcuacuucaccaaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcaaccuugucuagucccugauuuuagugggauugcuuccagcuucucuccauuuacuuugauguuggcuacugguuugcuguagauugcuuuuauuauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauuucuuuaauguguucuuggauucgguuagcgagaauuuuauuaaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaauaguuugugcagaacuggaauuagaucuucuuugaaggucugauaaaacucugcacuaaacccaucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuugucgaguauaagcuuuuguagaaggaucugaugguguuuuggauuucuucaggaucuguuguucugucucccuuuucauuucugauuuuguugauuaggauuuugucccuuugcccucuagugagucuagcuaagggcuuaucuaucuuguugauuuucucaaagaaccaacuccucguuugguuaauucuuugaauaguucuucuuguuuccacuugguuaauuucaccccugaguuugauuauuuccugccgucuacuccucuugggugaauuugcuuccuuuuuuucuagagcuuuuagauguguugucaagcugcuaguaugugcucucucccguuucuucuuggagggacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaauguuggcuuuccauucuuaauguuguuauugaagaucagucuuaggccaugguggucugauaggauacaugggacaauuucaauauuuuuguaucuguugaggccuauuuugugaccaauuauauggucaauuuuggagaaggucccgugaggugcugagaagaagguauauccuuuuguuuuaggauuaaauauucuguagauaucugucagguccauuuguuucauaacuucuguuaguuucacugugucccuguuuaguuucuguuuccacgaucuguccauugaugaaagugguguguugaggucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuugauaacuuuggguuggaagucgauuuuauccgauauuagaauggcuacuccagccuguuucuucagaccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaagguaauuguugcuuccuguuauuuuuguuguuaaaguuggcauucuguucuuguggcugucgucuuuuagguuuguugagggauuaucuucuuguuuuuucuagggcgugguucccguccuuguauugguuuuuuucuguuauuauccuuugaagggcuggauucguggagagauaaugggugaauuuaguuuugucguggaauacuuugguuucuccaucuaugguaauugagaguuuggcuggguauaguagccugggcuggcauuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuuguuguucugauuauuaugugucgggaggaauuucuuuucugguccagucuauuuggaguucuguaggcuucuuguauguucaugggcaucucuuucuuuagauuugggaaguuuucuucaauaauuuuguugaagauguuugcugguccuuugaguugaaaaucuucauucucauccacuccuauuauccguagguuuggucuucucauuguguccuggauuuccuggauguuuugaguuaggaucuuuuugcauuuuccauuuucuuugauuguugugccgauguucucuauggagucuucugcaccugagauucucucuuccaucucuuguauucuguugcugaugcuggcaucuaugguuccagauuucuuuccuaggguuucuaucuccagugucgccucacuuuggguuuucuuuauugugucuacuucccuuuuuaggucuaguaugguuuuguucauuuccaucaccucuuuggauguguuuuccuguuuuucuauaaggacuucuaccuguuugguuguguuuuccuguuuuucuuuaaggacuuguaacucuuuagcaguguuuuccuguuuuucuuuaaggacuuguaacucuuuagcaguguucuccuguauuucuuuaaaugaguuauugaauuccuucuuuauguccucuaccaucaucaugagauaugcuuuuaaauccagaucuaccuuuucagguguguuaggguguccuggauugggcgaagugggcguucuggguucugaugauggugagugguccuggcuucuguuaguaggauucuuacguuuaccuuucgccaucuggcaaucucuggaguuaguuguuauaguugucuuuguuaagagauuguuccucuguugauuuuguuacccucuaucagcaggcgugggagacaagcucucuucucugaguuucaguggucagagcagucucuguaggcaagcucuccucuuucagggaagguguacaguuaucugguguuuggaccuccuccuggcugaaggugaaggcccaaaacaggaucuuucccagaagcuguguugcuuuggccaggaagguggccaguugucuggagucgaagaugucgccgccugagaagcucuguggcucuuguccggaaggaggccggcugucuggagcugaggauggcgcugccucagaagcucuguggcucuugccgggaagguggcugguugucuggagcugaagauggcgccgcccagaagcucugcgacucucgcccgucccagaaacggcuggcacucuguauuccacacggucacccgugcagccugcccuccgcggagucccggagccaagaaggcucccgccggcgccugugccacaaaccucucaggccuggcagacccccgugcucucaccaggaagguggccggcuaucuggagcugaagauggcgccgcccagaagcucugcgacucucgcccgucccagaaacggcuggcacucuguauuccacacggucacccgugcagccugcccuccgcggagucccggagccaagaaggcucccgccggcgccugugccacaaaccucucaggccgggcagacccccgugcucuccguccuaaauuuuuaauaagcuaauuugcuaaaaauaucagaaaacuuacuuaugaauuaauuagaauucucauucugaaauuuuacauugaagaaaaaaauaacauuuaaaagauacaaaauaaugggaagagaaaauggggcuggaaaaacagauccaaagcagguaaagaugggauaaaaaugauuacaugagcaugcacaugcguaucugugugugucugugucuguguguguguguguguguuugugugugugugucagugucacuguuauuuuguacaauuaauauguaccaauaaaaauauucccauaaagaggaauuauagugguucuguggagaagacaucacauggcuguacuugaguagcgcguaaauccuagguuccaucaucaauaccacaugaagccagauccggcagcacaguccuagaaacccgcacuuggaaguaagacaggauaaucaggaguucaagagcauccuccgcuccauggugagaugcaggacggccugaacuacauaagacgcgcucucucucucucucucucucucucucucucucucucucucucucucucucucucccucucucuuucucucucucucuaaaacaaagcaaaacaaagcaaacaacaaaaacugugacaggcauaagugacucaugccuguaaucccagagcucccagagacuauaacaggaagaucacaaguuugaggcuagccugagcuaaagaauaagacccugccucaagcaaauacacaaauaaaacguaaucuuaauaauaaauuaauuuaaauaaauuaaaaccuuaauagaaauuccugaaaauaggauguggaucuugggagcgaacuccguggagggccccauuguccccagaggacucuccacgcugcaggcacccuagcacacccaggaucuugcgaucacuggugaguggaaugcaacaucugcuccaaaaaacccagagggucuugugccagcaggaacagggucaaaggaaaccuacgcgaccaguggcuggguaucauuccagucuguaccagcccugcgccaucuugggugcgaacucagcgggcccuagcacacccaggaucuuggcaucacugagaacagucuacucuggagagcacgugggcagcagaagcaacagagcucuuaaccucugugccaucuuccuagccccuaaagcucaguuauucuuaguauguaacccuaaacuuaauuuuguucuggaaaguaguuuaagaacagguagcuaaaguggcaugcaggguucuuuuuuuuuuuuuuuuuuuucauuauuuuguuuauuuacauuucaaauggugucucccuucucagucuccacuccccccuccccaaaaaaaaccuccccaccccauugccccuucccuuugccucuaagggggugcucuuucacccucccacuuccaccucauccaucuagcauccccuucucuggggcaacaagccuucacgggaacaaacgccuucccucccauugaugccagauaaggcaguccucugcuacauauguagagggaaccaaggacagacccacucuuuggugggugguuuagucucugggaggucugagggaccuggugaauugauauuguuguucuuccuaugggguuuagacugagacgcucuauaucugugcacagccugcauuugguagcugcauugcgcccaaggaaaagaauaccuuguugcuaggaaaugcauucuaaaggggauagacuuccaguuugcucucagccaacuuuguccugugugugcacaccuauagagaugcagacacagugaaggauugaaggaauaccugugacauguuuucgaaaauaaaugaaucugaauaaaaaauaacuaaagcuaaucuacaauuuuauacaucuaaaaguauuuuuaauuguuuuuuuaauuuuuuagguauuuucuucauuuacauuuccaaugcuaucccaaaagccccccauacccuccccccccacuccccuacccacccacucccacuucuuggcccuggcguuccccuauacuggggcauauaaaguuugcaggaccaaugggccucucuuuccacugauggccaacuaggccaucuucugauacauaugcagcuagagacaugagcucagggggguacugauuaguucauauuauuguuccagcuauaggguugcagaccccuuuagcuccuuggguacuuucucuagcuucuccauugggggcccugugauccauccaauagcugacugugagcauccacuucuguguuugcuaggccccggcguagucucccaagagacagcucuaucuggguccuuucagcaaaaucuugcuaguguaugcaauggugucagcguuuggaggcugauuaugggauggauccccggguauggcagccucuaaaugguccauccuuucgucuuagcuccaaacuuugucucuguaacuccuuccguggauguuuuguucccaauucuaagaagaggcaaaauauccacacuuuggucuucauucuucuugaguuucauguguuuugcaaauuguaucuuguaucuuggguauucuaaguuucugggcuaauauccacuuaucagugaguacauaucauaugaguucuuuugugauuggguuaccucacucaggaugaugcccuccagguccauccauuugccugcgaauuucauaaauucauucuuuuuuuuccauuuuuuauuagguauuuagcucauuuacauuuccaaugcuauaccaaaagucccccauacccacccacccccacuccccuacccacccacucccccauuuggcccuggcguuccccuguacuggggcauauaaaguuugcguguccaaugggccuuucuuuccagugauggccgacuaggccaucuuuugauacauaugcagcuagaguccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggcccuggcauagucucacaagcgacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguauuuuauaucuuggguauccuagcuuuggggcuaauauccacuuaucagugaguacauauugugugaguuccuuugugaauguguuaccucacucaggaugaugcccucuagguccauccauuugccuaggaauuucauaaauucauucuuuuuaauagcugaguaguacuccauuguguaaauguaccacauuuucuguauccauuccucuguugagggacaucuggguucuuuccagcuucuggcuauuauaaauaaggcugcuaugaacauaguggagcauguguccuucuuaccaguuggaacaucuucuggguauaugucaaggagcgguauugcuggauccuccaguaguacuagguccaauuuucugaggaaccgccagacugauuuccagagugguuguacaagcuugcaaucccaccaacaauggagaaguguucuucuuucuccacauccucuaaacuaaguuuuuaaacuuaaaacuaaguuuuuaaacuuaguuuuuuguugguguuccuaugguuuuuauuguuuuagauuuugugugcaugaguguuucucugcauguguguaugugugccauauaaaugucugaugcacaagaaggucagaagucuucaaaaccucuaggauuagaacaugguuaugaacaaccccaugugugcugagaacugaauaaaaaaaaccaacuggauaaaaaauaacuaaagcuaaucuugcaacaacagugcuaagggacugcugagccaucuuugcuucuagcuccauauuuaaggguucuauuuggugugugugugugugugugugugugugugugugugugugugugugugugguguacaucuguauaaacaaugugcacauguauaguauggaaaccaaagagggugccaacuguccuccuucaugcucuuggucugucccuccucuaaggcagagacacuguagccaggccagaugccagcaauccuagcagucauccugcucccuuccuagcucaauucuggaaccaugggccuuuccaggaauguuuggcuuuuccaauucuuauauuuguagaauguaagcucuuaacaauagaaacauguugauucucugguuuugguuuucaaucaaaaugguaacacagacuggcgggauggcucagugcuaaagagcacugacugcucacaaacaucuacaauaagacacaagauaaagcugucuccugagaggcucugccagugugugacuaauacagaaauggauguucacagccauccauuggacuuagcacaggguccccaaugaaggagcuagagaaaguacccaaggagcugaagaaguuugcagccccauaggaggaacaacaauaugaaccaaccaguaccccccaagagcucccugagacuaaaccaccagucaaaaaaaaaaacacauggugggacucuaaacugcauaauuagaggauagccuagucgcucaucagugggaguacaggcccuugguccugugaagguucuuugucccuguauaggggaaugccagggccagggagcgagaguggguggguuggggagcaggggaagggggggcaggagauaggguauuuucagaggggaaaccaggaaagggguaacauuugaaauguaaauaaagaaaauaucuaauaaaaaauaaaguaaauuuaaaaaaagaaaagaagcugugggccggaaugagugguggucagaguggggcuggagcaggagaagggaugggggcagcaggggugggggaguggcgggagaaaauggcuaccacaauguagccuaggcuguccuggaacucaagguguagcccaaauuggccucaggcucauggaaaucuauguuagccuccuuucaacugaagcuguagaacaacauaaucacuaauggccuccugcucucggcugucccugcugccuguaguucuuugugaagggcugaggcguuguggaccuucccacauguauuuuuguagaauguaagcucuuaaccauagaaacauguugcuuuguucaucagugccauccuuguucagcucacuuuggggcagucauguuggugagacuuuacaacuguagcuucugacauuucgaggagacagugguuuuuugguuuuguauuuguuguuguuuaaagagaaacuuagaaacuuuggacccagaucagaggaaagcuuucauguuugaauuuacuuuaaaagauuagauaguucauuguugaaccuaaauguaaauauuaaaaauuaaaaauaacuauuaugaaagaaauaauuucaagucaauuuuacucacaacagaacugcucauaaacucaucuacuuaugauguguucccaccauaugaaccuguauauaggcauccugaaauguauagacucuugcucugggaccucaaacuucaacauauaaaaggucucuucaaggaucucuuaggggaaccuuuuuuuauuuugacaugagagaugauuaaagacacgcaaguggcuugaagagcagaguaaaggacacagacacucuuguuugucacuguuugucaccaugggaaacaguuuuaauuggaaguguuuuauuugccaucuaaggucauugcaggcacuuccagagguaauguuugaaauuaaagagauacuaauucuauaugauggcucaucuuucuugucuuggcauauaauuugauaagauuuguguaaauguaauaugguaaacuaugucacugugacagacugagauugcucuaaaaaugcaguguaggaaaacaauugauagcccacagaaaccaacuuuuuucuuuuuauuauauuuuuauuauuagaacaauuuuuuaaguuuaaauguauuugaucauauuccuuccauuccucaaguccuuccagguccuaacccuccuuagucgcccagccuuaaguucguugucaaagacaaacaagcaaaacccaaauauaacaaaacucucuacaaccaagaaaacagagcaauacccaaaaagaaaaaaaaaaucacuguaaccaaaaaucuguggugaguauuauauguuagucaacuguuucugaauaugaguguggcauacaugcccacugucacuccaucggagacaguacaaauucaguuguuaagaccuaguugauucaauucauuauuuaaauauaauacaguaacauaaaagaaaaacuaccacuuuaaaguuagacaggacaaaucaacacaaggaaaagagcugaagagaagccauaagaaucagagauccacucauuuacacacucggaaacaccaucgaaaugugaaacuggaagccaucuauaugugcagaggugcuggugcaagggcgcgcucuuggaaccauaaaagaaagugaaaggccagccacacugcagcacaggaaaucugauuuuccuguuaagaaaauauuaaccuuccucccuauaaggacuccuuuaugcauuucuuccuucacuuguaguccaucuuucugaguacauaccauguuuaggccuugggcuuucugcagugaguauuaaagcauauugcuaugcacaaaauuagcaaaaauaucuauuauccacuuucuugccaaagaauauacucacuaacuuuauaauauaugauucuaacugaccauaaauuaaaauaguaacuguucauaagcauaucuacucugccuugcuucucugcuggcuucugcgcuuuacauaguucucuauucuacuacaucucaaguguguuucagcagaaagcaggaguaagcaaccacugugcaagcaaagauaauuaugacucuagugucauuacaauacggugucauugcaauuuuuuuauuuuuuuccuuuuauuaguuuuuuguuuuuugaaaugggugaaauuuuauuucuuuuacaguuggaaggcagagcuaguuuucuaggcacacuuaaauaaacacuucauauugacuuuagauuuccaggugcacuacauacauaggcaacugagccauacuaauuugacaaaccuuuacauaagauagaaacuugugcuccuauuccuuuuuuuuaauuauuagauuuuuuuauuuacauuucaaauguuauccccuuuccuaguuuccccuccgaaaauccccuauccucucuucuguccuccugcucccaccuacucugcuuccuggcccaggcauuccccuacacuggggcauagaaccuucacaggaccaagggccucuccucccauugaugacugacuaggccauccuccgcuacguaugcagcuagagccacgaguccauccauguauuuucuuugauuggugguuuagucccagggagcucuggagcuacugguugguucauauuguuguuccuccuauggggcugcaaaccacuucagcuccuuggguacuuucucuagcuccuucauuggggaaccugugcuccgucuaauggaugacugugagcauccacuucuguauuagucaggcacuagcacagccucucaggagacagcuauauuaggcuccugucagcaagcucuuguuggcaucugcaacagugccuggguuuggugguuguuuaugggauggauccccagguggagcaguuucuggauggucauuccuuagucucugcuauugaauucaugaaacucuuagacaaauggauggaucugggggauaucauccuaagugagguaacccaaucacaaaagaaaacacaugauauacacucaaugauaaguggauaauagcccagaaguucagaauacccaagauacaauuugcaaaacacgugaaacucaagaagaaggaagaccaaaguguggacacuucaauucuucuuagaagggggaacaagauacccauagaaaaaguuacaaaguuuauuuuauuuuuaauuuauuuuuugcacuccauauuccauuccccacccccuauccacccucugacuuccacaucccucaccuccuccccaccccacccccaccccaccugaccucaauucccugaggccuccauucucuugaggguuaggugcaucaucucugaaugaacagaccuggaaguccucuauuguauguguguugagggccucauaucauaugguguaugcugucuguuuggugguccaguguuugaagguucuugggggccagauuaauuaagacugcugguccuccuacaggaucgccuuuuccucaccuucuuucagccuucccuaauucaaccacaggggucagcuacuucuggccauugguuggguacaaauaucugccucugacucucucagcugcuuguuggguccuuuggagggcagucaugcuaggucccuaguuuugugagcucuccauagccucaguaauagugucaggccuugggaccuccccuugagcuggacccuacuuuuggccuuuucacugcaccuucuuuaacucagguuccucuccauuuccaucccuguaauucuuuuuuguuuguuuguuuguuuguuuuugaaauauauuuuuauuagauauuuucuucauuuacauuucaaaugcuaucccaaaaguccccuacacccccgcccaucccuguaauucuuucacagagaaacaauuaugggucagaggugugacugugguauugcauccccaucccuccacuugaugcacugucuuccugcuggaggugggcucuauaaguucccuuucccuacuguaggguguuuuaucuaagaucccugccuuugaguccuggaagucucucaccucccaugucucuggugcauucuagggguguucccccaaccuccuauuuccugagguugccugcucaacaagcugaaguacccaagugaggacuaaucagucccacuugagagggagaagaaagcaaucacaguggggagagagggagggaccugggagagacaguaggcuggauggucaccaccaccauggggagagggaaaccugauggcgguacugggugagggaaaaggacugaaacccugagggcuagcagaaacaauuuuuauucuuaaaucacuaguauaguuuuaccaugccuuaucucacuuuauuauaauuuguaaaugcuacaauuuucugguaaacaaauuauggcauucuuuauguuggaauucuuaaagugucugggucuugauacuaaaucuucaugugcaacuuccuuuaggaagauuuuuuuaaaagccuguauuucuacugguaguuauaaauuuuggucuaaaaacauuaaauguugaccaaugcaaaacacuuucuucccauaagccaacauuauucuucauguguagauuaaccuuccaccuuagucuuaaaagcagauguuccuuucaggaugauuuuuuaaauuuacucugugacauaaaaauaaaauaguagaugucauaaaccuauagugauacccaaaaaguaucugagagucucuggaaaauaaucucuauccuuugcuacuuuaauaugaucaaauauaagucucacacuaauauuaaauuacuugacaaagaaggacuuucauagcuaagugauaaaauuguaaguauuauacaugggacuggaaagaugcgaaagaugccucacuaguucagagcacuggugcucuuucacaggaccuagguuuaauuccgaauuccaacaugauggcucacaaaccucuauaacuaaaacuccaggugaucugagacacucuucuggacucugugaaaacuauacacauauguuacauaggcauacaugcaaacaaaacacccauacacauaaaauaaacaucaaaaauucgcagacaaugguagcacaugccuauaaugccagcacuugugaggcagaggcagacagaucucugaguuuaaggccuacuuggucuaccaagugaguuccaagagagccagggcuacacagagaaacccuguccacaaaguaguaguaguaguaguaguaguaguaguaguaguaguaguaguagaaguagaaguauuggguauagccaguauauaaaacaaaaguaauggaaacaguauguucuugccaaauucuguaucacauuuaaauucauuuuaaguucauuucuuaaguauauucauuuucuauuacuguguaucaaacccaagauuguaaauguuuacaaaucuagaaguaaacuuaauaccagagaaagaaaacuuaauuuuaucaguaauaaauuaugaaagauauuugugcaggggucaucugaacaguuugagaaggccucuaugugaaaaauccagcuacagcuauguccgaagacaucuccacauaaaugcuauauaugugacuauaaacaaccuuuaaaauguuuccuagucauuguuuagucauagcuggcuguaugcaguuauaucagcaagcauuccuuaguuaaaguuuauauucaguguaauuauuuauaaauucuccuuguccucuguaauauuaccugauaguauucauaaaguaaucaacaguacaauuugcuauuauuacaugauaggucugugaauauauuaagcuauaccauguaaauaagcucaacgucuuuucagaaaucuugccguguaaaaggcaguauuugauuuuucuaagagcuaggucugugaugcaaguuuuaguccucacuucuugagcacuuaaaacaagaggaucauaaguucaagacuugccugaccuacagagggagcuaauacagcaaaccagguaggcaacaguuccauauuuuugcauagcuuuaagcaggaugaaaagaaucccagaucagauauguaacuggcaauaugaaaaccagcgugauuucuccugaggauacugcuuggucacuagccaauaacaaccagcaaugccugauggguagagaugcucucccagaaauauaucaucuggaaccagcaaaaaacagagcaugaggugauaacuugaugcaaguuuuacauguucauaacaauugcacucucuagcuauaguuaucaguguauuagacucugcuuuguuuauaguuuaagggcuuuuaauuuaacuuuuuuuuugaaaauagauucuucucucauacaguaaaugcugaccacaguuuccccuuccuuccgguccucuccacccucaacucagauucacuccccuuccauuucccuuaaaaaaaugagcaggccuccaaaagacaacaaguaaagaugacaaaacaagauacaaugacacaagucaaagccuucauaugaggcuaaacaaggcaaccuaguaggaggaaaacagucucaaagaucaaacagaacuaagagacauaccugcuccacuguuaggagacucacaaaagcgccaagcuaccagccauagcacauaugcaaaggaccuggugcagacccaugcaggccccacgcuugcugccucaaucucugugagcccaugugagccugcuuagaugauuuaaugccccaucuucuccugguguccuucauuuccccggacuccuacagucuuuccucccuaaaaagguuaaacuuuaaauuacaaaacuuuuguuucuaauuuaaaguuuuacagcuggaaaauauaaagcaccuaauccuuagaaaaucaaaacuaaacuuauggcuggagagauggcucaacgguuaagagcacugacugcucuuccagaggaccugaguucaauucccagcaaccacaugauggcucacaaccauccauaauaggauccaaugcacucuuauaguguguguuugaagacagcugcaguguacucauauaaauaaaaaauuaauuaauuaauuaauuaaaaaaaacuuauucauacuauaguuauguagaaaacucaaaaucuagagauauuuuuccaguguuuucagacagaguuuucuguguccuagaacucacucugcagaucauuccggccuccaacucauagaucugggauuaaaggugugcaccacuaugcuagagauacauuauuaguauaaaaaguaucccagcuagagauacauuauuaauauaaaaaagcuaauucagcaagauagucagaaacaaguucaauauaugaaaaugcauuuuauauaccagucacaguuaaagguaaaguguuuuaaaauccauuuacuuuaucaucaaugaauauuuaauacuaaaaauuuuuaaaaacauauacguguauauuuauuaucuaacauugcaaagugccaauuuuucucaaauugaaacauaaaugcuggcacaguuuucuuguuuuuuuuuuuucuuuucccucccauuuucuuuuuuuuuuuauuaucuuccuaggcuggccucaaacuuguuaugcaguugcugaugguccucaucuuucugccucuaucucccaagugcuaauauuacagguauacaacaucucuccucccugccugccugccugccuucuucccucccucccuccccacuucccucccucccucccucccucccucccucccuuccucccucccuuccuccuucacuccuuuccuuucuuauuuguuuguuuguugauugauugaguuaggauaugcacaggaaccccaaugggcacuaugaaggucagaggauggcuuucccaauccucccacauguggauucugaggaucaaacucaggucaucaggcuucaggaugcuuucuuuucccucuccucuguccccucuccccucccacucuucuuuccugaaagacuggccuugaauuccuggucucagugagaacugccucagccuuuaaguaauuuagaugaaaggccuguaccaccauaucaaacuuagcaggucuuucauuuaguugguucuuugggguuuuguucaugugaaguucuagauucccaccuuguguuugaugcuucuaccagaauggaaaacugacaagaaccauagacacccuccuugucaugauacaucagccaaaauaaaucucucuagggauagaaaacaugacaaaugcagaaaaggacaaaaauguggguuuauuacucugacuacugauacugugguuuagaagccucugccaguguuuucuggaaccuggggaagcuuaaagaaccaggcuagagaaacucuaggaugcuguaagccuuugcaaguugugauucuaaugggagcacaaaagaccugaauguuggcaggugugggccauuaugccuauucuuaugauguuacaaauggaaauaagacacuacagggaguugggcuugaggucauucauuucacauugugcucaacaccuugacugcauuuuguccauguccugaaacuucaugggauguuggauuugaagguaauaauaguagcuaauaugguagaagaauuucaaggcagucuagcauuugcacuguuguaugguauaguaaccaagaggaccgugagaauugugagcauaaagcaaagaauaaaagcuuagaaaccuuuuaguuuaccaagaagagaagcacacaugaaguuguggccuaggagaguagagugaaccagcuagaaagaggauaacaggcgaaaagaaaucaagggcuuugcuucugguuaacaggaaaggugucuuuacaggcaucucgggcacacagcccacccaucacaaguugaagcuauaaaguucaauucaguucaaagacugauuuaaggggagagcuccagagugcaguguucacacaaggccaccucagaauaucugucucauguucagccaccugcaugagacaugcagccuaaggcaugagucucuuacuacuucuaccaguggccaacugugcccaugggauacaaauuuugcagucauacagaaugcaaggcuuaaaaacucacugacaauuuuacccagauuucaaaagaagccugggguggucagacaguguguggcaggauuagagcuucagacagcuccugauggaugcagugcagaccccaggaagucagaggacaaaacauggaacaucggccacaagaaagcugaagcacugagcagagaccaugugagccacaacccuugagaacuaaccgcucgcucugggugccagagauggagauauauaggguuugaauuuuuaccuuucuuugguucagucuuuucuuguuuuccuuuuuuuuuuucuuccuuuuuggaaagagaaugcuugcucuauaccaauaaaucuuggaaguaugaacuugauuuuugauuuuacaagggcucaaggcugaguuugccuugcaucauaacacuuugaacucagauuuuuuuuuuuuugagacaggguuucucuguauagcccuggcuguccuggaacucacucuguagaccagguuggacugaaacucagaaaucugccugccucugccucccaaguauugggauuaaaggcaugugccacuaccuccuggccaguuuuuuuuuuuuaauuuugguguaugauguuuuuauuuccaaguuuuucauaauaaaguuaauaaaaggagacaaucacacauaaacgugcacauauaaaauacauacuacaguuauacauacaugcauaugcucaugcaauaacuuaacauuacccuuuuuauugaauauagagucuuuccucauaaaguauauucugaccacaguuuuccaguccaguuucacuuuuguguggaauaucaguuuucucagaccauuuguuaaagguauuuuccuucccucuuguauccucuuacuacccuugccaaaguuaguugacuacacaggguuugauuuucagacucuaugcugauucacuguuuuauacuauuuugauuacugaaguuucuuaaaacaguuuuaagucaggaaguacugucccuccuacauuguuuucuuuguuuuguuuuguuuuguuuuuuaauuuaaggcauuuuuauuagauauuuucuucauuuacauuucaaaugcuauccccaacacccccuauaccuucccccuacccuacucccaacccacccacucccacuuccuggcauuccccuguacuggggcauaugaucuucucaagaagaagggccucuccucccaaugauggccgacuaggccauccucugcuacacaugcaaguagagacacaacucuuguggguacugauuauuucauuuuguuguuccuccuauaggguugcagaccccuuuagcuccuuggguauuuuaucuaccuccugcauuaggagcccuguguuccauccaaaagaugagugugagcauccacuucuguauuugccaggcaauggcauagccucauaagagagagcuaugucaggguccugucagcaaaaucuugcuagcauaugcaauagugucuggguuuggugauuguauaugggauggaucccuagcugggacagucucugggugguucuuucuucugucucugcaccgaacuuugucuauguagcuccuuccaugaguauuuuguuccccauucuaagaaggagcaaaguauccauacuuuggucuuccuucuugaguuucauguguaucuuggauauucuaaguuucugggcuaauauccacuuaucagugaguguauaucauguguguucuuuugugauugaguuaccucacucaggaugauauccuccagauccauccauuugccuaagaauuucauaaauucauuguuuuuaauugcugaguaguacuccacuguguaaauuuacauuuucuguauccauuccucuguugaaggacaucugcauuauuuucagcuucuggcuauuaugacuaagcugcuaugaacauaguguccuuauuacaaguuggaacaucuucuggguauaugcccaggauaggaauugcuggaucuuccuguaguacuauguccaauuuucugaggaaccaccagacugguuuccagaguuguuauaccagcuugcaaucccaccaacaauagaggaaugucccucuuucuccacagcgacagacagauagaccaauggaauagaauugaaaaaaugaacccacacaccuauggucacuugaucuuugacaagggagcuaaaaccauccaguggaaaaaaagcauuuucaacaaauggugcuggcacaacuggcgguuaucauguagaagaaugcaaauugauccauucguaucuccuuguacuaaggucaaaucuaaauggaucaaggaacuccacauaaaaccaggacagugaaacuuauagaggagaaagugggaaaaagccuugaagauauuggcacaggggaaaaauucuugaacagaacagcaauggcuugugcuguaagaucgagagucaacaaauaggaccucauaaaauugcaaagcuucuguaaggcaaaagacacugucaauaagacaaaaaaggccaccaacagauugggaaaggaucuuuaacaauccuaaaucagagaggagacuaauagccgguguauauauaaugaacucaagaagaugaacuccagaaaaucaaauaacccuauuaaaaaaugggguacagaacuaaacaaagaauucucaacugagggauacugaagggcugagaagcaccugaaaaaguguucaacauccuuaaucaucagggaaaugcaaaucaaaacaacccugagauuccaccucacaccagucagaauggcaaaaauucaggugacaucagaugcuggcaaggauguggagaaagagggauacucauacauuguuuuuuauucccgguguugcuuuggcuagucagguuuuguagaucuguacaauuuuuucuauuuccauggaaaacgccauugguguuuuaauggggauuugccacaauauggauagacgucuagguccuaagugggaaaaaaauaaaagccagacauagaaaaaacaucacaugcucacuuacagguacucuuuuuuucaaaaucaaauagaagucagauuuaaugguacauaccuuuaaucucagcacucaagaagcugaacccagccuaaucuaaauaaagaguuacaggccaggguacuuagagagacccugucucaaaaaaaaaaaaaaaagucaaacagagagacagagaacaagaaugaugaugagugaggaggaaagggagaaaaaagaagcugaugugcucaaugcauagcaagaacaaguuucccuaccugccuagcaugccugcagagcacgagcuaagcaggagaguuagacaaaagacauguugaauuagugauuucgugaagcaaauguuuuuagcuguuagagguguuucacccucuguauaucuuaucaaacuguaggcauuaaaaauauucaauaacauuuguuuuuaaauaauacuuaaaucauuucaaauagcagaagaaagcggcaacugaaaauggaagguuuugcccaucccuuuuaagaaauaaaaauuauuuuauuuuuuucauagguaguuuugccuguauguguaucugugcaccguguguguacagugccaacagaggccagaagaggucauugaauccuuuggaacuggagauacagaugguugugagcugccauguagauucuaggaacugaaccugggucuucuggaagaacagcugaugcucuuaauuucugagccaucucuccagccccuuuugcccacucuuaaagggaauugauguaucuuuagaggccaagucuuagguaacauauaaugaaacaaucauuucaaacaaagauggcaggccaggcauuguggugcacacuuuauucccugccacuuggaaggcagaaguggguggcuguccaugaguucaaggucacucuaauagugagucccaggacaaccagggcuacacaguaagacccugucucaaaauugaaaaagaaaaaaagaaagaaaccaucuguacuccugcagucuagauucaauagauaaugaaaauacaucuguuuuuauugauuuugugggagcugauuaggaagguuugccuuggcuucaauaagagaccuguagauuaggcucuacucugccucaagaauaaguuuacuucccagaguuaucuccauagucuuaaacuaccuagugucucuaauugccuucucaugucccaccagagcuaagagauauuuggcagcauguuaguauacaaacaaaaggacaggcuccccagaagcugcagauaauggggggggggguuccacauccaguguuucuguccauauccuagccuaucucuucgcuuaggucaaaccuaacaucgcacuuuuagggucucagcacaauguuaauggacuugcuaccauguuaacaauguguugacuuagcugcagucaguauugcucucacaaagucccaaucaauauuuuacucugucuucuaccucccuguguggcugucccacacuuguguaaccguggcuaccuuucuaccagugucccgggucacaaauaaugacucugggacuuaauuauuuaugaauaagcuugggcuuguucccugacuagcucguaacuuacauaacccuuauucuauucugugugugccacuugacuaguuaccucuucucaguuuuguauguaauauccucagaguccagguggcaaauccuucuggucucuccccauggucucuucauaccaucuucucuuccucuggucucucugggacccccuaacuggaauugcccuauucuuuucugccagcaaaguggcuuuauuaacuaaucagaggugauggagaaacaauuuuuacauaauaaugaggcccaagaugcuugaccauaccauggucuggacuguaaccagaugucugggcacagacaucaguaucuggauccacagugcacaagaccaacccccaacacacuuucacugugcacucacagagcuuccuuggcaauccuucucuguucaaauaaaguuuguauuuuuuuuagaaacucugggguucauuuucagacauaucucugugguuuuguuuucuuuuuagaaggcacaauauuucuuggugcucugguuuucucugauucuucauaacauucuagaaauaacuguuggugagcucauaaauucaguaguuaaucccacugcggcucaccaauaccuauuucagacucucauuuuuuauauaugagacuccuucaacaauuccccuaccuguuauuaucagcauaccuguauugacaagaucuucauugccucuuaauuguacacacuuuuuucuuguuaaagaucaauuuuuaaaaucaaacuuugucauuuagaaaauaucauagacauguuacccugcuaauauuaaugugucucauauacccauauuuucuuuuccccuuugucaaaugaguuuacaauguuuuuuaucuuuugcuuuaauacauauuauuauaauauauagucuuauuauauuuuuugcuuuaauauauacacacaccuauauauguauguauacacauauguaugcauguguauauguauauauguauauacauauauaugcauguguaugaauauauauguauauacauauauauuauucuacaaagaagauaaaauagggggacauagacaguucuucaugaaauaaagauauaagaaaacuaucauauuuagaggugacuuugugaacagugacauucccuauucuaaccagaaucuaacauguaaauuauacauggaauguuagaauuauuccauaaccuuuugaucuuaggccauuaagauaaaguaacuaguaauaauuaaaacaaugaaucaaaccaagaaauuauuuugaauuaucuuuuuugguaaauguuucucuacaauuauaauguucuucaaucucuacucucuauucaucacuuauaauuuaccaguaaaucucauaauaucuggcaaaaguguguguguuuguguaaaauaucacuuguuuuauuugucuguuagagacuuucccucuguuauagaauguagauggugcgaggugcauaguuauucacacuaugacacuucuuuuacugggcugggagucaaguguucaaagguccggccggggcucaaucccagcaccauaauacauaccaaaaaaucaauuucaauuuacaauguuuuaacuuuuacaauguuucuuaacuuuuugaaacuuuguuuuuguuacuuuuaauuauguaaguucaguugcccaugauggggagaggcauuagguccccuagaguuggaguugcaagugauugugagcugccuggagcagauucugagauugaauucaggucuccuuaaagacagagccauuucuccagcccccuauuuuugacuuuuuaaaacaaauacuagggaaaaaaguggguuacaacuucaaaacaguauacaucugccaaaauauuuuugaccaagauuuuugcagcuacaucaguauugcauuuauauguguuucuacagaggggggaaaaaacaugcauuaaggucacgugaacaagaauauaggcugguaucuuaguuucccuuuuuuucccaaauaagagcaaccugaugaaaaaaaggcuuguuuuauuggcucauaagcaugcacucacaugcacauacccagacacaugcuuacacauuauuugaaaauaaauauuuuaaguggccauucuuugagcacuauuuuugcagguuuucauauuaauuuaucaaaauauucaguggaauuuuuuaagguuuauuuucauuucauuuauguguauggguguuugccugaauuuauuucugcacugcacgucccacaaaagccagaauaggguguuauauucacuacagcuugaauuacuggugguuguuagcuaccauguggguccugggaaaagaaccucaguccucugcaagagcaacagugugcuuaacagcuaauccaauucucuaaccccacugaugugugcaaaccaagacugacaugacuguaguuauguaucuuccaaaugcuacuuaugaauguuaaaaauucacuuucagugauaggaggaugacuccauugauaaaaugcuugccuuucaaccaaaagagccugaguuucaucaccagaacacacauaaaagaaagucagacaugauggcaugcacuuguaaucccagcacuggaagggcagagugagacaggcagagccauggaauucagcagcuggccagcuuaccccaaggccaaugaaagaccuggucucaaaaacaaaacaaaacaaaacaaagcaaaugagagugccugagaaagaacccccaaggcccuucucugccuucacaugcacacacacaaucuugcauacacaugaacacaugcacaaugaccacuuccaaaacuuaagaauuucuuaaauuaaaaaaguuuuuggauaauuucauacauguacuuccaaauuuucauacaugaguguuuuguucacagcauuuccacccaucuuuccucccauuccaacuccuuccauguuacccccuuauccucaaauuuugacuucuucuuuauuauugcugcauggauguguguauagaggcugucaagacaucuaguacugcuugaauguacacaugcauguauuugugagugugugugugugugugugugugugugugugcuuggaacugaauaacuuagcaagggcaugccccaguggaagacagauuuuucacccuauuucagcagucacuaauugccuguaacucuauaucuaagauguuauauuuucuaauaaaauuuuauauuacacuucaguguauaauuuaccaacuuuacuuuggaaagaauucuuuguucccugcccuaacucgguuaccuaauguagguaauucagcuggcaaccugcuuuacuuacugauugucccucuucugauaaaagcauaaaaucuaauuauuucaucuuuauuugcaagaguagaugcucagaacaacugcauguacccaguucuccuuugcacaauggucuuuucagagcaagacugcucgugcagagaguugucauaagccaaaaccaaaaagaauuuuggagugauuuuuaucaucaaggacauuuguucauccuucagaaagauugucacuagggaagugggggauaaaauugcuugagcccauugacucaaagucucuccagagucauagacugaauugguuuuuaaggaguaagaggaacugugagaggagacucccacgaccuuuacaaauugauccucaccuggucaccacuggcagguguagcugaucuuauggacaaaugguagaugugagcagguuaggauaugggaaggaaagacagcuaauacugggggacacucggugcuuaggaauagcuguugcaucugaggauggucauucaaaaagaacaaauacggauuaacuagucugucaucaggagugcaauuugauacuugguacugagcugaaagcagauuguagaccauacagaaaaagacaaacucuucguaaaccuucccagagacagggccuucuucuagaaauauucaugacauuuacuugaaauagacauguuugaggaugucuagaacuguacacuuguguuuuaagaauauaauucccuccaaauucaaaggaauccauggugggcaucguuugacaaacuuaguaaaacaaaauacaauaaugguaucaacauguuucauguguuuuaaagaacuuguaauuuugcacacauacuggugaaguccgacuuuuuccuaagaauucuguuaagaauuauuagaauuuauucaggcccuuuaagacuuaccagugaaacaccuacucaccaauuccuuccacugaauaaauugaauuuuuccagaaauguguaagcaaauagagaaaugaccucauuuuucaguguagauacagugcuauaggaggcucugucuccagaggaugacuucaauauuggaucuuaguuccaagaacaaguucacaaggccagagaagagggggcgaagacaucauugugaagggcaccuggcaagaaaugaguucuccaguagggacagcucccacagcuaagucacaugcacaaacuuguagcuuucugcucucuggccaaccaagugcagccauagcaucuuuauuguuauaucucccagauugugauacugucacaaagcuguugcuaggcaacaaaugugguuaccaggucucagcgaauagcugaagggggaaggcaaaguguugcaccauuguagaguaaccauagcaaugaccuacuauuacagacuaaagaauuaucauuaacaauguuaaaguaucagaggcccugaauucagagacuuccaagcagauucugcauaauugagugauugcaguugagauuucaacuguuuccuaaugucuaugagggaggauuuguaauuauuuuuauuuuaauuaaaaaauugauuaugaaguuauugguuaaauuauauaugcuaucacaaauauuuuuuuucuuaagcccauauuauuucuucguguauucccaugccuacaugcuaccugcuuccuuuuucacaaacuaaagguuccauuugguuugaagaauaguguauaauauucaacccaauauuaaaaccacagagagaaacuguaguaaaauaaccugguaaauugaaaaucuaacguuuuucugaauuccccgacugaagagggggccuaaaugcucuuucagugguucugcuuugaaacaggguuugucuggcuuuucuagauuuguucuaaaaucuguaaagcauguggcccgccuaggauacuuucaaggccccuggucuccuuuugaauccguccuuucauuaaauaucuccagugauuugaucccagugaccucacugagacagucguguccaacaucagagacuaggacaggccagaaaaagaacuauucccccccauucugccugggaagccaagacaccgaggcgcuccggggugggugugguggaaucgggauccugcacgcuggggaaaccaaucccaggccuggagaggugggugguuucugggcgggagagggaguggcccuucccgcugagcuacuggauuggcccugagggccucggggccccaggagcuccgggccguaacucuggggccccgggagcaaguuuuagcccggcgaggaagggcgggggugggggcgcgcuagguggcgcgccccggggacaccagggacaggcggaaccugggcgggugagcgggaggcgagcucgccggcggcggugcagucgccuggagggugggcuccucgccuccggccacacacccgugcgaccccucguaacccgguguguguuuccgcaggcaccgaccgucacgagcucacuuccuggaagagcuucccgucuaucuucaaguucuucgcggaagccucggaggccaagagcagcucgcagaagccggcccugacgcggcgcucgcaccggaucaagcacgaggagcugugagcgcgcagccgcccgcccgccgcccguagccuccuggcccccauuagauugcuuucuuucuccagcgcagggucgugauguguccgucuaaauagcguuuugcauuauuucuagaugagugcaacugucaaagcaauauggcuucagcggccgaguugccugcggcugagccgggccucgcacugugggccccggcgaccgaggcugaaagcgccgggagugccagcgccgggcgcuccuaauugcccggcugauccgcgggcgcggcuggccgagcggcgucugcgcgguccuaccgcccgcugcagcgcggucgccgcugcccagccucaauugugcccauuuuuaauccccuuuaaacccagcaagcuuuuauucuaaaccucaaacuugauuuuaaccagguuuuuuccucaggucaucuaaugagccucugucuuuuacacaaagccacacacucgaguccuaaaaaugccaacuuuaaauucagaacaugauggacuauguaguuuggggaguacaaguucuuucucccuauaacgacuuauuuucacuucaacccccccccccaaaaaaaaaaaaacuguacaugaaguaccgaauccgaauccucauuugugcccaguugaacuccagucuuuaugucucugauuucaggagggaaugucgaaaggaaaauauaaacagaucuuuuagauguagguauaagucuccauguucagugaauuuuccaguuacuuauaagaacugaccuuacuauuaaaauauauaacacgaugugugcgccaaugcagggugauggugguggcuguugauccuuacaaccuguacuuucaccuuucuuguagcgugcccugucagaugcaggacuuuuuuacuaucaucaagaaaauaaaacuacauaaccucuuucuuccaaaaguccaaguaggguuaaugugcuucaguuuucaucugcaguaggaaaagagaggcguagugugaauggguugcucuuuugaggccaaaauguuuacuguucucuuccugugauagggcgcugcccuguaauuccaacaguaaggccaacgcggaagauaaaauaaguugacauuuuacuggcuuuugaauuaaagcauuagacauuaauuacuugaaauuuuuaauuagugaagguuauauccagugcauggugagauugugauuuaauacauccauccuuuuuaaaaugaaugcaauaaguaauuugucuaccuuguuugagaccuugagacaguauaagcaaaaugagucugaguugcuaaugacagggaagaaaaccugagcucagccaccucaugaggaauacucucaucccaugaacugauuuuagcaagguuuaaacugguaacaugucaugcucuuugcacaugcauacauucaguaauucuguaaggacaguaaaguccucagugccauggcugggcaucuccugacauuacuuaggcagaaguaccuuaggaaaaaccaaaauggggcuuucuccagcuuuugggcaguuuaaauauguuacuccaacagugucaagcacauugaacugucauaguggcccuuuacauuucugcuuuuagaaggauuggugaacucugugaaaauaauaucuuuccaguuacugggcuugaaacacuggugugcauugauuauauuuuaccaaauguuauaaauugucugguguuuucaguaugugaaaauguucacaagaaagugaguuugcaacauguagagguuggaaaaaccuaugcagggcuaaauuugcuagacuucugcagcuaaauuaaagcagaguuaaagugcucagcuuaugaaccaaacaaaaguauccugcuccugcccuccggguuccucucugcaacucuuaaaccuuauucagagaaagucucuguuuccuugggaugaguacuuuacugucacuggauuguaaccuugucuucugucuagcagagagcuauuuacaaaguuacauuuuguaaaugucuguuacuacuuuugaaucugugcuauagcaacccagagggagccaggcgcagcaccccagaucaccagcugaugagugacaaaugauucuuuacaauguaggauuucuugaccuguugauuggguugcuguugguauauguguaaggauguuauucaccucagcuuucuugggauaacaacaagcacuuggcaguacccugccuacagggaggccaggguuaauauuucucaucuggccuucucccuauuuuuauucuaggcacacagugguagaaagguaaggugugagcuuuuuuaaaaauaaaucuuauacuuaguucuuaaaguaaauagauggaaagagacauaaauuggaaauucaaaauagucugauucaagcuuuggagcuuuuucggguaccuaacacacaguccuuggaagucaucauggauguuugcuagaccaucuacguguaauaauuguucuuuucucacaauucugccuugugcuuccugaaaugcauuuuuguuuguuuauaugucaaaaauaauaaaguguggaccuccuauaaucuuguuuaccauuuuaaaauaaaauuuuccaacaaagcaac

SEQ ID NO: 7137 - RNA, 526 nt, Mus musculus
acaucuuccaguaacucuccaaaaugacgaacacaaagggaaagaggagaggcacccgguguauguucucuaggccuuuuaggaaacauggcguuguuccuuuggccacauacaugugaaucuacaagaaggguguuauuguagacaucaagggaaugggcacuguucaaaaaaggaaugccccauaagugcuaccauggcaaaaccagaagagucuacaaugucacccagcaugacuugggcaucauuguaaacaagcagguuaagggcaaaauucuggccaagaggaucaaugugcggauugagcacagcaagcacucaaagagcaggaacagcuuccuaaagcuggugaaggagaacgaccagaagaaaaaggaagccaaagggaaaggcaccugggugcagcugaagcgccagccugcgccacucagagaagcacacuuugugaggacuaacagaaaagaaccugagcuguuggagcccauuccauacaaauucauggccuaauguacacaaagaaauaaag

SEQ ID NO: 7138 - RNA, 2163 nt, Mus musculus
ugaccgugggcccgagagcgcucuugaauaaaaauccucuugcaauuugcaacaagaccguuuucucguuggugauuuuggggugucgccucuccugagucagaacgugggggaguccucacguugugggucuuucauuuggugcauuggccgggaaacgcgaccaccccucacacccgagaaccgacuuggagguauggggauccccucuugugugugugccagccgguguaucuguuuugagugucuguuuucugaaacgaacauuggaacaugugcuuguuauguuggguuguuugugucuuguccuauguuucugaagcacggcaaagucugaguuuggauccaucugaguuuauugaauuugugucuugguuucaggguugcgagaucguggguuccagucccaccucgugcuuugguuucaggguuacgagaucguggguucgagucccaccuugugccuugguuuuacaccuggcagagugaggaacaagugugcuucucugguuuuggucgucuagguagaaguggacgacgguguuuguagacgauggggugaugggguuuucugaaaugcgcgcgucuguauuugcagcuguccuuuugggccguaaggaccggaggacuguggucggcagacgugcuaggaggaccacaggcuguggcccugggggacgcccugggagguaaggagagccagggaugccuggccgucuccagaucggucagagggaccgaguucuguugaagcggaagcuucccccuccaacaucgucuaauucuuuugccugcuuguggaggacaagaaagggucgagugugucuggauuuguugguuucuguuuuauguguuuuuguguacguguuuagagcuaugugaaaaucuagagaaacaaagguaauucucauaggugcuuuauacccugacuagagauaguuuacaccugagaugugagaaaauggguuuugagaaaagcaguacucuccgacuaucuggagauaauuugguaauaaaaaaauaaaauaaaauaaacaguauuaauuggucuuuggaacccugcaccuguaguuaggaaucuaguguggcuagagaagcccugcuaggcacugauuauaaaugcuguucuuauagggaccagcagcuucucaaaguucuaugguaagggaacagauggcuguuuuuccuacaaaaauuggauucaucaggugacaaggugcuccucucuugaaauuacagcuagaaaaaaauuaagaauuuuguuugguuuaaaugggcaacaugcagcaugagacaacccaugggaacaggucucuaaagauacgccugaauuggguaauauucuguguaauucuuauccuagaaaucugauuuauaaaagauaagauuuaggguagugucuuugagauauauuggcggcuacaccuucuuguguuugugugcaggaacggacagccaaacuuuguagcaaguaauguuuuuggaguucauuuuuaaagaaaauagauuguuugcacuguuaaaauuggguuuugcuucucaaaauugugguugugcucucauguuacaagagaaauugaaggcuucuccugaauuggagccaccagcuaaaucggcuccucuaaaaucuauaaagccuccugaguggccuaguccacaaccuuccccuuauccacagccucgaccccagccgccgagggaaccccaaaccccucggggcguugagaggaggaccgcugugaguacauggagccacagcgacccacagagcagaguccgggcugacucugguggacccgcccaaacuuuaaacccuucaguacuggucauuuuccucugcugguauuuauaacuggaaaacuaaccacccccuuucucaggauccccaacgccucacaggguuggcggaguuccuuauguucucucaucagccuacuugggauuacugucaacagcgguuacagaugcuuuuaacaaccgaagagcaagagagaauucuguuagaggcuagaaaaauagccugggagccaacgggcggucuacacagcuacaaaaugagaucgacaugggauucccuuugacucgccccaguugaaacugcaacauggcuaaagguagggagagcuuaaaaaucuaucaccaggcuccggucuccaaggugcc

SEQ ID NO: 7139 - RNA, 2097 nt, Mus musculus
acugagacgagcaggagcguggagcagcggcuucucugcugcccugacuuuuuaagaaaucucaaugaacuauuuguagacaaucacugauccugccugcaugauuuuuuuuucuugcacggcaaagacacccaucaguguuaagugaagaucacaucuuauaugcgaucuugacuuuuuuuuuggucuuacauuauauuuuuauagauuuuguuauaaucauggugcugggaaagguaaagaguuugacaauaagcuuugacugucuuaaugacaguaauguccccguguauucuagcggggacacugucucaggaaggguaaauuuagaaguuaccggggagaucagaguaaaaucucuuaaaauucacgcaagaggacaugcgaaaguacgguggacggaaucaagaaacgccggcuccaauacugccuauacacagaauuacacugaagaaguagaauauuucaaccauaaagacaucuuaauugggcacgaaagagguaaguuuuuaauuagucacuacauucgacuucuuugcaugagaacuuuaaucucauuuagugcaguucuaaucggcaguuuguuaaagguuagcaaacuuagaagcuguaguuucuccuugacguucaagcguguuaagccuuaauccaugcaggcgucugcaaagugagugcaaacugcacuuaacuacaucuguaaccggcuucauaucugccauacgcaccuuacaacguguuuaaaugugacuccgucguuuuacuaauauuuucaaauucauuugcaaaagcugcaguccgauauuggauuuccuuuauuuuacaaucuuagauacagaaaugagcuccaauaaagaacuguagugacauuuaagaagguugcuagauguaucugauuuugauauuaacgugcaaacgacuuugaggacuugauuauuguucuuugauaaagggcuuccaucccuuauuuugacauauggcaccaacacccccacguguuuucccccuauuuuucccaauucccuuuaaaauguacaucaagcaucguuuauuucaaagaauaaugucuaucauuaugcaaacuauuaagucaguuuuagaagccauucggggucagugauuuucuucucggagcaucaugucuaacuuuggaacguggauucaaugaaacccauggcagacagauggaauugaaaaguauaugacacaucggauuuggguuugggguauaagacgaagauugaagcauugucaaagggagaagggguccugagauuugcaaucuguuguuuaagugccuacauuguggaaauacaggcgacuccaagcuuguuuuucuaaguuuccacccuuuguuagaagcgguucaauccuguuucggaccaguucugggggauggugaggaggggcgcuuguucuccucucagcagauugguuacacgcgucaggugguggcgaugacuuaauuccuaguccaagaagaauauaauguuaaaacugguuauguaauuuguuucuccuuucuaaugcaguauuuuagugcaaauacuggcgacuuuucagauagaggaauacuuuguuuuuuuuuaauaucuaaaauguacauccuagggagacguuaauugaacuuaaggcaagugggaaauggaggaugcuuuaaguuacacagaauuaauguaucgucuuuuaaauaugaaggcgaagccaauucuuaggguuuacgcaccuacaccaggguauuccaaauacugaaugguucccuaguucuuuuuuugcagcguccacacggauggggcguacaaugccuaaugacagcgcucucguuuuuuuuuaaaaaaaaaaaaaaaaagggcaggcacaugaauuugcuuuugagccugcuuggacguugcagccuuuaaugaaauaagaagagacaaagacuuuugccucgaagaguucagacuuguagugggggguauagauagagaguucuguggacaaacacuugauccauugcaccacgaucucacgguuaggauaacuaccugcacccugcgaggugccccggcaagccuggcuacgcguggacgggcucgcagggcuggaauaguuucaaug

SEQ ID NO: 7140 - RNA, 15211 nt, Mus musculus
cgugcuggcgugggccugcgguuggccgcgggguucuggguuccccgccuccgcccgcgcccucgcaccuccgccuacucuacgcgaugacgcaccgcagguuugcggacguggcggcggcugucggugcggaaggcggggacggcggcgacggcggcgacgguggcagaagcggacccagacaccggagaaccuagagucggucaugaacgucuccggggccgcggcugugguggaggacauaaccgugucgccgcgccccugcuagaggacaggugacgguggcuguggggcggggcggggcaggacgucgaucggggggucaccguggggcgcuguccccgguucgggaaggacucuuaccucccgguuuugggcagcccuuuccgggccauucugccuguccccuuagcaucugcuccgaagcgucccagucugacgcggcgacuuagaaaucagagauguaaucuuugcgggggacguccggaggaaagggaaaaauaaaaauaaaagcgaguggaauggaagagggaggaaguuugcaguuguugcuuagguuuaaaauuggcccuggagaauaggaucggggugauucuguccuaagugcugaacuggcuugugcccugugagucuucucuugcucccugccgaaggucaagaccaaauauuaauaugcagcaauuaauauguaguaccuagggauuugagaggucgcuuuccggucuagaccggguggaugaaaacaugcucacgauacccauugaugaucacuuucaggacguuugucagcagugcaguaugcaacauguucuaguuuucugaagccauagauuccauagauaauucagagagguaaagagaauugaggcugauggcuuugauuccguguacuuucuaaucuuuaguagauugacaugucauuaccuuacugggccaaagugcagcuuggcacuuggauuacagaugaacagucagaccguaguguccagauuguuuauuuugcuuuccugucauuuuagaggaauagagacagaugcgcgaagacgggagucuuuugauuccugauuaagacauggugagggaaagacugauagaagaacacauuguuucaaauggcuucuggguauuagucaguaauuucagagagcuguacuaagaaugggagggagagcgcuuuagagggauagcauaccuaaggcaacguaaccacccauaugcauugcuuuagaucuaaucuuuucugcuuuugauggaugcuuuugaggaucugaaacagauacuuccugagguaguacauguauguauguaugcaacuugcuacugguuccacaaaacugacagacauccucuacaucuaagaugugggcuuuuuauuuuguuuuuagaaaagaccuagauaagggagugcaagcguccuuguagaaacaggugugcuccuuacuuuaaacugagaugugaaacguggcucucauuuagcuuggaucugucaaauuuggagugguuuuuggcaauaguuuagccccugugggagcagcugaagcaagcuacuaauauagcuguuaauaaauuaucuaaauagagacuuuucaacuuuuaaagauauacagugucccuguaaagcaaggucagaaacuggauuuuaagggcuggauuuuaugaaaugaaauagguauguuuuuacauagagaauaucaucuuuuuguugucugaguuuuaguugucuccugccacccucccuugucuguuuguuuuuuauuuuaguuuucguuucuuuucauccauccuucuaaacccauuuugcauuccaggauccaugcauaauuuuuugaugguuucucuccucccccuccccaccccccgcacugcuuuuccaaguuugcuggaagauguuaucuucacugagauaaacacacuuguguguuuaacauuuguucugcugucuuugaggaauuuauuaugauugaccuaguuugcuuucuguugcugugauaaaaaccauaaccaaaagcaacucuuauaaggacauuuaauugggccuggcuuacagguucagagguucaguccaguaagucaaggcaggaaaauggcagcauccaggcaggcauggugcaggaggagcugagaguucuacaucuucaucugaaggcugcuagcagaauacuggcuuccaugcagcuaggauaagacucuuaaagcccaugcgcacagugacacaccuacuccaacagggccacacauucuaauagugcuacucccugggccaagcauauacaaacuaccacaguggguuucuucggcuuauacaucuccauccauccuugagggaagccaaggcaggcacugagagaccgugguggaggaugcugcuuaguggcuugcuuuccauagcuugcucagccugcuuucuuauacaacccaggaccaucagcccagagguggcaucacagagggcucuuccauaucugucauugauuaagaaaauguuaucucaguuccccccaacccccaacgcccagauuugcccucaggcuccucggauggaggccuuuucucaacugaaguauccuuuccuuuucucagaggacucuaguuucggucaaaccgacaaagaaaacuacccgaaaaauagccaaagcccaucucugugcagcucuucuguccuccagguuguaagagaacgguacuauauuuagcuguggagacuuuuuaacuucuuguuugaugacugagauacauuggaguuugaauuuuguuuuaucugcaaaagccccucuuacuccaucuuacucuuacauggauaauaauggggaagccaguacugaaugagaagucaguuguuuuagguuccagucucuuuuuaaugagaauuggaccaaauugaugaagaugugcugauagugacuguauuaguuaggguuuuacugcugugaacagacaccaugaccauggcaagucuuauaaaaaaaaauuuaauugggcuagcuuacaggcucagagguucaguccauuaucaucaaggugggaacauggcagcauccaggcaggcauggugcaggaggagcugagaguucuaugucuucauccaaaggcugcuaguggaagacugacuuccaggcaacuaggaugagggucuuaagcccacacccacagugacacaccuacuccaaccaggccacacucccggauggugccacuccuugguccgagaauauacaaaccaucacauuccauucccuggcccucauagacuuguucaaaaacaugagucuaugggggccguacuuaaacauagcauaaugcaaaaugcauuuaguccaacuuucaaaguccucauagcauauagcagucucaacaauguuaaaguccaaaguucaaggucucuucugagauucauccaacuaauuaacuguaauccccaaagcaagacaggaaaucagcugggcaaacuccaaacucugcaucuccauggaugaugucaaagcagucuucagaucuccacuccuuuuucauauuuguugacuguaacaaacugcuuuauccugggcugguucaacucccuguuagcagcuuuccucagcauguaucccauggcucuggcaucuuuaacaucuuugagucuccaaggcaauuucaauguuacagcuucuuguuucagugacugggaguccacuugaucuuuuggacuccuccuaagggcuggcaucacuucuccaucucuguccucuguagcacucuaugcucagguugauccacuccacuacggcugcuguucuuggugaucaucccaugguacugacaucuacaauauagugggguguuccacuccaacuaggcuucaccaauagccucucauaggcucucuucaggguaccaagccucaaauccuuugcaugaccacuucaguccugggccaucaacuacagcugaggcuauaccuucuccaguggccuuccaugaccucucacagugccaagauucagcuguucuucaugaucccuucaugccuucaaaaccaguaccaccugggugauucuuacauauuaucaaguccagcugcagcgcgagguacaaccuuggcuaucucuggaacacagcuucuuugugcucccagaaaauacuucccagaagauuucacaucagugaugcuggucucuucauaaucacugcuaauuucuuagcuccagcuaaccagcaucaauugucccagcaguuccuagagccagagccacauggcugaagcugcaaguucugcugcuugcaggaauuagaacaugaccugcuuguacuauuacauugucacuggcuuucuguuuuccaaauccuucacugccuaagcuuggauauccugggucuugcucuguagauuggccuugaaugcagauaucagcaugccugucuccugggauuaaagguguguaccaccaugccuggaucuaaauuuagcuggguaggaucuugucccaaggucccacucccuuaaucuguuauuuccuagaacacaggauuuugcaccauuucacuuccugguaccccuuuaauacucaaaccauauauuuuauauuuuuuccuuucuaagcuugcuaugcuuauuuaaacuucucuucauaagacuuaaccagagaacaaagucucugcugagcuuuuuugaaacuuccuuugucaaugcaauuaaucugagucucuucaccuuagccucaggcagacuuuucaaacaagggcaaaaaguagccaccuucaccaaaauaccacaaaaacagucuuuaugccacauucugaaauucuucuccuuugaaaucucuugggccaggucaacacaguucaaauuacucccagcaacuaagucuuccauauuccuacuaggaugacccauuaagccccauuuaaagcauuccacugcuuuccaaauccaaagucccaaaauccacuuucaaauaaaagcauggucaggccuaucacagcaauagcccacucccaguaccaacuucuguauuaguuaggguuuuacugcugugaacagacccuaugaccauggcaagucuuauaaaaaacaacauuuaauugagcuggcuuacaggcucagagguucaguccauuaucaucaaggugggagcauggcagcauccaggcaggcauggugcaggaggagcugugaguucuaugucuucauccaaaggcugcuaguggaagacugacuuccaggcuacuaggaugagagucuuaagcccacacccacagugacacaccuauuccaaccaggccacaccuccacauggugccacucccuggucugagaauauacaaaccacaaaccaucacagugacuuugaaaguaaauaagauguauucauugauaaagaauucuuaguccaauucucagugggcauguauauuuuuuguaacugaauauaaaugucuaaaauccuuucagucuuuauggcauauaaauugaauuugaugagaguuuuagguuauaucgaaagcuuccaaagaaaaaucccuggucaggagcaaaguuaugaccuauaacagaguauauacuguaguguacuaaacauuaauucugaauuuaccacgggccagugaguaagaagugcagagguacguuaaucucaugugagucaaaugcagaacaaaaaaagguuugaauuccacagaaguauugcagcuucuguguguauaugugguuguacagaccaaauauuuugaguccuucagaacuagaaguugcagguagucaaaaauucuuaggacauuaaacaaaauuuuccaauuuucuuccuagucauagaauaagagcuuaauauuuugacaacaaaaaguacaguaacuuucuaguuuaaaauacaguuauccuauguuuuuguuauauauauuucguuacaucacaccuucuuuuauuuuuguuauuuauuuauuuuuuuuuuaauugagacaggucucacuguguagaccagacuggccuugaauucauggagacaucugcuuaucuguacuuccccacugcugggaugcagggugugugucuccgcacacagucauagcuucuuacaacagggucucaaccacgccuggguucacaucccuggaggggggcuuaugaacaguccgacaacaaugaaaggguucugaguuagaguaaccgaagcugaggugagagccagguaucggggugucucuggcauugcuuacccugcugcaugccugacugacugcagccucaguucugcccgugugugcuugcucugucaccagauggcaugaugcuaaucaauagaguucagggaaagcucccuacuuuagaaaaacauaauacaaaacaaagcgguguaagauuuuucuauugucauuucucagcauuuaaguaucaaacaaagauguuuuggauaguauuuuacuacaauguuugauuuuuuuuuaaaaaaaugcuguuagaggacuggcacauguacaaagguucuugcugccagcacuggugaacccacaugguugagagggagaacugagcaucugcaguuguucucugacaucuacuugugacagcgcacacacuguaagcaaacgguuuauagauuuccgaauuuggaucucguaggaaaugguuaaaugcauuuauuuggcuugagauuuuggacaguuuccaaacuggcccaaaccaugggacauugcgugcuagcauugaagugaaccugcaugcuuagcucuggcaucuugaauccuuuuauugauaacucuggaagugcuguagguucccuucgugcugcagagcaccaaaagcccagccaaaguucacuuugcauauaauguuauuacaucauggagcuggaggccagaggacagguuguagcuauuggcuuuccuccuaccaugacucacaggggugagcucaugugaugaggcugggcagcgagcaccaugagcuacugagccaucucagugugcaagagugagcaaauccgugugugguagaggagaaaccaucccagugucucgggauucggauuuacauuuugucuuuaguaagugguaaaauuauagccaaacaaugggcuaaaugaacaucuugauuaccugcuguagaaaccaguaagccugggguuguguaaaagugucuaggugaacacagaguccugaguggaaagugucagcagugcguuaacugaccucuucccacgcugcggaccccacuguccgggugugugcugcacuuccauaauuguagagccugaaccuaaaucccacauaacaaaaacaguauuaggaaaaguagugccuagccuguaagaugcauguaagucacugaguggaucagccacauuucaagguucucucuuuccuucccccagcuagaacgucauggcggggaggaaucagaaccggacgguuucccucccaggaauucaggccaguggccauguacuugcuuuuggaaauuguacagacaaugacauguuggaagaagaugcugaagucuacgaacuucgguccaggggaaaggagaagguucgaagaagcgcaucgagagauagacuugaugacauuguuauauuaaccaaagauauccaggaaggagacacucuaaacgcaguagcccuucaguacugcuguacgguagguuugaauuuaauuuauguugaguaaugucauccagaacaaccgauuuguucauuagagcaaccaggauugaaguaaauucuguguccucuuuccuucuuccucccuguaccuuuuguuaguuuuuuucuuuuacacagaaaucuccuaguccuguggacaugaccuuggucauaauuuaagggaguggaugacugacucucaguucagccuuucacuuugguguguuucuguacuuuuugugugugugcuuguauauguaucuauacagauaacauauuuaaagguugauaaagaauugauauauuuuguucuuuauuuaccguguauuauucugcaacuugcaauuuucauaucuuagauaucccuuauaaccuuauagacgucauuggaggcuagaagagggcuuugguuuccccuggagcuggagucacaagcuuuguaaccugcccgauaggguugcuugggaccaaacccagcagcacaugccuuuuacuccugagccucuauaacccuuucuuauuucuaacauauaaugugaacuucuauauccuucuuuuccuguuuaauauugccauauuuucauaaauauaaaauauuuuuauacuugaaauuccuuuacuggugaccuguuuauacuacuaugcaguaagaacucacauuuucauacauuugcuguauaaaugucucuuuguauauaugcuuaaauaagauuuaaaaaaaaccacaacuuccuguggccacacuauucuauauaauauuuuuucagguucaacuauugcaguuauucauaguaugugaaaauaaauuauagcuuuagauuugaagauuaauaauaucuuucauuggcauguuugugaugagguagagaugagcaccaggcaucacuccuuagccgccuuuuguacagcagcaucauugcagucacugagcacugagaggcaggcucacacugaugagcuuuggaggagaggagcuggaucacuuguacaugugauaaccuuuuauucuccugaaguaacuguugucuguguggcuuacugcuucugucugcuaggccugggagcuucuagccucccugcaaucuucucuaggcuuagaauguuuuuucagccucugagacuugcugcugaauaaggucacccuuucuuguucuuucugaacccugccuggcugguucaucucagcuguucaagcucaaauuccucucucagcugacuuauucaaucuggcuuuucaauccuccucugaguuguucugcuugguuucaaacuaacucuagcaaucuucucuaaucuucuggcuccaucucauugucuugcuuuuucugucuaccugugucuagcuuguucucucuucgaccugucucuguaaaacuguccuggucacacugccuccuucucccucucugggcugcuccacucucccucuuaacucuacuguucuguuuuccaugaacucuacuguaucccuguacuguacucucuucuuccuguacugucugucucucccuuaaguagcgucccucuccucucaguuggacauauccuauucugucacuuuuucugccacuugauuagauaucucuuuaaaacaugcauguuuccuucuacaaacuaacuuuaccuuuguuguuuggguuguauuccagccagagggauuaaaagugugaaugagucacacccuaacuagaagcagauucaaauauccugaaacagucgcucauugugcucccuugugauggaaacucaaccugcaaagaaacauucucuuauagaaggaccuguguugcucugaaggugcacucaggaauuauugcuauauuacaaauauaugcugcuacaaaacagugaauagggaaacaaaagaucagaguuggaagacuaaacguguccacauuagcauaacagaaagcaugauucuguaugcuuagagauguagccuaaguacauggugggucuuagaugccgagaacauagacuaccaagcaguucuuagcaaagcagauguuaagacagcguggagccaugcuucgggcuugccacugagucuucauuugucuuaagacaaaaggggcugauguagacaggcaacaaguacucuucuacccucucaccuccugguuagucuacacuucucucaggagucguccaaaaacacgcuguacaagacuuuguccagucagaugguuuuugauuucccaaguacaggccacuaaucugguucuguucaugagcucccucuuuaacccucugcuugaccuccugacacucacugcaggcuucagagacucauauugcuuaauagucaguaaaugcuaauauugcauggauaaguaauuuaccacuacaaguacucuuuaucaaucggaacccaugaauaugcccaccaaccuuauaagguagggaaucuuaugauuggcacuuuacagauaugaaagguuucucacccugaaccacguagcuaauagaaagggauugucgugcuucagacacagaugugugcacaugugugcaucaugugauacugccuuccucaacacucuuuccccaugucucacacacaugguguugcacaggcgcccuccucucacuuuuccucauacauaaucuuuucugugacucuauccaagucucacauccucagaagaguuucagacaucugucuccaccccuccugagcaugacucacuuguguaucucaggcaccugaaagucacuguaucuagaucugugugcauccucuucccacgaucuagccucuucuguaucacccauggagccgaccaggccaaaguucuguccauucuacaucucugacauuagcuggguaccacaggauaagagcuugaguguugacuuaaauguaacaaauggaacuauuaaagguagggagagaaccuggcuaauggugaugugagaaacagcccauccuuucuuccccaucagagcagagaggaggugggguuauaguguauauaaagaaaccacaggccugguguuagaguaacgcuuggggcaaauuacacauuaagcaucaaguacauguuucucacauuuuaacucuuugaaaguacuauacauauuagaacacaguccaggaauagagcugugugaggagaauucugagugcuugugagaauacuccaagaaaacaagaaucucauuugcuucaaaacccagaguuguuccuggaauuguaguagacagaagcgaguuuacuucagacguugucauucauacuccuuuaagagaaaccacguuuuuucaaacauuuguggcuuguccuugugauugugaucuuuauuccgauucuuagcccucggaguauaaguugucggacacucugaauacaucuggcuacacaucugccuacacaucugccuacacagcccgagcaggaaacagagcuuuaauauauucggugcagcuuuuccugccuagagauaacuaaaacugcacuguggcguuaauggcauuuuacuuccgauaaaaauaaagccuuuuuaacuggguaaguuaaagugcuuauacucuacuugucagcucggaauaaggaacauugguacuaauaauuguucauucacacauuccuuguggacauacguuaccugugguacauuuguaugcuguacgaagagaaacagcagaauagaugaguauuaacuaguguuacuacuaucuaggcgauuacaccaaguuguuggugauuuccuaacaccagauaacuuuaguguugccauucucauauacaaggaaaccuacaucugugugugauagcagcacuggugguaagaauguaacugaacuguuuucucucccaagugagugaauggaugaaggucuaguuuuagaauucaguucaauguugcauuuuucuuuuuugcagguagcagauaucaaaagaguuaacaaucucaucagugaucaagacuuuuuugcucuuaggucuaucaaaauuccaguuaaaagguuuaguucuuugacugaaacucuucauccucugaaaggaagacacauuuuacauccuccaccuguuccguauuuucaagagcaagacauugugccagcugaugguucucuuucuuccagugagucagccggcaguuuccuaaaagaaguggaccgagacauagaacaaauagucaaguguacagacaccaagaaggagaaccugaaugaagucgugucugccuuaacagcacaacagguccgauuugaaccugauaacaaaagcauucaccgaaaggauccguauuacggagcagacugggggauugguugguggacagcuguagugauaauguugauaguggguauaauaacaccaguguuuuaucugcuguauuaugaaauuuuagcuaaaguggauguuagucaccauucaacaguggguucuucacacuugcauccaggacucacaccuccaacacagcacagagagauggaaaaugaaauugguccaacaaaaggaauaccuguuggucagcaagaugaccacaaacuauauaggcaagacccucaggcacaugaugcucaacacaaaacguaacagugagcugcaucaguguuaguggucaugugugcauauggaauauggugacucacaugcauccgacaacugcuucgaagucggaaucuaggacaucgaagaugguuuguuuuuaccuuucuaaaaaaucccugaacuuuuacaaauggacugucuauagcaccugcauaugcuauauugaggcuggucaggccguaccccugcuauaucagggcuuaaagcagaaauaauuuaaauguaugucuaggaauucuaacuuagaagacgcugucauuuuucuuacucaagauuaguuauguuuaaauuuuaacuuuuaaaagauuaccuuuuaguuuguuguucaugucaaggauuccaaaugcuuacaacugaagaaaauuugauaccauaccuaccaccaaaauauuaauuauaaaaguuuuaauucuaaaauuauuccugacaccaaguacuuaacacuuaaaucugaaacuuuaaaaauauguuuagcauaugugccaugaaagcaaauguagaaacagauauggaaacauaguuuauaauuugcauaauacaggcuaagaaauagauaucuuaagaccccccaaauagugucauuggguuggaaacuucccauuugaucacacggacacuguaauucgucaagaucuauuccuuaaaaaaaggaauccuuuaugacuagcucugcaaccucaccuccacuucuucauuuuuaaaaauacuugugucugauauuugaaggcacuuuuguaguucuuugaugaaguguuacacagaaaaguauauucagcaaaucccucuuuauauacucaacauacuuauugcuguuauaaauaguaacuuaugccuuaauuaacaccuaacgccuuacaaaguuacuuaacguaaguucauguacacuucacaaucaaaguuugugucagauuuuauugaauaggcuaucauuucacaggcuauauacauuugucugucuucacuuuugagcauaaaugaaugaaggaaaaacaaauuuguacaaccugccucugaagucuugcagaagaaaaugauucauuaagcaaaaaugaguaagcaagacuuuuacacuagcaguagacggguugcuuuauucggcacucuguugaccucugcuuuuccaaaaagaaccuguccaauuuagauuauccuccuaaugugcaucauccaauggagaaacauaugccaagguguguggcguggucaaaagggcuuaauaguggcauuuucuacaucuaaugugggacaagcaauuuggcuaauuaguauguauucuaaaaauacacuuuuagggaguggggucugauuugcguggguuuugugaaauaaagugcagaccguaaaauaugucacauuaccucauuuuuuagacucuauuuccuaaaucaauguuucagcuuuuuaaacauuuuguauaacaaauuccaauccugauacaaggaauuauuaauaucuauuuguuauauuugggauuuuauaugcuuucagaagaaaaagcauuacaaaaagacugacauggaagucagucauuuuaaggccccuacaucagagcaguuuuagaaauuuuuccuuauuuaguaauagguacauuuugauaaauugauccuugaguaaaucuuauuaaaaauaauuuuuucacauaccaugugcauuuugaaaucagagugaucuuuaauuauguucaguguuaacacagccaguuuacauuuuaccuauauuaagccugcugaaaaaaaucaaguuuuauaguaaaaaaaaaaaaaaaugcagauuucagggcagaacaggcuacauaaccucuuuuuccaucaaauagaguugugauucuuuuauaggugguuuuacuuggaauugugaucgaagggucugaucacuuauauuuaaaggaguagguauauuugcugguuaaaauaguuucugucuugagcacucuuucugaaggaaauacaacauauauccuuaggacacaaccaagcaauuuccuuuuccuauauaucuuagaaucauuaauagaauaugauucgauauguagaauuaugcuuucaucuuuaaaagaaaaaauuaagcauuuaguagaauuuuugaaaauacauuuaauguacauuugcaaacuaugccaauuuuuggcaacugcaaacuacauuguauucuaaacaucagcacaauugucguuguuacaauagaucauguccaagcccuugaaauuucuuugaggcuuuaauuuuuaaguguucaaguauguggaugcaguuguaaccauaagagaacugagucauagccauuggguuuaucccuucaccuaaaaacuuggaauugcaaauaaagaaaaaucugauacuguuauagggcaaaaucgugacuuugugaagacuugguacaugguugaguuucuuuuggaccaauggauaaauuauuuaaauauuuucacuguccugucuacaaaaccagguuaugaucugcuggccauguauagauuaagaaggaguauguaaucuaaaguuuccuuuucugguggauuuucauuguuaaagcuuuuuuuuuuugacucugcuuuuuggugguaugagacguucauuaaaugaaccacucuuuaguaacugauuguuagucuuuaguaaaaaaaaaaucuucugacauuaccucacugcagugcgaaggcuauagcuagaaacagaaguggagaucuagacucagaguauugcagaguuaaguuauuuaaauacugcauuaucaugggacuauuucuuauuuugauuuacagcacuguugcucaggaaaucaguauuuuuuuucuacguaugugcauauugcacuuagaucauagaaauauaugaaugcuuuauuuaauucacuugauguauguaaaaaucuaggcaucuuuuguauaauguauuuuauauaauuggaaauguauuaaaccauuguuagcaugcacaucuguaaaacuguuuuuaaacuuuuggccuuguuuuucauauuuuuaaggauaugcaaaguauaauaaaauuucuauuuuauuaaucaauuugaaaau

SEQ ID NO: 7141 - RNA, 37502 nt, Mus musculus
cuguuccgcgcccucccguccgagccgcagagcgcaggcugcaccccaguugccgcagcuucugcagccgcagcaccaaggcaguaacgcaggcugcugaagcggggaggagacaccgggcaaugcugcccugcucgggguucuacugcaggggccgggagagaugcgugggaagcgacacacaggaccgcccccacacgggcagcggggggcugugcacucgccgccggagcccagagugaggccgagccuguuggaggcugacuacggcgccugccaagggcuaaaaagcucucuuccggggguguggccucgcgggagugggcggggcuuccagugcgcucugcugcgccguagccgcgugcgguguggggcgcgcuacuccggagguagaaucugcggcuccuugcuggaggggcugccggcuuucuugcuuccucugcugcaccgugugcucaagccucgagacuuggcuagcagguaacuggaagcuaucccguucugggcaggaggugaagaggguagaagggaguugauggggcacguggagaacgugguggccggguauccggagccaacauucaugaaagccccucuggagugacuuugggaaguaucccuaccuccccaaagcugcugcugcggucuuccaaaccguuuaaaguuuucguagccagaucucccagcuuuccgguggguuuguucucagugagaaagaagggaguuuauccucuuacaagagaagacuaugcaaaucugacgacuguguuuuuucuucauucaaaguuuggcggcaguuugcugauaagggcauacuuaccgucgcuucuguuuucuuaauuguuggcacccuugauagugaggagagggguuggugauaaaauuuuucuuuaaaaagaaaaaccuaaauggccgucauaguucugggugguucuuugcucuuugaagagagcagagaaaguuagagcuuaaggaaaggcggagcacuuugaggggacaugaaaaguggauagggacuggguguggccuugcaagccaccagaaaucacccccacugucaguaucaagucccugcgcuugcacccaaccacuagcuauugauacaucuauuucggauuaagaaaucccuuugagaauuugacuaaccuucagaaauuauaaagagacccacgggagagcauuauaaaggauaauuaggaagauucuuacugugguaucuccuaauaaguuuccuagagggagaacuguacuuccaacacuccaaaacucucugguggguguaggagcaggucacugcccuuuugaguauuuugcuaaucucaucgguuaugcaguugggaccauucuuagcacgagugccucagcuaaauggugugugacaagcagaaaacuguuuaaaaacaaaaaaaagucugaugugaguucucgagaaucugaggaagcuaacaccuguacacaaauacuuguuauauaaugcaaaaaaaaugcaaaaauuggauucuacuuauagauggacuagugaaugauugcacuggccuuaucgaaugcauuuucugcagagaaacacagugcccucuguacuuuguuuuugcugcagaagggggccacucgguaagauggcacaguguuguuucuuggccauaagcucagaaagaauucagagaugacuaucuggcuuguggcaggcucuagaguccuuuggaccuacaguucccaaugacacuuuguuuucuacuuuucaguaugacucugcuucucaucguaauuacauuuaagcucagacaguccugagagaggcagaacuucuucaacuaguuuuucuggccugguuccugcuucauuuucacaccaccuaucagguucugacagguucucuaaaguauauuuugcccacuucccauacucgaucguaaacuccauuaaaagcagagauguuauuuuguuugccucuguauuuccaacagugagaggaugguuuggcccagagguuaggcuuagaguugggucuuuaucaagaccucaguggauaguuacuuggugagaagcagaaguuaaauguccuaagcucuguuaauugaagagaaugacauaucagacgauuagccuucuguuaaauugaugagaugaauuguuagggacauaacaauuaucuggacauaaaaugccuacgauguuucagagggucgauguuaaaggccugagcuaacgcagaaaaaaggggaauaauagagaacacacugcuaauagucuucuguuaggugaucaaaggagacagccagaguggaaugagucaggcucgugauuagagcaaguuuaggucauucuucagaaagauacugugacuuggcuuucgcugucuccccuggccuccagcuacuugaacauuuaaaugagcaagguuguguguacaagaggauguuacauuucagucacaauuauaacucacaacauuuuagaucuaggaagaauugcagaggugagcgcaccaucuuccaggagauuauguguacaguugguuuggagagacuugaacaacgcccauuuucagaucucuuggaacagauucugaacggaaguuuugaggcaggacucugagcuggcagucaggcagcauccugaggugaugguggcagugcugcuuugucgaucuaguguuuucgauuucagauuuggggcuggaaagacgacccgaguucaguuccuagcgaccacagcgaguggcucacaagcccugauggccuggcauccucuucugaccugccugggcaccugcauuucuccgcacauacccacacacauuuuaagauuuugaaauucagaacuuuuugcaguugccaauuucccucauugaucugggauuaaaaaaauagguuguugccgggcaguaguggugcacgccuuuaaucucagcacgugggaggcagaggcaggcggauuucugaguucaaggccaaccuggacuacaaagugaguuccaggauagccagagcucuacagagaaacccugucucggaaaaacaaacaaacaaaaaaauagguugucaaugacuuuagacauguguucccagaaguaaaauauagguagggcauugaaaggccuuccuccgccuguguacgcucaccuuugguaggaauuguuugagaugagaucagaugaccuuuauaaccauuuccucuucuacaaagcaaggagguugaaucuacugugauucuucguuuagccaggaccaaauaaugaagccuuggaaugggucacuuauuguauauagagaugccaacauaucucaaaggagcggaugcuuugaaggaagaauuaagaguugcucggugccugaccaaaaggaucaaagcuaguugaguaaaugacugaguuggauuaggccguucuaaacaaauuuggguaaugaggaaaucgagaaauaaaaaacucuucauucacaaaguuugggagcuggggccaugucccaucuauuaaggacauugaagcagaaggauauaaauucaaggccugccuaggcuguagaaagggcucaaguccacacugggaaacuaucaagucuguccucaagaaguaaauauguaaauaaauagaaauuagaagacugagacuaaaguuuaguaguggacguuuaccagugugugugugaagcucuggguucaaccccucuucucccagccacacaccuucccuugaaaaagucugacagguugagaaaaaaaaaaaaucaauguauuagauaaauacaucaaauaaggauuuaagugauuggcgccuaggccucacuugugaaccuuuccuuucaccauucagucucuggcuacaggggaagaaaaugaauuuagaaaccaaguguuccuccacccacucccaccuccccacuguugaugugauuggguguuuccgggagggagggaaaccuggaaaggggauaacauuugaaauguaaauaaagaaaauauccaaauuaaaaaaaaaaaaagaaaaagaaaagaaaccaaguguuguauauacgggagcacccugucugcgacaucaaacuguaggauggcuuguaggcagugcgccuuguaaccaaugugucucaaaagcuagcauuggauucucugccggauacauuuacuguuguuaucaguuuaugcccaaugacugcaagauaaaaauaggaaguuggagucugcagagcuuauuucugggacaauauuccauuaaacaguguuaagucagauacucuuagagugaauuucccaaaccauuuccagggcccaacuucaaagauguuggcuuauuagguuugagaacuaaguguuccccaggacucaauauguuuuauauuuauauuuuuuaucucccaguuaauuccucugaucaagcaaguuugguaaacuuuuccuagauuuauuucuaaucucuaguuagugacauauucuagacuggcagguagcacaguggucuugucccugccuguugggcuccuacaggugcugagcaaaggugucagccccuuuacucagcagagguccuacuugaaagaccagcuuucuguagaaucagcaugguagagugacucagcaaugggaaugaagccauugugauauuuuacgucuuuuagaguagacagauggaaugagcuuugaaaugaaaaugaauuuccuaauggauuuuguuuuuaagguaacucguguaugagcacagucaaccccuaguagaguuccaaucagcaaaauggaaaaauuauaaaaauauaugcaucacucaagucugcaggcuuuuaaaaaaauguauaucgacauuuugcaaucuacgguggaauagcagauguagacacacguagguggugcugaugagcaagcagauccuacacuaaacaagacagacugguaguaauucacccacagaccauccugagugaugcagugggaagacaguauuucuauuuuuuuuuucaagacaggguuucucuguauauauagcccuggcuaucuuggaacucacucuguagaccaggcuggccucgaacucagaaauccgccugccucugccuccccagugcggggauuaaaggcgugcgucaccacugcaaggcugaagacaguauuaacuauccuaguagcagaagucaauccaaacucugaauuagcggcuaguguaccuguucauuggaaaucauagucaaaggaaugcauuaaacuaccuaggugugugauuuuuccaacccagaaucugggagguuguuacugauucugagcugugcucagauacauugcugucccuggggaaguauguuagaaaguccuugggccuuguucaggaccauccgaacauaagcauuugcaugcgccuuugugcucugaugauguguguauuacaggacagccaucuagucuuuuccauaaguaaauaguaagaauaacagaacgggagacguucuagaauuagaaggaaggaaaugucaaagacaucauuccaacugccaugugaauuuuuuugucuugaauaauaauuuuaaaaaacuauaaauuuacuaaugugcuaagggagaaaguuugggugcugauuacauaagagaugauaguaaggagcuauagcgauuauaucugugguuuacauuguuuaaugagcucucggauuagcaggcuuuccuguggccuuuucauccguacuuaguugugguugaucuucacacccuucuccugcuccccaacuucagacucuucagcccucccucuuccccuuccacuuuuguuccauguggguucuaucuuuauuccucuccucuccuuuaaggcucucuuucuucucccaucuugggccccauucuaguuuccugaccacuaacuauacucacugcuacagaaauacacauacgugaaaaucaugcagaaaaucaucugcacaugagagcacaugggauaguauugaucauuuccauccuggacuaccucaauuaauagaaguauuuucuagcccuauaaauuucccucaaauuuuauaauuuuauuuuuuauuauuguacugacugguuuugugccaacuugacacaagcuggaguuaccauagagaaaggagcuucaggugaggaaaugccuccaugacaucuaccuguaaggcauuuucucaauuagugaucaaggggggagggccccuuguggguggugccaucucugggcugguggucuuggguucuauaagagagcaagcugagcaaggcaggggaagcaagcccauaaguaacaccccuccauggccucugcaucagcuccugcuuccugaacugcuugaguugcaguccugacuuccuuuggugaugaacagcaaaauggaaguguaaacugaauaaacccuuuccuccccaacuugcuggaucaaaauguuuccugcaggaauaaaaacccugacuaagauaauuaugaaugaauuuauuuccauuguguauauguauuguauuuuuauuguccaucuuguguggauggaaagcuaggcuacugaugggcaccugggcuaguauuguguuuuugcuacuguauaaauagggaauaagcguggaugugcagguaacuucaucuccaugggcguuugaauaguccuuugggugugugccuaggaggcuguaauuggugcauaccauaauucuuuuaagaaaucucuacacugauuuccacagugguugcauggcauuuuuucccccucuguuagcucucagagaauauacauaaugaagaguuuuaaauaaccugagucauggagacucaggagagccuaaaaaagaagggccuggucauauauugauaacuauuggaacugaaugggcagauacaugggagcugauuaagcugucuguccugcuuguguguguccauaguaucguagaagucuguggaagucuaaaggccccaguuguccuuggcagugacaguaaugagauuauauaaucauuucuuaauuauugucggaaugucaaguacguagacaugcugggauaaauuuacaaaacguauaauguaaaauugugucugaaaauguucucauugucagcccuuauauaagucaaaaccugugcugccugagugcuucacagaagagagaaaacugcauuuccccagugacuggauuuuucuauguguagcuacagcccuagacauaugagguuauuaacguuggcagccaccaagccuuuaaaaguucagcgauuuaauacugcuuccccccuauaaaugcacuaacagguuggucugugacaugcugcguucuagguguguuggcaguucacaauuacuguuuaaagacagauucacugcauaauuaauguaauuucaagccucagagguggggcuuauggacauguguuuagcuguguuuaaacuaaacuauugagcagggagacuuccccgcagagcguccaucccagugcucucagcauaguguguguuuacagucaccuagaaggauuuccgaccacguaauuuugauuguuggugucagagauucacaaccuuuccgugcaucacaacucccuugggaccuucuuagagcacaaacuuaaaacacaaacugacggcuuccccuacaggugugcccccucugccuccgcuucuccucgcccgucuccuucccuagggaagaccccaugguuuccauuuuuaacacuuuucuggaugcagcugcuggagacugcccucuuuggaaacuacugcuccagauuucuaagcuauccaagaguucuagugauugcuaggguuaaaaccuuuuguguuggccccaugaugaaggaagcuuagauuucuaagcuuuuggaccaggccauuauaaucagaaaacuacgaagaaguagcuagccccuuguuaauuuuggaggcuugcccuuauuguuaaacaucacaaacccgagagagcgaccauugaugauggccuuucauccugccaagagaccugguuugaacacagcaacugcuauugcccuugcccccugcuggugugauggugagaaaggaggcugcuacacagacggaagugaaaguuccugcagucuucugugguugagaggucaaaucacuguccugggcgccccggguucaaugcgccucagagagaggcagggaugugcauuuucauguucacaguugagccuccccaguucucaugcuucagagcagggccucuuaaacuucucccagcccuugaccccugcuuaccugaguauuuuauauaacaccaaguauacagguaucaugcauauguagacauacacacagccacugguaaucacaacuugauauuaaaacaccuaauugguaugcauauauuuuuaccacuuauuaagacaaaaaguaaauaagaauccuaagaagguggauguuguuuaaaaacugaagucuugcuauuugccgucgaaggacagaaagcgucuugaaguucuucaggguuucuccauacuuuaguuuuaugaccaucaguguugaaagcacuguuggacagacggaguucaagauggcagaaaugucuuagagccuuuucugaaguuguuggaaauucugucuuaguccugagccuagaccuauuaaacaaguuuuuaugaaacuugagugagcaauuuuuuuaaaauuaaacuuccuaacaauggaaucuagugggguuuuuuuuuuuuuuuuuggaggcguggauauaugcugaagaggaaaaauagaagucuucguaagauauugacagucuuugucuuccauuauguuuuauaacagugaaagccuguaucucugcacuucauagcauacaggaguuccgaaucugagcuuagauggcucaagcacugagacaugagcuccgguggugagggguaggcaggccuguacaagccaagugugaaugugucucagguagugacugccugcauugaggcgggggugggggugggggacauagagcuugugcaaguugaucgagcaugcuuuccuucaguaacaaggcugcagugacacaggugagcguucaugauauauugcauuuauuuuugguuguugcucauucagaaaccuuuuuuauugucguuucuuuguuuuuaggguuuuguuuuuuguuuuuuuguuuuuuuugcucuuuuuuuagacacaguucugcaauccuauacagggucaguuuaagaugcaggguuuacauggugguacacaagucuguaccucaguguuggggauggagagaagcagaucauggugcguacugaccagccggucuccagcuccagguuccuugagagaccuugucucaaauaguggagaagcaaucaagcaagauguccaugguaauauagacucugccucuacccaugcaucccauacacaagcacacacacacacacacacacacacacacacacauacacacacaugcacacacacuccucucauacacacauguauacacauauacacacaagcacacacacuccucucacacacaugcacacacucccacacuccucccucacacaugcacauauucccacacuccuccaacacacaugcaaacacacauacucucacacuccuccaacacacaugcaaacacacauacucucacacuccucccacacaaauguagggcuucuguuagguguugugguuuggcuaugccuugcccaugggaagugacacuuuuaggaaucauggccuuacuggaggugguauagccuuguaagaggaagcguaucacagugggggucggcuuuggggcuucuaaacucaguguggaagagagauucagucucuccugguugccuucaagucaagauguagaacucuccuuuccuagaggaucacgucucccauguccugccuugaugauaguggacugaaccucugaaacuaagccggcuccaauuaaauuuguuccuuggucauggugucuguucacggcaguggaaacccuaacuaagacaggugugaugguauacuccuaugaugccaguauuaggaugcagaggcaggagaaucacugcaauuuuaggccaacagaggauguuucgagcuagucauggcuucacaguaaugcccuucuuguaggaaggagggaaaaaagcaagcgagcgagcgaucaggacucuggggugugagucgucuuccaggcucgucuguauauucagcacaaguccugaguauaugauaucauuauaccucucaaagcugagagaacauguuugcuuuccuuugaguagucuggaggcuuccucagcaguuacuauaguuacuauuauuugacuuaggcagaccuuuucagagccuuaugaaucccuuucauauuccuaaaaggacauuacagcccagaguccuguuuaacacucagauucuaggauaaauaacuuguguggaguuacaguguaugguuacuagcgcucaaacugacauaagauuuccucuucucagccugaauuuauccauccccucaugucuuccucuuccuccuuuucuccuccucuuucuucuucuguauaucugagaucuuguuaucacaccccagagauggagggaacuguaucaguuggcuguauaguuccagcuggaucucuaaggagaccuagggucagcccuuuccugaggaccuaagugaaggggcuguagccuuuaggcuacaucccuacuggugguggcagugaaacuuuagccgucagugacacuuguuccuaagcacauuucuuuuuaacugauaagaaaauguuucaaucuauucuagugacacuuuaaccugccuucagguccuaucagaucuuuuccuccacccaacccccacacccuuucuuucucucucucuuuaagaagcaaaaacaagaaacacacacacaaacagaaacuaaaauauacaugcaauagaccgguaagacagaacuccacaaagcaauauaaaacaaaaauucuuuuuaaaacaauuacgauuaggaccaucaaguucagacuacugggccugaggccuccccagagacuccauuggagaaaacuaaaaacaaauuguuacuuugcaagcaaguauaggcuguauugugccagugguuucuugguuaggggugagugccaggaucuacuugccuuccuuguuggagauggggauggggaugcagucugucuauuuuacucucuugguccuggcacccuguuuaacuugaacccgugcagacccugcgugugguaccacagucugugaguucaugugcaccaggccuguucugucuugaagacacauuuucuuugcaguuauccaucuacucuggcucuuacaaucuuucugccaaaauauacauagaucccugcauagauccucuucugcuuagauccuugaacucuguucaaaauuauuuuaaaucaaccaugcuauaugagggcuagaaucuuguauuuugcuuuaaaaugcuuguuuccuuuuguguaugauccagugaaucuuacccacuaauugugucuuucagcauugguccacacggcugcuauagcugcuuccaauggcuggcaauaaaggaagagggcgugcugccuacaccuuuaauaucgaagcuguuggauucagcagaggggagaaguuaccugauguuguguugaagccuccaccccuguuuccuguacgugugaugauagcucaguuuucacaauguauuuuuguguuucaugggaaagugcaguucugcuuagggcuugaguacaugcuaguaucaugauauccucaugucuaagaguaagaguauguugcauuuacuuugcacucaaacauccgauuauucucagauccugcugaagacugcuuucuuagaaaacagagaacaaaaacuauguauguauguauguauguauguauguauguacaauuuuguacaaacaugaugacuacuguguauacuaagaacauuuauuugaaaucugugucuucuacugaugucauuaauauauucuaauuaccaaaauaauauuuuaaguagccaaguuagguucaugaugccccugguguagcuagugguuuucuucauauucuguauuuguaaaaaagauuuugcuccuuacuaugaugccauguuugucucaucaaguuugucuuugcugcaucccuguucugagucacuucagaguuuguuaacugcucagggcagaaacguuucuccuacucuugcgauugcuucuaaacugaaugauagaacagcugauguuuccucuacauucagcugaaagcggaaguuuccauuuccagauggguaugugcuccugcuggaaaccaacaaucaugagugaccugacccugcauuaaucugucauguuucagauggagaagcccauuguugaaggacucguggcaguauagaauuagauaaagagauuaugcacuaaaaaaaauuuaauaguuuggauuuuuuuugagaauuuuauguaucauuuacagaaucuuauauaugauuccaucguuuucacuccuacucaucccauguccuccacacucccucucaaauucaugaccucuucuuucuuucuuucuuucuuucuuucuuucuuucuuucuuucuuucuuucuuuacuuauuuauuauauguaagugcacuguagcugucuucagacacuccagaagagggcaucagauguuguuacagaugguugugagccaccuugugguugcugggauuugaacucaggaccuuuggaagagcaguuggcacucuuaaccgcugagccauuucaccagcccccucaugaccucuucuauaauuauuguuguuauauguauguacuuuauauguacaacauuauacacacagguacacauauguacacauauacgcacagccuccuggguccguuuaauggugcucauauguaugugugaaggacugacuacuagaaacuggauaaccuaucaggggccuuguucuuggagaaaacugauuuuucccucucucuacaauaauuaguugacuauagcucuuuauggauugccaggggccgugucuuuugggguugaauucccucauccauguuggcguuucagcugcugcuauccuuaugaaggucuguuuugacaacaacacuguugagauuucauggaugugacuugugucaucucuagauaacacugucucacaucauguguccuuccuagucccuggguucuuuucauuucacucgcucuucucugaugccuccugaggcuuagguguaugccaaggacuagccucaacuuggagagggguucugagagaaggggucuuugagaacagugaaacaaauggguugaagucaaaucaugggguacaaacugauggccuguauucugcuugagauggcucccuagguagcucuuuguagauagcucuuagcucuguagucugcuugagacagcucccugcuugagacagcucccugguaauagaaaacauucuaaaugcuuucuggauagcucauagguuuucggaucaaagucagaaaagcugcuaaaaaaauuauuggauuuucugaccaagucaaugcuguuagaaaaguucuaaaaguaauuauuggguuuucugaugaaaaucagaaagccagaaaaaaauucuaaaagccauguuagcucuccaagcaguucucucuggauagcugcuagaaaauauucuaagagcuggaauuaccauuccugccucaccuggcccuggaccuaaacacccucugucccaggcugaacucagaaaucugucugcuuuugcaagcacaaaaacuuaguuggguaggaucuugcccugugaucaccacucccuaaaucucuuuaucuccuuaccuuguaucuuucugacaaguuggcucacaguacugcugccucuguucauuuagaucugugaugcuccuuauauaauucauauugcauccuuauuauuuugcauaguugagaaauuauauauuuuugaacucauguuuuccaaguucuuucccacagucauuuuaccauuuugcugagacauaggcauauccucaacuuauggauuugugcuguuucuaacuaucauggagucauuaaccuuggcaggaagacuauuccccaaaagaggaacaugaaguaauauauauauauauauacacacacacacacacacauacauacauaugagcguuaugcccacagugaccauugacauucauggaggcccauaccgugcuggcucucuuccaaggaugagaaccaugucacacuguucugccauggccaaggcagacaguuguagggguuguguuuuagauaugccaaaugggcauucauggucucuucuguugcaucuugaccaguuguggauuuuuuauaagugccucugagugcugcagaaagaagcuucucuggugaggggugaaagccacguuuacccauggauauaaggauaauuguauguagaaucugauuagaaauuauauugaucaagagaaauggcaguaguagguuuucucuaggaucuagacccucuucaaccaugaguagcuggcuagguguagaguaugagggaugagugucuuccuauugaacgggcccuaaguucaguuagacagcuguugguuauccccaaguuaaaaaugccaccacugcaucaucggggauauuuugccucugccccagucauuguuguucauaggcuuuacaucuggguucuuuggcaguucacauagcaccuucuguccaguagcucaagaggaaaucaucuuggaguggcuucccggucuuguuuccagcacuuuaauggucugggaggccgugaaggacagugauaguagccuauauuguuuuagaacuguuuuggauagccucacccaaagacugaaaggggcuuucccaagccugacagucuauggcuuuugggagagcauuaucauccuguauaaugcaugcuuauaaauaauguuucccuguggcuuucucaaacauccucagugucauuucucucuccuuccucccucucccucuguaucacucucccuucuucuccccaguugaaguccccccuuuccccuucagagaccuguauccuauuaucauuuuugcucuucauauuuuaccuuuaauacucaauauaccuugaaaacagagacaaauaucucagccauaugcauaauaucucuuuauaguggcuucccucaaauuaagaccacaagguguggcauuaucuccaaacacugggagaggaagcacguagcaccacuuucuuuugggaauaguacuaaguuauugcuagaaggcugugccugcccugcccuuccucaucuucucagccuuuucucacugcuggguucucaggccccagcugugcuggaccccuugcccucucaggucuuuguuccugcuggauucuuaucuuuaauagucugcucucuuugcaugaauagcugauugguuuuuguccauaacucuguucaaauaugacuuacgcaggaggcugugcauuuuuacccuguguagauuaaccacuaccugacccucaugucgcaucuucuguucuuuuauauuugucuucaugauuugaaauuuauuguccucccuuguuuauuuaauuguguguuucuucccugggguguggguucuguuauuuaguauaccauacuuucucaaggaaguagguuuuguuuuuuuuuuuaagauuuauuuauuauauuuauaugaguacacuguaguuuuucggacacaccagaagaaagccucggauucuauuacagaugguugugagccaccaugugguugcugggaauugaacucaggaccuuuggaaaagcagucagugcucuuaacugcugagccaucucuccagcucuaaggaaguaguuuugaaugucugaauagauugagaauucaucuguggaaagauacuauaucauuacccuguuguaucuuuaucuguauucugggaacccacuuuuuaaugaauauauacauauggucaaauacauaccuguauauucauauaaauaugaguauuguggaauacuuuuucuuuuuuuuuuuuuuuuaaauuuuuuuuuuuuuuaaagauuuauuuauuuauuauauguaaguacacuguagcugucuucagacauuccagaagagggagucagaucuuguuacggauggcugugagccaccaugugguugcugggauuugaacuccugaccuucggaagagcagucgggugcucuuacccacugagccaucucaccagcccauggaauacuuuuucuuaccuauaagguaagaauaaagaaggaaaugugcuuaaaaguuagauuauauuaguucaacauauuuauuauuucauuuucuuuaaaauuuugagaccaguuuuauguguuagccugugcugucuuggaacuaacuguguagcccaggcggaccuugaacuggaagcaguguucucgucauacccuccaaugcugggauuacaagagcgaacaccuccccuaccuagaggcucgguagcuuuggauuugauuauagccuuuacugcacgugaagcuuagucuuuaaauaacagcaacauuuucuagaacauggaaaaaagaaauaguaaaauucuuaauguauuucaauagacuuugucucuuacguuaaauaggauacagacuacaagccggugccccugaaaacgggagaagaugaggauuacaugcuggccuugaagcaggaguugagggaaacagugaaacgauugccguacuuuauugaaccacccgaagaaaaacaagguacgcaugcgcgucaggcccuuccggaggcuggcaguucaguguucacagaaggagcaguggaugcggggaccugugaucaugugacucagccgaucacccaacuugaaaaaacauuacuuaccagaauugucagaaaggaaaaacauuuauauuuuauuguauuguuuuucuucuuuuuuuuuuugcaacuuacucauaauacuuugugucuuccuuuuguaauacaauauuaaccuuuuaacauuuccuuaguauucuuagaaaaacauauuuuaaugauuauguuacuccauuagguggcuaaaauauuaauuagcacugauguccuccuguuagaauaaaguguuucuuuuuuuaaacuaugcaaugcugugauuacugccauugugcauaaauuuuuaauggaugccucugauuauugacaguuuaggcuaaaaaauuuuaaaacccugacuuuugucuuauuguugauguucugaugauauaaacuauguguuaguucuugaugcuaaaggcagaaaggaggaauugugcuucaaggcucaaccaucucaggcuagaaauggcaagugguguuagaggaagggagccugcuuaucagaugagcaguccuuuagcacaauaaaaccguauugauuguuagagagaucaauaucaucuuugaguucuuaaaacaacaucauuaaaacaugagaaauucguauaguagccagucacaccauuaguauuaaaaguguuuuuccuuccucucuaggauacauuggcugagucagaaaggaaguguacggugcuacaggucuuccuaagacacaggcugcacaagcuuagcuuucaaugaccuaccugcuugaguuuguuuauauaaugguuugaugauuuacuucaacaauagagagguuuuauuuuuauuuuuacuuuucugauuuuguugcaugcaugccuuugucgggacuuaaaaauuaaaauaaauuuuauauauuuuuaaaaugaacuaauacucauuuuuauuuuagaaauuaaaaaggcauggcauacuuugauacuauuaaaguuagacuuuccuuuagauacgagacauguuuagcugauaggauguauuuauucaaguacgggucuaaucaaaagguacaucagaucauucaagcagucagauuauucuuguagguagucauuguuuuaguuauuguucuguugcugugaggaaacaccaggaugaaggcaacuuuuacaaagaugcauauaauuggggcuugcuuacaguuucagagaguuaggucaugaucaauaugguugcaggcaugauaccaggaaaguagcugagagcucacaugugauccacaaguuacaggcagagagagagcuaggccaggucuggcaugggcucuuaauccucaaagccugucccaguggcgcagcuccuccaacaagacuacacuccuaauccuuuucaaaguguuccccuaaggaacacgcauucaaacauaugagucauggggccauauaaaauauaaaaagauauaauacuuaugucuuaguugggguuuuacugcugugaacaggcaccaugaccaaggcaagugacagcauuuaauuggagccagcuuacagguucagagguucagucuauuaucaccaagacgggaacguggcaacaugcaggcaggcauggugcaggaggagcugagaguucuacaucuuaaucugaagucugcuagcaaaauccucacuucuaggcagcuagggugagggucuuaaagcacacacccacaguggcacaccuauuccaacagggccacaccuucuaaaagugccacuccuuggcagagcauauucaaacuaugacauuccacucccugggccaaggauauacaaaccgucacaauuuacuuguuuaagcccauagaaaauucuauaggauuuuccaaauugauagaaguaaaaucucuucagaucuuccuuucugcuccucuuuccuauguaugcuuuaaaaagcucugugguuuaaaauacagcuuuaaguaagauguguauaugcuuauguguguauaggagcaccuuucuguucacggucaugauguuccaaggugucaccagaggaugccugaacccacagaucguacccaacuguguacugcacucuggugccaucauugaggaccgggagggugacauggggaugcuagacagaggcaaaguguuacgucagaaauuaauuuugucuguuuuguugguuuguuuauuguuuuuuguuuuuaucuuuuuuuaaauagggccucacuuugugucucugacuggccuggaacuugcuguguugaccaaggugcccucaaacacacagaguccagccaccuauuucuuccaaaugcuggaauuaaaauguguaccagcauccucaacuuaaaucaguuuuuaagaaaauaugaaagaagauuucagaaaccuucaucuuuauaguuauuuucuuauuuuuaacuuccaaugaacugaaaauucaauacuaauauguugcccuagccccagcccuccgagauagucugugggaguaggggauaagaaggcguagaaucagcagaacaaauuccaggagccagaucagaagcagaagcagacuaguuuauuauuauaguggagagagugccuuuauacccucuguccacguccccuuggucccuaacugcuuguccugcacagcuggcacuggcugcccaagucacaggcucugucuuuguuccucugugggugucucccuccggguguaaccucuccaggguuagugaaugcagaagccugcgccugccugcuguacgugugugggccauugcgggccacuaaucagaaagugcugacucacuccuccugccuuaacaaugccaaagagaagaguguuacauagaaaaaugccgagucaggaaaugaaugcaccaguaagcagaagcucccugcuugcagaugguaggcgaacgcuugagcaaaaucacagacugaauccccagaugacaaaaccuaagguagaucgucagggauaugagaaucagugaauacgcagauucaguccuucaggaauucaaaagaaaugugcuguccuuaugccagaaaucuuugagaaggauaucauuagagaauuuauaauuauuuggcaucuucuuugcuaaaaaugcaugugaccauauuucuuuucacuuugauauuuauuuauucaccaaaacugaucaucugugguuuguaaauagagaaaugcuaaagccaaaaccaaagacagagacacugauuagacagaaguagguuauauagaauuuugaaaaauuauugggucacucauguuuaucauuuucaguaaagaaaaaaaaagaauagcaccguuucucuuacucaagaaaaguguaagucaucaaagguuuuuaaauuuaauugauuuauuugcuuauuucagguuuuacagacuaaagaacaaacucugugucuuccauaugcuagacaaaugccauaccccaagcuuuguccccagcugcuccaaaguuuuggguuuuguuuuuaauucugacuuuuaauuauggaaguucaagaguuagaaguacaggugagguuaggacagaaucuaucagaaagccaucuggacuccuccgagggccucaaccuuccuaacgcagccaccuuuaagacaguuccccaugcuguggugacccccaaccauaaaaauauuucuguggcugugauuuugcuacuguuaugaauuaaaauguaaauauuuuuagaaagagaauuuugccagagggcuagcgacccacagcugagaaccacagauuuagaugacaugagcacaacugaaggucacaagcaauuggauaaaacucauucucaugugaaugugcaugagcugccacgcacgugcucugcuuguggggacagcuguuacacagucggcuccaugcagacgggcuuaucucuugugguuaaauuuaucuccaaaacaaguaaccaugagagguacaggcagauagcuuuucuuggcuucuuagugaaccguccgcgugagcuuuucuugucuuuguucuguugcuugcauuuuugccuucucuauucccagccacacuaagcgcacauuuguuaccaccacccuggaucuuugguuaguucuuuuuuguauagucuuuuuuucuaauaccggaucucacucuuuaggccaggcuacucagcagcucacacaccuccaccugcuucccgcucgucuucccuuucuuacagcuaaaccuccaagccacuuaaauuuuuuuuuuguuauuaauuuuuuucaugaaguauuuugauugcuuuuccucuuccucaauucuucccugauucuucccaccucuaaccuuccuaacuuuguguucucuuucuccaucucucucuuuaaaaaacaaaaaccaagaaacaaaaccaaucaaccaaacaaagaggcaagaaacaaauucucacaaagauacgaaaagaaaaaucauaacaaauggguaacaggaagaucaaauaauaacacacaaaaccaguaagcuuuggccaacuguuccugagcauggagccuagguguaucuagugaaacuccacuggagaaaacuguuuguucccuuugccaguggguaccaaugguuauggcugggaucucaugagcacgucuccuucuuagugcugggaccucaucugucuugaaccuguguaggccccauguaugcugccaccaucucuuggaguucauauguacauugauccuguugugccugaagacauugcauggaaucaucagucaccuccaaaccuugaggggagucgggagaggucaucccacucgggacugagagcuccacccacucaggacugagagcuccacccacucaggacucacagcuccacccacucagcacucacagcuccacccacucaggacucacagcuccacccacucaggacucagagcuagucagguugucucaggcugagaaccagguuuaagguugcugucucugcuuagcccgucauugcuaucagugaauuuuauccagguuacucuaguugaauuugucaauguugauccgguuacguguguuauauacaaauguaagaaauacaugaaaauaagagacauuaucuggugauauaaguugcuuuaaagaauagcuuaagggcuggugagauggcucaguggguaagagcauugaaugcucuuccaaaggucuugaguucaaaucccagcaaccacaugguggcucacaaccaucuguaaugagaucugaagcccucuucuggagugucugaagacagcuacuguguacuuacauuaaaaaaaaaaaaaaaaaaaaaaaagaauagcuuaaguuuuuguguuucuaaugaaugcuuuuucucuucucacccuagaugauauugaaagguauagcaaacgauacaugaaggucuauaaagaagaauggguaccagguacuauaaaauugagugugcuuuuacaaagauucaucuuaguuguauuuaugucuguguuugugugugucuaugucauguuugugagucccuuggaggccagaaggagucagauacccuggggcuagcaucccaggacaaggcugcugugaccucccugaugugguucuugaaaccaaacuuugauggaaggcaagcacucuaaagcaucucuccagccccuucaaauacuuuuuaaagaccaccuucccuaucaaauaccauaaaaguuuauuagauucuugggcguuuucuuuguuuuuagcugucgaaaaguagagucuuuuuuuccccuccuguaauuaauuaguaaugaaaaucacuuuaaggauaccuuaagucuuucucauaugcuaugaggcauagacaaguuuuagcuacuagcauaccauuuugguagaaagaugcugagaggcucguuguuagcauucacaggugugacauugcauagcgacaggcagaggggaccuuaaaggaaacucauuaaaccaguuuauguuauaaacagaaaacaauugucauagaaaugaaauaaccugucagggucucuuaccaauacugccugcugucccucagacaugcauccuuuuauaccugugacacuaauguuuuuauagaaacugcccuuaggugacuguaaauaucauuuacaagcuugucacuuucccagaguagagugcucucuuugccuuguugaucuuaagauguggggcuaggaugggaaccccuuuccaaaucauucuuuuucauggucuaagaaguuuaaaacuaaaauauauggggcuggagagguggcucagccgguaagagcacugucugcucuuucaaagguccugaguucaaaucccagcaaccacaugguggcuguacagccaucugcagugagaucugacgcccucuucuggggugucugaagacagcuacaguguacuuacauauaauaaauaaauaaaucuuaaaaaaaaaaacccuaaaauauauucaaaucaaaaauuaucuuuguagguaaaaugauaacaaugguuaacuauuuuguaaaaauacucugacauuccuuuaucagcagcuccuaucuuuaaaccauuuuugaauauuucaaauauuuuaacuuauauauuuguguuuuguguacaugugugcacaugcauauguuuguguauacaccaaauguguguagauggccugagaaggccaaaaaaggauaucaaauuuccuagagcuggaguuaugcaugguugugagccacacaguaggggugccggaagcuggacugggguccucugaaagaccaggaagugcuuucacuacugagucaucccucccuccagcccccuugaaucuauauuuaaaaacaagacuaaggauuguagaauacuugccuagcauauacaaggccccgaguuaaauuucuagcacccuccagaaaauuaaaagaaaguaaauaaaaaaaggaauuguuuaguuaaugcaacgcggaaagccaucccuuggggagaauuuauauguucagaacuacuaguauuuuuaauugaaaauuucaaauaauuauuaaaauuauuuuaugucuuauguauuggcuuugauuaccugccuuaacuuuugaaaaaaaaaguuacauaauauguauauaucaacagacaacuuagaaaauacaaaguagccaaauaauaauaguaaagaaagcacuugucaucuugauaguaacauccacaaagaauuuccauaagauuuuuuuuuccaagacacuuaauuacaccauuucaaagcuguuuaaugagaucuuuuucucuacaggagaaacuaugucagggucguucuauuuauauugguuuuguuuuguuacauuccacacuaaaucuguacaagcagauacuaagaaauguugcugucuuugcaugagcagcuguuacuguguuaacuagcuaaguccagagccaccaaggacacugagacuuuucuauucuuucuuuuguacacauagauuggagaagacuuccaagagagaugaugccaaggaaaaaaugcaaaaaagguacacuggcuaauagacuguaguccgaguuuguaagaguauugcugaagcucgguauugcaaauucucuaagugugucugacauuuugauuguuuuacugccucuuagugacuguugacuuuugaaucuucuauuuucuuacguuaaucucauuccuuaauugugaaaauuugcugugcuagcaaagaacucugguauauagacggucucauuuguauaugugcagauuuuuaugaucucaccggcuauauuguacauugguucaugacacauuuuaaaauuggggcacuguugacuguuguuggcuguugggggagggagaaucaacuuuuaaggauguggccaguguugaguugacaaauuugacucaguggauuauuaaaaggaggaggguauaaauuugggaagagaaugugggacuugggaggaguuagugggaggagggaggacaaguugaaauaaagcacauuguauauaguuaggaaauucacaaagcauuaguaagcuauuuaauauuguaguugaaccaacaaaaauguaucccugucuaacauaaaaugaaugagacucagacuaugguuauuucuuuggcuuugauaauuacuccgugugggagguaaccccugauaugcucuucugacugcuggccugccugcuuccccagcuguguucccccagauaccugcuguuucuccuggccaugugcauccccucucauggcggcuucuagcaacagaccaaaccucaacauaaaauuaaaaagaaaggcauguacugggaaaaauugaagagcugguagagcuuuauauuagauaaaaagauaccaaaguaucuauguuuguuuguucuuuaauaauuccauucaauaaauaauugucugcuauuaccagacacugccaugaggaacagagaaagcucauguaguugagacuauucuugcuucuuggagcuuacaguuagguggaggaacaacaugaaaggacugggggguggcuugaucaguaaaggguuaccuuaguucagaucucuuuuacccauguaaaaacuuuggcacugcugaacccaccuccaaaagccugggacucacuggacagccgaucaacucuggaacacacacacaaacacacagagacacagagacauacauacccacacacauacaauaugaaacgaaaacauacgacgugcuuuucggaagucugggaaaaguucugaggaagcgcaguggauagaccauuaccgucaugauaaaacaugcaaguguguagauaaugcuggucacaugcuaccauguguagcagacuggaggucugagaaccuaccuaucuugguuaucauuggagcuucauacauuaguauugcuaauguaccgcuucugguggcaaggauuccauuuauugaaaaacaaaauuacauagucuuuccccaugugugcuaguauucuuaauugugcgcaguguagguuuugugucuguuccucccaguugugacggccuguauugauggacaugaagguagauagauagccacagagggcucaaagguggcagaggcuuguugaagaaccagccucagauagauauggaaagaaacaaguacaaauaugugcacacauaaaaaauuauuguuaacuaugggaaauuuucaugucaacauuuuaggauaaaaacagucuuucuggccgggcgaugguggcgcacaccuuuaaucucagcacuugggaggcagaggcagaaggauuucugaguucgaggccagccuggucuacagagugaguuccaggacagucagggcuacacagagaaagccugucuugagaaaacaaacaaaaaacaaaaaacaauccaacaaaaaccccagucuuucuguacuauugaugauuugauacuuccgaaugugagcaugugugcaugaauuaaguauuaaaacacagagaaggaaagaugaguggguugaaucuggggcuuuuuaguaaaauaauaguaacuguaccugaaaggaagucucagugguucagagugcuuccugacucaucagagggcucagagcccagaacccacaucgggugacaucaggugacucauacacgucuguaacucucagucugaagaaucuaauagcccauucuggcacacacaccacacccauacacacccaaauaaaaaauuaaauacuuuaaaugaauuuaauuauauauuauauaacuuguuguauucaccuaauuguuguauauauugugaaauuaaauaauuucguaaaaaguccuuagagaaaaugaguuuauagugugaacggaugaccuucuccgcuaacaguuguugacaguguuccauauuuuuggagcucuuugucauacaggauccuaugcuuugaguacuuauuaaacaguccuugccguccagggagaugacaaaaguuauaaguuauacaccauuuaauguuagguuauuuuuuuccaugaaacuucauuaauucaagagcugugaaguaacugucuuagucaggguuucuauuucugcaacaaaacaccaugacuaaaaagcaaaguaggagggaaaggauuuauuuggcuuacaguuccacgucauaauccaucauugggggaagccaggacaggaacucaagcagggcuggagcccgggggcaggagcugaugcacaggccauggcuugcuccagcucugcccucugcagcacacauacuuaucuucugggcuccggcuggcuccacuccacugcugcugcuguucuugugguuguuuuguagugcugacaucuccaaaacuacuggcucgcuugcugcaacuggacuucacuuugaccuuucacuccacucucuuccuggugccucaucuucucugcgugacuccucaguccugggccuucagcugccacccaggcuacacggccaccaauggccucucuuggccucucacacgcuuagcauuagcagcucuccaugaucccgucaugccuucaaacccaugccaucugggugacuuuuacacauuacuaaguccagcuaccaacaugagauacaaccuuggcuaccucugcaacacugcuucucugugcucucaggaaacacuucccagaagauuucaucucagugaugcuggugucuucuuaaucaccucuaaggaaugucaauuguccuaguaaugaaaagguuucuaaaucaaaauaccaaauggcccugauagaguuuucagucuucucucugaaauuucacaaacccggccuccauccucuucauugcucucaacuuuaauauuuucuaagcuuccacagaacaucccacagaccucuuaacauucaauggcuuuucuagcccaaaguuccaaagucauuucauaauccuccccaaaacacauggucaggacuguccacaauaccccacugucccccacuguccugguagcauuuauugucuuaggguuuccauugcuaugaagagacaccaugaucaaggcaacucuuacaaggacaacauuuaauuggggcugguuuacaguuucagacauuuaguccauuaucaucauggcaggaagcauggcagcuugcaggcagacauggugcugacagagcugagaguucuacaucuugaucugaaggcagccaggagacuggauuccauacuggacagaguuuaaacacucucucucucucucucucucucucucucucucucucucucucucucucuaagguccuauauaugacauuaaaacccaccuccacagucauacacuuccuccaagaaggccacuccuacuacaacaaggcacaccuccuaauagugccacucccuaugggccaagcauucaaacacaugaguauauggguggggcggggaugaugacagcuauucaaacaacaguagugacucuucauuuaaagguuuuaaguccaccaguuaugggucauccacuguggucugcaaaucauuuguguguugaguguuuaucuuuaacacggcuaagucuuucugagccugguuuuugacgccuaaggauuugggggguguuugauuuugguaaagaacuguagucauuucaucuugugagaaucauuuauuucuuauaagaauuccuugguaauuggcauucuucauaggaaauaauucuuugauugcccauuguuuuagaauaauccuggaaaugaaauauuuugcuuagaguaaaacaaauuguguaucuuugagcuuguugaaacaguuccuuucaccgcugugaagugaccggcuaaccguuuuacuuuucucugugaaaacaguucuugcaaacaucaggugaaagcucuuucccuacccuuugccagggcggauuuacccugcacuucucuugcuucacaucugcuuagcacugcuuguguuaaaauggacuucagugauggaugggugaccgagaaacccuugcagggccuuuucuuguuauucuaguguuucugucucaagaaauguuauagcagauuuugucucuaaucauauuaaugguaagacuaaaguuucagugcuuagucaaaauauaccugguuguagucuaaauaguacugugcagagugacgcauaugccauagagcuacaccacagagcuuaggagguaccgcccuugcucuccuugccacaguagaaaaucuguuagacuggagagauggcucagcuguaaagagcacugacuguucuuccagggguccugaguucaaaucccaacaaccacaugguggcucaaaaccaucuguaaugggaucuaaugcccucuucugguaugucugaagacagcuacaguguacucauauauauauauauauauauauauauauauauauauauauauauauaaaauaaagaaaucuugagagagagagaguaugaaugaaugaaugaaugaaugaaugaaugaaucuguuaagagauugugcuuucauuacaggggauccaaaauccaagccgagcaaagcugcagccaaggcuacaucacucauuaauucugcagauguguugaaaacgauugagguaaguugguaguuauaaaugugaacgaguacuaccucuucccccaccuuugagccuucuccuuuaaucauguggauuugcagaagagaggcccgugcuuaaguuagggcugagcuuugcuauuauggagguguggagaaagaacucuccugucugagcccuccagggcuucugcugucugggggcucccacccugacuuuuuaagcucugcccacagccccaggccuucuuuucacuguaccccuaacucccccauuguauuggauuguggcgugggggaggggagagacacgugacccacuggcacuguaauggaugugauucuuuacagacauccugcuuucccuuuguuggugugugguucuuuuaccccucaccccacaucccaguguuuuggaauguauaacuggaagacuguagugaggcaaagauuuucuggaauuuauuugccuaucuuuaaucaaaacaaacacaauuuagguuaguaccuugagacugcugucuccucccugccuaugacacauauguucuuguuguggacuccagaacuaugcaaauucauauauauauauauauauauacuuucagaaauacuuugccacaaaaaauacagaacuuccuccugucauuuuuuuaaacuuuuaaacauuauuuuauuguuuuauguguaugaguguuuugccugcauguauguauguauguauguauguauauauguauguauguauguauggguaacaccacaugugguaccugguguccauagaugucaaaagauggcucuuagcugcugagccagccugaauuccccugucagugaugaagauaguaugccacacuucugcauuuucacguuguuaccuaacaaaacaugccuaacauaggcauggcuccagaugugacuguccagagcucccucauucuguugucagugcugugagaaugaacuguaguuacuuaaucaugucaauaaugugcuacugaagagcuuuguuucuucugcuguuuugcuguuauuacuaaugcugagaguuuauaauaagcgugucacaugaguagaguugcuggccucuuuggcacaucugcuugaugggaaggucuucauuuaacugcuucccuuucugaacagugcuugagccgggugagggcauggccaaaauauacaucuggaagaucauuggcagagcagcagcaggcgucagguucacuagauagaauggugguggacuguguccgguccugccugcacagaaagcuuggagaagcucuccagaggcucgcacggugcucuguggauugcccuucacuuugggugugguuuuccuuaggacaaacugugcuuccuuggugcugacauuugccaccuuuuccagaaaaauucuaaacauagaaaucuuaauguguuuacaguuuuaacagagcaaugguuguuccugguugucuccagcaaaagcagcuucgugcuuuauuauggaggcaucuccgggcagagucagcagcauuagguccggucucagagcaguggcaugcacaccuuccuuaugucuucuuuccuugccuguccagugucuaagcuagaacugcucugggucugcaucuuaccuccuuuccagaugucagucccucucuccuucuaccugcacagucagcuugaguaguuaaaggccauggaagagaaaauggagaaugcugaguaggagagccaaaaccauuagcuccuuggaaagaacaaagucaucacacaguacgcgucccugggauuauaagggacgucugaaacugccucuguucacucugcugauguacacgguggguuggaguuggauguguguggcaaagguaaagaugaggcuaucugcucugaccgugugauuuggcaucaguagaaauacagucuuugguucguacaguacauuggaugagugcuguacucugaauaauacaguugaugccuuguuuuaaagaaaacaauucuguuucucauuuugaaauaauuagugacuuucuaaaaagauaauagaguauacuuuucacaaaguaaaauaaauauuucacuuccauuuuaauugcauuuaauuguaggcuuuuuuacguauggucuaguaaaaacagaaaaggacacaucuuaauauuaauguagcauauauugugugugcgugucuguguguguguguaaccgucugucugucuuagauguuucaaaaggcuuaugaaaauuuggguugcuuaggauuuucuaagaagauggccaguugggaaauuguacacaugauauugucaaaauaacugccaaggcaaggcaaugguuguuauuacgguaagcuaucccauguguauacgggucuugguuuugauuuguucugccugagcgaggugaauuacaagcaacauuguuugaauuuuauuuaaagauugggucuuaagagcuugagagacggcucgguagaugauacauuuacugggcuagcauagcaacugacaagucaagucucagcacgugcaucgaagccagguggaccugcagcagccugugaucccaguacucgggagucagaggggagucgcuaaggcaagcaguggacuggcaaaacuagccagaaccugccuuaguaaguuaaaugaagcauggaugaggaagauuuccagugucgcuuuccagccuccacaagcauguucaaacgaaugagcacauugacaugcacacaugcauuccacacacacauaaacauucuaaauucaucuacaugggguuuggcuaaugugaucuuuccuuugccuuugaacuucuucaguucaauuuggaacuaaaauaauuucuaaggugaauauuuaggaagagcaacaaaguuauaguuaacucuggauguaaaauaugucuucugcucaugaauaaucaacaaagccuuaaagagagauggagcaugcuaacacaauaauucauuaauuacucuucuuuugguuuuucgagacaggguuucucuguguagcccuggcuguccuggaacucacucuguagaccaggcugaccucaaacucagaaauccgccucccucugccucccaagugcugggauuaaaggcgugcgcaaccacugccuggcuauuaauuacucuucuaauuacuguuaguaguaaucagaaauuaggucaugugaaucuuuaauuaugaaaacgauuguugugcccaucucacagaaaaccugugaaacucuguugggugagggccacccaacuaagcaaacagauagagacaguaauaagauuagguaacaucaauugaaaaaaauaauugguaguaauaaggcauuuauaaaaucaaaacugugagaugauguccagugugugguguccagguagacagcaagagccgcccagaagcaaagccucuccaacucccuuccccuucuuuguuuuuacaguugcuaauaccagcaguguguucagcgauguguuuuaaucuucuuuucacaaccuuccagauguaucaugaagcagaaauucuuggcaaugggaagucaugaaagacaaaggagacaggggugggauaaacuuaagucacgucaaacgguuuaggaggagguaggauagaaauccugaaaagaaagcguugcggauuagaauucuaagccuagaguagcugagggaggcccagugauaagaaacagaaugaagaguagguguugcucugaaggccguggcugcagcuucccucagaggcaggaggcuggcugguaaucccguaauuuaggauucagcgaggauggaagauuaucguagcucuucuuuuuuagcuggguguguggaucaaagaguaaccauuugcauguacauuaaugaaucucacuuuaucaggaacuggaaaagagaggcgagggugaaagaucggaugaagaaaacgaagagaaagaagggagcaaagagaaagauaaagaugaugaggaggauggcgaggaagaugcagaacaggaggacuacgaugaagaggaacaagaagagguaaaagucugcuuuaggaagauaagggacuaacuccauuagaggccuuguaacuugaaaguucuacucuuuggucuuuuuaauugauuaauuaauugaaauuucaugguaauuaacuuacucauggaguugaguugauaaauacuucacguuaacgaguacaguggaguauuucaucugcuaacaugucuauguuaauuaaagaaaauacuuguuuugcuguuaauaauuugaauauuuagcuuaagaaugaaucugggacucaguggagagccaagagccacucaggccaccaggcucagcuguguuaugccugagcaggacugcuagcaucucuguuagcgucugagucaccaaacauuuggaguaaggacccacggcuaaaguacaguguuugacugugaaugccagggcuucucuuacuugcuuuugggugggaauucauuugcucauauuuccuuacaugcauagagccaaggccuuguuuccuaggugccuuccuuugagugcucugccagccaccccuucccuaguacagaggccccaggcuccaacuuggugucuggauauuuauggauuucuagguaucagaguagcuaggcuaauuuuauggcucuauaaaggguuuuuguuggaugcguaaacuugcaggauuuagggaagagaaaguaauauaaaauacacaaauguacauauacauacuagauuuuuuuuuuuaauuuguaagagaaagcuggauuuccaaaagcuuucuuuugagaaugucaucuguuuucacuguaaauaguugaaauguggauauuuaggggauagggucuggggguacaacagggucucgcuaucuauguaguccagacugacacugaacucugcaguucuuucugcuuagucuuuuucaugcagggaauacaggugugagccacuaugcuucuccugcauagcuaauuguccacucacauuuuuuguacaugcauuggguccuggccuguuaguccuugaccuucggugcccccagucuauccuagagaucaaacacguccuuagcauuguucuaucucauuccaucccuagagucucaguguggacacaaauguaagagcucucuaacaccacgguguauuuguuaaauuuugauugguucaaaagucucuguuacaaaaccaugcacuacagcuguccaagaaguuuuguuuuguuuuguuuuguuuuuuugguuuuuugagacaggguuucucuguguagcccuggcugucccggaacucacucuguagaccagccuggccucaaacucagaaaucugccugccucugccucugccucugccucccaagugcugggauuaaaggcgugcgccaccacgcccggcuguccaagaagucuuaaucugccuauaaucaaauggauuuuugaaguuuugauacaaggcacgaaucuuuuauagccuuaaggucucaguuagaacugacaccuugccagaagccaagaaauccugaggagaauguagugucgcuucccauagguuuggguuggaaggaacagucccucuguggugccauucagcuuugugccuucaugccuggguucuggugcaggguaaaacuaucgaugaagcacuucuuccuugguggcccaugcauggguacaacaaaugcuuaguguuucagcuccuuaaccaccuccucgcuccaccaaguagugcugcccagggcaucccugcugagguguacucacagcacuuucuguucuuuagcuggauagcugcaccugagcacaguagaaaaggguacuuaaaagaaagcugggcugaucaaaaugugugaaaacuucauuugaaaaaggaacgcacacaagcaagacuuucuaugcaagucuucuguguuuccuuuuuaccucaacuugguaucuguaaacgacagagauguucuuuuuuguauugucuucaauggugccuucucaucaccugacugacugaggaauccaucccuucucuuaggagaaugacuacauuaacuccuacuucgacaacggcgaugauuuugguguagacagcgacgacaacauggaugaagccaccuacuagcuguggaauccucaaauguuugggggauucagcuucgagcguuuggacccacuuuauuuuggauaaggauuaaguccguauuuucuguuguucaguguucuguauccaacucuugagaacgacuuuguguuuacagcccaugaccuuacucccuuaccucugccacaccugugacuaugcaaugcgguuguggguucucuggcuuuuguuugaucuggauuugaauguuucuagagaguuuucguggcacucuuguguguucacaguuuaaaaagcucacucuggcucaccugcugaccuucgguagcaaggguuacucgucauaguggauuucucuuaauacugcacguggggcacuuuaaaagcaaacuggacgaugauuucucuucccuggaacauuguuuuaucacgcugugaccucauaaacugaccucagaaacgucccugaguuccuaacaguagaguuaugcugauaggaaacagguucucggcaagcaccagugaccugggugagacccacuucaguuuccaccucagccacaacaaagacuuucacguggguggaagguucucaacgcuuggccuuggggauaacuccaagccuuacaguguacaguguguaaacuaaugauuccauuguaguaagucugacacuuucaacuuguugggcugggacuugugggaggggaagcugagacacacugcucaauucuggacuuaaacuggaaacaaguccugguuguguaaaccucaugauaaaauggugugugaguggauauggugaagggcacuccccuccuuuguguuucacaagacucauaaacugcaagucaauuauauaaucacuguaaaaucucaggucauuuuggaauuaugagcgauucuucuuguuuuaacuuacagggugacucuccccugcaguuuucuauuuugcaggagaaaauauccagaucccuucaccucugaggacuuuaaaacaugccaaagauuuucaagggaauucauaguaugcauuucgaaacuaacguauuaacaggaucugccuacgggaggaaaaucgguuuuucccagugggagacuuguuacucaguauccucugaccggaaacuggaggccugcuucuucucucaggaucgagauaaccuuaauauuaagcuuaaguuugggugccuuaguuucuccacuuguaaaugguuuccuaucaaaauuuauaggaaaauuuauaguguuuagacacuaaccagaauugaccaaauaugcuuucuuuuacgcuacagaaacaaccaugucguaaauuguuugcucuguacguaguacuguggacgugagauagcugugaggaaccguuuccuguugaguuauaauucgauuuccagucuuguaccuguguuagaaacgguaguuucuuuguaugauccgagagauuccaaaagucuuuucucaggugaaggaucacuuucaauggcagugcuucuuuaaauacuuccugauggguucgagagcccaucuugacaguauacugcugaacgcuuacauccaguucccaggagcugauaaagaugcugugagauuccuaguggaaaccaagucuuuaaagcugcaguguguuagggaacuuauuaaguuuuaguaauaauggcaaaugcuguuauuugggaauaaaaaguacuucauucucuuauguuugauaccggggccaaacaagauuccauucguagacacucuuugguuguuuccuuccaguauuacaaagccacagauaacuuuuccaguugggagccgcacuggcagugaguucuuucccagcauccacugucuucaagggugugcgccuuccacccagagggaagcgcuuucccacaggauugacucggaaacccuuggcaucucuccuaaggaugcgcaucuucauuugaaagaucagcuuacaacucuaaacguacuaauuuugaggagagaugagauuuuccaggcugcuugacuaccauaaaucuuguuuacuuuagcucugagucuaugaaauuaccuuguagagagauaaauaagaguacuaguuagagaagaguacuuacugggacuggugauaaaauaucuuuaacaaucucguaacaaaacuaguugcccacaugcugauuuuucuguauuuguuuacacauacaaaauuuaaaaaaauaaaauuuuggccuuaauaccaagauga

SEQ ID NO: 7142 - RNA, 42232 nt, Mus musculus
agcuuuuuagcccuuggcaggcgccguagucagccuccaacaggcucggccucacucugggcuccggcggcgagugcacagccccccgcugcccgugugggggcgguccugugugucgcuucccacgcaucucucccggccccugcaguagaaccccgagcagggcagcauugcccggugucuccuccccgcuucagcagccugcguuacugccuuggugcugcggcugcagaagcugcggcaacuggggugcagccugcgcucugcggcucggacgggagggcgcggaacaggugaucugggcagugucgcagcguccuauccacgcucccuuccgcauccccgccccucgaucgcaccuccuccggagcugagaguagcuccuccggcucugcagcaacagcagcagcagcagcagcagcgaguccuggacugccugugggaggcacacccaccuagcccggccgcaccccugcgcagcagcaugucggcgcucgagugguaugcccacaagucucugggcgauggcaucuucuggauucaagaacgguucuacgagucaggcaaccgggccaacauuuggcuggugcgcggcucggagcaggacguggugauagacacuggccuggggcugcgcagccuuccggaguaccucuacuccucuggccucuugcaggauugcgggucuaaagaggaugcaggacgccggccacugcuggccguggccacccacgugcacuucgaucacuccggcggucucuaucaguucgaccagguggcugugcaccgcgccgaggccgaggcccuggcucgcggggacaacuuugagaccgugaccuggcuuucugacagcgagguggugcgggcgcccagcccuggcuggagggccaggcaguuccgagugcaggcagugcaacccacccucauucugcaggaugguaaugggccccgcgggcgugcgcugucacugagggaggggcuuggagagcguguacagcauguuacagaccuccuuggcacuguugggguacagugcgggaauacucuguuucacccuuugcugcguggaagucagcuuaagcagagacuaggcccuggcaggcuucucuguccggagaugcgcgcugcugcuguguggcugucucuuugaaagcucacaccauccccagucagucagcuacaguaguaacacugcagagacuugugacuggagauuuuccauucuuuucccaaguaccgguugaacauuuucagcuuuuguaacgaguaggcuuuuaagcaauggcaccuugggaagaguguuaggcucugugcuuugaaaacugcugacuucaucugccuccucacuucacugcauagugccuauccgguccaccuguaggcuuggaaagcuuugguuccguuucauccauccugaccuuucggauggauuuguuugcuuauugccucacaagaaaaaaaaaaaaaaaggcuugacagugaacauaaaauauagaaauaugacaaauaucuggucuggaugagagcaaggccuaggaaagaucaauaagggaguuguuuccgguggagaaaguguguguguuaaugaggacuucauucucuugguccuaagcaauugauagauuggagcaaaauagacagggucccagucccuuuccccucaugcuggaacugcacuaacugaacugauuagcaacagcagcaauauuugauuuaucaauuuuauauuuuugucuuaggauuuauuuauuuauuuacauccccaaaacuacuccugcuccugcucccucccucacagagucucuccucccauccccucuucucuucuccuccgagaggguggaggccccucuggguaccccuccccccaacacagcacauaaucaagucucugccagauuaggugcauccucucucacugaggccagauagggcagccauggagccugaggugcuugccugcuaccuaugugccuggaaccucuuuucagucuguguguucuuugguuggugcuucagucucugagugccccuagguuaguugacucucuuggucuugcgcuggagcucccuuccccuucugggccuucauucuucccccaacucuuccauaagagucccagaccaccguccaauguuuggcuguggguaucugcaucuguuucaguccacugcuggauagagacucucagaggacagguaugcuaggcuccugucugcaagcauaacagaguaucauucauuaauaacgucagggauuagugcuuguucauggaauuuuucuaucccugcauuuccuuuagacaggauaaauuuggggucaaacuuuuguggguggguugauguccuuaucccgccacugagaguuuugucuggcuacaagagguggccucugcuaguuucauguccccacuguuaggaaucuuggcuaagcucacccucauugacuuucugggagccuccucuaugggacacccuagagauucuccccucccccaacuuacacccccauccccacagcugaagauuuacauucauucuccuggcccucugaccuucucuccugucuaucccuguacuugauccuaccccaccccaccccucacaccauucuguguacuucuugaguacauaccaugcauguccuuuugggucugaguuaccucacucaggaugauauuuucuaguuccauccauuggccuguaaaauucaugauguccuugguuuuugguuuuuuuguuuguuuuuuguuuuuguuuuuguuuuuguuuugagacaggguuucucuguguagcccuggaacucacucuguagaccaggcuggccucaaacucagaaauccgccugccucugccucccaagugcugggauuaaaggcgugugccaccacaccuggcuugauguccuuguuuuuaacaguaggguacuauucauuuguguaaaugaaccacauuuucuguauucauucuucaguugaaggacaucuggguugguuccaguuucuggcucuuaugaauaaagcugauaugaacauaguggagcaugugaccuugugguauguuggagcaucuuuuggguauaugcccaggagugguauagcuuggugauauagguagaacuauuuccaguuuucugagaaacagacacauugauuucuagaguguuuguccaaguuugcaaucccacuaucaauggagaauguuccucuuuuuccacauccucuccagcaugugcuauugcuuguguuuuugaccuuagccauucugacugguguaagguagacucucaggguugauuugauaugcauuucccugaugauuaaggauauugaacauuucuuuaaguacuucacagacuuucaagauucuucuguugagaauucucuguuuagcucuauacuccauuuuuaaagauuuauuauuauacauaaauacacuguaguuaucuucaaacauuccagaagagggcauaagaucucauuauggguguuugugagccacuaugugguugcugggauuugaacucaguaccuucagaagaucagucaguacucuaacccacugagccaucucucaugccccuauacuccauuuuuuaauuggguuauuucguuuguuagaguuuaacuucuugaguucguuauauauuuuggauauuagcccucugucagauguggaguuagugaagauuuuuuuccaaucuguagguugcugauuuguccuauuggcuaugucuuuugccuuacagaagcuuuuucauuucaugagguccuauuuaucaauucuugaucuuagagccugagccacuaguguuugguugaugaaauugucuccuguaccaauguaaggcuauaucccacuuuuucuuauauuagauuuacuguauccaguuuuauguugagguccuugauccacuggaacuugaguuuugugcagggagauaaauauggaucuauuuuccuucaucuacaugcagacaucuacaugcagacauccagucagaacagcagcauuuguugaagaugcuuucuuuuuuccaucauaugguuuuagcuucuuuguugaagacuaaguguccauagguguguggguuccuaucugggucuucuauacuauuuuacugaucaaccugucuguuuuuguaccaguaccaugguuuuggguuuuuuguuuuuguuuguuuguuuguuuguuuguuuguuuuaucacuacugcucuguaguagagcuugaggucaggaaugguuauuucuccaaagguucuuuucuaguucaagauuguuuugacuauccaagguuuuuugguuauccauaugaaguugagaauugcucuuucaaggucuguaaaaaaugugcugggauuuugaugggaauugcauugauuuugguaagauggccauuuuuacuauuuuacuacugauccaugagcaugggagaucuuucugucuucucauauguucuucaauuacuuuuuucagagacuuaaaauucuuauacagaucuuucacuugcuuguuuaguguuacaugaaaaauuuuauauuauuuguggauauuguggagaguguuguuucccuaaucucuuucucugcccuuuuaucaucuauauaaaggaaggcuacugauuucuuugaguuaauguuauauccagccaguuugcugaaguuguuuauuagcuguaggaguucucugguagaauuuuggggauugcuuauauagacaaucauaucauccaugacuaguaauaccuuggcgucuuccuuuccaauuuguaugcccuugauccccuuuguugucagguuucucuaacuaugacuuacaguacuauauuaaauaguuagaaggagagugggcagccuugucuugcuuuugguuuuagugcgauugcuuuaaguaucucuccauuuaauuugauauuagcuguugguucacuguauauugcuuuuauuauguuuagcuaugucucuugaauaccucacuuuuccaagacuuuuaacaugaaggggcguuguauuuugucaaaggcuuuuucagcaucuaaugagaugaucacaugaguuuucuuucaguuuguuuauauggaggauuauuuugaugaacuucuguauauugaaucaucccagcaucccugggaugaagccaacuugauuguggugacuaauguuuuugauguauucuuggauuuuguuccuagaauuuuauugaguauuuuuuuuucaucaguguucauaagaaaaacugaucuaaaguucucuuucuuuguugaguuguuaugugguuuggguaucaugguaaguguagccucauagggugaauuagguaguguuccuucugcuucuauuuugugaaauaguuugaggaguauuggcauuagcucuucuuugagagucugguagaaaaccaucuggcccuaggcuuuuuuauuuauuuauuuauuuuuuauuuuugguuaggcgacuuaaugacugcuucuauuuccuuagggguuaugggcuguuuagaugguuuaacugaucuugauuuaacuuugcgaugugguaucuguccuagaguucagccauuuuagguuuuccaguuuuguggagaacaggcuaaugauuuuuaaaauuuacucaguuucuauuguuaugucuuccuuuucauuuuugauauuguuaauauggauacugucucugugccuuucaguuaguuuaccuaaggguuugucugucuuguugauuuuucuuaaagaaccagcucuuggguuuauugauuauauuguucucuuuguuucuaauugauugauuucaacccugaguuugacaauuuccugcucucuacuccuauugguuugcuugccucuuuuuguuccagagcuuucagguguacuauuaaauugcuaguaugaaagaucgcuccaguuuuuuuuaugaaggcacuuagugcuauggauuuucuucuuagcacugcuuucagugugucccauaaguuugaguauguuaucucaucauuuucaucgaauuccaggaagucuugaauuucuuccuuucucucuuucuuucuuucuuucuuucuuucuuucuuucuuucuuucuuucuuucucucucuuucucucccucucucccucccucccucccucccucccucccucccucccucccucccucccucccucccucuuucuuucuuucuuucuuucuuucuuucuuucuuucuuucuuucuuucuuucuuucuuuccugaccaaaguaucauugaguagagagcuguucaguuuccaugaguauguaggcuuucuguuguuucuguuguuguugacauccagccuuaauuaaucuguggugaucugauagaaugcaauggguuauuucaaucaucuuguaucuggguuguuggguuuuuugggguuuuuuuguuuuuguuuguuuguuuuguuucauuuguuuguuuguuuguuuguuuguuuuuaaagcugaggacugaacccagagacuugugcuugcuuggcaagugcucuaccacugagcuaaaccucaaaccucccccccuccaaggcuugcuuuauauuugauuauauggucaauggagaagguaucauaaggugcuaagaagaagguuuguucuuuuauuuuggggugaaagguccuaugaauaucuguuaaaucuauuugguccauaacgucuaugaguaucauuguuucucuuuauuaucuguuucagugaccuguccaauggugagagugggguguugaauucucucacuauuaugcugugggguucgaugugugauuugagcuauaguaagggcucuuuuacaaauaugggugcccuugcauuuggagcauagauuuuucagaauagagaguuccucuugguugguuuucccuucccuauuucuuuugauagcuuuuggauaaaagucuauucuauuagauauuagaauggcuacuccagcuuguuucuuggguucaauuaauugcuuggaaaauauuuuuccaguccuuuacucugagguaguaucuaucuuucuagcugaggagugcuucuuguaugcagugggaugauccuguuuauuuauccagucugcuaaucugugucuuuuuauuggcgaauugacgucauugauguagaaauuuauuaaugaucgaugauuguuaguuccuaguuuguuguuggaggcgguauuaugugugugugauucuuuucuuuugguuuugauaugagaugauuaauuucuuguguuuucuuggguguaguaguuucccucuuuguguuggagucuucauucuaguauccucuguaggucuguauuaguagaaagauauuacuuaaauuuugucauggaauauuuugguuucuccaucuauggugauugagaguuuuguuggguauaguauucugggcuggcagagacaucuguccaggaucuuauggcuuuuagauucucugcugagaaguugcauguaauucugauaggucugccuuuauguuacuugaccuuuuuuucccuuguaacuuuuaauauuuucuuuguucuggacauuuaguguuugauuauguagcaggcagauuuuauuuucugcuacagcuuauuugguguucuguaagcuucuuguacauuuauagcuaucucuuucuuucuuucuuuuuuuuuuuuuuuugguuuuucaagacaggguuucucuguauagcccuggcuguccuggaacucacuguguauguauaccaggcuggucucgaacucagaaauccgccugccucugccuccugacugcugggauuaaaggcaugcaccaccacgccuggcuaucucuuucuuuagguuacagaaguuuucuucuaucauuuuguugaagauguuuucuggcccuuugaauuggaaucuucauccacuucuauuccuauuauucuuagguuuagucuuuucauagugucccagauuuucugcauguuuugaguuaacuuuuuuuuucauuuuuuauuagauauuuucuuuauuuacauuucaaauuuuauccccuuuccucauuuccucucugaaaacccccuuaucccauccccucucccccuucucacuaacccacccacuccugguucccuguccuggaauuccccuacacuggggcaucaagcuuucucaggaccgagggccucuccucucacugaugucccacaaggccauccucugcuacauauguggcugaagccuugagucccuccuuguguacucuuugguuggugguuuaguuccugggagcucuggugguacugguuaguucauauuguuguuccuccuauggggcugcaaaccccuucagcuucuuggguccuuucucuagcuucuccauuggagacuguauuagucaggguucucuagagucacagaacuuauggauagucucuagauaauaaaggaauuuauugaugacuuacagucggcagcccaauucccaacaauuguucagucgcagcugugaauggaaguccaaggaucuagcaguuacucagucucacgcagcaagcaggcgaaggagcaagagcucgagcuagagcaagagcuagacucccuucuuccaauguccuuauauugucuccagcagaagguguagcccagauuaaagguguguuccaccacaccuuuaaucccagaugaaaggcguagcccggauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuucaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuucucuacuacccauucuguauuuccuucaccuucagccagcaccucagcaggucuuggcucuuuuccuggaggauugacccauaccuucauuccugaugggucuguguccuuugucauccugcuuggacuaggcuguuguaguuucccauugacuuuaaucacaggacaugguaguacuaagagacgcccuaagggaucuccuacacuccagacauacucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguagaagcacuccccucucuggagccaaaacuucuaggccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccccgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacaugcuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggcacauguuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcgcgucccacuuuaugacuugcagggucugauaguacccagcucaugauggguaguucaggucgcauaguaacuugguguccuauugucaaacguucaguuuccacuaaggcccaauagcaggccaagagcugcuuuucaaagggagaauaguugucugcagaugaugguagagcuuugcuccaaaaucccaaaggucuuuucugugauucaccuacaggggccugccagaggcuccaaacagcaucucuaucagccacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauaggcccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucaguggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuuugauuuuaucacacaacuccuuccuuguacuucuguuacucuagaaccacuccugguaccaacuucuguauuagucaggguucucuagagucacagaacuuauggauagucucuagauaauaaaggaauuuauugaugacuuacagucggcagcccaauucccaacaauuguucagucgcagcugugaauggaaguccaaggaucuagcaguuacucagucucacgcagcaagcaggcgaaggagcaagagcucgagcuagagcaagagcuagacucccuucuuccaauguccuuauauugucuccagcagaagguguagcccagauuaaagguguguuccaccacaccuuuaaucccagaugaaaggcguagcccggauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuucaaauauugucaaguugacaaccaggaauagccacuacagagacccugugcucaguuuaaucgauggcugugagcauucacuuauguauuugucaggcacuggcagaaccucucaggagacagcuauaucaggcuucugucaggaagcacuuauuggcauccacaauagugucuggguuugauaacuguauaugagcuauauccacaguugugacagugacuggaugaccuuuccuucuguuucugcuccaaacuuugucucuuucuccucccauggauauuuugaucacccuucuaagaaggacgaaaguauccacacucuggucucccuucuucuugagcuucauguggucugugaauuguaccuuggguauuccgaacuucugggcuaauauccacuuauuagugagugcauaccauguguguucuuuuugugauuggguuaccucacucaggaugauauuuucuaguugaguuaggaacuuuuuacauuugacauuuucuuugauugauauauccauuucuucuauguuauccccuaugccugagauucucucuuccaucucuuguauuuugguggugauguuugcaucuguaguuccuguucucuuuccuagguuuuccauccccuggguugccuccauuuguguucucuuuauugcuuuuauuuccauuuuuaagucucggacuguuuuuuuuuuccccauuuccuucaccuguuuuuauuuuccugguuuucuuuaggcaauuuauuuguuuccccuuuaagagcuucuacuuguuugauugugcuuuccuguauuucuuuaaggggaucaauuauaucuccuuuaaaggccucuaugaucuucuugagaugggauuuaaggccacagucuugcuauucggguguguuaggauaucuaaugcuagcuguaguaagagagcuggguucugauggugccauauuguauuggcuucuggugauuacguucucaugauagguuuugccauugccucugguguuggcuggccugggugucccagguuggagcagcccuccugggaggugggcagagcuguggggugaggugcagugugcugaucccugacugcaguggguauagguucaggucagaaggaagauagagcucugacaguguggggcauggugugcugaucugcaaguuuugcuuguauaggugcaaacuggagggaaguugaauuucugacaggacagggcagagcccacgacugucaguaggauuuauuuuaaauuuuauuuauuuuaaauuuuauccacauaacacuuaugaagugaggccagagaccccugauuaaauguuuuaccuagaauacacuaagcagaaucauaaccaaacccaggacuuacacuagggcauaaaagaugaaagugcacagaauacagaaucguggguagaucaugaaaaucacuuuuucuguguuaauaaucuuaaauugccuacaaauuucucuguaauauuaagaaaaauccaguugcugcauuuuaaugaagccuacuaaacaauaugucaauaaaaauauuuuacaaagauacauuaauuuaaaaguaugagauucuauucccuuacaaccaacuaacaggucucuucauuaaaguuuuuaagucuaaagauuucuuuuuuaaaaacuucucuagaugggagucugcuuugaaaauuauaagcuggguguaauggcacacaccuuuaauugcagcacuugggugauaaaggcagguggguuucugugaguucaaggccagccugaucuacagaggacauuccaggacagccagaacuacauacugagacccugucucaaaaacaaaacaaacaagcaaaaacauaaaacaaaaacagauuauacaucuacacuagauauaauuuguauuacuauauuucuucuuaaaguugaugguuucaggaagaaaccuaaaauuuauauuagcuguguaugaugacgcauaucuuuaaucccagcaguugagagacaggcaggcagaucccugugagauggaggcuagucuguucuacauagugaguuccagaaaaaaaaaaaagaaaagaaaagaaaagaaaaaggaaaaaaauuugaaaauuacauggcgugagccuauaaucucagcucuugaacuguggcaacaguucaaggacaucaaaaaauuaaaauaaccucuuuuuacucagagaaaacaugccugaaaaacaaaaaaaaaaauuuacauuaauauuuaaauacauuaaauuguuggaaauaaaaauauuguauuuguuuacucuuuaugaucaccagcaauacgaagucgagagucaagaagcguggggaagcaaugagauggcuuaguagguaaagcauuuuccaucagcccgauaauccgauugugaccccugaguccuaccuacauggcagaaggagagaccugccuccagcaaguugauagccacacacagagcuugacauaugaucaugcuugugcauguacacacacacacacacacacacacacacacacacacacacacguuugcgauuuucuuuuuaggaaugguagguguuguguccggccagcagaucagagaccuggguucuagucuggaaaggcauuuuggaaaccuggaagagaagaagggcuaggcugcgugagauaaggaaggaaccaagacaaggcucugugcucaagguucaauuuuuacuauuccggcacuccauuaugaaggaagggggaggggcccgauucccgccaaauaaucuuggaguaagguugcaggugaacacgugauggcuucggaucagcaaagcggcaagcuucagcagugggcguggcagaacgauugagcggcuagcuccaccccugagcaagcagguuucaggcugggggagggaagacuacagguaggcauuauuguuauuuaggagaggagagacuagcugaguaucguggcuaugaucagcuagacugguuagaaaccaguauuaucuuaauccugguuucccaaauccgaguugaugguguugggguucgggaauugccacacaaaccauccaaacaccaaucucaguuaagaaaggguaguuuauugaacgcacagcgaaguacuugucagaccagggacaucauucagaauuaggucugaaacuaugacaucaaacauuucuuagagcaaacuuuuuauaggaaaacccagguuccaaacuuugacagcaagccguggagugauaugcuuacuagacagagcauuaucagcugaccuuuuaagcagauugguccugagugaggaaagaggggugguggacagguagcgcccaagggacuaucaguacauugagauaacagaacauaagugauucaaccauaacuuuuggcuuauuagugacauuuuucaguggcagcucuagauaauuacuucugggaauuggagucuaagaaccugaacuuaauuucaccuuaugagcaaaauggagacugaauacaaaaugucuuccuucaguuauguuaagaggauugggccucaacaguggcaaauccugacauuuuuggagcuggaaaagcauuguaaauuacugguauguggugcuuugagccuuguuuugagagcgacaggaccauguuguguaaaguggcuucucauuaagagacggacaccucaagcuuuccagcauccucuacucucucaucuccggaagauuaauuuccugucuucugaaugaugugggcugcuaagugaauuguaacccaguccagaugucuggaaggagauguaagagauagauauuaaaaauucauuuacaaucugcacacacacacacuccuaugcagcuguaauagaauagcuuugguuagaagacacgaaggcaaaggcacuacauuucauuaagugaauagaugauuugcugucaaggcaaagcauaaaucuacacuguuaucucuaaccuaaaagcugccucuaauugaaggucaaagagguuagcagucuccucgagugcauuaccucgauggaaaacaaugcauguacuauagugaaacagcaacuuucugcagaugaaaguaguagaccuuagauacaguccaggccuuuugaacuagaacauaucacuuugucuauuuuucacaguauucugcugguucaaguucaagugauuuuucccuuuguccucauucuauaaacaguuucccuaauguugcccugauaaauuaugucaggagaggagcaguuucagauagacacugucauuuaugaaaauuaaaaacaaaaacugcaaguaccagaaaaaggugaacagacaugcaguuuguuuccuuccugaaaccugcuggaauucuagguauccuuguggccaccaaagucaggagaauguccuucuggaagaagugaggcaguucuacuuaauauagugcuucucgcccuguggcuugugacccccucuggggcucuaacaguccuaucacaaggaccaccuaugaccauggaaaauacauguauuaaaugacugcagaguuaugaaggcugagaaccacuaguuuaacacaacucggcagcuggguugguguugguucaaauuuuaggagucaucaaguaguuuaguuuacacauauuuaagugcaacagaauuuggaaaaaaaauuuccagugauaauuaauucaauaagacacauaccaaaaaaaaaaaaaaaaaaaaaaaaaaagcugggcgugguggugcacgccuuuaaucgaagcacuugggaggcagaggcaagcggauuucugaguucgaggccagccuggucuacaaagugaguuccaggacagccagggcuacagagaaacccugucucuaaaacaaaacaaaaaacaaacaaacaaacaaaaaagcauaagauacaaauacauugaaaaucuuuuaaaguacaagugauauuuuauaugaauuugggcucgauagauuaacugaggaaacaugcuuuagacaaacaaguuuauuauaaggcuauagggguagaaaguacaauggaaucagacagacaagcucaagauaagggucuggagggagccaguguggccuggccauauagauaacacaaaggccaccagacuguuaaccacaucuauucccagcuuucugggcagaaaacagguauacaucucucucuuugaagagacaacugugcauuuaacauucuugguuuccuacaaggaccucaugccuccuacaugaaacuaauauuaccauguaaugccuccuacaugaaaccaguauuaccaugaagagacuaugacuugaaguuuaagucucuauuggucaaggaaaugaucauggaugguggaaaugagaugugaccaagggaacaguucugucucaagagccaguucagugugaggaccucagugggagugagagaacacuaacacacauggcauaagugugagcauuuuaaaaaaggaauggcuuccccauucacauaggucucaugggauugaaaauaagggguuuucuuaauugaggcgugcuugguacaguugagcucagggaaugagagugugagagugcucaguguacauuuuuuacuagaucucaggagaaugagagugugagagugcucaguguacauuuuuuacuagaucucaggagaaugagagccaagccaucuaagcauaggaaagaagagaauuaucaacuagacuguuuagaaacugggguuuucauaaacaaccaccaaacccagacacgguugcagauaccaacaagagcuugcugacaggagccugauauagcugucuccugaaaggcucugccagugccugacaaauauaaaaguggaugcucacaguaauccauuagauggagcacaggguccccaaugaaggagcuagagaaaguacccaaggagcugaacagguuugcagccuaggaggaacaacaauaugaacuaaccaguaaccccagagcucccugguacuaaaccaccaaucaaagaaaauacacagagagacuauggcuguagcuucauauguagccgaggauggccuagucagucaucauugagaggagaggcccuugguccugugaagguucuaugucccaguauaggggaaugaaugccugggccaggaagugggaguggguggguuggggaccagggggaggagggagaggauuggggauuuuuggaggggaaacuaggaaagggaauaacauuugaaauguaaauaaagaaaauaucuaauaaaaaauaaaaauuaaaaaaaaaaacugguauuuuuaacccuguuuucccaaaccgcagucaguacaguagaaaaguacuguaaacucuugguguguggggcuuuaagcuuuaguuagccuuugaaggcaugaaagaaaacuguacaaaaugcuuugaagguuauaggaaaguugguuuucauuaauagauagaugccucaaucuagccaaguuucuguccagaauugcuaacacaagaucaaaugucuuaucauuuagaguaaaucaauuuggaagucgauaugggaucgucaucagccagcaaagcuauaagagaaguauucuggagguaacgaggagguuuugaaagugggcaacagaacacuguccauaaagaguguaggagacuuaaagaaaacaauucauuuuguagcagaugaguauaauaaauguacaaaaagauggauaagauggacccuaaggggaaaagaauagguaagcagggagccuuuugaaaaggucaucccuggagugaugagugcagaggucauuugaggaaggcagagguguagaagcaauccaaggcugugucccacauggagaagauguucauccacacuaaaagaccccacaggauugccagcacaggguugaaaacucacguuguaaaaaauaagaacucugaggacaaagaagacccuacagguucccagaaguaaacgagucagguauugggaucagagccaguuuagagcagccaccaucuuaaaaggcauccaucccaucaucagccacauacucacaaaagcacuucugaggugcuguuauuaggaaaccacagagucugccucucacaaggaaggaaggaagccagcagaggaaggcacuaaguacaguaacaaaucuaauggacaggagaaucaaaacaaagcaugaggaugauggagucggugcccugaugaugacuguacagguguagacagaucacaguucuuuugaugggcuauguggugagaaaugcauguguguaaggauggagaaugaaaaaagcuaaaaauguagaaagcaaucaauagcauaaacaucuuaaaccaauagggauacaugcaugaaaucgcugggguguauauaaucguuacaucagaaaacacagcacaaccaauacuuagagacaacuauguuuuguagagguaagucucagaagaaacuaaaguuacguaaaaugguaggaaaugucucuuccauuuuaaagcccuaaacaacuuauuucaaauauguguauauuuuucuauuaaaaacugaaaauagaaaagagauggaggauauuuaaaugggaaauggcauuugagaagucaagagaugguaggaagggagggagagacgauuucauagguaaaugguccuuguaaguuuucaagaaacuugagcacuucucagaauguaggaagcauuuuuaaaacucgagguggaguagagcagauggauuggcacugaggacuccccaugguuagugucugguugcguggucucuauucaucucuuuguuguaguuguuguuaaaacaguuugaauaucacauagguauuacuaaagaauagacuccagucuugcauugguacuccuuuugaacauaaaacuucccucacaccacucccuucuguacauuuccuaaauaacugguuucaucuuguacuggcuagucaaccugacauaagcuggagucaucagagaagagcaaaucucaacugaguaaaugucuccaugagauccagugguauggcauuuuuagaaauuaguaaucaauggaguagggccuagcccaugguggguggugccaucccugagcuggaguuccuggguucuauaagaaagcaggcuuugcaggccaagaagagcaagccucuugguuccuguccugcaugaguuucugcccucccuguuuuuaaugaugaccugugagcaaaauaaacccuuuuuucuccaagcugcuuuuggucaugguguuucaucacagccauaguaacucuaagacacaacuuuuguauagauuaacuuaacagugacuucuuucccuaacuuuccagucauuuaguaaacaaaugguggagguuuuucauucccagaaguaccuuaaaucuguaaugaucuucuaguagaaggauucugaccucaagaaaagaauuuggagaaaucuaaggaugucuuccacuaacaguguuauugcugagguuaaagucaggaccagacaggaugaagcaguaaugagccuuuucuuuuuucuuuugcccugauauagauaaaaaagauguccugugagaacaaucaugauuucaguugucuucagcucugugcuuauguauccuuugggauaacuuguuaguuaggagugacugugguuccagaacuuugggguucaaaacaaucacuugaggaaacuuguuaaaagcagaaauucauaggcccugauagccagaacuuuagaugccacaggggugauacaggacaaaggaagccucguugucaagggacucuccaggugacugauguagucagugcggaagaugauguugcccuguaagaccacaugaguucugccuuucagccuggagacgcugcuuuuaacuucaaacuucuucuaucugaagaggcaggcucucucaauaguaccucugaaagugugguccuggauuaagaagccuccaaguugccaggaacuggucaaaaugcagauucuuauacacuacucuguaucuauagaaucaggaauguguaggaccugccucuaguuuuacaaacccuucauaggaugucagggcacucuuaguaugaaaacagcugguaugguucauugaccucaaaguugcccaguaucaagaaucaccuaaaaguuucacaaauuuccccaaaagccuccuugucuggggaccaccugcucacacaugugaaguaucagagacauuugcauuucaacuauaacauugugcuuucguuuaggcagaaacauuguuuucuuuucuugccgugacuuuauugcacguuuaaguagucuucccacuuuaucuuucucauaauugucuuuaguauucuggacuauguacauuuuuaugguuuuuuuguuugcaguucuguaaauuaaacccacauccucacaaguguuaggcauggacucuaccacuaacccacaacuucagccuucagauaaauuuuauagucauuuccuuuuaaaaaaugguuuuugacauuuauuacuaucaaaacaaccccauggaauagauucuauuguuauugucauuuuguagauuaaaaaaaaccaaucucuucaagagagaaacugacaagauuguacauccacacaagugaugggcagaacaugaaaguaagcuuacgucugucuagaagcaucuagcuugggacauggaggagcacgguagcagugauaaagauguaaugacuggcauuuacugguacacugagcagcacucuaaguacagacauuacaucacuuaaacuaaaaacaauucuguaaggcaaggacuauuguuauucccaauauggaaguacgcaaacugaccaguuagaaaaccuucucaauaagaaaucuaaugucuaugcccuaacucuucccaucucuuaauuucuguuaauuauaugauuagauacaaaaauagggucaucgugucacuugcauguuuugcucuuauuugauacccaccacccacaauugcacacaugagcuaccuucuccauccuaacaaaucacguugagauuuugauugaguuucugugaauaugcauaaguauagcaaccacaacacacaugugauugucaaaauacaaauugaaaugagccagauuaaaauuaaaacucugguccuaaucgcacuaccaucauuccaaguaguucucagauucaggugggucccacagacugcuucagcuauggcagaaggcugugguaaugccacagugagucuucaaguuauuuguuucuuuuuacccccaaauuaguccggguucucuagcaucacagaacuuacggaaugaaucucucuacauaucaagagacuuuauuggaaugacuuacaggcuguauucccuuagcccaacaauggcuagcucugaaguaaaagucaaagaaucuuguaguuguucagucccacaagucuagaugucucagacacuggucuucaguagaugguggaauccuaaagauguaggcucccaugcccuugaagaaacggaugugcuaacaaggugagagcaagcaggcaaagagcaaaaccuucuuucuuccacgcucuuauauggguuucuagcagaaaguguggccagauuagaagugugucuucccuucaagaucagaacuaaaggcaaaugucuaccugcuucaaaaucuauaucagaggugugaccuccuaccauagaggucuggacccaccuuaaaccaagcagaauaucugucacagguguucccuccauuucugaguugaaguuuguuccagauauaguuaaggugacaaccaagaauagccaucacacccccucaaccucgguacuagggcuugaaccugugcccucaucuaugccaggcagauucucuggcauugagcuacaucccagcccccuuuguuuuuaccucucauuguuuucaucuuuauaucuugagagaagcucuuauuaaauuucacagguuggccuuaaauauaugcagaaagcuagggcagcuuuguaguucugccaucccuaccucagcuucccucccugguaguugagcccaguccugccaugcucuccugugagcaucuuucaucuuugccugaguauuuuuguguguguuuuuuguuuuuugaauuuuuuuaaaaauugcuuuugauaguuccuuguaguuuauauaaauauaguuaauuuaauguuuguguacucgccugauaccuuucccuuuaucucgguucuuuggcuuuuucuucauuauauaguguagggggcaugccgguccuugcgcuucagauaagcgcuagggaaaccagggauguuaaagacacauacaagguugucacuucaaacaaagagcuaaaacccauguucugcccagaaggcuggggauggaugugguuaauagacuuugauuaucugugugcacaagccacaucaauccuccccagaacuuuaucugagcuuauuugucuccaucuaugcacacaggauugaguuaauuaucaccaggaacauucugcaaaugacacugagcuuagaugacuaaaguaaacuacuugggaucagaccccagaagguugguuacugaauggugcuggauccagcuaccucccugucuucuugcagaucaugacugugcuggccaugguggauggacacacacacacacacacacacacacacacacacacaccccaggcauaggauuucucuguauuagaucauaguaccuguuaacaaagauacaguuucuucuuuuguaauacuuguggcuuugcuucuguucuccuuaaggucuuuguuguacuucuuaaagucuugaguaccauguuccugccuuagaaggaaagcauuuguccuuauuguugagagaaauacuaccuguagguuuuccacaggagauuuuuuaucaagcucaggaccuuuuucuucuuugucuacuuugcuugcaguacuuuuuuuuuuuuuuuucgagacaagguuucucuguguagcccuggcuguccuggaacucacuuuguagaccaggcuggccucgaacucagaaauccgccugccucugccucccgagugcugggauuaaaggcgugugccacuacgcccggcgcuugcaguauuuuaagaucauuucaugguugcuuccuccuccucuucauccuccuccuccucugcuuucuccuccuccucugccuccuccucuuccucuucuuccucuaccaccaccacuugugccuuguuugccuccagucucaauguagcccccacuagcauggaaugucuguuuuuccucagccucuugacugcugggauuauagguuugagcuaccaugcucaacucuccucuaugcuaugaauauaguguauuuuauauuauauuauacuauauuauauuauaauuaauuuauucauaugaauaaaauauuugauuuuacaaguuaaaauaauuauuaaauuuuauuuuucacauuuauuagcgagggggaaggguguguguaugugggaggggagcguacgugggugcauacaugcgugcaugcgccagggcacacagguggaaagauagauuaccuugcaggaguccauucucuucacuguguggguccuggggaucacacucaggugaaggcuugguugcagguaccucugcccacugagccauuucacuggcccacaaauuuauaguuuucuacaauaaacucuugcuuauuuuccuguucauaagccauugaauuugacuugccuguguuuggggacuaauuuaguuaggaguuuauguaguguucauuacuuuguuucaugcuucacauugccuuucucuaguuuuauuaguguaacauugacuucuuagaagaguuuuuccuucuauacucuaaacgucucuauauaggauugcuauuaucccauuagucaaugacuggcagagcuguccaguuaggcucuaagucuuggcuggacuuuguggggagauuuuaaauuacugauuauuuucuucacuuaguauaauucaacuuagacuuuuuuuuucuuguagcacguuugaauuaagcacuaaaauugguaggcuuaacuuguaaacagugcuagcuuacuguccuuuuaaauugauuuguuuaguuaccauaugaaauaauaaguuucauucugacuauuguugugggagaguuaggagugugcuuaugugucuauauuccuauuauaaaaauauacauauuuaguuugggguuuggcuugugucacuuagccugacuucccuuuuguagguucuuaaccuuaucaauaaaagaaacaauagccucagaagcagcauuuuucuuuucuuucuuccucucgcucauuuauucauucaauugacuucaugaucuaagcagcaggucaagcagccuacacacgcuggccucguuggggagcaggaaaguagcgaagagaugagaagguccucagcuuuuugaguuaguaucacagacaggcucagcaagcuggcguagccugagacagaaugagaaugucuaggguuucagagggagugcauuucuuccuuuggaugguuaauauuucauuccuuacagguucuagauguuaauucuugaucagauacauaguugauaagauuuuucucccauaugccugcugucuccugcacuuggguaauuguccccccauuguaaaauacuuuugcauuucaugcaguauuauuugucaguuuguacaguuauuuccugaauuaauggaagccuugugagaacauuggugguuugcucuagccguuguugguguucuggguuaguggggaugauggugagagagagaaagacaucagauacaagaggccucucugcagccuggaaacagcucugaugaacuggcugccugggagcuucuagaagccucucuauugucacacagaagucacucuuauugauuccuugugauuuugagaucaggccgcccaguccugcucacuucccagucucuauuauccacccuuugaccuugcaaccuuccacaaaauaaaaaucauacaaaccagaaaaggaaagaaaagcauagagaacaucucucaucauggaagcuguagcugucacagugugucccaugguauaucucucugcugcuauucauugcaaugagucaacagucuuguaguggcuauucuugguugucaacuugacuauauuuggaaugaacuacaauccagaauuggaaggcucaccagugacccuuaucuggaggcuuggagauccuuaucuggaucuugguauggagaucuugagccauaguggcuauggauuccagaagauugaaucuccgaguuuaaggaacacaccuuuaaucugggcuacaccuuucaucugggauuaaaggugugguggaacacaccuuuaaucugggcuacaccuucugcuggagacaauauaaggacauuggaagaagggagucuagcucuugcuccuucgccugcuugcugcgugagacugaguaacugcuagauccuuggacuuccauucacaccugugacuaaaccauuguugggaauugggcugucgacuguaagucaucaauaaauuccuuuacuaucuagagacuauccauaaguucugugacucuagagaacccugacuaauacaagucucuuuuaagucuauuaaaccagagucauuaucucugucuucugugacauacccaaucacaaaagaacucacaugauauguacucacugauaaguggauauuagcccagaaacccagaauacccaagauagaagauacaauuugcaaaacacacgaaacuuaagaagaccaaaguguggacacuuugccccuucuuagaauugagaacaaaacacccauggaaggaguuacagagacaaaguuuggagcugagacaaaaggauggaccaucuagagacugccauauccagggauccaucccauaaucagccucuaaacgcugacaccauugcauacacuagcaagauuuugcugaaaggacccugauauagcugucucuugugagacuaugcuggggccuagcaaacacauaaguggaugcucacagucagcuaauggauggaucacagugcccccaauggaggagcuagagaaaguacccaaggagcuaaagagaucugcaacccuauagguggaacaacauuaugaacuaaccaguaccccggagcucuugacucuaguugcauauguaucagaagauggccuagucggccaucacuggaaagagaggcacauuggacaugcaaacuuuauaugccccaguacaggggaacgccagggccaaaaagugggagugggggggguaugggggacuuuugggauagcauuggaaauguaaaugaagaaaauaccuaauaaaaauauauuaaaaaaauauuggacccugggacuggaaacuucuccugguuagccuguuguugccuugugucauggagauccuguagcuuuggaucugcaggucugaccuuuuuacuuaucccaaccauuugaaggugauauagauuugggagugagccaacucagagcccucaucugggccugaguugcucaggucuuugccucuuccuuaucugcaccaccagggugagcucuccagcacuguucugccuagauccccgaguagauccaucgacaggaggcaaagggcuccagcucucaugcucucaggccagcucaccuuaaggcacccagaaccagcuccacuguacugcccugccaggaagcauucgcccaaaaggcacuuuuagccagucauuuccacauaccaaaaccucucauuugauuuaaggaaccauuacuuaagcauauuuucagacuuccuguuuugccaggacucaggucuaaguuaugcaaaagcucugagaauccuugggaaaaacaacuucagaaucucagauagcaaaaggcgauuucacagccuaugugccagcacucagagcuuauccagauacaauggcucugcucaaauuagccacacauuuuagggguucuguggccugccagugacccauuuuggaugauuuuguauggggugagacagauggggaucuauuuuucaacguugggaaugugguguuacggaaggacuauuuucucggaauguagcaugacuauuagccaacguagagcaaagauuauugugaccuacccaguacucuucuuaauuauggucauugcagugaaauaagcaagacauaaugcgauagcuaguucugugguaauggugaugggaguguacaucucccuucuagaaggagagcgacuggaauuucccccaucacacucuuggcuccacguggucuugggugccgagcaaauaggaggugaaugacuguuaaccgagguugggacucagaugcagcacuugugagugcuguuaacugagguugggaccugugaugccgugcuugcaguguaucacccaggcuggccagacuuugcagugcuggagugucuuaguuacccaggcuccuguaagugacuccagcaagcucaguggcucaccaaguucauuuggguggaauuguuucaguggcccauuggcucugcucuuugaggguuaacagaugugugcucauucucuccaggggaagucacacaaacugugaauaucuugcuuucccggcaugagucacugaacuggcuuuccccccaaugaguacuuaggacaaauuugucaaaaauuagguggcugcagguaugcauauuuauuucuggaucuucugcucccucccauugaucugguaucagguuuugugucauuaaaugcugauguggccccuacagucauguaguggaacuugaaaccagguguagugauguugucaccgguacuccuacuguuggcuagucaaaguguuuuuugagucaguguccauccuagaacuguuuuuggccuucugugacaaaugccacuuguauuuugauagugaucgcauuaaaucuguaagucuucuugguaacauggccgucaucacaauucauaaaguccugaaguucaggagacuagugggugcuauuaucuugacaaaaucuagaaucaccuuggagaagggccucugggugugccuguggagggaacauuuugaucgcauucauugauguggcaagauccaucucaguuguggacaggaccauuuccugggcugaggaaugcugagcuguauaagauggagaaauagcuggucagcagcaacagccauuauuuauuucucuacuuuuuggguauggaugcaacgugccugauguuccaaaugccugcuucccuguuuuaguucccugcuaugauagacuguacuaugacagagguaaaccugucuuggaguuucuuuuguuaagggcauuuugauuacagcaacaggaaaagaaacuaccaagacagcaagaugguuuguuuguugguuugguuuugguuuuuuuguuuguuuguuugucuucaauuuuuuuuucuucagugugcuaaaggucucauuauacaagcuuuucaacuucucuguuugguugauuucuagauauuuuacuguuuaaauuauuauauuuuaauuuuuccuaauguauuuuucuuuauaaguaugcuauugguguacuaaaauagcugaugguuuucaugucaauuuuauaucuugcugcucuguugaaaguguugcucauauuuaauauuucuuugguggcugaguauaauguguaugccuuuaauccuagcaguugagaggcagaagauagaucucugugauuuuuaaggccagccugguauacacagggaguucuaggacagcaagaucuaccuaauaaaacuccauaucuuaguugcuguucuagagcugugaagagacaccauggccaagggaagaaagcauuuaguugggggcuugcucauaguuuucgaggguuaguccaugaucuucauggcaggaagcagacaggcaugacacuggagcaguagcugagagcuuuauauccugaucugcaugcaacaggcagagucugcggguuaccauggggaggggagacgaggcagguucagcagguggguugguuugguggagacuguggcuggagugcagggaagccuccuggugggagguuagaagcacagcucauuaggggaagaccugcuccauugcuccagcacgauaagaagaggcaguccgugguuuuaaggcguuuuauuguagauaggcagagaaagggagaguagggagguagaggccggucauggccauauggagaaggggguaaggcaaggcagagagugguagagcaugggagcaagaguaagagaauaagagguaagagagcaaggauggggcaagcagcuccuuuuauagugggcugggccuaccuggcuguuaccagguaacuguggggaggagcauaccuggcuguuggcagguaacuauggggguggaguccagacagaauaccaggagcuugggacauugccuacugacugauggccacacaccucucugcaggggacccggggcaggggggggggggcccugugggaggcuguagcugcaacaggagccaggggcccaggaggcguggucaccaggguuccaggccugugggcgacuggggaccaggcugucugugcacagcucacugcgccacaugagcuacuugcuaauauucuuccucucuaaaagcucuugaguugggcuugcuuggcugguucacguugcucucagcacuacugucuuucaugcucauacuaccauggcccaucucaaugcguuaaacugcucuucuaaauccaaaguccacagugcaaacaagcagcaugaucauacuugucacaguaauaacccacaccaggcaccaacuucuuagucacuguuuucuuaccuugaagagacaccauggccaaggcaacucuucuaaaagaaagcauuuaauuggggacuuacuuacaguuuuagaggcuuaguccaugauuaacacagcaggaagcagccaggcaucuugcuugagcagugccugagagcuguauauccuaaucagcaggcagaagcagaagaggugugugugaggggcacugggaggcagugacagacagacagacagacagacaggcaggcagacagacagacaaccuaaaaccccgcugccagugauauaucuccccgcaaagaggcuuucuaaccuuucccaagcaguccuacaaagcaguguaaggguccaggauuugccaaugaaugauacccuggacucaaauaguauguaaaugcaaggaguguuuuguucugcaguuuaccauuaccuugaagugagcucacaggcuggauuuaaagcacauuaggggaauuuauguggguccugagaacagaccauguaucuucugcaacagcaauaagugcucugacuggcggagccaugucuccagucuuugaaauuuauauuacuuuucuuauguauguguaucagggaggagaugcacacauuagcgcaggugcccauagagucuagaggaaguugaucccauuggagcuggagcaggagggugugagcugccccaccacgagugcuggcaucugaacuuggguugaacaaaaugaacucuuaaacuucugagccaucucucgagcccuugauauguauauauugguuaagucauccuugauccuugaaguaaaaccagcuuaaucaugauuuuuaucauaauuuuuauuuguuguugaauuugauuugcaaguauuuuauuuaggacuuuugcaugggucuauaguuuuauagucuauagucuauaguuuuaauauuguguccuuaucugauuucaguacuggcucauugaaugaguuugaguguuucuuuccauuucuaucuuauggaguacuucaaagaguacuucaaagaguugauuuuuuuuuaaaggccuguuagauaugagcagagaaucuguccaguccugagcuuuuuguguugagaauccaucuauuauggcucuuaugucauugcuuguuauaggccuguuugaguuguuuguauuuucuugauucaauuuugguggguuauuuguggguuuuuuguuuguuuguuuguuuuugaaauauguuuucaaaguauucccucauugucaugaauuuuauuguaaucugcuucaugucccccuucuucucuguaauuuuauggauuuaggucuugucuuaaggguugguugauuuuuuucaaagggcaguuaaugcauuuuuuccccuagucuuuugauaucuguuuugauaaauuucugcccuucuuuucuguuguuguuguuuuguuuuguuuuguuuuguuuuuuccguuucugcccuugggcuugacuuguuccuguuuguacaucucaaugugcaucucuaaaugcuugggagcacucgagauuuucagugcaaucacuagcaugcacuuagucuguccucuuaggacauccuaugcuguuaggcugucauuuucauuugacucugggauuuuaaauuuuauuuuuuuuuauuuugcacguaugggaguuuuaucuacaugugugucugugcacccagaaagggucagaaaaaggcacugggucuccauuggaacucaaguuacagaagcuuaugagccuccaauaggagcuaggaauagaacagcuaguauucuuaaaugaugagccacuucuccagcuaggaauugagcagcuaguguucuuaaaugaugagccauuucuccagccccaauuuauuauuaaaaaaaaaaaaucccugauguugccuauaacccacuggucauucaaaagcguguuguccaguccugcauuuguuugucauuucucuuguuauugguuuuuaguuuuauucaguuaugauuugauaaguugucauuuuguuucauuuggagacauuugcacuauggccuaacaugugauuuaugucagagaagguuucagaagauuaauauucuauaguuggucauuuggaagauagugucgacugacucugacauuucuuuacuggcuuuuaguacggaugaucucucuaaagaugaguguuauaugaagcugcucacuaugacuuuaucaggaucuacuucccuuuuaugucuguuaauauuuguuggauagauugagaguuccaauauuugaugcauagaaauaacucauuuuugguuaaucauuuacuucuuugauaugcaaugaucugcuuuaucacuucugguuaauuuuggauugaagucugccuuaugaacuacuagaguagguaugccugcuucuauggcgcuccacuugagggugcgucgauucucacccuuucacucccgucugugucuuugccagugagauguguuucuuuuagacaacauauagcucaaucuuauuuuucuaacccaaucagcugcuacagaccuuuaaauuguaaaguuaauaccauuuacauuuagaauuacuauguggaguaauuucugucauuucauuguuuuuccuguuugguuguauuuuucuuuguuauuuucuuucuccccuguaucaauuaaggguuuggggguugacuaauuuggauaugauucgucauugacucuuuugcuuucauuaaucuaucucucucauaaauauauucucucguguguugauacugcauuccuucuuucugauuugaauucaccuguauucugccacgcuggcuuggugguaauggauuucuuuaacuuguuuaggucucagaauacccuuaucugcugauuuuaaaagauaacauuacgggggcuggaaagauggcuuagugguuaagagcacugacugcccuuccgaagguccugaguucaauucccagcaaccacaugguggcucacaaccaucuguaaugagaucugacucccucuucuggaguguuugaagauagcuacaguguaauccuauaauaaauaauuaaaucuuaaaaaaaaaaacuuuaaaagauaaccuuacuuuauaucuuuguuagacaucauuuaaccucagggcuugaaauacaucauucaugcucucaugacacuuaguucuuuugagugcucugauguuauuuauacauguuugcuuuuguaugucaguugacaucuuucucuuacaucccuaauauuguuccuuguuaugcguuuuugucaucuugaccauaauaggucucuagucaugucuguguaagacuuuaaauguguacugugcuuggaugucacuguauuuagauuugggaagucuaggcuauaaaucacugacaagauuuuuuuucuuuucuuuucuucucuuuucuuuucuuuucuuuucuuuucuuuucuuuucuucuuccucucucucucuuuccuuccuuccuuccuuccuuccuuccuuccuuccuuccuuccuucuguucacaucucacuuccuucuuuuaucuaauggauuccuugcuuuagugucccaugagacagcaaaaauauaaaagcccaaauagcaagcuaacaauaccaacacaacagaaaauaguguguaggagaagcaguuugaagugcuuuugaguaccagagccaaccagguccacguguaagugagcugagguuugagcuuucucuguuugucacauaugaaugggugucacauaugaaugggugucacauaugaaugggugucacauaugaaugggugucacauaugaaugggugucacauaugaaugggugucacauaugaaugggugucaggcuccugggcuucuuaaucucuuaaucacucagugcugucuucucuccuuuuauucuuuauuuugggaauuugucuuuuuuacaauuuucguuucgauuugcuuaucuaaagguauauuaauuuuguugcauuauucaaaaaccaauuuggcuuuacugauuuuucucuaauggcauuuguuuucuauucuauuuuuucuauguucuuuuugaaaaugauuuauuuauuuguauucaauguauauaaauguuugucugcauguacacuacauaccugguaccaaggaggccaggaagaguguguguucccuugaacugaaguuacagcugcuauguuacugcuggaaaacuaacccauguccucugcaagagcagcaaguucucuuaaugacucaaccauuucucuggcuccauuuuguauguuccuuauuauuauucuuuuaaaaccuuuuuauguguauuuuucuuucuuuuuaaagaaauuauuaguuuguuugguuuuugucgggagccauggccuugugaaaaauuucuagcuuacauaaacagcccugagagaauauucguggucauaacagaaagaauauuugugaguagagagagcacugugauccuugguuccaggagcugaagauugccaccugaccuucagagagccccuugaccccagguuugcccgaccuguagggauaaucagcagagacauagagcuggggagagagcaugggagggacaagaaacacaaagaaugaaagcaagacaauuagacugauuaagcuuugaaaaacuuuauucugggauggcaauauaagaacgaggagucuucaagggaggggggaagaucccaugggcucuuugaaggucagguggcaaucuucagcuccuggaaccaacggucacagugcccucucuacccacaaauauucuuucugcuaugaccaugaaugcucucucggggcuguuuauguaagcuagaaauuuuccacaaguccauggcuaaggccaugguucccagcaauucuuaauuggaugcuuuauguuuacauuucaaaugucauccccuuucccaguuuucccucugcaagcccccuaccccauccccccuuaccccaguucucugagggugcucccccacccagccacucccaaauuaccugcuucuuauuucuaguuauuucuaauaauacuuucauugccuugugaucagaggguauacuuugcauuuuauuccuuuacauuuauugaaacuugucuuaugucuuagcauuauaggcaaaugaauauugauauauaaucaaauaaauguuaucucucuacauauaaaguguuuuauauaugucaauuauauuaacuugaucaauaaguguuguuuuggucuucuguacucugguuaauuuucucuugauuuuguucuuuuuucuuuuuuaucuauuuuggucuuuuuuugagcuagauagauuuucacuuuguagcucaggauaacuugaaaauuacuguugcccaaucuauccuugaauaaugaauaauggcauucccccugccucaaacacacacacacacacugaagagcacacagcacacauacacaccacauacacaugcacauacacaucacacauagagaacaccacauauagcacacauacacacacuacacauacauacacaaaacacaugcauguacacacacacacacacacacacacacacagcacaaggcacacauacccacagagaaacguaaccugaaaguaaagcuaacuuuguccuuaauuuccucgaaacccauguaauaguccucugcuuuuuucaaugauuaacaucaaguacacugucaugaauuuaucaguaauuucuguuucuauuuuaggggaugugaucaaccuuggcgacagacagcucacuguuaugcacaugccaggucacuccagaggcaguauuugcuuacaugauaaagaccguaaggugcucuucaguggugacgucguguaugauggaucacugauugacuggcucccauacagcaggaucagugacuauguuggaacuugugagcgucucauagaguugguggaccgaggccuuguggagaaggugcuuccugggcacuucaauaccuuuggugccgaaaggcuguuucgcuuagcuucuaacuauauuucaaaagcugggauaugccacaaagugucuacuuuugccaugaggucucuugcaaguuuagcucuccguguaacaaauccuaggaccucacccuaguaucuacacuggucauuuguuuguauuaacuguguaaauuaacccaguucccccauguuguuggaaacaguuacuagugagcauuucaaaaagugcuuuaagaucacaacuguauguuagagaaaaagauuaaggaggaagccaaaagaaaaaaaaagaaaaaaaaaaaaaaaaaccaacccagagucuuagcuuaguaucuuuuucuuuucuucgaggaagaagccacuuaaauaagcuugcaauuggccaaugcugucauuucagaguguguguccuggcaauguugugaagugcuccaugcauuaaggaugcacucacagcaucucaaagaacugcccuugucccauaguuuacuuccccagauaaugagggggaaaucauaugggguucugugcuuauacuuuacacuugauuuuaucucccuauuuuauuuaaagauaaaguuuauuggguucaaaaauaagguagaacucaacguaaacuagcauuuagaaugacagcuaaaacagcccauauuugugauccuggauuuuaugccuccuuuuuauuuauuuuuuaauuuuuuuguauaaggcauauaacaugcuuucuaacuuuacaguugaacaguacaauggauuuuugucuuacugcaaagcuuuaaauguaaauugcagagcacuucaguaaaaagcuacugcuuguuguuuguuauuguguaaguaauauuuucagucaugaaagugaaauucaaauguauguuaucuaacuauaaauugucagauuucuuaaaaggacacugucaggcaaauuugaaaauaaacacauugagaauaauuuuuuauuauauccuauuuuaguauuaauagauacuauaaacaaauuuuuuuucugguuaaauagcgauuucaguauugugucauguuuuacaguaacaaaacaacuccugauaucucugacaucuugauguaaacaauucuuuucauuaauauaacauguauauuaccacagaagaauauuuaaauuuauggcaguauauguauuaucuauuaacuagagccaacggccuucuuauccugauucacaacaccuguuccuguucaguauucguugucuuaaacaagaacaagucaauguucauaugucauagaaaauuacuaaaccacaauucagugacacgagguaaaauguguggguuuggugcuuuuaauaauaauaauaacuuaucaaaacgccuuuuggaauauuucauaaaaguuuuuaaaacaguuucccacuaccuuuuuuuuaauuauugcuguuuuauuauugacauuguugaccaaacagauccacuuuugaaacucagaucacuccguaccagcaguucuuguuucugucaaguuauguaacuuuuuuucucugcaaacuacccagguuuuuuagguuuuuauucauucaguagacacacaugcaggcaugcauguacgcucucacacacacagacacagacacaggcaugccacauuuacacauagguacacaguacugugcuaaacaauguaggauguucaaaagugaaagaacucacuauagcuagaaguuaaggccacaaccccccgaaaauaauacaugcaaguugacauuaauaaauguaaugcuuaaauguaaaggauacaaggaagggugugaaguuggguaagggcaaauuccuuggaagaagggauuuuuuuagucagauuuggagggaagcugggaaauaaaaaagaugugggaaauaaaaaagaaguuuucaggaauugcuagauggacuagccuauuccuugcgaccguauaaauuuaauuuucuggaaucccauuucuuccaaauaucauaugcuuagcaugaaaaagacggguuuguaauauuguauauguggcucauucuuaaagucagaugaacugagcugucaugugccaccauauaaaccuuugcugacacucagaaaggaggucaugauugguucugucguccuugaggacggugggucuguuucaacuggugucacgguaccuagaauagagauugguucagggcaacuacaaccacuuaauaagccuuaaauauagccauuauuuuuguaucagcagcacaaaauaaagccaaaaguccuuaaucauugacuauuuucucauauuuuaguauuuacuuuaaaaucaggauagaguaggcauuaagcuuuauuaggaaaauuuauuccugaugagauguuuauuuauuaaaagugcaauuuuucaguauguuuuuaaaauugcaauguaagauugcgauauuucacuauugcuacccugugaaaauacagaaguaaauucauacucauuugguauucaugauccauuuuaaaugugcauccuggagguaacugaccauccucagacagcaugggcuagaaacaaugcuaguaacugcacacagguuugccugcucccgaccacgcccccucuuaaaccugcacaauacacagaauuguccacauagauuuuuuuuacuuucuaacaugccauauaugugaaaaauaaaucaaauaauaucaaauccuaagagcaguuuuagaaaauaagaaaauauguauuuucacccugacagugacccuuguaaauuuaugauuuuuuuaaaauagaauauuguaguggaacucaagguugucaaaauguuagacaugucaaaauuauuucuuauuuauuauugcuaauaaugaacuuguggacuuucacuuuauuuaauuaaugucucuuuuuaacugagaagcuugaagcaaacagaaacuuuguguguuauacugauauaauugaguaucugguuauguguauuuguucuaauauggaaaauaugaaugugacaugcacaaauuguucuauaauuuucaaauauguguauguaaacauuggugugguaacuauuaaaguggccauguauuucaguguucaag

SEQ ID NO: 7143 - RNA, 5049 nt, Mus musculus
ugcauauacacaauuauuuuauuuacuuucuuuaauaaauaugaauuuaagucugaacucaauguucaaauauuuuguucacaauuuuugauuuuuaguugaaaucaauauuuucccuugaaauguaacuaucacacagcucuuaucaguuguacagaccuuuuaaauaguuuauauuuuucuauugacuagaaagauaccuaaaucaugagugguguugggagguaaucaacaaaacacauuuuacauuuuccucaaaugccaaaccagaaaaugaaauaauuuuacuauaaauuuaagacgaggaugagugagcagcgguuuagauuguucuuuauaauucauaaucuuaaccaacacacaauggaaccaaaccaaacugcaacagaggugauacggagcuugugggauauuugacuguuuuugugacuucugaaacugauuuaaugggaucaaaaaaugguaaucaagaaaggggucuauuccaguauuuugguaguaguuaauggcauuugaacuauuuaauugugccaccucucacauauucuuugugaaagcacuuuauaguagcugugacaaaucuuaaacaaguuuacuuguaguuuugaaagccagacacuauguguaggcuucacugggccaaaaaaugguuggaaagacuggguuucuuuuggaaaugucuagcagacacaucuagccuuuugaaauuaggaacaacacugucaucuaugaaguuuacuauggcaaacugcacaauugaguuauaaaucguucugccaaauucucauaagucuuuaaguaauuuaugcauuugcauuuggugguguuccccacugucuugaagucugacaauccugcuuuuagacuaucuuuauucuucacugcuagauagauuccagcuucuagcaucuaugacucagggagaugccuuugacgucucugguucuguucucaaaaccaaguuuucuggcccugaucacaggugggggaaauccuguacuugucagaauuagacauuguuauuagacucuguucacucucaugacccauuuuaaccucauaucucaaggucugaacucuaaucacacuuguagacaucuucuuccuuauuaggugccacauuuauggauucaggauaccaagauguagccuuagcuauuauucuaccuaccacacuacuauaaucuaugcacagccuccagaauagucacuuaugagucacugauaauucuacaguguuuuaacuuacuacguaguauuaccugugcacuauuuaagaaaugacauucuuauuaaauuguuuauuuuucaagaacuuuuuaauuaucuuugcuuuucuguauagagauaaguacugucuucaccaugccagugaaugcauccaccuucuuugucuccauuuccauugcuugauauucauuuaauuuuucuuuuugagacuuuuccucccaguacccauuaaucuguuucaggccaacagcuuuuuaggcuucuuguauuuccuuguucucuuuguugacuuguaucuuaguuggguuuuacugcuguaaacagacaccaugaccaaugcaaguccuauaaaggacauuuaauuggggcuggcuuacagguucagagguucaguccauuaucaucaagauggaaacauggccccauccaagcaggcauggugcugaagaaucugagaguucuacaucuucaucugaaggcugcuagcugaauacucaguuccaggcagcuaggacuaggauauuaaagcccauacccacagugacacaucuacuccaaccaggccacaccuccuaauagugccauuccuuggcccaagcauauauaauccaucacaacuugugaaauguuuucauuuaauauugcuucuagguagggaggguaugggggacuuuugggauagcauuugaaauauaaaugaagaaaauaccuaauaaacaaaauaauauugcuucuaggacaaauuccuauaagcuugguaggcuaaaacauucuccagauuagguauauagguauagcguuguauaaguaauuugcuuagggucuugcaauuccucccuagguauaagugaugccaucccccauucuggaggcuguugaagaugagugugcuuucugagacuguuacuccaaaucaguucccugccuuuguucgauugagggucccacuuuucuuuuugaaggccauuuuaugacuuuaaaagaaaaacagcaggauaggcaaguugucuuaauagcuucucagagaaggugggagaagcagcuaaagaccaauggauuugagugucugcaagaguuuuuagcaugcugaagauuuuugcuaguuacuuuugcuacaaaauaaaaauuauaauuaucaugcguugaauuuaaagcacggaaauuagcucaagaaucuuaaaaaaaaacuugcacaaaaauccaaguggaucaaauauguuuuaguuguagaaacagaauuuuauuugauuacuuuugucuauauugaccaaauccaguucuccaacuuuuggucacuuuuaguuacuuuuauuuucuuugaaauaauuuaaauuuaacuauguauuagaagcaucaaauuuauaauaauuauugugugugugcaugugggccacagccauggcacgcguguggugucagaagaccauuguuugagguugguucucucuuuucacaauggguuuccagugggguugcaaggcaggagaauacaacuucccucaucaggcuuguaugagaaauacuuuuaagcaaaacuuucuuuuaaaguauuaaguaauaauuucuucuuuauuucacuuccuagaagaaugugaaauuuauguguuucaagaaaauucuucauauuaaaugagaauauuuuaccagcuuuuuaauucuaucaaaguuccauuaaaaaaaaucucauuauauuauuucucaguaauuuauuccuucuaguuuaguuuauuuuguccuuuguuucaaacaucuccauguaaaugguuuauuuucaccuuuauuuaauacuuuucuucuuaggcuugguuuuacaaucuuaaaauuuuaguaguuuuuuuuuucacuaguguucuuuaguauacauaugacguaaucuaauuuccuuuuuuuguuuguuuguuuguuuuuucgagacaagguuucucuguguagcccuggcugcccuggaacucacucuguagaccaggcuggccucgaacucagaaauucaccugccucugccucccaagugcugagauuaaaggcgugagccaccacugcuuggccuaauuuccuuuuaaacuuguuaguaaaaguacuuaauuuuuauauuuuaggcagggucuacuacuaguccuggcuggccugcaauucacaauguaaagaauucaaagaucugcuuacaugucucuugggugcugggauuaaacauguguagcaccaugcccaguugaguucuucaacauuuuucuacuuugguuuugggagugcuaucauuuagcuauuacuuuuuagcuuuaucccaauccuuuacuuguccaaauuccuaucuacacucuagcuuaacucaugcauagccaauuacacagcguccuucguucacauauaagcuuacauacaguauuugccguuucuaauuccuagccccaguuuauuguauuuauaccgauaagcacugcagguuagcucaguaguuuccaaguuuuccacaauaauaccucauuuuaugcaucaaauauuuauggagcaccuaaguuccagauauuuuguuugguacaaauacucguguaaacagaacccuggccuugaagacagucagucucgcucgcagucugaugaucuaaguaaacuuuaagaggcuuggugggcagugaagauaagacgcacauaaacacuuuauagcacuagaaaaugagaagcagaagcaagcacacauuuccaaucgcacagaagaaaagggugguuuggcuagucucauuguaaaugaccuaacaaaacagcaaaacgagaagccuaauccauaauccagccugccuuaaaaucacuugggagauguacgggggagaacgcuuagcuugguccucacugaacuaagaauaaagaaugucgccuuuagauuuaaguuucucaggugcaccggccaccuaaaauuguacaucuuuucgcagaccugguuccccaauaaacugcucccucguucugagcaggcugcuugggcuggccuuuucccuucccucggucgacgccgugcaugucacgcguggggccucgccuugccugccugagucucgcguggugacucuaauacgcgcgcaagggagucgggaaagaaccuggccaauccagggagccagacugacaaccagggccaaaaaauguguacuugauugacaugaaugcugaccaaugaaaaaagaagagcagcgacgcuuccgccccaauaggccggcuguuggcaauuucagccaaucgcgcccagaaacuugucuggugggugguccccgaggcguggagguugguggcuguugagcgguucccgugguaaaguccccgaguggaacaucucugucggaagagagaaugaguuuagcucugaggucgguaacgaggaggccgugccuccguccccccagagggccagggcggguguggacgggagaccgggucgggggcgggugcccagcgccgagcaccagaccucggcgguucccgccuccgggcaccgccgcagcccgagugaagucucgcgagguuucccucacgcgacugcgggacucagcccugguugccugauucccccuggaaagucgcaggagcgcucgccuuucuccccgggccccgaggcacgcugugcucuaggcgucucggguggagcucguuuccgugacaccguccuuucacuuccguccaucccuccccucauuggcuccucaccuugcccaucuacaguuaaaggugccccgggcgggccgcgccgcgccgccccuuuggcuccgcagggugacgaaggaggcgggagcuggcguggggguguggcgagugggggcagccggggucacg

SEQ ID NO: 7144 - RNA, 6143 nt, Mus musculus
gaaaaauaaacgcuguagccuucggaaacgguuguuucggcuccuguucugugggcggcugaggaccgcgggcugcccugcuccgagaacagguuagaagaggcagcuccagcccaugcauaaucagggcuccgcggcgccuccauucuuuccuccuccuccuccuccuccuccuccuccuccuccuccuccuccaccaccaccaccaccaccaauaccaucaccuuuccugcuccuccugcuccaacuccccuugggugcagcguguauuauuuuuaauacugaugcauauguaaauauauuugcauuuuuaaaaauuccuugaaauuuucugguucuacaguuuuguugauuccccucccccucccuuuuuucuuccuguuuuauuaugucuaucugucucuguuguccguucugacuuuuuauuuucugucuuuuuuuuuuuuuuggcuaauguuugcuauuucuagcuagauuauccacacaguugccuaccuucuauuuacuuaagauuacaaauaugcauuuguguuauguauccaacgccaacugggggaacauccuaguuugaccauaaaagaaacacauuccuuuuugucuuucuuuacauaccccuccauugacuauaaugccuacuguuuugaggcucaaaguuugauugucugauuaacuucauauaaguauaaacacagguuggagccaauuuauuugagaaaguaugugugagugaagggauuccaacgauuacuaaagaauugugcucauuaaccgagggaaugcgguauucacuagcuauugcuuucuaacguuucuugcaaaacaaaaaucuauuuaaaaauguguagagacagcaauggagagccaucugcaaggaggacauuuuucaaccaugcuguauguuguaucaugucugcagcacucaaaauguacugaguuuuauuuugucucuauauagauggaagcacauuaucuugacugcaaagcauccuuaauuccagacuuugaagugaaaccacacagacaaaacagcuaacuauauuaaagcaggcuaugugccuuaaaauauacaggccuugagcuggauuucaagcaauaguaaucguguuuauaggauauaguuuuuccuucuuggcaauauucagcacaaggacuauugaauauauguauauuuaaauuacauauuaacauucccuaaagcuaucuuguaaaaaagacaauccauaauugcauaaccacaaagaacagaaaaugugcacacaugcagcucuuucgaugaaacaagucugaguccaugcacagguaauuaguuuucuuaugaaugacuuaccugcacagauacucgaggcaagacucagcccuccccaacggcuuuuguguauaaauauucacauauauuuccucccaucucaaccuacagcuguaugccaucucuccuuuuggacucucuagcauccauuuucagcacccuuaauucuuauggcauuuuccagccuuaccucuggcuauaguuuuuccaagccuacacgaaagugcucauaugauaugucacccaauaaaaaguggucagauggcuaugcguaaaacauuaaaaaauggaaacacauccacccuucagguucacccuuaccuugccauauauagcaagauuacguuucuugaggugaaauuucagcacauuuugugaauaauugcagaauuccucaacugguuacagaauuccgguuggggugggggaaaccuggccgaauggauuaauucagcaggcugaaugucugaguuuggcugcaauucaauugugcguggcuguuuauucuugccuguguucuggcacguaccuguccccuuuuaugcaggaucaggacaaacacacuggccacgcugcagggcauagagugucggugcauguauuuagauggaaguagcaaagaauguggaacguauugcuguaugagcaugcauguuuguacaaaugcaugugcacgcgcgcugugugacaagggacagagagagguacaccucuuaucucugaucucucuguaaucuuuucuguuucuaaucucccucauuggagucaccaucgcuguggugugcacacuguggcuuaccccgagggcccguggcuuggugguuuccuggcucgaugagugcugcgguggaggguggggagcgccgcugccgccgcugccgcggguccgggugcucugucccagcacagcagcagagcgcgcggugucagagccccccucccucccgccuucaaccccauccuccccuccccuccgcucugugccucccuccacccacccccaucccccgccccgcauuaccauauggaggccgagucccugcgaaucacagcagcagcgggcgguauuugaauaagccccgcaacccuaggcggaccccaauuccuccaccagcagcguucucugcacauagggccaccgcgcuggucuauaaccugguagcuacggacaccucccuaaagucccuaaugcgcgcagggaagagggccagauuaaggugcugggccucccccuugcuauuuucguauuaacuucacugauaaaaacagacaauaaauuauacaagaaaggagcgggagagagaaaacagcgagaaacagaagaagcgagggaaagugggagaggcgcuauagaggaaggaaggaagacagaagcaagaaagcagaaaaugaaagaguugagugaaacggaaaucggaugagauugguacaauauaaaaauauaugaaucugagcaucucaagcuaaaaauaccaucucauugaacuucacaaccuccaauuagaaacguguccguccuacccccaaccccagagaugaaucugcugcuucgauaagaaaugauuuuuuuagaauuguguaaaaggcauaagacuuuaaagaaaggagccgauuuuaugaaagggcaaaugcaaagggcauuuaaugaaaauauuuacgaacucuugcuaaauuucaggcucucagugacuacgcagccucuugcgcugcggguccugaaaugguaaggccucagucuugacaccagaacaaaauuauucaaacauacuugggacuaaguggaauuuuuuuuuccugucugcuaguuuuauauuuguuaggguuuuccucucuacaaauguuuuaguuuuacacaaaaccacagcaguaugucuucuucuucuuuucuuuuuaaaucacauagcaaccucuugauugaaggcauuaucuuagagucaaguuaaauggacaacuacuucuauuuccacacuaccucuugcgauugcucaagaccgugaauuuaggguggcuccugcccucuucccuugccaccuuuuaacagagaagugaauucccuaugcaaagaaauccugauaucaauaaaauccccagacaucuacaggaugcaaccaauguaagugcgugucauggaaucuucaagccaaaugccccccccccccagacacaaaaagaacgccucugauuaauaaucgcuuacgccgcauacugagccaaagacagggggccgcaggacgccagagaaaggaacagaauuuucaauauccagaauuucaguacagauuccaaagaugagguaacccuaucuagugaagauuaauacuuaguaaauaacgguuugggguggacagcgggacgucuaguguaguucaagcuuuucucagagcaaagggaggacaacgcaaucacccgacauucugcauacagcccuguagguaagaccguagguaacucaaaguccaggccuagcacguucucucucucucucucucucucucucucucucucucucucucucucucucucucucucucucucucuccuuccuccuucccucucucuuucuuccuccuucccucucucuuucucccucccucccucucucccccuucccucccucguucucuuccucccucuuuccuugucuuuugagauaaggauauuaaaacucuuuuugugagcgguucccgcgaagcuagauuuugaaccuuuuguuuauuuuaauuucaaagucgaaguacagccgugugugaauuccuuaauuuaggguuuuuuuuuccggggugcuccagauagccccgacgccacccuaggcuuggggagagaaaggaaggagcgggugaagcgggcuccccgcuuauuccagcagggcggccuuugggccccaccaauauuccucucuccuuucucucuccauaggcccaccaauguugcuguggucgcagccaggaggacuuaggucagggguucuagaaacaaaauaagggaauugccauauccccagagcucaaagacgucuaggaaaucacccgggccagaaaacugaguggugcuaggggccaacgucgggcuccaggguccugccagcagggaaacagcgacaccuacuggcccuugagcaccucgcuugggucgucggggcggcccuggccugggagaaccugcauucucuggacuuggguggcuucaagaucuuuauguucaagacacucuggacuucuauagccauuacugaacaaagaaagaaaaagcuauaguuucaagaugguccuaggggagccgcagaagggaccugauaacacaggcaauacacacaaccucuauucgaagauccuuucuucuggaacccuggggaccugcaaauacuguugaccacagccaaagcgaaauccuaauuuacuugagucuauauuacaguccucuucaucaccguaccuauuucagcgccaaacgaagacugcaucuuuacaaauguccggcaccauaggccugucauuuguuuaaguccuuugggaugccauuugcaccuuuauuguacugacuucauccagaaauugacagcuuuucuuuucuuuaauuccucauguuaggacaaacuuagagagagggugauguuuuuaacacacacacacaaacacacaccacaaagcaucuauaacaauguagauauguuaaagaauaugcacuuuauauaacauaucugagugcaauguguguauucuagacuuugucuuaugaguuuuuuuuuuucccccauacaccaaauggucauuuucugaguagauguggugcaggugggccgggcacugaguggaggagggaggggacccagcagccccucccacucucuauguuuccuuuucaugggccagguucugagcaggcaggggccucugaaaccuuacugugguucagauaacuaaccuguucaaaugcuagggcagaugccuuccucguagaacacuggagcauuugaagccuuugagguuucaauuuaaaaugucacuuauuaacaaaucccaguuuuuaaaacaaugaaugcaccuguuaaucuaaggucaggauuuccuaucgaauacccuuagcuguagaauagugaguggaacaacggucuaaaauaucucacccauguggguaagaagccuugguauagccaaauuauugucuccauuuugaauaauugcaaagguuugcuaauuacauuuuucuuuaaauaaaacaggaagcucuuaguuucccuaaaaacagaugauuaaaauauaguuuucuauguucuuuuuauuuauuuuuuuaaaaaaaaucucccaacuguucaugaagucucagcucauuuuuauaaaugcaguuuuuguucuaauuuucuugaaaguggauaggaguauguucuguaacauaugcacucaaaccuugagauagacacuuagcaaucugugugguguguggugugugaguaaacucacauugcuaauacugaauaaaacagagcucuauuccuucucaaugagccuuauaucuugcugaguauuaagguuucuucuugaaaaaugaagccuucauaggagagagaaggagagggaaaagacugcagaacaauuagacuauacugggcagacauacaccaggcaaccaaacccaguucacagggguuuuuaggucuugcaagcaccuuggaaagcggcaguguuccuuuucccuucucugugugggacuuuagaauguaucuuauuugucacccccaaaucauagcuagaauggauucugguuucacugucuuugguauaacuuuaaacauuuuugagcccugaugugaaaaauacagaaaaguggaacgugugcuuua

SEQ ID NO: 7145 - RNA, 34087 nt, Mus musculus
cagagcagacgcuggcacgugaccgggacgucacgcacgcguccgcggucugggcgggggcggggguucgcgcguuggccgucgcucguggucgcugucucucggagugucgcuguuuuugucgcggcccugcggcccgugagggcuacagcauguaucacagcagcagccagaaacggcacuggaccuucgcuagcgaggagcagcuggcgcgccugcgggcggacgccaaccgcaaauucaagugcaaagcuguggcuaacgggaaggugagguccccgcgagccagccccugugcccacccuaaaccugggaccucuccugaagucccgcuuugccugcaggcuggaagccuguagagcgcucgccuggcugugucagugcagacagggacugacgcgacagccaaguccggggcuggcgguggcagaggucugagugacauccuggggacuggcaagagccuuggaagagugcggacuuagugcgggacucgaacuggucacuuguccugcaggaugucacgacaaaucauucucuguagauggcaggagggagggcacacacauaggcuggugucuaguggaaagucagacuggcaggcaagugccuggagugcugguggucacucauggaugaagcuguaccucugcagcagugguugaagaacgugcacaagcaacuuuguaagcggaaguguaaggcgguugaaauucuugccaaaacugaaaggaacuuuucaaagacuugaaauggggggaugauggcuuguuggaucugcuuuccagaaacaaccuucacacagaagguuguacaaggaaagaaaauaguugacacaaguaaugcguguucuaugggccucuauccaggucuuccuacaacucucccauucauuucuguguacggcccuggauaacuuuauaguagcuucuacaaauuucaggcaaauaaaauuuguaccaacaaaacagguagacaaugaacugaguuauuuuaauuuuggugacauauggauuuacugcaaaagcuacuuugggagaguuccaacccaugaaaauauguauuuuuuuuuuaauuuacaaauaaugguaucaaaccugggagugaauugacacauacucugucaugacuguuuaaaaauguccagcugacaguuugagaacuuguaaaaugaaagccuagauucaguuuauugauuuuugcuuauucuucuccuagauauuuugcuugaugcuuaguaaacuuaacaaagagagaaagcuucaggucuauuuuuuguuggugguauaaguccaauuuaagcaggacagauaagacggucuuacaaugaauucacugaccuuacauugaaaugucugcucugucuaaagguucuuccaaaugauccaguguuucuggagccucaugaagaauugacacuuugcaaguacuaugaaaaaagauuauuggaauucuguucaguguuuaaaccagcuaugccacggucuguugugguaagugaugggagagaagaauaugcuuguuagcuggcuugagagaauugaacuagacuuuucccuucuuuuuccuccauaauuuuuuuuucacauuauaucccaauagcacaccaccucuucucauuccugccguuugcaaauucuucugaccaauacucccuucccuucucagagaaggggaagccccuccuccuuuggguaccacccugccuugugacaucuagccccagaaggacuaagcaucucuaccacugaggcccaacaagucauucugguugggaaaggggauccaauggcaagcaacagagucagagacagccccuguuccagauguuaggggacccauaugaagaccaagcugcacaugugguacaaauguggaggguuggggagcuagauccagcccucuuuggugguucagucucugugagccccaugggcccagauuaguuggcuccguagacccuccuauggaguccuuuacaacucuggccugcucaauuccaccacucuuccauaaaacuccccaagcucuucuugaugucuggcucugggucucugcagcuguuuccaucuguugcuagaugaggccucucaggagacaguuaugcuagguuccuaucugcaagaacagcagaguaucaguaauagugucggguuggcucuuucccauggaaugggucucaaauugagccagucauugguuggccuuucacuugagguugcuuccaguuucuggcuauuaugaauaaagcugcugugaacacaguugagcaagugucccugugguauaguggugcauccuuuggguauaugccgggaagugguauugcugggucuuaagguagaacuaauccugauuuucugaaaaucugccaaacugauauccaaaguguuuguacaaguuugcacucucaccagcaaaggaggaguguucccuuugcuccacaucaucaccaguauguggcuggugacugucacuucaguuuuguuuguuuguuuguuugguuuuguuuuuuggcgagacaggguuucucuguauagcuguggccgucuuagaacucacuuuguagaccaggcugaccucgaacucagaaaucggccugccucugccucccaaguguugggauuaaaggugugcaccaccacugcccggcucaguuuuugaucuuagucauucuaauggguguaagaaggaaucucagaaucuuuuugauuugcauuucccugaugacuaaagauguugaacauuucuuucagugcuucuccgcuauuugagauuucuuuguugggaauucucuguuuagcucuauaccccauuuuuaauugguuuaguugauuuuuuucaugucuaauuuuugaguucuuuauauguuuuggauauuaguccucugucggacaauccuguacaauaaaagaauuucuggagguaugacccucccugauuucaagcuauacuacagagcaauaguaauaaaaacugcaugguauuagaauaaaaacagacagguugaucaauggaauagaaucaaagacccagaaauaaacccacauaccuaugaacacuugauauuugacaaaaaagccaaaaccaugcaaugggggaaaaaagcaucuuccaacaaauggugcuggucuaaguggcugucugcaaauagacucauauauauuacccugcacuaaacucaugugcagaugggguaaagaaaguagggaacugcuugcacucauuggcacaggagacaaauuccugaguuccuuagcuuaggcauuaugaucaaagguuaauaaaugggacuucaugaaauaggaaagcuuuugcauggcuaaggacaccaucaguaggaaaaaauggaagccuacagaaaggaaaaagaucuuuuauucuuuacaaguagcaaaaugguauuuacguuagaguuaucuuugagguuaaaguaguuccuaacugcagacuaaauaggacccaaacuauuuggcagacuauaauagaaaaaaaaaaaucuaguaguuuauuucuucucacaguguggcucaauacaggccaucucaucagaaaauggcucucuugccaugacuagaauccuagacuccuccccucuggugacucuuggagugccuagccugguaauccucugcuucuggcuggacugggcugaaacugaggggaaggcguaguugcuccaugaaucuugggcugaaaagugagucauugcacuaacuuuguuagccauaccagacaaaagcaagacugaaauguggccucucuccagaugcuuaguucucuggaucaaggugugaaucuuaauguacguuagccaccauaacaugcuuacaugaaaguuguauaugaaucagucacauuuuuuuaaauacugguauuuucauacuuguaucaguauaaugaaugugagaaaaauuaauuuuguaaaaauuuuaaaggccuaauucauaguugcuauauuuuaagaggaagggcaucuccugggucacuuuauagugugcuguacagguugugacauuccuuucuuuuucuguuuguuuguuuuagagcuuuauuguggaaaggcagagagagagagagaagguagagaaggagaggcugcccauggccaugaggagaagggaggggauagagguagcaagagggcuggaaaagcaagagaagcaggagaggcgagagcuuaagcgacauccgcauuuuucuucccauauucuuuacaguggaauugagauuagaauauaaacuagugacuuuucaacucugcuaaacucaguucugguuugaaaugcucauugauuuauguuccagcugcuacucuugcccuaagagguuuuaaaacuuugauuagaggauaauagaggugacauuguuauugauuucuugguagcuuuguuuauuuuguuuucuugugucuguccucuaagagucauguuggccuugaguuuauuauauuccagaggaugaacuugaacuccugguccuauugcuuaaaccucacugggauuguaggcacuacacaucugguucuacuuaguacccaggaucaaaugcagagcugcauccaugccuggcaggcgcacuaccuacugaguauaucccaggcuuaaaugucucaggauuaguuuaugugguucuuaguguuguguuuucuacugggaugggaauagguaacuugugguacaagcuaaacaaugaagaaaaaagaugguguuaaggguguccaaaacacuuuuuaccuuauuauuacucucauggcuuguugguuguaaaggccaaguaugaaaggcuguuguacuggcugguuuugugggucaacuugaguuaucacagagaaaagagccucgaggaaaugcuuccaugagauccagcuguaaggcauuuucucaauuagugaucaaggagggagggcccauuguggguggugccaucccuacacucguagucuuggguucuauaagaaagcaagcugugcaagccaggggaagcaagccaguaaacagcacccuccauggccucugcaucagcuccugcuuccugaccugcuuaguugcaguccugacuuccuuggugaugaacagcaguauggaaguguaagcugaauaaacccuuuccuccccaacuugcuucuuggucaugaugcuugaauagaaacccugacuaagacagcuguuuuuuuaaguuuccuaauagagaagaacuaucuacgcuccuccauuuuuauaauaggaaaaaagaaagaacauugaaaauauuaaguacauuaguauuuauuauucauuuuaaagcuguagacaugucugagagaggaaacagucauaaacaguagcaaauacagcugauuaguuucuaugaugaaauuggguuugauuuuuuucguuacagaaacuguagaaugagcugguaggauuaauuuauuucuuugggucaagcaaucuuucagugaacuuuaugaaauucaucuauacaauggauacagugauuuuguuuguuauuguuguuuaauauaauuugacagcaacucuagaagcauuuaaaugaaguauuuuuuccugugaucaaauaaauaagugguuauuuuacuguuaagugauucaauagguaaagauagagaguucuuaguugaauauagccuccaacccuugauaaaugucacucaugcuauuucauuuucugugaagagagcaauuuuaguacuguguuauaaggauuggaauaaauugauacuacuguguuuugcacagugggacuuauugaaugggaagauucaggcaaaggugaggcgcuacaguuuagcaguagucaucaugguucaucacagauuuggaguugacagagaaaaggcuuuuugcuccaaucauguuauccauuagcauuuuuccaaaauuggcuaaccugugauuguaguauuuuaguccuuaaaauuuucugaguauaaguacucauuuugcucugaguucuaaaauuaauucauacauacauauauauuuaaguuuaguuaacuacagaaugacuuacuguacacaggcuggggacagauaacuaaauauauauauauauauauauauguauauauauauauauauauauauauguauguauguauauauauauaggcucuuugauuggggaaguucugauacuaaggucuaguucccuaauugguucaugauuugucaauaaagaagggcaggagccaauugcugggcggaagguacauuugggucuggguaccaagaggaaagagacacagggaaagagagaaggggcuuuucuaccauguuuuggaggaaaauggaugcagcaaccauguaagaccucggggcagcuagggccugcagcuucagcuauggaaggauggccaaaaauguuuugcaguggcuaauuggauuaagccacuaaguuuaggguagaaggagagucagagauaauaaaugguaagggcaugcauuuccaggcaggagguauuugcccagagcaauugugcuuaaaggcaaguuaagguaacaaaguugucuaugugucuuuuaugcaaggauucaaggguuuugggugaggcugguaaccugacccuuccuggagcaagggucuugggaguggacugguggaguaguugacuuccggagcauaaggcagauagaaaaggaagcguggccaaggcaguagaguuucuaaaacuucacucaacaguuuuuguuguacuuuaucauaauuuauuuugauuaagggaaaauuuaaacauacugauguagaaaauguuuuuaaggaaaccugugcaugagugaauaaguuaaguuuuucaaaauuuaacaugcuacauggaaguaaguuaugcuuuuauaaauguuuauauuuuuauuuuuaaucuuaggguacagcuuguauguauuucaagcguuuuuaucuuaauaacucaguaauggaauaucacccucggauaauaaugugaguaugaauuugguuugguuugguuugguuuugaaugaagauguuuauaaugugugaaccuuuaucuguggacuguugacaauuuuaguuaggaacaauuuagacuugaauuuuuuuucuauuugaauauaaggucuucuuacuugcuguuauguucuuuauagauaaugacaucugaccugcaacuugucuaccacucacaugguuuuccuuacaucuaguuauucuaccaauacugcugucagugauaccuuuauucucccaauugcucaggcuaagaaucauuugaggaaauugcuuucucuccauuuccauucaguuuauggaucuuguaacuucagauucauuuuggcuaaacagaaguguaguaugcucugcauuaugcuuaccacuguauaugagagcacaauuaauauagggcucaucaguuugcugucauucaugcuucuguuuguccccauuucguucccaccagucaagcucaggccuuuauugugauuucagauucuaaaggcugucagcaauagcuuucuuacacuaguuucucugaacuuaauuuaguaacucagggaauuucauguuugcuuguaagcucguaauaaccacauacucaaaugacuugaggcuucugcugaugaccaucugcaguauuacuuaccauuaucugucuucuauggucauaagguauauguacaugaucaauucuguuaaaucaaaucuuccauuuauaguucuugaugcacacuacuuaguuauuucuucaaguuucugguuggacuauauaaagcuauuaaugaugguuaaauacuguagcaguaguagauguugggccaaucuaacuuuauacuuuccccuaagucuaacgaauaaaaguuuaaaaaggaacacuuaaguucuuuuuuuuuuuuuuuuuuuuuaauuuccugcagugucuagcauugucacauuucaguauuaugcaguuuacaaaguacuuuaagggauauuuagguauuucugcuguccuuuauuuuuuuauguaggcuuacuugugcauuuuuggccugcaaaguagaugaauucaaugugucuaguccccaguuuguuggaaaucuucgagagaguccucuuggacaggagagggcacuggaacagauuuuggaauaugaacuacuacuuauacaacaacuuaauuuucaccuuauuguccacaauccauacagaccauuugaaggcuuccucaucgauauaaagguaaaccugcugauaggaaauuagcuaguagagcuaauucuuuguuauuguuugcuaaaacgaauugaaaacuucauaaucaguaauagacuaacucguacaacacaggugcaaccugagagucuaggguaauaguuuucaaaccucagugugcauuagaguacaccuggagaguuuguuucuuaagauuauuggauaagaguucccugguuucugguuuaguaacuuucuauaauagauuaugagauuauaguaaugucauuaaagaauuauuguaacucuuguaaccgauauauauggucauagaucuaggccuagugacuuauagaaccucaaaaaagucuuaauauuaaacuaaaauauaaauugaucuuauuuuaaauguuuuauguacucaguucacaaauaaaagcaccaaaauuauaaguacauagaugagaccuguauuuucagagccucaggaaguuuaggugggaggaccacuuugaaucuaggaguuugagacuagccuggcaauuuaguaugaguacaccacaaaacuuguaacacaaauaugugcacguguacauuuaauguauagaauuuauaccuauguauuuacaugugccacauauuaauacauauguuaauaugacguagucaauuuaaguuguuaauagucuaaguaaagucaaagaacagucgagaacugguuauuuucaggugagcaguuguagauauucuguuuaugcuaaacagguuuuggggugcaaccuagaaagaagacaggaaccaugacaacuuucauggaccuuagauaacuaugacugugguaaauuuuauauagggaaaucaaaauauucuauuagaagauggcagauugaaaagcaaggaaaacacuguugagaaagcaucaguggaagugaaauucagaucaagaguagcaaauagguaaggagggaacauuccacccagagaccuuccucgucaggagcucagacucacagcccacuuaagaaaugaagagccuggagauggaggggaaagagugcuuggcuugaauugaaggcaaaagucuagacuauauaaguaguguugaagauguugaacaaagggaaaagaagauagugaaagccuugucuagagaauggguaugauugaguucucaaugugcaaaaauggccuguuggcaccucacagguuaguuuuuggcuauacuaaucaggcuucucuagaguaacuuaaucuauagagagagaaaaaagggauuuauuaggaugugguuaguuaauccaguaacgagugcuuaugaacagaagaucccagagcccauccaguaacugcuaagucucugaggcuggaugucucagcugaucagcauacacuggaaugcgaaagaaguaagcacuaaugcaagugaaggaauggacuugcuagcaaggcaagagcaagcaggcuaaaagaagggccuccuucuacaaccaugucuuuuauauaggcuuccaggagaaggugugacccaaaucagaggagagucuuaauaccucaaaagaucuggauuaaaggagugucuuucuaccucagaauuccagauuaggaaugaaccuucccacuucaaaugaaugaauuaagcaacaaucccucagguucacgagccauuugggguucuagauaauuccagauguagucaaguugagagccaaaauaggcauuauacaaucagauaagauuugacaucuguauguauccugcauuaugaaaagagugaaugggcaaagggguaacaguggggacuggucauaagaaauguuuaaagaguagcugaaaaauggagaagcuuauaaugggacuagaauguauccagaguugucggauuguuggaaaacaaagggaaggaaagcgcucguguaaguaagccgaacgccuuccaguucugcuuagauuggacaaagcaaauguaggcuaaugauauuugcugaauuucgugccagaaaggucacucaugaguuuguugacauuugucuuugaaguguagaaggauaaaaaaaggagauugguggcuuuaggggaauaaguugaaagacaacagacuguagagaugcacuaguuuagagugcuagcuauucuucuagaugaacaggguucaguucccagcacucgcaucguagcucauaauugccuguaacuccaguuccaaggaguccaaugcucuuuucugccccucuugaccaccaggcauacacguagugcauagacauauguguaggcaaaacacagauacacaucaacaggcauaaaagcaaagaaaauaaaaacuuuaaaacuauaaaugaaggagagcugucucaugucaacuugguuacauagaaagauccuguucagguaaagggaaagagggagaaaaauagguauguuucuuauaaguguuccuuaauuacuggauauauucuuagacacgagaugaauuugucauugugugaucaauaucacaauguuccgccuuugcacauugcccuuagcuaggugcuacugugcauggagcugucauauacucucauaacaauggcuugcuucuguuauucuuauacaccugggguguuuuauaauuagcauuuuguuacuaaguagaaaaaacauacucuaacauaaaaacuaacuuuuugcuaguaaguauaaaacauacacucuaaaauaaaugaaaaguguauggugcagcuagaacauaaagcaguaccaugguuaucauuuuuucaaaauucuguaauguacauaccgugucuuacacugaagcauagacuuguuuccauaagcaucacugcaagcaugguccucgugacgcuggugugguacugaauggcggggaugcucggaugcuuuggaagcuugcagaacucaugccucuuauucauuacugaaagaaaaaaugguuuguacaauagaacuuguauauguaacuuggauuaaacuuuuuuuuuucuuugaauuggaaagguaaaaugaaagaaauguuggguguagacauguuuaguuuucuagaagagauugacacacuuaaguacugauccaaugagcuagcaauaagaaaaaguuaaagggaaauagagacuguauagcagagcuuuagacucuacgaacaauauaaaggagguuagcaugggguuugaaauaggguacagcuggccguagagaagguguaagcucuuguguugacacaagacagagugagucugggugaaaauacuauuguaucuggggauuuaauggaaauagucuuauccuuauuaagugcagagauaauuuuccauagaaugaugguuuuuuugagacuuacucaaaugaaagaacaaauuuucuaggaagacaucauuguuaggcuaagagacacaccuaggucagugaauuugaauuuauaguaguaucccaaaaccucuuuuguagaguuuucugccaaugcccagaaaucaaaaguauagaaauuagauucagaugcuguugaaacugaggcugaagagauugcuuaucaguuaaagaaugcgugcucucuuccaaaguucaucgacaucuggugguucaaaauugcccauaacuccagcuucagaagaacggacaccccuuacuguuuauaugugcacugugcacauauuacacacauucacagacagacagacagacauaaauaaaaauaaauauguauauauaaauaaauaaauaucuguauacauacauauauguguguauguauauauacauauguuuauauauuuauacagcaaagaaauuauugaagacucuaguaaaucugaucagguugaagacuucaaaaccaaauggugcaagauuuacaagaacaucaugaaaaauuaagagaauccugagaaagggggagugacuacauuuaucauuucagagguuagauauuuggggacaaugacuaggccuaugugggacucuguaguugaaccugauauauuuuauuucagaauauuuauagauugucuuacuacuaggauuuggcaaugaguaucuaaagccagucugagggcucaaaauuuaaggaaaggccgggugugguggugcacaccuuuaaucccagcacuugggaggcaguucaaggccagccuggucuacaaagugaguuccaggauagccaaggcuacacagagaaacccugucucgaaaaaccaaaaaaaaaaaaaaaaccuuaaggaaaggaauugacaguuuuccauaauuccugaacauagucuaaaaguauuucuguagauauuugugaaggcuaauugguucaacauucguuuacauuuacuccccccacccccaugguauacauuaaaaaaaacuuugcuuugacagugauuugguacaauuucuaauguggccuuccagucuuuaccugagcgucuguaucauacauaucuugucuuugccuugaaucccauagaaucucgaagaguuucccuuucuaaguuagaaaaguacuaaauugagaauaauguuaagcauuauugugcuaaagcguaugauucuguuuuuuucuuauaagcauauauugcuaaucaugguuguauuccaaaaaguuugaaagucauaucagugaaaacacucagaauuuggugacaauaacuuagcuauguacauaccaaacaaucuagcauugaaagauucaguuuuggaauagaggaaaggaauuauaaaaaucauucuuuauuaaguaccuccuaguuacuguaguuuuuaaugguggcuagccaauaaacucagaaaugguaacaucuauaaacuuucuuucuagacucgguaccccauguuggagaauccggagauucugaggaaaacagcugaugauuuucuuaguagaauugcauugacagaugcuuaucuuuuauacacaccuucacagauugcccugaccgccauuuuaucaagugccucuagagcuggaauuacuauggaaagguauuaauuuguuuuuacuucuuaguagaguuuuacuucuuaguagagucugagcuuuuaaguaagcuucauuagacaauauuucuguauauauaaugccuuauaucugguaaguuugugauugaagaaagaaaucgccuuuaaagaaagcauuuaaucgaguauuguugagcuaagagaauacauuucugacuaaaguagaagugugacagguaguuuuggaagacaguuauagcuaccaguguaugauagauuuacaaggcaguguuaaugcagcaaaucugauuuauuuuaucauauguuguaaagcauguguaacacuuucaguaaggauuuguagaaguaugcuuuaggguauauccauaugaaaauuauaguugagccauaaauaauaauagcgaguacauaaacacacauagauagacauuacaaugaguacuuaaugugaguuaauucacuugauuuuuuuuuaauguuaucauauguacaugcuaauucuuaaacuugaaacaguacuguaaguauauuauuacacagcuggaagaauggccaauuagaaacaauuguuauacuccaguuguuuuacaauuuauacuauauauuauuguucauuuaauuucucuuaugaugagauucuuuuguuucaucuuuauaaacaucugaagaaaguaaaauuuucuaaacuuaaaacuauuucauauacuuaaaauuucaaaauacaaugauaagaaaacaucagauauugacagaugugauuuagauuuuguucuuccuuacugggaauauuuauuauuucuacagaagcgaccuuagccuuuuaaaauuuaugguauguauaccucucuuauaacacuuauuuuaucuauguguacuuguaauuauaugccauguguauaggugccauauguauggagacuagcaaaaagguguaauuuccccagagcuagaguugggugccaagugccugcuccagcugaggagugggcugaagugggacacagagcuggaugaaggccaaggcugauaguuaugaccuuguaacucucuucucuguccugggggucagaagcugauggcccuggaaacuuaacucuuccuuacuguucugagcugagcagugcugaguguuggcucuguagcucucuuacuauguaugcauuaauaaguguuaguuucuuuuuuagcucaaggaccccuugcuggugagagaggcuuagaacuuaacucuucauggaccagaggcaaaagaaaggaaaagaauuaaaaucuuucaccaggcaauauguauagaaaaauauacauucauauacauauacacucuagucaagcccaagcaccuaucucaucagcucuacaaguguucaugcauacuuacauacauacacauauagcuacaugucauacauauagacagacauauacaucuauaugggugguggguggggcugagcacccagaugccacacuuuauuccuucucucuggccuucuuacaccuucuuagacaaaaguucuuuagaaaauuaccuuauagguaaaauauuacacaaaaguggaguuacagaaagaccuugauacuaaguucaaagcauuguuucauccaaguucaaagcaacaguuuuacaaggccuuguuuuaucauagugcauaccuguggcuuuauccuuggaucugacccagaaugaauauuuuucuugaucacaaaucugucccaagccuauuucucucuuuaguauaauugugaaagcucauuauagacccuguuacgcagccuuuacucuucaaugaggaauggacacauacuguucuugauucuaacuuuauuauauuucuuucuggcaaaacaacuaaaccaucucuuaaaacuuucuucguaaaauuauuugaaucaaaucagaaauucuauaaaaucauuaauuuaucuaaacaacauuaauucaugaauguucaucucuauguugaugugcaugaaaucugugcaauagggugggcuaaugcccagggaucauuagaugguaauaggaaaagguauaucagcuguaagaagcaaucccgagaugaacgucccuugggaccuugccucucagagcuuacccaccacaagccaugcaaaauugguggaccaccuccaggaaagucaccugcuagccuuagccuuccuuagauagcuagcuccugccagguaggugguuaagagcugccauauauggaugcugggaaccaaaguugagucuucugcaagaacaguaucauugagauauuucucuagccccaguaaaccuaucuugugcaaauauaacacacuacguagauuuaauccuauugugguuuauaucucauuuacuuacuaugcaaacauuuaauaagcuuccauuauacuauacuaaaggaauacaagaaugaaacccugagcuaagaaaacacaaugaugugaauaauugacuuggcuggagguuagguguagagucuuuguaagggccaaugggaaauggaagcaggaaugucaggaguuaaaggacauccuuagcuaugcugaguugaaaaugggcuucaugagaccuuguuucaaaaagaaaaaaaaaaccaugauuuaaaaaugaaagaauagccaggcgguaauggcgcacgccuuuaaucccagcacuugggaggcagaggcaggcggauuucugaguucaaggccagccuggucuacaaagugaguuccaggacagccagggcuacacagagaaacccugucucaaaaaaaaacaaaacaaaacaacagaaaaaaaaaaaaaaagaagaagaaacuucaggagaguugcaaaugcauaacaagaggggaauaaggaaacuaguuaauaugcaacauagcuaucaaaguuuugucauauagcuuaaucuagguaguuuaaaauauagcaacaacauuucauaaaacucuuugcauucuuuacaacugauuuaucuggagaaaguuuuauauauauacauauauauauauauauauacauauauauauauauauauacauacauacacacacacacacacacacacacacacacauauauauauauauacacauauauauuugaaagaccugagauugcuuuggacaugauaaaaaucggacgugauagacuuauaaagccugagguaauaauaccguguugguagauuacuugcucauguauacucuagguacagugacauuguuacugaagggagccagcugacugcugccauguuccuuaucuucucccuuugagcuuagugaaauccaucucucuagcacagacuuuuccuaagucacauaaagccaggcuuguaguuaggcugugucuauagcaaacauuuaauauuacaaugacaaauauaggcuguuaguacuuuuaucacuggaaagcuauauaucauaaaauuuaaacuuuuaacaguacacaucucuuaaacuggcagaagugguaguaaguuuuucaaacucuaauagguuuuaguacuguagagguuucaaauaguaaguaauagucuuaaguaauuuuaaaacugucuuugauguaaugaacauggagguaaauaauuuauaccugucuuuucagugugcuaugugcuuucagugaauuaaaauguugguuuuuuuacuucagcuacuuaucagagagucuaaugcuaaaagaaaacagaacuugccugucacaguuacuggauauaaugaaaaguaagugcuauuaauguaguugcuuucugaacaaaugcuguaguagacuaguauuucaauuuauuuuuauugaauuacuguucucaaaaugcauugaagauucauuggcaagaauaaauggaagguaugugaaagaaaauucuuuuaucuguaaaaagagaauauggauuuagaaaggccuaagucagaauagauucuuuugaaaguauucacaaauauaugguagacauuuagaaucagagagcucacuucaagggaaaguuugcaucuggaguauuuguuuuguaaauaauuuuaacuaguuaauaucugucauauacugaucaaucaauacaaagccaguaauuuuucauauggggguuggugagggagaggugucaauuucagaagacagacacauugacuauuacagcuuagagaucgauaaaaaugagguuugucggcuagauggguuggaacuaggugguaagcccuugucuagcucauuucaguucuuguucaaacacuaacaccaaaaaacccacacuauccaaaccaaaaagccaugaagaaugcugcuuaaaaaugcccccuuaaaggagguccauguccuaucuguggaacccguaucuguuaacugagacuguaaaagaugggguuguacagguuaguucaugagaaggugcugaugguaacuugaguuacugaagcaaaauaguacauguugucacagggucuucaugacuagaagguaagagacuuugagaaaaacugugaaaacagcaaaagauaugcagauguuggagugaugugucaauuagagccuucagauaaaauuugccaauacugugauuugggcccagggaaacaagauucccgauuuuuggacucugaagugugagagaauagaguugguugcuuuaaaacaccaacuuaauaaaaauuuuaauaggagccuuggaaaauuaauauagacuuugauaacaggcuuaccaaaaacuccuuggugcuaguguugagaaauccucuuagaaauucugauuugaauuuuugcuuaauuaauacauguauauguauuaauuguaugugcgcauguaacauauauguguauacauauacacauaccuacauauauauaagcacacauacauauuuggcauacauaucacuuaauuuguguuuuugccacagucuagcaaugcaacccaggcuagacuuagacuugaaguguuuugccuccguuuugugagugugaaaaugguaggggcaugccaccacauuuaguucuuuauugucuuggcaauuauguucauagguauggagacguacuuuaaggguaaagcaaaacaauaaaauacaggauugcagaccuuuguuuaggugauaguaaauguguauguguauauuuuaauguuuguuuuaaaugagauucaagucaugcaguuacaugccuugaagugauucuuugcuuuaaguaauuuuggauuuccucugagcauaauagaggguuggucuuuuuucccuauaaacuguaggucuucauauuuaccacuagaggguucacuuccaaagccgauugugauuugauaauaguacuuuuuuuuuuuuugguuuuuuuuuuuauaauaguacuuucuaacaauuugguaguagaggggacuauaaagaaaacacacugcuuauugaagugugugguuuaauuauugauuucuuauauugucuuuauuuuguuccacuuauuuuaauaaauaugaaacaaggagaaugcuucaaaaauacucagcuuuaguaauaugaagguauucauauuuuuuuuuauaaaaacacauagugaucuaaagauguuuaaucacaaauaccaauuucagucugaaagcacauggccauauaauaagucccuggacuaucauguuucuaaucuugagauuuuugguuuauuauguuaaacauaacaagauaagauagaaaguauuguauauagucuuaucuuugcugaucuauaguuuguuuuuaacauuugauuugcuaaggaaacauccuuguuuuuuuuuauauguuauauucuuaguaaauaagaggguauauuuugggauagauuguucauguguauggcuggugguagagaauaaagaauauuuacuaaaucacauagggauuauuucaaaagcuuuaaguugagcaaaauguaaacauggaggcacuuggaaaacauuacuaccaguauuauauacagcaugcuaauguuaaugcuauauauaguguggcauauagcagauauuauuugaacuuuaagagcugcugcugcuugauuuuaauacagaauacaaguccugguaagaauauguuaucaccaaugucuucaguuuccugaagcaaguuagauuauuaugcuuuuuuauacaaaagcagauguuuuguuuugguuuuuuuuuuaaaacaggauuuuccuggguagaucuggcuuucuuagaacuuacucuagaccaggauggcaucaaacucaguuccaccugcuucugccuccagaguguagagauggaggcauguggcaccacauuuagcugaguuuuuauuaaaaaagaguuuguauccccauguaggcaugagaaaucuaguaaaaaaguacgagccgcccaggucugacgagguugcuguccugaaacagaagcuggagcggugucauucuucugaccuugcacuuaaugcgguuacguaaguaggcaugauaaagaaguuauguucacaaagucauugaguucaauuguuaaauuauuucacuguuacaaguuuguuagucuuagcaccuaaaucaaacuuuauaaaaaguugaguauacugauuuugucuguguugggaggcaagcucagggccuuguccauaggcaagugcucucuauuuguccacauccccagcuuggccuaugugcacauuucuaguggaaguaaacauaaggaaggaauguugggcuuucacccuacagguugauccugaucguuaguguguagcuuggcucgcuuucccacguuaugggaucacugggagccagucuuccuaugaaauuguuaaaccuuugucucuuagccaaccugauauuuucuggugaacaaauguacuguuuuagacuuaauuuuuauaaacuaguaaggaaggaagcauugugucagagaacgaguaaaauauucuguuagguuguguaaguauaagagcauauuuaaugucucuugcuuuguaggcuaauguagaauuuacuauaaaauacauauucucuacauaaaagauccauuguaacuuaauuuuugagcaugugauaauacaaguaaaagauuuuguuuuauauguauugacucuaaucuuguuacuuauuaacauguaaugggaauuagcugugauagcuauagauguuuauuuauuuauuuauuuuauuagagaaaugcuaacaaauauguguaaaaagcugaagaguaugccaaagucuucagcacaagauagucauggcuuaauuucuuaaauguaguuuuaguagaggauucccagggcuugcagagugcaaauuauaggacgguugucuuacagauauagcuucaaaacaugucuucauguaaaucuugaauugguagguuucaguaguaacuaguaaauaucagaagguuguagagaauuaaaguugacacauugguaaguagaaggacuguagcacuugacuguguucuuacauuaaguuugaaaagaacaguuauuggaagauagaaugcccauuauugguuuacauaauuauuguggcuguuuucauucuguggcagaaaaguuaagugcuuauggcagaaacugcauggccuauaaaguauuuacuaauuuguccucagaguuggaucauuugacuauuaauucuguucuagcuaguaaaggaaugggccauaauccagaaauuucuaaucgauagaguuuacauuuuauuccaaguugccauuugcuuugccaacccugccaaaaaagauuucuacauucuuguaagugucugaauauuucuuuguaaaagaaggacuuuaaaaauuauaaaauacaaucaguuucuccaaagugaaauauacauaaaaauauguuuaaauucuguuagauucaccaguuagaaguuacugucaauuugcuguauaguuucuacauagugucuguucugcuccucucacugcaggcuggaaacaguucaugaacaacacuaaguaguaguacuucagcacaaagcauuuauuuuuccuugaucauuaacauuucugccuuuauuuuucauuguacaguuacuguauucuucuaagucacccacugaguaaacaccaauguuuccuuuaaucaaacagauuuugaucucagaagucacuuaccagaugggucuaccaucugccaaccuuuucuuuguagaaaugcaugaaauacuuguuuguaguaauguguccacaucaugcauuuaacauugccagucuuuaacuuuugccaguccgggugaaaaagauaagagucaccuugaccauuugcauuucccugguuacuguaacuauugauguuuccagauuuaauagccauuuguaaguuuucugcauugcuucuggcauuuuauucuuguaauacauuauauauuaacaucuuuuuuaaaaaagauguuuauccuauuuauguuuuuucuuacacuacuuugccaaagaaaugcuuaggaaggguaaaggcuuuggggggcuuguuuguuuuuuaaccaauauuuguaguuuuucuaguuuguuuuugaguauuauuucaugguuuucuuaguugacaauuuuuaaucacaaauaaaauuaaaagguauauccaguuuuuaaaucauuuauuguauuucaguuauguacuuaauaagcaaguaccuguguggagagcagaggacaacauaaaagagucaguuuuccucuuuccauacagccauggggaacaaaccaggcuguccaucuuggugucuaaccccacugagucugucaccagauaugcagagccaguuuugccuguccugcuuugacugccgauguauuaacaacaccauauucuuaauaaccauagcuuuuauaguguguccuuuuauuuguuccuaaacagggucugguuuaggacgccucagauucucaauuauucuauccuaccugaguguuggcacugcaggugugugccaccacugcacuccacuuuaguaugcuuuuaugauaaccaagacaaggucuuccaacauuuuuucccucuagauucucuuugcuauguuuacuugaggccagguaucacaguguaaccaaugauuauccaauaaucuccuuagagucacaagaacugggacuuauggguauguucaacguuuucguuguuuucaucuuuguagguucuugcuacacuggauuaaauauuaaauauugccuuuguauccacagauaauaccuuuccagcuaucuagucccuacucuucaguacauaauguauuuuguuuuugaagauagggccucauuuuuuuaacccaugcuagacugaacugaaggcaauacuggugccuuaguccgaguacugucauuguagcugagggcuaccacauguucacauggccgugcuagcuuauuuuauagguuuuguugccacuaacaguuuugcuaaucgauacuugcuuaauuauaggaagaagaggaaaggcuaugaagaugaugacuaugugucaaagaaacccaaacaggaagagguauguuuuccccugaagagaacucgcuauaacuuacacuuucuggcaugaccuaagcuaguguguauguucugaacuacuauaagcauuauagagagguggggcugagaacguuuaaaacagugucuugcuuuguagcccaaguuggucuuaaacucccaguucuuuuuugaccugagcccaccgaauacuaggacuacaaguaccucuaaaguuugaaauuauuaaauuuuuacucaccuguuuauguacaguaaaaguuuuaaagaaaucguuaaagggaagauuuauguuggguuauguucagggggaauggaguccauggcaggagcacguuggcagcugcucguuauguggugcuaaucaggaagccuaugcaugggcuguuuucacaugacucugaaccacuucuaaaguaagcuaccugacugaaguaacuuccuacgauagaaggcagugaugcuaaauuuuaucuauucucucaggauucuuuccuugccuuaccccaguuuuaaaaucucucucuuaagaagucaaggauaaauaagcacaggcaaaggauaacuuuucacuccucacagagugggcagcugccaugucguuaucacagucaagugcaggacuuagcacauaccuguaguuagcacuugagguauagaggauccaaagcuggcugaaggcauaauaggagacuaucucaaaaaaaaaaaaaaaaacccaucuacaguagacuguugucaauccacaauuucuuaaagggagggagguaaacaacaaauggcucaauacuucaauguuacccuuaccacauucuuuucccuuuaggaggaauggacugaugacgaccugguagauucucucuaaccauaauaaaugaccgcagcaguacuuauuaaccaacggaaguaggaagcaugucugacauuuuacuuuuuaaaaaaauaguacaaugugaaaacaucaaaauauauuaaacuuuucuaguuguucuauauauuuucuuugugauuguuuuauauaacauauagcuucaaaaggggugaaugccaccuaguuugaauauucauaauccacuaggauuaguugcaaaccauguccuccugugguagacaaagucagacugugcuacacuuccuuguauuguuuuagacaaacuauaauaaacaaaccuuuccauuuagaagcauuauacuagaaaaaaaaaaaaccugaacaauagguaaacaucugaaaaguuaagaaaauagguuuuauccuccagaagcccuuacaaaugcuucucagaugucucuccaguagacugaacuauugaugauucauuacuaagcuggagaauguacugggcacuuacguaguacuuaggugcuaaauuuuauuacaugcaguuacagauaucuucuagguuuaaauaaaaauagaauuuuugaguauagauaaaaaaaaaucuuaaauuucuacagauaagucauaguaaaugauauagucaauuuuaucauuaaaugauuaccucucaguaaauccuuauaaaguuggcauuauagugacuagaaaucuguagaaaaauuauaugcaaaaauuuaaaguuaaauaacuuaauauaaaaacccaaaacauaugccucuacuuuucuaugacuuuaguuaauuauauaccucaaugugcuauuuucccaaauacagauuggggaaaauaaugccugcuccugaugggauuagucacagcagugcuugacauacuaguauguauuugcuguauauuaauaauauguguuacaguuaagaccaaaauaaagauagauaugcauauauuagaccaguguuuuguuuugauguuucuuuuucugcaacaccggcuugaagaaauucugagaaaaucaacuuugaaucuaaaucuaccuagcuuacauauuccaugauacacuucccaggaggguagguagcauuuuagcuauguuuuuuuguaaaugguguuuacucuaugugcauuuucaucucuaauauuuuuauggcuugaguuuauuuguaggguuuuauaaaaguagaguaaaaaugaacacuccucugcccaaguauaguucaaguagaacaacaugcuagacuauagacagaacugcaagugcucgcagugugucugcuuuucuuucauaucauuaaaaauuuggcauuaaagcaagggccacaucuuucucugaaaauuuccuauccauccccauuaaaaauagguuugaaagauuuuauuucaucacugaccaccuaguuacuacagggccuaagaagguaaauaacacguuucccacuccaauuuaaaagacagagcaugucacuauaauacaaaaaugaggauaagucagauuucuuuuaaaauaaaugguagaaaagggagaagcauuucaggcuuaaaaaaaaaaaauuggcaaauaggcugucauggccgaacacucacagucagugaggacaaacuaaaaugccuuagaguccggaucucucccuguuugccaaaguccauauuuacauuaauuugucuguagccuuuccacguuauaaacuaaggacagagaugaguuacugucaacaucaacaaugggaacugcauugacaacaaagccaagaagcagguuuuguuguuguuguuuuguuaccaccguuaacuugauugaaacuaugugaggagaguaaauuuaccuuuaugguagcauucagcccuauauguaagcuagggaaaucucucaauaauauucuaaagaauacaauuuaggccucucaguuugauccucagcaaagggaaauagaccuugauuacuuaacauuuuuccuuguauacaauaucucuugagaaauacaaucgaaugcuuuauggaucuaggccuucagaaaaauauuuuuauugagaaaacuuuauuaauaccuuccuuaguaccucccuuggugguucuuuaaaaaaagaaaacaacaaaccuauuuugaucacuaagaauccucugcuacauacuguuuuuaaauccggucuucaauuaacaaguuguauauugaguaaauaaauggacuccuuugugaaagaaacaauaaaaauaacccugauuuugcucugauauuaaagcuugaacuaucccuauagugggaagaaaauuauaauaaaguuaaauaguaagcuaaucaguuaugcaagcuaucccuuaguuuauuuuaacuuaacccuugugaauacuucacacaaaaauacauacacaagagcaaaugaacuauacaaacuaaauauccagcagguaaaacaaguacaaauuaaaagauguguaaguuguuaaguggcugauuagguuaucugcauaaucaaagauaacaaaaaccaucuuagaagugacaaaaguauucuagcacuucguuuaaacauaaaagacaucagcaaucuauaaaauggucaaauggguaacaugcaauaauugguacaaugaccaauaauauuuauugaauuuaaacuauuuacuguuguaaacauuuuaacaaaagcaugagaucuaaauacagucuuugacaauuccaacaaaauaagugguauguuuaaaaaauaaagcugaugagcaauagauucaucgauuuuauauauugucuuucaacaguuccagaaagaauagcacaguauuuuuaaaaaguauacagcaagauuguuccuauuauaaugucaaacucuggaaacuguaaauacaaagaaagucagugaacagucaaauggucauguucauaaagaagaaauuacaguaauaacugucugcgauccaguuaaauucuguugucuauagaaugcguuuccuugucaguugauuucauaguuccuuuuccaagagacagcaaaacuuuggcaauuggauauacugaaaauauauuuucaaaguucaagacacagucagucauagcauuuuuguuguuguuaaggguacaccaaggcucagaguuugguagagauuccauguggaaaaagugcgcaauauucugcacagauagcuuacaaaggugcuggcaguugcucuucagcagaaucuuggguuuuugcuugcauagcucacacaucacuggaaugugggaaagugugcuauuuuuuuucuuucucuauuuuuuucuuuuuggcaagagcaaaggagacaugauggugugaauuaccacggugggcauacugaauccacgcagaacacaggcugcuaccugaugucauugguuuuuguauacugguuuuguuuuuguugaagcaguucuguuaucgccagaagcuuuuucaguacgugcuagacacaggagaaauagugaggaaaaaaaucacuaagcaaauaaagagcuuaaaauuucaauuauaggauuuauuacuuuugauaaaaacuauaucaaaggacugagauucuacucaagacauaaacugaguauuuuuaguuguaaccaaaauauagaaggucuuacuacacuaaauuuugucauuauuaaaucuugaaaaaucuaaguuaaacaauagcaauauuuuccaauuguacucuuaacuaguuaggacugcuuggauucuagccucgcaggcuaauuaaucagacuuaggauggucuaucuugauuuauccuuuccuaugugauacccuuuucucuccauuuaacuaccuuagcuuaagagagacuaucuccaguaacuuaucacuaaaucaauuaaaguaucuuuacaguucuacuggacagcaaaagcuuaauguggacugauuuuuaagguaugaguuauguaccauaccaacuugaaucacuauaauaauguauccucuguaguuauuuuucacauuucuuauauaguucuccugugcuucacaaguaguuuugcucacacacuugguaugagaguaacugaaagaguaccaugccuucuuacuacugacaguaacucacuugccauuuuuacauguaccauuuauaaagcaggaacauugccauguaaaaccuaccugcuguacaccacgcucauugcugaguguucucaguucaucugaaugagcuacacaaaucucaugcaaugcugcuaagucacgagacaggucaguucuagaaugcucuguaguguccggaaguucagguacauucuuuaagggaaucauaaaacugcguuuagaaauaaaaacccuuguagucucuucuaaaguuauccuaacuagguauaaaacauuaauuuguacaaaaauuuuuauucaaguaauucugcugaacauggguuauaggacaucuauuuacaaagaagccagguucuucaacuuucauagaaugacagugugaaucuuuuuuaaauuuagagcauaugcaaaauaaaugauaccauuacaacuuaaaacuccuagacugaauacuacuacaguacucuuaucuaaauuaaccaacaucuaaagaacuaaauuaugaaaguauaauaaaaauucauuguuugcaauuucuauagacugugcucaagauaauucuaaaauaugggauuauuggacauuaacauguuuaaccuucaugaaguaacuuagccaucauaauaaauguauaauaccguauuauugcauuaaaugccaauaauuagaaguacuccuaauagaaucuuugcagaagcucacauaaauguuucuuauaaauauagaacuuauguugucggucuuccuucuaaccccauuuguuugccaaaaagggcuuuugacauuuguuuuaaaaugaaucacugagucgaaauacacuacuacaacugaaucgccuauacuuuugaugacaaacuuggcuaaacucacacaugcgugcuaauuucaccuuggucuccguguauacauaccacauuaugaauauauuuacuuaaaaauucauucaguguuagaaauguauaugggguagaaaauuuaacuuuauuauuuagggucucagaaauuaugaauauguucaauuuuguaucaguuuaauuuauaaaagcucaagugagguauaauaauuauauuauuucauuuaguucuaacuuuaguuccaauauaaauggcuucaaaucuuguuucagcuacaacuuaaaagguuacuaaauccaacaauagcuaaaggguaugaaugaaaagacagccugaaagaugacugguugaaagccacaauuguguaugcuugauauaaacaagaauaagugaaaaagacauuuuggauagaaaagauuuuauuuugaaguccugguuuuaaaauuuaaagguuauuacucauauggcuaagcucauucucaaagaacuugaaaauuauauacauaccccaaguucaucuaaaaacaugaucaugcgauguuuauuacuuuuuauaaauggauugacaccuuccauauaaggcuccuaaaaaaauuaaaaacuuccauaaggcuccuaaaaaauuuaaaacuuccaucucauauaccuuaaaagaacuguuuuacaacaaaaacuauacauguugcaagaauuaguauuuauucaugcaaaauuucucuuuaauauaaacaguuucgugggaggaauggagguauuuaaugaagauucaaaauuaaauuacaaauuaaaaaucauuaaacauauagcuuggcagacccaaauuguuuauauauagauuuagaauuaauuacugauaaauuaugaagaauccaacacauuauaaggaauuaaauaaaauacagugaaaccaaaaacucccuaugacugcaaaauacgcuuuggguuucaggaaauuucaaacaauaacccauaaauguaaacuacuuaaacuaaaauccuaacccacuauaauuuauaauuucuaguuaguaaaguaucaacaacaggcuucaaaugggauaacauucaauuggaaaucccaaagauguagacaugaaauuggaagaacaacaaugaaacacacgaacacccccagcagaugaacagagauaaggaucugugggcugcugagacgccucugcauuaagagcgccugcuacacuugcagagcaggaccagggcucacuugccagcacucagauggugacuuacaacuguuauguuccugagaauauaauauaauauacucuguccucuucuggcccauguaggcacaagguacauaccagugcacuuaacgcacauacaggcaaaacacucauacacauaaaagugaauaaaucuuuuuagaaaaaaaugaaucuggcaagaaauaauaauaaccaaaaauggaaaauggaauauaugacaaaagccugaaauguauauuuaauuauuaaccauaccccaaaguuuaggacaagucugaauggaaguguaaagaauacuuguuacauuugaacaucaguuaaaggacugcauacugacuagugguauguacaugugaauuuaugaacaaauaugucauauacuaagucacaaaagcagauaacuauaucauuccaaucauguuuugaagaucugguauauauucauugugaauuuaaauuuccauuuaaaauguuauuaauuuaauuaucaaaauauguuuaccuuagcuccaaauuccacaagauuugcuaaauucugcacagauuuagccacuaaugucaguguucuugcagcaauaggagauggggaaucuagaagaaaauuggguauagccaaugacaccgacuccagagguuacuuucagauaaauggucaaacacuuaguauuaacacuaaagaaauauuaaaagugccaacaauccuuuauucagaauauauucacaauaguccuugaaaauauaucacuuaauucaaaagaacuugaauuaaaagggaaaauugaacauacuuaucagugcuuguuuugugaaaaggaaacuaaaggaguaauuuccaacuggcugauauuucagaauacuucaaaaagcugcuuuauugcuaagaagacucucacucuaaaaacuuucagaccaugcccaaagcuaauucaacccacauaggggagcauuuugcaaucuuagcaauucccuguucccaacauuauuugcaggcaacuagcucaauuuauacaucaguuuuugaguucaugaaacaguucccuguagaacagagaaaauggaauguaaaugaaaaguauuuguagcuaccaaacagaaacugacaauuaaggccccacccauguccauggacaaccuugaguuucugaucucuuaucagguacaagggguugaacccagggccucauguauacucugccaguguuccaccagcuuaguuacauucucagccagcaacuauuaacauuuugacucacuguuuuguauuaaaguggcaguuuaaggccaauguuuagauagagcgcucaaaaauucuaagccuuuuaauuuuaaaaaaguuauguauacuuugguguggguauguacaaaugagugcagcuacccacagaaccaagaccagugucugaucccuuggagauggagucauaagugguugugagccaccugccauggguguuuggaagugaauucagguucucuguaagagcaguguauguucuuaaacacugaaccauuacacccagucuuuuauucuuaauaugcaucauuucaaucaccuuaguauuaauaaaaauugcaggaaugugaggaguauaaacauaauaauagugaaaaaaacuauggucuucccuuugauuuuaagaucagggggacucuuagacucaccauucaugcauaugggcauuguagauacauaccacuguguuuagugacauagucuggcuacaaagcccagguuugucuugggcuuuuuuguaccuuagccuccuaaguucugggauuacagaauuccagaaugaagucccaccucaaauaaauuuuaauacagauuugagguucaaaguauagcaugcaaaugacuguuuccuucuauuaauguuaauggacucauuacaacauuagaguaagaaacaucaauacuuuuucuuaagcuuacaaaucuuaaaauuuuguccuguggacagugagugaaaagcaaaauggggucaagcuuauuaaaaagaaucuugggcuaucuuuguaaguguucacagauugcuaauguggcugcacauaggucuuuaaccugaucuuagcagaaaguuuaccuuacaguaaccugauguaggcaaaggacacaagaacaagagcccuuccuaaucuccuacaaacacuugucagagccagcaggccagcaagagugguaaacgugcuugccaccaaguuugauguccugauuucaauccuaggcacucagauggugaagagagacagucaucucccaagagcugaccucugaucccuacacaugcuccauaacaagcaaaugcccauauauacacacacacacacacacacacacacacacacacacacacacacacacacgugcucaagugacuacaauguagacuuuuuaaaauaaaaaaaaugagucacaggacaaaaaaaucuuagauacuaaaagacaaagcaggcaaguuuuauuuguaucuugaauuuuuuuaauuugauuuaaaaggcaaguauuuuuaucaaauaugaaaauacagauuuuuuucucauuugaaaauauauuaaaagguaauuaccugagaugauauuaaacauccguggauucaggauagcagggcagauaaggcgaagaaaaacaaaaccacuaauugaaagaaaaaauucuuuuuagaaaacuuacauuauaaacaaaaaacuuaaacuuagaaccauaacauuuacucucaacauagggaagccuaaacgaaguuauuaagaaacuuauaaagcaaacuuacagacuaacuuuggaaaacuugcacauaaaccucuuaccuguuuauaguagauuaguaauucauuuucuacuagaguaaacaguuuauuaaacacauugagauuugcuguaagauuaugaagagugaaauaagccuuuuauagguacaugcuguaagguuucaaaucauccacucucuugucugucuuuugaaguuuauuuaaacaaacaaacaaacaaacaaauccaugagaguaaauuaaguugguuauaucaaaacugcucacaacuuauauaaacaguuuaauacauugucauuauaagugacaccugaaccaaugaaaauguauucaguaaacacucaaaggcuuucaaugauacuacaauuuuuuauuuuuauuuuuuuugguuuuucgagacaggguuucucuguauagcccuggcuguccuggaacucacucuguagaccaggcuggccucgaacacagaaauccgccugccucugccucccaagugcugggauuaaaggcgugugccaccaccacccggcugauacuacaauuuuuaaaguuuucuuuaaaaguuguugaauuucaaaguaacagaacuuaucauggcuuaucaacaguggcuaugguugacaucaguuuuacuuugagaacugcaguuaguguaagcuucaauagauaucccacucuguauauguugucauguaagaucaauuucacuucuuaaagaauacaugguuccccauaguuuugaaguuccuucuacagauuacuuacaauaauuaauaacucuucacauuaugauuuuucccccauagugaagguuccuucauaagguuuucugaagcauuuugauacuuuaguagggucugggaacuaaaaaccuaaaucucagugaaaaaaauauuuuuaaauuuuuaaggugauuuuaaauugaauaauacauggguacuacacaauuuaaagaugacuaggaagagaaaucaccucaggcacaaaagccucuaaaguacacugucauuauuaauccaaccagaggacucccugcuguauuaguuuaacaguuacacauauuuaagcacauuuaaaguacagaacaguuuauuguacaucacacacagcugcugaaauacugugcuuuucauuuucuucauuccuacaauucuucaguaugucuuggcacagcuacuugaguuuugguuggcuguuuuauucagcgguaggaaucaaauccaggaccucuuaguguuaagcuaguaccccaccacugagcugugcccucagggcacuauuagacauucugccuguaagaaaaguagaauucucuucagagaauuuacauuagaaacaggucuuuaaaacucacuuuacauuuguacauauacuguguauuuuccauaauuacuagaaaacugcuguauuugauguauuucuauuaaauuucuagucacuguguacuagcugagauaugcuuaccaaaauguuugaacaagauuuuuagaugguuuuagaaauuaaguuuauaacucaagcaaacaauguaaucucuguagcugugcuuccucacuggagagugauaaugagugccaaagcaguccuuaauguccuaugagcacacugaaucacagcuucagaauuacacggcaaggcuggagaucuacaugcuacaaacgaauuaaaauccagaugguucaauuacgguauuuccccaagcaacaaguuucuguauuuuugccuacauaaacaaaucaaguguguguucuauacaaugucuaugacaaaugaaaaagugacucuuaccuaacgacucuug

SEQ ID NO: 7146 - RNA, 34087 nt, Mus musculus
caagagucguuagguaagagucacuuuuucauuugucauagacauuguauagaacacacacuugauuuguuuauguaggcaaaaauacagaaacuuguugcuuggggaaauaccguaauugaaccaucuggauuuuaauucguuuguagcauguagaucuccagccuugccguguaauucugaagcugugauucagugugcucauaggacauuaaggacugcuuuggcacucauuaucacucuccagugaggaagcacagcuacagagauuacauuguuugcuugaguuauaaacuuaauuucuaaaaccaucuaaaaaucuuguucaaacauuuugguaagcauaucucagcuaguacacagugacuagaaauuuaauagaaauacaucaaauacagcaguuuucuaguaauuauggaaaauacacaguauauguacaaauguaaagugaguuuuaaagaccuguuucuaauguaaauucucugaagagaauucuacuuuucuuacaggcagaaugucuaauagugcccugagggcacagcucaguggugggguacuagcuuaacacuaagagguccuggauuugauuccuaccgcugaauaaaacagccaaccaaaacucaaguagcugugccaagacauacugaagaauuguaggaaugaagaaaaugaaaagcacaguauuucagcagcugugugugauguacaauaaacuguucuguacuuuaaaugugcuuaaauauguguaacuguuaaacuaauacagcagggaguccucugguuggauuaauaaugacaguguacuuuagaggcuuuugugccugaggugauuucucuuccuagucaucuuuaaauuguguaguacccauguauuauucaauuuaaaaucaccuuaaaaauuuaaaaauauuuuuuucacugagauuuagguuuuuaguucccagacccuacuaaaguaucaaaaugcuucagaaaaccuuaugaaggaaccuucacuaugggggaaaaaucauaaugugaagaguuauuaauuauuguaaguaaucuguagaaggaacuucaaaacuauggggaaccauguauucuuuaagaagugaaauugaucuuacaugacaacauauacagagugggauaucuauugaagcuuacacuaacugcaguucucaaaguaaaacugaugucaaccauagccacuguugauaagccaugauaaguucuguuacuuugaaauucaacaacuuuuaaagaaaacuuuaaaaauuguaguaucagccggguggugguggcacacgccuuuaaucccagcacuugggaggcagaggcaggcggauuucuguguucgaggccagccuggucuacagagugaguuccaggacagccagggcuauacagagaaacccugucucgaaaaaccaaaaaaaauaaaaauaaaaaauuguaguaucauugaaagccuuugaguguuuacugaauacauuuucauugguucaggugucacuuauaaugacaauguauuaaacuguuuauauaaguugugagcaguuuugauauaaccaacuuaauuuacucucauggauuuguuuguuuguuuguuuguuuaaauaaacuucaaaagacagacaagagaguggaugauuugaaaccuuacagcauguaccuauaaaaggcuuauuucacucuucauaaucuuacagcaaaucucaauguguuuaauaaacuguuuacucuaguagaaaaugaauuacuaaucuacuauaaacagguaagagguuuaugugcaaguuuuccaaaguuagucuguaaguuugcuuuauaaguuucuuaauaacuucguuuaggcuucccuauguugagaguaaauguuaugguucuaaguuuaaguuuuuuguuuauaauguaaguuuucuaaaaagaauuuuuucuuucaauuagugguuuuguuuuucuucgccuuaucugcccugcuauccugaauccacggauguuuaauaucaucucagguaauuaccuuuuaauauauuuucaaaugagaaaaaaaucuguauuuucauauuugauaaaaauacuugccuuuuaaaucaaauuaaaaaaauucaagauacaaauaaaacuugccugcuuugucuuuuaguaucuaagauuuuuuuguccugugacucauuuuuuuuauuuuaaaaagucuacauuguagucacuugagcacguguguguguguguguguguguguguguguguguguguguguguguguguauauaugggcauuugcuuguuauggagcauguguagggaucagaggucagcucuugggagaugacugucucucuucaccaucugagugccuaggauugaaaucaggacaucaaacuugguggcaagcacguuuaccacucuugcuggccugcuggcucugacaaguguuuguaggagauuaggaagggcucuuguucuuguguccuuugccuacaucagguuacuguaagguaaacuuucugcuaagaucagguuaaagaccuaugugcagccacauuagcaaucugugaacacuuacaaagauagcccaagauucuuuuuaauaagcuugaccccauuuugcuuuucacucacuguccacaggacaaaauuuuaagauuuguaagcuuaagaaaaaguauugauguuucuuacucuaauguuguaaugaguccauuaacauuaauagaaggaaacagucauuugcaugcuauacuuugaaccucaaaucuguauuaaaauuuauuugaggugggacuucauucuggaauucuguaaucccagaacuuaggaggcuaagguacaaaaaagcccaagacaaaccugggcuuuguagccagacuaugucacuaaacacagugguauguaucuacaaugcccauaugcaugaauggugagucuaagagucccccugaucuuaaaaucaaagggaagaccauaguuuuuuucacuauuauuauguuuauacuccucacauuccugcaauuuuuauuaauacuaaggugauugaaaugaugcauauuaagaauaaaagacuggguguaaugguucaguguuuaagaacauacacugcucuuacagagaaccugaauucacuuccaaacacccauggcagguggcucacaaccacuuaugacuccaucuccaagggaucagacacuggucuugguucuguggguagcugcacucauuuguacauacccacaccaaaguauacauaacuuuuuuaaaauuaaaaggcuuagaauuuuugagcgcucuaucuaaacauuggccuuaaacugccacuuuaauacaaaacagugagucaaaauguuaauaguugcuggcugagaauguaacuaagcugguggaacacuggcagaguauacaugaggcccuggguucaaccccuuguaccugauaagagaucagaaacucaagguuguccauggacauggguggggccuuaauugucaguuucuguuugguagcuacaaauacuuuucauuuacauuccauuuucucuguucuacagggaacuguuucaugaacucaaaaacugauguauaaauugagcuaguugccugcaaauaauguugggaacagggaauugcuaagauugcaaaaugcuccccuauguggguugaauuagcuuugggcauggucugaaaguuuuuagagugagagucuucuuagcaauaaagcagcuuuuugaaguauucugaaauaucagccaguuggaaauuacuccuuuaguuuccuuuucacaaaacaagcacugauaaguauguucaauuuucccuuuuaauucaaguucuuuugaauuaagugauauauuuucaaggacuauugugaauauauucugaauaaaggauuguuggcacuuuuaauauuucuuuaguguuaauacuaaguguuugaccauuuaucugaaaguaaccucuggagucggugucauuggcuauacccaauuuucuucuagauuccccaucuccuauugcugcaagaacacugacauuaguggcuaaaucugugcagaauuuagcaaaucuuguggaauuuggagcuaagguaaacauauuuugauaauuaaauuaauaacauuuuaaauggaaauuuaaauucacaaugaauauauaccagaucuucaaaacaugauuggaaugauauaguuaucugcuuuugugacuuaguauaugacauauuuguucauaaauucacauguacauaccacuagucaguaugcaguccuuuaacugauguucaaauguaacaaguauucuuuacacuuccauucagacuuguccuaaacuuugggguaugguuaauaauuaaauauacauuucaggcuuuugucauauauuccauuuuccauuuuugguuauuauuauuucuugccagauucauuuuuuucuaaaaagauuuauucacuuuuauguguaugaguguuuugccuguaugugcguuaagugcacugguauguaccuugugccuacaugggccagaagaggacagaguauauuauauuauauucucaggaacauaacaguuguaagucaccaucugagugcuggcaagugagcccugguccugcucugcaaguguagcaggcgcucuuaaugcagaggcgucucagcagcccacagauccuuaucucuguucaucugcuggggguguucguguguuucauuguuguucuuccaauuucaugucuacaucuuugggauuuccaauugaauguuaucccauuugaagccuguuguugauacuuuacuaacuagaaauuauaaauuauaguggguuaggauuuuaguuuaaguaguuuacauuuauggguuauuguuugaaauuuccugaaacccaaagcguauuuugcagucauagggaguuuuugguuucacuguauuuuauuuaauuccuuauaauguguuggauucuucauaauuuaucaguaauuaauucuaaaucuauauauaaacaauuugggucugccaagcuauauguuuaaugauuuuuaauuuguaauuuaauuuugaaucuucauuaaauaccuccauuccucccacgaaacuguuuauauuaaagagaaauuuugcaugaauaaauacuaauucuugcaacauguauaguuuuuguuguaaaacaguucuuuuaagguauaugagauggaaguuuuaaauuuuuuaggagccuuauggaaguuuuuaauuuuuuuaggagccuuauauggaaggugucaauccauuuauaaaaaguaauaaacaucgcaugaucauguuuuuagaugaacuugggguauguauauaauuuucaaguucuuugagaaugagcuuagccauaugaguaauaaccuuuaaauuuuaaaaccaggacuucaaaauaaaaucuuuucuauccaaaaugucuuuuucacuuauucuuguuuauaucaagcauacacaauuguggcuuucaaccagucaucuuucaggcugucuuuucauucauacccuuuagcuauuguuggauuuaguaaccuuuuaaguuguagcugaaacaagauuugaagccauuuauauuggaacuaaaguuagaacuaaaugaaauaauauaauuauuauaccucacuugagcuuuuauaaauuaaacugauacaaaauugaacauauucauaauuucugagacccuaaauaauaaaguuaaauuuucuaccccauauacauuucuaacacugaaugaauuuuuaaguaaauauauucauaaugugguauguauacacggagaccaaggugaaauuagcacgcaugugugaguuuagccaaguuugucaucaaaaguauaggcgauucaguuguaguaguguauuucgacucagugauucauuuuaaaacaaaugucaaaagcccuuuuuggcaaacaaaugggguuagaaggaagaccgacaacauaaguucuauauuuauaagaaacauuuaugugagcuucugcaaagauucuauuaggaguacuucuaauuauuggcauuuaaugcaauaauacgguauuauacauuuauuaugauggcuaaguuacuucaugaagguuaaacauguuaauguccaauaaucccauauuuuagaauuaucuugagcacagucuauagaaauugcaaacaaugaauuuuuauuauacuuucauaauuuaguucuuuagauguugguuaauuuagauaagaguacuguaguaguauucagucuaggaguuuuaaguuguaaugguaucauuuauuuugcauaugcucuaaauuuaaaaaagauucacacugucauucuaugaaaguugaagaaccuggcuucuuuguaaauagauguccuauaacccauguucagcagaauuacuugaauaaaaauuuuuguacaaauuaauguuuuauaccuaguuaggauaacuuuagaagagacuacaaggguuuuuauuucuaaacgcaguuuuaugauucccuuaaagaauguaccugaacuuccggacacuacagagcauucuagaacugaccugucucgugacuuagcagcauugcaugagauuuguguagcucauucagaugaacugagaacacucagcaaugagcgugguguacagcagguagguuuuacauggcaauguuccugcuuuauaaaugguacauguaaaaauggcaagugaguuacugucaguaguaagaaggcaugguacucuuucaguuacucucauaccaagugugugagcaaaacuacuugugaagcacaggagaacuauauaagaaaugugaaaaauaacuacagaggauacauuauuauagugauucaaguugguaugguacauaacucauaccuuaaaaaucaguccacauuaagcuuuugcuguccaguagaacuguaaagauacuuuaauugauuuagugauaaguuacuggagauagucucucuuaagcuaagguaguuaaauggagagaaaaggguaucacauaggaaaggauaaaucaagauagaccauccuaagucugauuaauuagccugcgaggcuagaauccaagcaguccuaacuaguuaagaguacaauuggaaaauauugcuauuguuuaacuuagauuuuucaagauuuaauaaugacaaaauuuaguguaguaagaccuucuauauuuugguuacaacuaaaaauacucaguuuaugucuugaguagaaucucaguccuuugauauaguuuuuaucaaaaguaauaaauccuauaauugaaauuuuaagcucuuuauuugcuuagugauuuuuuuccucacuauuucuccugugucuagcacguacugaaaaagcuucuggcgauaacagaacugcuucaacaaaaacaaaaccaguauacaaaaaccaaugacaucagguagcagccuguguucugcguggauucaguaugcccaccgugguaauucacaccaucaugucuccuuugcucuugccaaaaagaaaaaaauagagaaagaaaaaaaauagcacacuuucccacauuccagugaugugugagcuaugcaagcaaaaacccaagauucugcugaagagcaacugccagcaccuuuguaagcuaucugugcagaauauugcgcacuuuuuccacauggaaucucuaccaaacucugagccuugguguacccuuaacaacaacaaaaaugcuaugacugacugugucuugaacuuugaaaauauauuuucaguauauccaauugccaaaguuuugcugucucuuggaaaaggaacuaugaaaucaacugacaaggaaacgcauucuauagacaacagaauuuaacuggaucgcagacaguuauuacuguaauuucuucuuuaugaacaugaccauuugacuguucacugacuuucuuuguauuuacaguuuccagaguuugacauuauaauaggaacaaucuugcuguauacuuuuuaaaaauacugugcuauucuuucuggaacuguugaaagacaauauauaaaaucgaugaaucuauugcucaucagcuuuauuuuuuaaacauaccacuuauuuuguuggaauugucaaagacuguauuuagaucucaugcuuuuguuaaaauguuuacaacaguaaauaguuuaaauucaauaaauauuauuggucauuguaccaauuauugcauguuacccauuugaccauuuuauagauugcugaugucuuuuauguuuaaacgaagugcuagaauacuuuugucacuucuaagaugguuuuuguuaucuuugauuaugcagauaaccuaaucagccacuuaacaacuuacacaucuuuuaauuuguacuuguuuuaccugcuggauauuuaguuuguauaguucauuugcucuuguguauguauuuuugugugaaguauucacaaggguuaaguuaaaauaaacuaagggauagcuugcauaacugauuagcuuacuauuuaacuuuauuauaauuuucuucccacuauagggauaguucaagcuuuaauaucagagcaaaaucaggguuauuuuuauuguuucuuucacaaaggaguccauuuauuuacucaauauacaacuuguuaauugaagaccggauuuaaaaacaguauguagcagaggauucuuagugaucaaaauagguuuguuguuuucuuuuuuuaaagaaccaccaagggagguacuaaggaagguauuaauaaaguuuucucaauaaaaauauuuuucugaaggccuagauccauaaagcauucgauuguauuucucaagagauauuguauacaaggaaaaauguuaaguaaucaaggucuauuucccuuugcugaggaucaaacugagaggccuaaauuguauucuuuagaauauuauugagagauuucccuagcuuacauauagggcugaaugcuaccauaaagguaaauuuacucuccucacauaguuucaaucaaguuaacggugguaacaaaacaacaacaacaaaaccugcuucuuggcuuuguugucaaugcaguucccauuguugauguugacaguaacucaucucuguccuuaguuuauaacguggaaaggcuacagacaaauuaauguaaauauggacuuuggcaaacagggagagauccggacucuaaggcauuuuaguuuguccucacugacugugaguguucggccaugacagccuauuugccaauuuuuuuuuuuuaagccugaaaugcuucucccuuuucuaccauuuauuuuaaaagaaaucugacuuauccucauuuuuguauuauagugacaugcucugucuuuuaaauuggagugggaaacguguuauuuaccuucuuaggcccuguaguaacuagguggucagugaugaaauaaaaucuuucaaaccuauuuuuaauggggauggauaggaaauuuucagagaaagauguggcccuugcuuuaaugccaaauuuuuaaugauaugaaagaaaagcagacacacugcgagcacuugcaguucugucuauagucuagcauguuguucuacuugaacuauacuugggcagaggaguguucauuuuuacucuacuuuuauaaaacccuacaaauaaacucaagccauaaaaauauuagagaugaaaaugcacauagaguaaacaccauuuacaaaaaaacauagcuaaaaugcuaccuacccuccugggaaguguaucauggaauauguaagcuagguagauuuagauucaaaguugauuuucucagaauuucuucaagccgguguugcagaaaaagaaacaucaaaacaaaacacuggucuaauauaugcauaucuaucuuuauuuuggucuuaacuguaacacauauuauuaauauacagcaaauacauacuaguaugucaagcacugcugugacuaaucccaucaggagcaggcauuauuuuccccaaucuguauuugggaaaauagcacauugagguauauaauuaacuaaagucauagaaaaguagaggcauauguuuuggguuuuuauauuaaguuauuuaacuuuaaauuuuugcauauaauuuuucuacagauuucuagucacuauaaugccaacuuuauaaggauuuacugagagguaaucauuuaaugauaaaauugacuauaucauuuacuaugacuuaucuguagaaauuuaagauuuuuuuuuaucuauacucaaaaauucuauuuuuauuuaaaccuagaagauaucuguaacugcauguaauaaaauuuagcaccuaaguacuacguaagugcccaguacauucuccagcuuaguaaugaaucaucaauaguucagucuacuggagagacaucugagaagcauuuguaagggcuucuggaggauaaaaccuauuuucuuaacuuuucagauguuuaccuauuguucagguuuuuuuuuuuucuaguauaaugcuucuaaauggaaagguuuguuuauuauaguuugucuaaaacaauacaaggaaguguagcacagucugacuuugucuaccacaggaggacaugguuugcaacuaauccuaguggauuaugaauauucaaacuagguggcauucaccccuuuugaagcuauauguuauauaaaacaaucacaaagaaaauauauagaacaacuagaaaaguuuaauauauuuugauguuuucacauuguacuauuuuuuuaaaaaguaaaaugucagacaugcuuccuacuuccguugguuaauaaguacugcugcggucauuuauuaugguuagagagaaucuaccaggucgucaucaguccauuccuccuaaagggaaaagaaugugguaaggguaacauugaaguauugagccauuuguuguuuaccucccucccuuuaagaaauuguggauugacaacagucuacuguagauggguuuuuuuuuuuuuuuuugagauagucuccuauuaugccuucagccagcuuuggauccucuauaccucaagugcuaacuacagguaugugcuaaguccugcacuugacugugauaacgacauggcagcugcccacucugugaggagugaaaaguuauccuuugccugugcuuauuuauccuugacuucuuaagagagagauuuuaaaacugggguaaggcaaggaaagaauccugagagaauagauaaaauuuagcaucacugccuucuaucguaggaaguuacuucagucagguagcuuacuuuagaagugguucagagucaugugaaaacagcccaugcauaggcuuccugauuagcaccacauaacgagcagcugccaacgugcuccugccauggacuccauucccccugaacauaacccaacauaaaucuucccuuuaacgauuucuuuaaaacuuuuacuguacauaaacaggugaguaaaaauuuaauaauuucaaacuuuagagguacuuguaguccuaguauucggugggcucaggucaaaaaagaacugggaguuuaagaccaacuugggcuacaaagcaagacacuguuuuaaacguucucagccccaccucucuauaaugcuuauaguaguucagaacauacacacuagcuuaggucaugccagaaaguguaaguuauagcgaguucucuucaggggaaaacauaccucuuccuguuuggguuucuuugacacauagucaucaucuucauagccuuuccucuucuuccuauaauuaagcaaguaucgauuagcaaaacuguuaguggcaacaaaaccuauaaaauaagcuagcacggccaugugaacaugugguagcccucagcuacaaugacaguacucggacuaaggcaccaguauugccuucaguucagucuagcauggguuaaaaaaaugaggcccuaucuucaaaaacaaaauacauuauguacugaagaguagggacuagauagcuggaaagguauuaucuguggauacaaaggcaauauuuaauauuuaauccaguguagcaagaaccuacaaagaugaaaacaacgaaaacguugaacauacccauaagucccaguucuugugacucuaaggagauuauuggauaaucauugguuacacugugauaccuggccucaaguaaacauagcaaagagaaucuagagggaaaaaauguuggaagaccuugucuugguuaucauaaaagcauacuaaaguggagugcagugguggcacacaccugcagugccaacacucagguaggauagaauaauugagaaucugaggcguccuaaaccagacccuguuuaggaacaaauaaaaggacacacuauaaaagcuaugguuauuaagaauaugguguuguuaauacaucggcagucaaagcaggacaggcaaaacuggcucugcauaucuggugacagacucagugggguuagacaccaagauggacagccugguuuguuccccauggcuguauggaaagaggaaaacugacucuuuuauguuguccucugcucuccacacagguacuugcuuauuaaguacauaacugaaauacaauaaaugauuuaaaaacuggauauaccuuuuaauuuuauuugugauuaaaaauugucaacuaagaaaaccaugaaauaauacucaaaaacaaacuagaaaaacuacaaauauugguuaaaaaacaaacaagccccccaaagccuuuacccuuccuaagcauuucuuuggcaaaguaguguaagaaaaaacauaaauaggauaaacaucuuuuuuaaaaaagauguuaauauauaauguauuacaagaauaaaaugccagaagcaaugcagaaaacuuacaaauggcuauuaaaucuggaaacaucaauaguuacaguaaccagggaaaugcaaauggucaaggugacucuuaucuuuuucacccggacuggcaaaaguuaaagacuggcaauguuaaaugcaugauguggacacauuacuacaaacaaguauuucaugcauuucuacaaagaaaagguuggcagaugguagacccaucugguaagugacuucugagaucaaaaucuguuugauuaaaggaaacauugguguuuacucagugggugacuuagaagaauacaguaacuguacaaugaaaaauaaaggcagaaauguuaaugaucaaggaaaaauaaaugcuuugugcugaaguacuacuacuuaguguuguucaugaacuguuuccagccugcagugagaggagcagaacagacacuauguagaaacuauacagcaaauugacaguaacuucuaacuggugaaucuaacagaauuuaaacauauuuuuauguauauuucacuuuggagaaacugauuguauuuuauaauuuuuaaaguccuucuuuuacaaagaaauauucagacacuuacaagaauguagaaaucuuuuuuggcaggguuggcaaagcaaauggcaacuuggaauaaaauguaaacucuaucgauuagaaauuucuggauuauggcccauuccuuuacuagcuagaacagaauuaauagucaaaugauccaacucugaggacaaauuaguaaauacuuuauaggccaugcaguuucugccauaagcacuuaacuuuucugccacagaaugaaaacagccacaauaauuauguaaaccaauaaugggcauucuaucuuccaauaacuguucuuuucaaacuuaauguaagaacacagucaagugcuacaguccuucuacuuaccaaugugucaacuuuaauucucuacaaccuucugauauuuacuaguuacuacugaaaccuaccaauucaagauuuacaugaagacauguuuugaagcuauaucuguaagacaaccguccuauaauuugcacucugcaagcccugggaauccucuacuaaaacuacauuuaagaaauuaagccaugacuaucuugugcugaagacuuuggcauacucuucagcuuuuuacacauauuuguuagcauuucucuaauaaaauaaauaaauaaauaaacaucuauagcuaucacagcuaauucccauuacauguuaauaaguaacaagauuagagucaauacauauaaaacaaaaucuuuuacuuguauuaucacaugcucaaaaauuaaguuacaauggaucuuuuauguagagaauauguauuuuauaguaaauucuacauuagccuacaaagcaagagacauuaaauaugcucuuauacuuacacaaccuaacagaauauuuuacucguucucugacacaaugcuuccuuccuuacuaguuuauaaaaauuaagucuaaaacaguacauuuguucaccagaaaauaucagguuggcuaagagacaaagguuuaacaauuucauaggaagacuggcucccagugaucccauaacgugggaaagcgagccaagcuacacacuaacgaucaggaucaaccuguagggugaaagcccaacauuccuuccuuauguuuacuuccacuagaaaugugcacauaggccaagcuggggauguggacaaauagagagcacuugccuauggacaaggcccugagcuugccucccaacacagacaaaaucaguauacucaacuuuuuauaaaguuugauuuaggugcuaagacuaacaaacuuguaacagugaaauaauuuaacaauugaacucaaugacuuugugaacauaacuucuuuaucaugccuacuuacguaaccgcauuaagugcaaggucagaagaaugacaccgcuccagcuucuguuucaggacagcaaccucgucagaccugggcggcucguacuuuuuuacuagauuucucaugccuacauggggauacaaacucuuuuuuaauaaaaacucagcuaaauguggugccacaugccuccaucucuacacucuggaggcagaagcagguggaacugaguuugaugccauccuggucuagaguaaguucuaagaaagccagaucuacccaggaaaauccuguuuuaaaaaaaaaaccaaaacaaaacaucugcuuuuguauaaaaaagcauaauaaucuaacuugcuucaggaaacugaagacauuggugauaacauauucuuaccaggacuuguauucuguauuaaaaucaagcagcagcagcucuuaaaguucaaauaauaucugcuauaugccacacuauauauagcauuaacauuagcaugcuguauauaauacugguaguaauguuuuccaagugccuccauguuuacauuuugcucaacuuaaagcuuuugaaauaaucccuaugugauuuaguaaauauucuuuauucucuaccaccagccauacacaugaacaaucuaucccaaaauauacccucuuauuuacuaagaauauaacauauaaaaaaaaacaaggauguuuccuuagcaaaucaaauguuaaaaacaaacuauagaucagcaaagauaagacuauauacaauacuuucuaucuuaucuuguuauguuuaacauaauaaaccaaaaaucucaagauuagaaacaugauaguccagggacuuauuauauggccaugugcuuucagacugaaauugguauuugugauuaaacaucuuuagaucacuauguguuuuuauaaaaaaaaauaugaauaccuucauauuacuaaagcugaguauuuuugaagcauucuccuuguuucauauuuauuaaaauaaguggaacaaaauaaagacaauauaagaaaucaauaauuaaaccacacacuucaauaagcaguguguuuucuuuauaguccccucuacuaccaaauuguuagaaaguacuauuauaaaaaaaaaaaccaaaaaaaaaaaaaguacuauuaucaaaucacaaucggcuuuggaagugaacccucuagugguaaauaugaagaccuacaguuuauagggaaaaaagaccaacccucuauuaugcucagaggaaauccaaaauuacuuaaagcaaagaaucacuucaaggcauguaacugcaugacuugaaucucauuuaaaacaaacauuaaaauauacacauacacauuuacuaucaccuaaacaaaggucugcaauccuguauuuuauuguuuugcuuuacccuuaaaguacgucuccauaccuaugaacauaauugccaagacaauaaagaacuaaaugugguggcaugccccuaccauuuucacacucacaaaacggaggcaaaacacuucaagucuaagucuagccuggguugcauugcuagacuguggcaaaaacacaaauuaagugauauguaugccaaauauguaugugugcuuauauauauguagguauguguauauguauacacauauauguuacaugcgcacauacaauuaauacauauacauguauuaauuaagcaaaaauucaaaucagaauuucuaagaggauuucucaacacuagcaccaaggaguuuuugguaagccuguuaucaaagucuauauuaauuuuccaaggcuccuauuaaaauuuuuauuaaguugguguuuuaaagcaaccaacucuauucucucacacuucagaguccaaaaaucgggaaucuuguuucccugggcccaaaucacaguauuggcaaauuuuaucugaaggcucuaauugacacaucacuccaacaucugcauaucuuuugcuguuuucacaguuuuucucaaagucucuuaccuucuagucaugaagacccugugacaacauguacuauuuugcuucaguaacucaaguuaccaucagcaccuucucaugaacuaaccuguacaaccccaucuuuuacagucucaguuaacagauacggguuccacagauaggacauggaccuccuuuaagggggcauuuuuaagcagcauucuucauggcuuuuugguuuggauaguguggguuuuuugguguuaguguuugaacaagaacugaaaugagcuagacaagggcuuaccaccuaguuccaacccaucuagccgacaaaccucauuuuuaucgaucucuaagcuguaauagucaaugugucugucuucugaaauugacaccucucccucaccaacccccauaugaaaaauuacuggcuuuguauugauugaucaguauaugacagauauuaacuaguuaaaauuauuuacaaaacaaauacuccagaugcaaacuuucccuugaagugagcucucugauucuaaaugucuaccauauauuugugaauacuuucaaaagaaucuauucugacuuaggccuuucuaaauccauauucucuuuuuacagauaaaagaauuuucuuucacauaccuuccauuuauucuugccaaugaaucuucaaugcauuuugagaacaguaauucaauaaaaauaaauugaaauacuagucuacuacagcauuuguucagaaagcaacuacauuaauagcacuuacuuuucauuauauccaguaacugugacaggcaaguucuguuuucuuuuagcauuagacucucugauaaguagcugaaguaaaaaaaccaacauuuuaauucacugaaagcacauagcacacugaaaagacagguauaaauuauuuaccuccauguucauuacaucaaagacaguuuuaaaauuacuuaagacuauuacuuacuauuugaaaccucuacaguacuaaaaccuauuagaguuugaaaaacuuacuaccacuucugccaguuuaagagauguguacuguuaaaaguuuaaauuuuaugauauauagcuuuccagugauaaaaguacuaacagccuauauuugucauuguaauauuaaauguuugcuauagacacagccuaacuacaagccuggcuuuaugugacuuaggaaaagucugugcuagagagauggauuucacuaagcucaaagggagaagauaaggaacauggcagcagucagcuggcucccuucaguaacaaugucacuguaccuagaguauacaugagcaaguaaucuaccaacacgguauuauuaccucaggcuuuauaagucuaucacguccgauuuuuaucauguccaaagcaaucucaggucuuucaaauauauauguguauauauauauauauguguguguguguguguguguguguguguguauguauguauauauauauauauauauguauauauauauauauauauguauauauauaaaacuuucuccagauaaaucaguuguaaagaaugcaaagaguuuuaugaaauguuguugcuauauuuuaaacuaccuagauuaagcuauaugacaaaacuuugauagcuauguugcauauuaacuaguuuccuuauuccccucuuguuaugcauuugcaacucuccugaaguuucuucuucuuuuuuuuuuuuuuucuguuguuuuguuuuguuuuuuuuugagacaggguuucucuguguagcccuggcuguccuggaacucacuuuguagaccaggcuggccuugaacucagaaauccgccugccucugccucccaagugcugggauuaaaggcgugcgccauuaccgccuggcuauucuuucauuuuuaaaucaugguuuuuuuuuucuuuuugaaacaaggucucaugaagcccauuuucaacucagcauagcuaaggauguccuuuaacuccugacauuccugcuuccauuucccauuggcccuuacaaagacucuacaccuaaccuccagccaagucaauuauucacaucauuguguuuucuuagcucaggguuucauucuuguauuccuuuaguauaguauaauggaagcuuauuaaauguuugcauaguaaguaaaugagauauaaaccacaauaggauuaaaucuacguaguguguuauauuugcacaagauagguuuacuggggcuagagaaauaucucaaugauacuguucuugcagaagacucaacuuugguucccagcauccauauauggcagcucuuaaccaccuaccuggcaggagcuagcuaucuaaggaaggcuaaggcuagcaggugacuuuccuggaggugguccaccaauuuugcauggcuugugguggguaagcucugagaggcaaggucccaagggacguucaucucgggauugcuucuuacagcugauauaccuuuuccuauuaccaucuaaugaucccugggcauuagcccacccuauugcacagauuucaugcacaucaacauagagaugaacauucaugaauuaauguuguuuagauaaauuaaugauuuuauagaauuucugauuugauucaaauaauuuuacgaagaaaguuuuaagagaugguuuaguuguuuugccagaaagaaauauaauaaaguuagaaucaagaacaguauguguccauuccucauugaagaguaaaggcugcguaacagggucuauaaugagcuuucacaauuauacuaaagagagaaauaggcuugggacagauuugugaucaagaaaaauauucauucugggucagauccaaggauaaagccacagguaugcacuaugauaaaacaaggccuuguaaaacuguugcuuugaacuuggaugaaacaaugcuuugaacuuaguaucaaggucuuucuguaacuccacuuuuguguaauauuuuaccuauaagguaauuuucuaaagaacuuuugucuaagaagguguaagaaggccagagagaaggaauaaaguguggcaucugggugcucagccccacccaccacccauauagauguauaugucugucuauauguaugacauguagcuauauguguauguauguaaguaugcaugaacacuuguagagcugaugagauaggugcuugggcuugacuagaguguauauguauaugaauguauauuuuucuauacauauugccuggugaaagauuuuaauucuuuuccuuucuuuugccucugguccaugaagaguuaaguucuaagccucucucaccagcaagggguccuugagcuaaaaaagaaacuaacacuuauuaaugcauacauaguaagagagcuacagagccaacacucagcacugcucagcucagaacaguaaggaagaguuaaguuuccagggccaucagcuucugacccccaggacagagaagagaguuacaaggucauaacuaucagccuuggccuucauccagcucugugucccacuucagcccacuccucagcuggagcaggcacuuggcacccaacucuagcucuggggaaauuacaccuuuuugcuagucuccauacauauggcaccuauacacauggcauauaauuacaaguacacauagauaaaauaaguguuauaagagagguauacauaccauaaauuuuaaaaggcuaaggucgcuucuguagaaauaauaaauauucccaguaaggaagaacaaaaucuaaaucacaucugucaauaucugauguuuucuuaucauuguauuuugaaauuuuaaguauaugaaauaguuuuaaguuuagaaaauuuuacuuucuucagauguuuauaaagaugaaacaaaagaaucucaucauaagagaaauuaaaugaacaauaauauauaguauaaauuguaaaacaacuggaguauaacaauuguuucuaauuggccauucuuccagcuguguaauaauauacuuacaguacuguuucaaguuuaagaauuagcauguacauaugauaacauuaaaaaaaaaucaagugaauuaacucacauuaaguacucauuguaaugucuaucuauguguguuuauguacucgcuauuauuauuuauggcucaacuauaauuuucauauggauauacccuaaagcauacuucuacaaauccuuacugaaaguguuacacaugcuuuacaacauaugauaaaauaaaucagauuugcugcauuaacacugccuuguaaaucuaucauacacugguagcuauaacugucuuccaaaacuaccugucacacuucuacuuuagucagaaauguauucucuuagcucaacaauacucgauuaaaugcuuucuuuaaaggcgauuucuuucuucaaucacaaacuuaccagauauaaggcauuauauauacagaaauauugucuaaugaagcuuacuuaaaagcucagacucuacuaagaaguaaaacucuacuaagaaguaaaaacaaauuaauaccuuuccauaguaauuccagcucuagaggcacuugauaaaauggcggucagggcaaucugugaagguguguauaaaagauaagcaucugucaaugcaauucuacuaagaaaaucaucagcuguuuuccucagaaucuccggauucuccaacaugggguaccgagucuagaaagaaaguuuauagauguuaccauuucugaguuuauuggcuagccaccauuaaaaacuacaguaacuaggagguacuuaauaaagaaugauuuuuauaauuccuuuccucuauuccaaaacugaaucuuucaaugcuagauuguuugguauguacauagcuaaguuauugucaccaaauucugaguguuuucacugauaugacuuucaaacuuuuuggaauacaaccaugauuagcaauauaugcuuauaagaaaaaaacagaaucauacgcuuuagcacaauaaugcuuaacauuauucucaauuuaguacuuuucuaacuuagaaagggaaacucuucgagauucuaugggauucaaggcaaagacaagauauguaugauacagacgcucagguaaagacuggaaggccacauuagaaauuguaccaaaucacugucaaagcaaaguuuuuuuuaauguauaccauggggguggggggaguaaauguaaacgaauguugaaccaauuagccuucacaaauaucuacagaaauacuuuuagacuauguucaggaauuauggaaaacugucaauuccuuuccuuaagguuuuuuuuuuuuuuuugguuuuucgagacaggguuucucuguguagccuuggcuauccuggaacucacuuuguagaccaggcuggccuugaacugccucccaagugcugggauuaaaggugugcaccaccacacccggccuuuccuuaaauuuugagcccucagacuggcuuuagauacucauugccaaauccuaguaguaagacaaucuauaaauauucugaaauaaaauauaucagguucaacuacagagucccacauaggccuagucauuguccccaaauaucuaaccucugaaaugauaaauguagucacucccccuuucucaggauucucuuaauuuuucaugauguucuuguaaaucuugcaccauuugguuuugaagucuucaaccugaucagauuuacuagagucuucaauaauuucuuugcuguauaaauauauaaacauauguauauauacauacacacauauauguauguauacagauauuuauuuauuuauauauacauauuuauuuuuauuuaugucugucugucugucugugaauguguguaauaugugcacagugcacauauaaacaguaagggguguccguucuucugaagcuggaguuaugggcaauuuugaaccaccagaugucgaugaacuuuggaagagagcacgcauucuuuaacugauaagcaaucucuucagccucaguuucaacagcaucugaaucuaauuucuauacuuuugauuucugggcauuggcagaaaacucuacaaaagagguuuugggauacuacuauaaauucaaauucacugaccuaggugugucucuuagccuaacaaugaugucuuccuagaaaauuuguucuuucauuugaguaagucucaaaaaaaccaucauucuauggaaaauuaucucugcacuuaauaaggauaagacuauuuccauuaaauccccagauacaauaguauuuucacccagacucacucugucuugugucaacacaagagcuuacaccuucucuacggccagcuguacccuauuucaaaccccaugcuaaccuccuuuauauuguucguagagucuaaagcucugcuauacagucucuauuucccuuuaacuuuuucuuauugcuagcucauuggaucaguacuuaagugugucaaucucuucuagaaaacuaaacaugucuacacccaacauuucuuucauuuuaccuuuccaauucaaagaaaaaaaaaaguuuaauccaaguuacauauacaaguucuauuguacaaaccauuuuuucuuucaguaaugaauaagaggcaugaguucugcaagcuuccaaagcauccgagcauccccgccauucaguaccacaccagcgucacgaggaccaugcuugcagugaugcuuauggaaacaagucuaugcuucaguguaagacacgguauguacauuacagaauuuugaaaaaaugauaaccaugguacugcuuuauguucuagcugcaccauacacuuuucauuuauuuuagaguguauguuuuauacuuacuagcaaaaaguuaguuuuuauguuagaguauguuuuuucuacuuaguaacaaaaugcuaauuauaaaacaccccagguguauaagaauaacagaagcaagccauuguuaugagaguauaugacagcuccaugcacaguagcaccuagcuaagggcaaugugcaaaggcggaacauugugauauugaucacacaaugacaaauucaucucgugucuaagaauauauccaguaauuaaggaacacuuauaagaaacauaccuauuuuucucccucuuucccuuuaccugaacaggaucuuucuauguaaccaaguugacaugagacagcucuccuucauuuauaguuuuaaaguuuuuauuuucuuugcuuuuaugccuguugauguguaucuguguuuugccuacacauaugucuaugcacuacguguaugccugguggucaagaggggcagaaaagagcauuggacuccuuggaacuggaguuacaggcaauuaugagcuacgaugcgagugcugggaacugaacccuguucaucuagaagaauagcuagcacucuaaacuagugcaucucuacagucuguugucuuucaacuuauuccccuaaagccaccaaucuccuuuuuuuauccuucuacacuucaaagacaaaugucaacaaacucaugagugaccuuucuggcacgaaauucagcaaauaucauuagccuacauuugcuuuguccaaucuaagcagaacuggaaggcguucggcuuacuuacacgagcgcuuuccuucccuuuguuuuccaacaauccgacaacucuggauacauucuagucccauuauaagcuucuccauuuuucagcuacucuuuaaacauuucuuaugaccaguccccacuguuaccccuuugcccauucacucuuuucauaaugcaggauacauacagaugucaaaucuuaucugauuguauaaugccuauuuuggcucucaacuugacuacaucuggaauuaucuagaaccccaaauggcucgugaaccugagggauuguugcuuaauucauucauuugaagugggaagguucauuccuaaucuggaauucugagguagaaagacacuccuuuaauccagaucuuuugagguauuaagacucuccucugauuugggucacaccuucuccuggaagccuauauaaaagacaugguuguagaaggaggcccuucuuuuagccugcuugcucuugccuugcuagcaaguccauuccuucacuugcauuagugcuuacuucuuucgcauuccaguguaugcugaucagcugagacauccagccucagagacuuagcaguuacuggaugggcucugggaucuucuguucauaagcacucguuacuggauuaacuaaccacauccuaauaaaucccuuuuuucucucucuauagauuaaguuacucuagagaagccugauuaguauagccaaaaacuaaccugugaggugccaacaggccauuuuugcacauugagaacucaaucauacccauucucuagacaaggcuuucacuaucuucuuuucccuuuguucaacaucuucaacacuacuuauauagucuagacuuuugccuucaauucaagccaagcacucuuuccccuccaucuccaggcucuucauuucuuaagugggcugugagucugagcuccugacgaggaaggucucuggguggaauguucccuccuuaccuauuugcuacucuugaucugaauuucacuuccacugaugcuuucucaacaguguuuuccuugcuuuucaaucugccaucuucuaauagaauauuuugauuucccuauauaaaauuuaccacagucauaguuaucuaagguccaugaaaguugucaugguuccugucuucuuucuagguugcaccccaaaaccuguuuagcauaaacagaauaucuacaacugcucaccugaaaauaaccaguucucgacuguucuuugacuuuacuuagacuauuaacaacuuaaauugacuacgucauauuaacauauguauuaauauguggcacauguaaauacauagguauaaauucuauacauuaaauguacacgugcacauauuuguguuacaaguuuugugguguacucauacuaaauugccaggcuagucucaaacuccuagauucaaagugguccucccaccuaaacuuccugaggcucugaaaauacaggucucaucuauguacuuauaauuuuggugcuuuuauuugugaacugaguacauaaaacauuuaaaauaagaucaauuuauauuuuaguuuaauauuaagacuuuuuugagguucuauaagucacuaggccuagaucuaugaccauauauaucgguuacaagaguuacaauaauucuuuaaugacauuacuauaaucucauaaucuauuauagaaaguuacuaaaccagaaaccagggaacucuuauccaauaaucuuaagaaacaaacucuccagguguacucuaaugcacacugagguuugaaaacuauuacccuagacucucagguugcaccuguguuguacgaguuagucuauuacugauuaugaaguuuucaauucguuuuagcaaacaauaacaaagaauuagcucuacuagcuaauuuccuaucagcagguuuaccuuuauaucgaugaggaagccuucaaauggucuguauggauuguggacaauaaggugaaaauuaaguuguuguauaaguaguaguucauauuccaaaaucuguuccagugcccucuccuguccaagaggacucucucgaagauuuccaacaaacuggggacuagacacauugaauucaucuacuuugcaggccaaaaaugcacaaguaagccuacauaaaaaaauaaaggacagcagaaauaccuaaauaucccuuaaaguacuuuguaaacugcauaauacugaaaugugacaaugcuagacacugcaggaaauuaaaaaaaaaaaaaaaaaaaaagaacuuaaguguuccuuuuuaaacuuuuauucguuagacuuaggggaaaguauaaaguuagauuggcccaacaucuacuacugcuacaguauuuaaccaucauuaauagcuuuauauaguccaaccagaaacuugaagaaauaacuaaguagugugcaucaagaacuauaaauggaagauuugauuuaacagaauugaucauguacauauaccuuaugaccauagaagacagauaaugguaaguaauacugcagauggucaucagcagaagccucaagucauuugaguaugugguuauuacgagcuuacaagcaaacaugaaauucccugaguuacuaaauuaaguucagagaaacuaguguaagaaagcuauugcugacagccuuuagaaucugaaaucacaauaaaggccugagcuugacuggugggaacgaaauggggacaaacagaagcaugaaugacagcaaacugaugagcccuauauuaauugugcucucauauacagugguaagcauaaugcagagcauacuacacuucuguuuagccaaaaugaaucugaaguuacaagauccauaaacugaauggaaauggagagaaagcaauuuccucaaaugauucuuagccugagcaauugggagaauaaagguaucacugacagcaguauugguagaauaacuagauguaaggaaaaccaugugagugguagacaaguugcaggucagaugucauuaucuauaaagaacauaacagcaaguaagaagaccuuauauucaaauagaaaaaaaauucaagucuaaauuguuccuaacuaaaauugucaacaguccacagauaaagguucacacauuauaaacaucuucauucaaaaccaaaccaaaccaaaccaaauucauacucacauuauuauccgagggugauauuccauuacugaguuauuaagauaaaaacgcuugaaauacauacaagcuguacccuaagauuaaaaauaaaaauauaaacauuuauaaaagcauaacuuacuuccauguagcauguuaaauuuugaaaaacuuaacuuauucacucaugcacagguuuccuuaaaaacauuuucuacaucaguauguuuaaauuuucccuuaaucaaaauaaauuaugauaaaguacaacaaaaacuguugagugaaguuuuagaaacucuacugccuuggccacgcuuccuuuucuaucugccuuaugcuccggaagucaacuacuccaccaguccacucccaagacccuugcuccaggaagggucagguuaccagccucacccaaaacccuugaauccuugcauaaaagacacauagacaacuuuguuaccuuaacuugccuuuaagcacaauugcucugggcaaauaccuccugccuggaaaugcaugcccuuaccauuuauuaucucugacucuccuucuacccuaaacuuaguggcuuaauccaauuagccacugcaaaacauuuuuggccauccuuccauagcugaagcugcaggcccuagcugccccgaggucuuacaugguugcugcauccauuuuccuccaaaacaugguagaaaagccccuucucucuuucccugugucucuuuccucuugguacccagacccaaauguaccuuccgcccagcaauuggcuccugcccuucuuuauugacaaaucaugaaccaauuagggaacuagaccuuaguaucagaacuuccccaaucaaagagccuauauauauauacauacauacauauauauauauauauauauauauacauauauauauauauauauauauuuaguuaucuguccccagccuguguacaguaagucauucuguaguuaacuaaacuuaaauauauauguauguaugaauuaauuuuagaacucagagcaaaaugaguacuuauacucagaaaauuuuaaggacuaaaauacuacaaucacagguuagccaauuuuggaaaaaugcuaauggauaacaugauuggagcaaaaagccuuuucucugucaacuccaaaucugugaugaaccaugaugacuacugcuaaacuguagcgccucaccuuugccugaaucuucccauucaauaagucccacugugcaaaacacaguaguaucaauuuauuccaauccuuauaacacaguacuaaaauugcucucuucacagaaaaugaaauagcaugagugacauuuaucaaggguuggaggcuauauucaacuaagaacucucuaucuuuaccuauugaaucacuuaacaguaaaauaaccacuuauuuauuugaucacaggaaaaaauacuucauuuaaaugcuucuagaguugcugucaaauuauauuaaacaacaauaacaaacaaaaucacuguauccauuguauagaugaauuucauaaaguucacugaaagauugcuugacccaaagaaauaaauuaauccuaccagcucauucuacaguuucuguaacgaaaaaaaucaaacccaauuucaucauagaaacuaaucagcuguauuugcuacuguuuaugacuguuuccucucucagacaugucuacagcuuuaaaaugaauaauaaauacuaauguacuuaauauuuucaauguucuuucuuuuuuccuauuauaaaaauggaggagcguagauaguucuucucuauuaggaaacuuaaaaaaacagcugucuuagucaggguuucuauucaagcaucaugaccaagaagcaaguuggggaggaaaggguuuauucagcuuacacuuccauacugcuguucaucaccaaggaagucaggacugcaacuaagcaggucaggaagcaggagcugaugcagaggccauggagggugcuguuuacuggcuugcuuccccuggcuugcacagcuugcuuucuuauagaacccaagacuacgaguguagggauggcaccacccacaaugggcccucccuccuugaucacuaauugagaaaaugccuuacagcuggaucucauggaagcauuuccucgaggcucuuuucucugugauaacucaaguugacccacaaaaccagccaguacaacagccuuucauacuuggccuuuacaaccaacaagccaugagaguaauaauaagguaaaaaguguuuuggacacccuuaacaccaucuuuuuucuucauuguuuagcuuguaccacaaguuaccuauucccaucccaguagaaaacacaacacuaagaaccacauaaacuaauccugagacauuuaagccugggauauacucaguagguagugcgccugccaggcauggaugcagcucugcauuugauccuggguacuaaguagaaccagauguguagugccuacaaucccagugagguuuaagcaauaggaccaggaguucaaguucauccucuggaauauaauaaacucaaggccaacaugacucuuagaggacagacacaagaaaacaaaauaaacaaagcuaccaagaaaucaauaacaaugucaccucuauuauccucuaaucaaaguuuuaaaaccucuuagggcaagaguagcagcuggaacauaaaucaaugagcauuucaaaccagaacugaguuuagcagaguugaaaagucacuaguuuauauucuaaucucaauuccacuguaaagaauaugggaagaaaaaugcggaugucgcuuaagcucucgccucuccugcuucucuugcuuuuccagcccucuugcuaccucuauccccucccuucuccucauggccaugggcagccucuccuucucuaccuucucucucucucucugccuuuccacaauaaagcucuaaaacaaacaaacagaaaaagaaaggaaugucacaaccuguacagcacacuauaaagugacccaggagaugcccuuccucuuaaaauauagcaacuaugaauuaggccuuuaaaauuuuuacaaaauuaauuuuucucacauucauuauacugauacaaguaugaaaauaccaguauuuaaaaaaaugugacugauucauauacaacuuucauguaagcauguuaugguggcuaacguacauuaagauucacaccuugauccagagaacuaagcaucuggagagaggccacauuucagucuugcuuuugucugguauggcuaacaaaguuagugcaaugacucacuuuucagcccaagauucauggagcaacuacgccuuccccucaguuucagcccaguccagccagaagcagaggauuaccaggcuaggcacuccaagagucaccagaggggaggagucuaggauucuagucauggcaagagagccauuuucugaugagauggccuguauugagccacacugugagaagaaauaaacuacuagauuuuuuuuuuucuauuauagucugccaaauaguuuggguccuauuuagucugcaguuaggaacuacuuuaaccucaaagauaacucuaacguaaauaccauuuugcuacuuguaaagaauaaaagaucuuuuuccuuucuguaggcuuccauuuuuuccuacugaugguguccuuagccaugcaaaagcuuuccuauuucaugaagucccauuuauuaaccuuugaucauaaugccuaagcuaaggaacucaggaauuugucuccugugccaaugagugcaagcaguucccuacuuucuuuaccccaucugcacaugaguuuagugcaggguaauauauaugagucuauuugcagacagccacuuagaccagcaccauuuguuggaagaugcuuuuuucccccauugcaugguuuuggcuuuuuugucaaauaucaaguguucauagguauguggguuuauuucugggucuuugauucuauuccauugaucaaccugucuguuuuuauucuaauaccaugcaguuuuuauuacuauugcucuguaguauagcuugaaaucagggagggucauaccuccagaaauucuuuuauuguacaggauuguccgacagaggacuaauauccaaaacauauaaagaacucaaaaauuagacaugaaaaaaaucaacuaaaccaauuaaaaaugggguauagagcuaaacagagaauucccaacaaagaaaucucaaauagcggagaagcacugaaagaaauguucaacaucuuuagucaucagggaaaugcaaaucaaaaagauucugagauuccuucuuacacccauuagaaugacuaagaucaaaaacugagccgggcagugguggugcacaccuuuaaucccaacacuugggaggcagaggcaggccgauuucugaguucgaggucagccuggucuacaaagugaguucuaagacggccacagcuauacagagaaacccugucucgccaaaaaacaaaaccaaacaaacaaacaaacaaaacugaagugacagucaccagccacauacuggugaugauguggagcaaagggaacacuccuccuuugcuggugagagugcaaacuuguacaaacacuuuggauaucaguuuggcagauuuucagaaaaucaggauuaguucuaccuuaagacccagcaauaccacuucccggcauauacccaaaggaugcaccacuauaccacagggacacuugcucaacuguguucacagcagcuuuauucauaauagccagaaacuggaagcaaccucaagugaaaggccaaccaaugacuggcucaauuugagacccauuccaugggaaagagccaacccgacacuauuacugauacucugcuguucuugcagauaggaaccuagcauaacugucuccugagaggccucaucuagcaacagauggaaacagcugcagagacccagagccagacaucaagaagagcuuggggaguuuuauggaagagugguggaauugagcaggccagaguuguaaaggacuccauaggagggucuacggagccaacuaaucugggcccauggggcucacagagacugaaccaccaaagagggcuggaucuagcuccccaacccuccacauuuguaccacaugugcagcuuggucuucauauggguccccuaacaucuggaacaggggcugucucugacucuguugcuugccauuggauccccuuucccaaccagaaugacuuguugggccucagugguagagaugcuuaguccuucuggggcuagaugucacaaggcagggugguacccaaaggaggaggggcuuccccuucucugagaagggaagggaguauuggucagaagaauuugcaaacggcaggaaugagaagagguggugugcuauugggauauaaugugaaaaaaaaauuauggaggaaaaagaagggaaaagucuaguucaauucucucaagccagcuaacaagcauauucuucucucccaucacuuaccacaacagaccguggcauagcugguuuaaacacugaacagaauuccaauaaucuuuuuucauaguacuugcaaagugucaauucuucaugaggcuccagaaacacuggaucauuuggaagaaccuuuagacagagcagacauuucaauguaaggucagugaauucauuguaagaccgucuuaucuguccugcuuaaauuggacuuauaccaccaacaaaaaauagaccugaagcuuucucucuuuguuaaguuuacuaagcaucaagcaaaauaucuaggagaagaauaagcaaaaaucaauaaacugaaucuaggcuuucauuuuacaaguucucaaacugucagcuggacauuuuuaaacagucaugacagaguaugugucaauucacucccagguuugauaccauuauuuguaaauuaaaaaaaaaauacauauuuucauggguuggaacucucccaaaguagcuuuugcaguaaauccauaugucaccaaaauuaaaauaacucaguucauugucuaccuguuuuguugguacaaauuuuauuugccugaaauuuguagaagcuacuauaaaguuauccagggccguacacagaaaugaaugggagaguuguaggaagaccuggauagaggcccauagaacacgcauuacuugugucaacuauuuucuuuccuuguacaaccuucugugugaagguuguuucuggaaagcagauccaacaagccaucauccccccauuucaagucuuugaaaaguuccuuucaguuuuggcaagaauuucaaccgccuuacacuuccgcuuacaaaguugcuugugcacguucuucaaccacugcugcagagguacagcuucauccaugagugaccaccagcacuccaggcacuugccugccagucugacuuuccacuagacaccagccuaugugugugcccucccuccugccaucuacagagaaugauuugucgugacauccugcaggacaagugaccaguucgagucccgcacuaaguccgcacucuuccaaggcucuugccaguccccaggaugucacucagaccucugccaccgccagccccggacuuggcugucgcgucagucccugucugcacugacacagccaggcgagcgcucuacaggcuuccagccugcaggcaaagcgggacuucaggagaggucccagguuuagggugggcacaggggcuggcucgcggggaccucaccuucccguuagccacagcuuugcacuugaauuugcgguuggcguccgcccgcaggcgcgccagcugcuccucgcuagcgaagguccagugccguuucuggcugcugcugugauacaugcuguagcccucacgggccgcagggccgcgacaaaaacagcgacacuccgagagacagcgaccacgagcgacggccaacgcgcgaacccccgcccccgcccagaccgcggacgcgugcgugacgucccggucacgugccagcgucugcucug

SEQ ID NO: 7147 - RNA, 2499 nt, Mus musculus
acauaauguauuuuguuuuugaagauagggccucauuuuuuuaacccaugcuagacugaacugaaggcaauacuggugccuuaguccgaguacugucauuguagcugagggcuaccacauguucacauggccgugcuagcuuauuuuauagguuuuguugccacuaacaguuuugcuaaucgauacuugcuuaauuauaggaagaagaggaaaggcuaugaagaugaugacuaugugucaaagaaacccaaacaggaagagguauguuuuccccugaagagaacucgcuauaacuuacacuuucuggcaugaccuaagcuaguguguauguucugaacuacuauaagcauuauagagagguggggcugagaacguuuaaaacagugucuugcuuuguagcccaaguuggucuuaaacucccaguucuuuuuugaccugagcccaccgaauacuaggacuacaaguaccucuaaaguuugaaauuauuaaauuuuuacucaccuguuuauguacaguaaaaguuuuaaagaaaucguuaaagggaagauuuauguuggguuauguucagggggaauggaguccauggcaggagcacguuggcagcugcucguuauguggugcuaaucaggaagccuaugcaugggcuguuuucacaugacucugaaccacuucuaaaguaagcuaccugacugaaguaacuuccuacgauagaaggcagugaugcuaaauuuuaucuauucucucaggauucuuuccuugccuuaccccaguuuuaaaaucucucucuuaagaagucaaggauaaauaagcacaggcaaaggauaacuuuucacuccucacagagugggcagcugccaugucguuaucacagucaagugcaggacuuagcacauaccuguaguuagcacuugagguauagaggauccaaagcuggcugaaggcauaauaggagacuaucucaaaaaaaaaaaaaaaaacccaucuacaguagacuguugucaauccacaauuucuuaaagggagggagguaaacaacaaauggcucaauacuucaauguuacccuuaccacauucuuuucccuuuaggaggaauggacugaugacgaccugguagauucucucuaaccauaauaaaugaccgcagcaguacuuauuaaccaacggaaguaggaagcaugucugacauuuuacuuuuuaaaaaaauaguacaaugugaaaacaucaaaauauauuaaacuuuucuaguuguucuauauauuuucuuugugauuguuuuauauaacauauagcuucaaaaggggugaaugccaccuaguuugaauauucauaauccacuaggauuaguugcaaaccauguccuccugugguagacaaagucagacugugcuacacuuccuuguauuguuuuagacaaacuauaauaaacaaaccuuuccauuuagaagcauuauacuagaaaaaaaaaaaaccugaacaauagguaaacaucugaaaaguuaagaaaauagguuuuauccuccagaagcccuuacaaaugcuucucagaugucucuccaguagacugaacuauugaugauucauuacuaagcuggagaauguacugggcacuuacguaguacuuaggugcuaaauuuuauuacaugcaguuacagauaucuucuagguuuaaauaaaaauagaauuuuugaguauagauaaaaaaaaaucuuaaauuucuacagauaagucauaguaaaugauauagucaauuuuaucauuaaaugauuaccucucaguaaauccuuauaaaguuggcauuauagugacuagaaaucuguagaaaaauuauaugcaaaaauuuaaaguuaaauaacuuaauauaaaaacccaaaacauaugccucuacuuuucuaugacuuuaguuaauuauauaccucaaugugcuauuuucccaaauacagauuggggaaaauaaugccugcuccugaugggauuagucacagcagugcuugacauacuaguauguauuugcuguauauuaauaauauguguuacaguuaagaccaaaauaaagauagauaugcauauauuagaccaguguuuuguuuugauguuucuuuuucugcaacaccggcuugaagaaauucugagaaaaucaacuuugaaucuaaaucuaccuagcuuacauauuccaugauacacuucccaggaggguagguagcauuuuagcuauguuuuuuuguaaaugguguuuacucuaugugcauuuucaucucuaauauuuuuauggcuugaguuuauuuguaggguuuuauaaaaguagaguaaaaaugaacacuccucugcccaaguauaguucaaguagaacaacaugcuagacuauagacagaacugcaagugcucgcagugugucugcuuuucuuucauaucauuaaaaauuuggcauuaaagcaagggccacaucuuucucugaaaauuuccuauccauccccauuaaaaauagguuugaaagauuuuauu

SEQ ID NO: 7148 - RNA, 87262 nt, Mus musculus
uggccagggaggcaggcggucccuaccgcaggcugagggagcuccuuuccgccccuccgccuguuuccaagcuugggcucuuuggagugacugagcuacggagcucuucaggagccugugaaugaacccuccuccuccucucccuccuccuucucgcugagucuccuccucggcucugacgguacagugauauaaugacggugggugucacaacccgcauuugaacuugcaggcgagcugccccgagccuuucugggcgaagaacucaaggagcgcgggcgcagcagcugugagcauuaggugcuguggccaagcgcugggacaaggaucugccgcuaccagcgcauccucucuccucuccagcucugucccgcacucgcugcacccuuccccaggccaccgcgcuuccuaugugaucuuccggggcaacgcggagcccuuucucacagcucagcagugaauuuccaccccgaaaacugcaguaagccgccuuucaagguaaucacuuuucuuuuguucccccauuuaaaagaaagagggaaaacuuguugggaaaagaaaaccguccagcuuaguagggggaaagacucacauuguaauuggaagagggcuuuaauuaaagccaagaggacuagcuguaaggcgaaguuagaaaaaugugcgcacuuucaaacaugaagguaacuuguuaaagagaugaauucagauagaccuuggugcugaaaaagagcuagacaaaagaaguccggggugggguagaggaaaaggacaaaccgaauagggggaagggauuuuguagcgaaauccuagaaaaguccugcuaucuugaguuggaggaauggaauggacuccucacaccuugauuuuguucucuuuaaaguggucgaggcaaaaguuugaauggagaguccccaaacuugcccaaaugcaagccccugaaaccaccuuagggcagaccaccugguuuccuggcuccguguguguggucaguaucuuugguuccuggaaagucaccucugggcagcuccugacaaggcagcaggauacuuuagcggcccaggaccugcacggacaugacccuuucccccaaccccucaggcaaugugggaggcuaucuggcagggguuggguaggguccuggggcugcuuuucuuugaugacuugagggcugucaaagcucucucacguugccccuguguucuuuuguccugcgcguggugcucccgagccagccgggaaggcgcauuggaugggggugggguuguuggaacaccguagaggucugggaggcuccugggcgggaaagcuuucccugaacuggaggggugugcaguaucuccccccucgcucuggaaaacgaaaugaaggcuugucccccaaucuuuacuagcaaaccaggacccauagauucuccagacaaagguggcguggagacucgaguuggggaccaauuggugcagucuucucgccuggauuacagcaguccucuguucccuucuguaucuucauccgcucccauuucuccacuugaguugagcaacuuuacgggcugguggagugguuguggagagugcgugccggguuuccccggggacgcccuggcugagaaaguccuacugcccugaguaggcgugggcauugcagagacuucucuagugccugcagacccgggacaucccgguugucucgguuuguucucggugucaaugggcguggacugcucagagggguuagacagaagaaauagugguaagaaaauaaugucauagccuaaacuauuugcucucggauccaacuacguucgccuccgcauguccuacguguucucgggaucccgaggaaagggaaagaaaucucccccgaggcugcagggcaauacugccucaaguacacccacaguggagacucgcuaucuguguucccucaucuuugugucucuuucucagucuccaucuucucugucuucucuuuccccuuucuaccuccucugcgcuuuugcguccccucccccacggcucacaaaugaauggcuagugugaagucccuuccgucucuguccaaggaggcaggcccagagggaggagcaagggcggggggugggggggggcggaggcggugcgcuccuuaagaucugcuugcaguuggguguuucggacuagcagaacccagaugucuaggaauagggaguuuuguaguaggcgugggcucccccugauggaagaauucagcacaagcggaaaauagggccagaaaaccacuuucauauccuuugguucaaagagaagacccaguucuccuuuaauagucaguuuuccacuucagaaucuggaaagugagucuuugggguuuggaggagacaaaaagaagggaauuuggucuuccccaaaacacgggcuccuuuucuuucauccgcguggcuucccgcggcgcucugggaggcgccugcagcugggcggacucacaacgcuggugacagagucagguuuguaguuuccugacgugcaauuuacucaucauuaagaaaaguaauaaaggcacuugcuuuggcaaauuucgcuaagguccuuggucacaaugcuaggacucuguuccaggcuauuguaaaagaacccccccuccccccacuccucaucccaaacuuaacuuucucaacaucaggacaggcguugcacauggaaacugggaagaaggcgggcgccuagaggcagaggaaaagaguuuuuccacugggaaagagugggacaauggagggucggcggauaaagaaaaaagaaaacgaaacagauggaugcaauagccaggagccggaagaacucguuucgaaauuuuguucucacuuucgugucuguuaugcggaaaacgauaaugauagcgagcgcauccuugccuggugcuggccugggaagcagcuacagaaacagaggugguccggccccgccuacagcggagaggggcuagccuccccagccccuaaacucacccugguuuggaggaggggcccggcuaggcacucccuucagcgccgggggguucgcuauucgccacgugggcuggagcuucagcucagugcgcgagacgggugugacuuccugggcucccagacagcugcacagcugcucgggcgagucgcuuagccuaggucuccagcggcugcggccaacuggggcggggcugggcugaacccggguggggccucggcuggcgugucuccugagcuccaaaggcuagcugaagcuggagcggauccaacuucuauuaagauggcaccaaagacucaaguuaaaagccguuaaaauacuguuuucucuugcuuuuuuggggaagugauaugcaaguacaggguuuuugcuuuaaaaggaggaaaagugaugauuuauucuaagucaaaucuuggcaugaaaaugagacaaauuugcgauugcuccaugcauucguuuugaaauacauuuacauuccuaaagaccacauuuagccagagacaaaauuaauucugcuguaauugaguaucaaccaggaucauuagagugggcaggaaagggcaggggguaggugucuagcacaaguugaccaaauggcugauaaagagcuggguuggcagcugcagcguuuagggguugggugggggaggggagagcgcugcgguuggucucaugauuuagacuggacccugcuacuaaggucuucacuguaaauucuccagcuucuaauucggaaaagcuagguuuuaaugauccucucucccaccuuaaauucuguuuauaagugguccauuaucgugguuuuuguuuuuuguuuuuuuccuuucuucuucucucuaaaagcuauggccuaaauugugcuaaguacugguuggcaacugugucaaacuaagaaaacauucacauaaaagccuaaaaugaaauguucuggauuuaauaggaaaacauuaguggaaguaucagauaguugucugagguggagcggauuaccauuuguaagaggaacauagcaaggagggggucccaaagcaccugaguucuaguucugagucacaauguaauaaaggaauacuugacaaauugcaucugcauguccccacgaaugcuacaaaggguuccaauagauucccaagcaguugagcaauuacuuccuccagcaggaaguccacaguccuuaaucuucuugugggugguagaaaggaugggauucaagagcaucacuuagaauuuauguaagaguucaaaguuugcuuuuucuuggugguuugaaaauuuaagccucuuuauaauaagucuuauuuccuuccuuaaaaaaaaaaaagaaagagagagagaaaguuugaaaagaauuucuucagguuaauagguauuuaugcagucaggcuuacccccuuucguggcuucuacuaacugcagggaaaucccugugguauuccaugcugccucugucuauguaugaguaacguuuuguuugggaaggauauaaagagugaggaaggguauaaagcuaaauuugauuagugagggugaugcacccauuguucugucucucuuuacacugcuaagcuuaaacacucucagguuaaugauuggucaauaguggggcauucuggagccccugaaagcacuaagacuaacugaaugucuuccucacacauauacuuaagcucuuuuauguuuuuuuuuguagacuuuauucauggauagacauccacagauucuguauuucagaugggauguggaucagagaagggcagcacuucuagacacucauguugcuuuggggcaaaagaaugaaugcuuauacuagguggauuuuuaaaauuuccuccacccaccuagagaaaucaguuaggggacagacaaacacucauuguuagagguuucuugcucuggucuagaaaaaaugugcugccuguugcagacauuuggaaucagaacaagggagaguaaaggcacaugccuugaccaaguuccauuaguauuaguaaauauuguccauuuuuauaaucuagacuugguagauauaaaagucuauaagcacaucucggucacaaaguugaaucuacaugaaguucuuagaauuggaugugauggaauaguuuucuuucuguggucaguacauaagaucuuuguuaaagguguguauucuauaauccaaaacucuuuucacccaccuguuauauaugcuauauucagauguauauaaauauagaaugcuuaccagaaacuacuuacucucagugccagagagagccucggugauagggagugugcaauagugugcacugcuuuagcagagggcugggguuuggucccaugcugagcuacccacaaucaucuuaaacuccagcugcagagggaucugacaccucugaccuuuggagacaccugcagucacaugagcacauccucauuaaguuaugguuccaaccuggccugagauaaaguggacuaaccacuacauugguaaucagaaguuuugugugagauguucuagcugggaaagcaaguuaaaugggccucugcuaucaucacuuguuaaauggauuccuuuauaaaguuuaaaagacuaaauuaaauacccaugaaaaggcuuggagaaauggaaaacuagauacuaguguguuaugccuaaugcaaauuuaaaccuagaaaaaaaacugggcagaguuaaaaauuaauaguguugcagaaaaauaugcuuuugaauccugugaggaaaauuaguucaucuuugaucauaguuauagaagaaauagucacaagcagcuggagagguggcuccgugguucagggcgcuuauucuugcagaggacuuugguucaguuuccaaccaacaugcuggaucauaaccaucuguaacucaaguuucaggggaucagaugccuucuuuugaccuccuugaacaccagguguaugcacauggugccuguacaugcacacgcacgcacacacgugcaugcaaguaaacuacucauauauaaaacaaaauaaaucuuuuuuuaaaguuaccaaaauaucgacaauacacuuuaucauugcucucaucaaucagacaaggaagacaguuugugaaacaugcugguuggguuguagagaacugaaguuauaaaugauuaccagaacuuuaguaaguuuuccuucagaaauaauuuagcaaacuauuuuucaauuuagcaacaaaugauacaaaaguugugcauauucuuucaucuagauauucuacuguagacacuauagaagugaugguacaaauaccacucaagauaaaugcacaaggauuuuucugcagggguguuuuauugauagaguagucuauuguacaaggaacaaggagagucugggaucuuucuagacccuagaucuccuugaccuuucagccuuccuguuuccuucagccuguacaaugcugggauugcaggugugaccuacuacauauggauugaagcacaauuagcuugaaaccauccuaaagaugcaucccagggaacuugcugaguaaacacuucuacucuucccaugaaaauucuaugugcgggauugggaaugcaugguuuaggugacgagaacaaaagaccaaugugcagacagaauguaucuugugaccucauauaauacacauucauccuuauacacacagacagcuacugaauguccugggcauuggagaacaagaaguaagaaaauauuagauguucucucuugaggcaucuauguuggcuaaaagagaaucauaauuucugaauacauaagaaaauuggugaugugcgucccagugaaaacagagaaugaaggagauagaguaaggaaaugagagcucacagggagcagaguauuaagggacaucacuaaaagcuuaacugagcauugguucgggaauccagguguaggcugugauguauccaugugguacacuuacuccugugaagucuaaaccauaaggcuccucucagagauucuucuugaaauaaugaacuaauaaguaguauaguauaacauauaaugcauacuauaucuaauuuguaauggagguauuuaaaauaaccagugguucagaacaacuaauugucaggaugguaaacaaaaccacugugucuuuguccuuaaguuagcccucgcuccucuaggcuuccccgagaacgagggggaauacuaaauaucuguuuaauagaacccuggcagcccauccuugaugugacaugccccucuucucugcagacauuucacagggcuacaaguucuguugaucuugucuuuugucucccuggaaacuaaacagcugcagucagcugggccuugauuguuugcugacuuuuuccgauucuugacuuuccugaaguauauggcuaaauauagggacuucuggcucucuuaucgccucagucuuuccauguacagagauuuguuaucacuaacagaccacccuuacaagacagaccuucuacagcagaacagaaaugggggugggaagcaugcuagaaacauuugucauuuaguaggacccaaugcagagaagaagugguguagcuuaauuaaaaacauggguaaggaucucauaaaacugaaaaaaaaaaaaggaaaugucuauccacauauauucaugauggagcaacaaaaauacagcucugagacauccagugucugggacagcucccugacguauuuuauauuuaccaaagccauaaccaaucauccuucagcuugaauguagcauagaugcugagggucaggcaugagcagacguagagaagaugcuagcuggagcuccagugaccuccaucacaaaaagcuccaguugggagagccccgugugcuuaccguuggagacuggacaguuggaauacagauuuaucauugcaucuuccaguucaguuucuaaggaaguuggagaccugggacuuagucuuguauuuauguugcagcaggcacuuuuuuuucuuuuauaacauaccaaugcauucaaaacauauuuaaucucuauguuuuuaaugugcuugcuucauaccuucuuuuagguuuuaugguaggcucucugcaggugagaauacuuacuauagagaugaagacaaacuuuucucuuuaauugagaaaaaauaaagauaaacuauaaggauuaagcaugguaucuagagagguggguuuuugagaauuugcccuugauagaaaugagaauggagaagauauauauuccagagucauggucacaccauuuuacuuugguauuguaauauuugacuuucugaauaucgacauauguccaauauuauuauuagccaauauugauauuuaaauaggcuguuacauauguacuccaaaucucaguuagcccuacagacauauuaacauucauaaugauuuaccgaucuuucaaaguggaaauauugaucaugcauuugguuuacuaaccgucucaagggcauugaaucuagcaccauaaaauauuguggcauuagugagugacucugucuucuagaccccuacuauuuuuauaguggauauaaagcauauuuuacuacauuuauuuauuguuuaugggugaagucaaaggacaacuugaggaagucaguucucuccuaccaaguaguucuuaggaaccaaacucaagucaucaggcuugaagcaagggccuuuccccacugagccaugucucuggccaguaaaacacauuguaaaguaaucauuaaaagcaaaaagaaguuauggcaguuuauuacaaacuaaaauuauauacugcuauuauaaagguaacccaaagaaugacauagggcuucaaauucuuuuauuguuagugaucugagcucuagccauauaggaaggcugaguuacuaauuuuaauuauaaccaguaauuagugacuaguuuagauaugcauggacauauuucaugugcauuauccccaggucugucaaucauuucuacauuuauuuucauccuuaaauaacuagagaaacaaauuuuagagaggcauauucauuuacuuauaaucugaggguuuaaguagaaaguguagaauuugaauuuaaaccuguuuaacaguguaauccagacauuaaaaagaauacauuauaacguuauaaagguuuccuggggaacaaaugaagaaaaaugaaaaagaaaaaaaaacacuuuuucuuuaaauaaacaaagaauucauuauuuaaaaguaugauuaauagaaguuuuccuaucuaguuugaauuaauauucaaggauuaaucauauuuaaugauuuuaugacucaauauucuucuugccuaugaaauuaaugucuuauuaauuucauuaacuaauugccauuaagaaagauguauagucacagaccuacaagccauaaccuauuguuguauugcuuuauaagaaauccagaaaugcuaugagguucccaguuaaugguuaaugcagucuaguggcaugcuauugugauugcgugaugaguccauuuagaugccaagguuaauuaagaauccucaguacaucuuccucucugaauuaucaguugacccaaggauggcaaaggugagauauguggcauauuaagcuuaaaaugucauuuuaggaaauaccucaaauuacaguauucuauaguuugcuugaguaugguuguagcauuuuuuuuuugagauuuauaaaguaacaccagaauauuauuaaagaaaaaugaguagcugucauaggauguuaauuuuuauuugagcacaaacuggacuuguguucuuucaacauuuacuuauuccaguccagguuuccuagguaauacagaauuuguuuucuaaggaaggcacagggagcucuuuagaguaccagcuuacguaugagccagugaaggcaucuuuggauguaacaaaacauucuugaauuuauucaaaccauaauaugccugugaauuugcuuccaagacuauaauaaaaaaaaccuagacaaucaacuuauauuuagugcgauuucuuuggcuguaccguuuuggagguuaaaguacuugacugauuggcuuaguuuaagggccuguggccagguagcaugucaugccugggaacaugugguggaaugugcugcucaugggaagccaguggaaaggcaaacagagagaggaagagauccgcaucccacauucccuuugagaacacaucauugacgacucaagaauucccacuaggcaccaucucuguaaauuuauccaacuacagggaagccaaguugaggcccaaaccuucaaagcaugggucauugagagacaucuaaauccaaucaguaacaaccccaccccacccccaagccuggugcuuauucuuacuaggaugguuucuacaaaucuagacuuggaagguuccauuuugugacucagaugguuaaacaccuuucccaaagcacauaguaaauuaguagccaauccaaggucaguguuucuugacuuucaguguaucuucguucacuguuuacucuugagacuuaaacgcuguugagagcuuuaaaacugguuacuuuguaauuaccagcucuuuaggauacauugguuuuguuuguucagccagagagacaguuagagguguuugugcgccugcaucaauagccuuccaaaggcccaauucuugcugcugcugaccucugccagagccacagacaauucccucucaccucaaaccgauugugaagcuugagcuaucagaaucgcuuuugcaucaucuucaucguucccuuauucaguuguauucagauuccuauugcuuaauucgauuuugagggugcuagcaacucaccuuauuuacacaggcuaacuaaggucccuaguguucuuccuauggccugccuagauguggccaccauguguauuaugucuccgugcugaggcuuggaauuauuuuggcaacuagugucucucaagcugugauucaaaguaaugauuagaaaguuugugauaucuucuauuacaagccuccuguguuuacaaccagcagaugacugccuuuuuuauuguacucgguuccuuauuaacgugugauguauggcccgucacaaccauaaaugcuugugguauacuuuguuuuccuucauuucuaggacaagauguugauaaauaugaaaggcaucuuauggaugugcucaaccuuauuacuaacccaugcacuacaucaaggugaguaaaguaacucucuuuuaaaguugauauguaaaagaagacuggggaaugggauuauaauaugggaucauugcauugaagaaucauuuuuaauaaucuauucauuacuaaagauuauuacuuaaaauauuauuacuaaauggaauguauuucaauaaaucaaucagacaaaaaauaacuaacuuguguuaaaugacucuuuuaguaacgucauagauuacuuauuauuauuauuuauuuugagauuggguuucacuauguacucuagguaggcucaacucaugaguguccugccccagucuuacaaauucugugauaacuaauacgagcuaacauaucuggcccucaaguugaacugugcaacaagauucucuuagagcauuuagaauacuuaaaauucuaauuacuucagcacuacuuuuucaaguaaaauuaaaucaggagaagucuagaauuuuaggguaggaaaauuaaaaacuguugucagcaaguauuccuaaccaucuccgucuuugugcauggaaagauagcugguaaguacauacacauguacugucucucuuagugguaccuuuuacaccuauuuagugaggaggcuauaaguguuacuguaguuuuuaguguauucaaggaaacacaauaaagaacuugaagagucuaugucaaucuucacugaucugcuccugcuucaugucgucugcaugcguaguuuccacgucuccugcacacacaugcugcagacuuccugaaacaauuugugcuuucacagaauuuauuuuucuuuccucuuuccccauaugugcuucuuuugcuuggcacuuccucagugauucuccuuaguuauaccuuaauuaauucuucauaucugaagguuuaagcaucuccaucuauucaccuauccacccauccauccauuugucuaaucuuccauucuuuaacaauauucuugaaagcguucucugugccaaguauuauucuaggagucuggggauuuaucaguggauaacugauauauuguuuuuguuuuccuuaaacuuaaaauuuauaugaacaggaaauaaacaaacaaauaaucaugacgaugaaaauacagcggaaugacgucccagagaauaacuucuguugaccgaagcaggucuggucucugugagaaaguaacaugcaagcugaaauaagaacacagaguuucugaccuccuaagauuugaucuuaaguuacaaagauaaacuggugugagcaacaggaaaaucaccgacaggagugaucaaaagaaaaguaguagauauagacagagagauaagcagugaucaguuuauauaaauaguagcagcacuagucacguagacaggauucacugggagcuggaagcuauuuuaagugcuuaacauugguuaaccaaaacauccauuacccaugugcuauaaggaggucacugaggggcugagaagaacaauugcuuuccacauccaguaagcgucacacaaaggggaugaaaaggacaagccaugcagaaucaccauccccaucuucaccauccccaucuucuuacacugcuugucuaccugggacaguacagaccaaauuuuauucugugugcaauaucgagaaauugauuuggaugauuuuuguggcagccuuggcguggaacuuguaacuuacuucagguaguggccugaggaugggaagucuagacuccaugaucuguuauaccuucaaaguugucuuauuagaaguuuccaagaaguucauaaagagaacacagaggaaagauuaacagugcccagugaaggcaagagguguagagaagggcccggaaaagcuuugguggcuaauaaugaaagaggaaacacagugaacaccacagcaagacaucuguccuuugagauacucacauagugaaagaaaacagugugugguguauuucugucuuagaguuuaaacaaaacaaaacaaaacaaaaaaccacuagcagcuaacaaugucaugcaauuacuauauuugaggcuccauucuuuauaaaauacacaaucaacuuuuagcuaacuugggugauauuuaguucuuuccuaugagaggcagaagcagaacauauaaacguuucagaucuccauaaaacaaauuuccccuguucacguugggaugggcagcagcaucugagaugaugccuggcuuucucucaucuguucuuggaggccauaggauucuaaaguucaguggcucacuuuaagcaacaccaugucauaccgauuuguugccuuuagcacacaaagaaaccuuuacuuuaacaauuucuuuaauuuaacaauuagccaggugugguggcacacaccuuuaaucccagcagaggcagguggauuucugaguucaaggccagccuggucuacagagugaguuccaggacagccagggcuauacagagaaacauugucucaaaaacaaaacaaaacaaaacaaaacaaaacaaaaacaaaaacaaaaacaaaaaaccaaaaaacaaaaacaaaaaaaaacccaaacaaaaaacaaaacccaacaauuucuauuguauuagaaaccaucuugauaacucaucuacuuauuuuaacauugcuauaauaauaugaacuagaguacaugaguuuaggaauuaaauagcaaaauaaaucccgacauucccaaucugauagucuccuggugcccucuuucugucucugcacagauggaauuuacaucacucuuacugugcagagucuaugcagagugaguaguaaugggccauucauuacauggggcuuucucccuuacuguacucauuuagaccacaacucaucugugagaacagugaacauuuuuuugucaggauauauucuuauuagacucagacaaguuucuguagguaacagauuuuuuuuuaaauugugcauacuuuaucuacauuauacuucaaaugacuaaaauauucuuaaaauauucagaugcaguuaacuuaguucuugugucccaaugaauuaagaccgaagucuuaaugcccaaaagcuuugacucuaugucuuuguguuaaucucauuuugaagaguggauugcauuguaagcuuauauucauguuagagcaaagguuuuuaagauuuguguguuuaugaauagccagaacaauacaaagcccuugugaaauugccuuuuguccccguaugcccuucaggagagcaagagugcuuaagccauguuccguguuccaguuacuuuuuuacuucauagauuugccuaaauccuaugucuucccauaugcauucauaacugugaaaacaauuagaauuuagcaauagccauuaaggaagaauagaucauguauccuacacuauuauaaaauuguuuccuacuaaaagaaauccucaauauuugugguauuguuacuauauuuuauuuuuguuaagugguucuuauaggagggaaagugugaauuccuggaacuuucaaauaggguaaauuagauuuuuacacacaaaauuuauaagucuuagaauucgugccccccccccccauagauagaucaauaaauuaaacaaagcagaaauguugauuguucuuagcugagucugaguuaaagggaugugaaucaggaggggucauuuuuaacauguucccugcaggcuuuuuggauacaugaaagaaaucaugaagguauugaaaggucugaguucuggcagugacuaaagacggugucuaaaagcaggaaaaauuuaagaugaagaccgccuaugugaaugaauuuagggucaggagagcgaguuaauaaaugccaaugcuaaaaaugguuagguuagauauaaugagaugcaugcucuggcucaggucuguccccacccaggagggggcuugccccuuccucucagaagacaucucaccaacaaaucagguucauuucaaagggcgaacuuuuaagcuauaggcuuuauuuucuaagcacugaaaaugauauuauugccuuguuauuacauugcuuaaaaaaaucuaaguaguauuuuagcucauuucauuuuuaauuguguuaaguaucccaugaauaaccucuauauguagaucaauggaauaaacauaauggauucuuguuuuggaauaaaugaggguuucuaucacaaauacacuagucauaauauuguuuugaucacauucuugggaggaggagacagagccucccuaugcagacccagcuagccuggaauuuuugauguagaacaggcugaucuucagcuaauggagguccccuacccagaugccucuaguccuaggauugcaaacaugggacauuguucccacuuuugguccaccaucugucauuggcaguggaauuucuauucuuuucuuucuuuuuuuuuuuuaauuaaagggaauaauaucuucuuguaauuuugaaaacaacccaacugacugauaaugguucaaugagcuacauuguuguggacccauguuuacauggagacuuauaugucuuaagccacuagcacaguguuagaaaaacaucaguaguuaaaaguuacagagucacucgauauggauguaacucuuaacuuuuggccaccauuucauaaagugugcauugcuugugcaagaacaagaaugucuagcaucucauaccccugguuuagccuaaccaguggaggcuggaaagugguaggaggccuggggugagggggauggguuccaggaagggugaaaggauauuuucuuuugcauucagugguguuaaauuguaaccaguguacacuuugucauuaaauguuuaagagcuuaaacagaaaugaguacguugggaggguuagguguacagaagcaggcuuuccggccaggggauaaugaaaggcaguguuucucugcaaagugauugcagcuggaguugucauuauaaugaagccuuugcuugaaacaagggcccaaagagggcucuucaaacaguagacaugcccccacuccaguuucaugaaagacuguuugaaauucuucuuucaauuuuauuuuuauuuucucuaagguaaugugguaguuaccuuuaaugauuuucaucucugaccuguugauguaacaaguucgggcuggccuugggaauuugccugccuuacuugcuggaccagaagagggcucuuagaauaugagcccugcucuuuucucuaguccucuccaguaaucuuuaaaauucgaacuucuccuucauaugcuaauuuuugaguauauuuuucuaaaguaauguuuauggcaauuacccgaaaugaauuuuuccucuugucaguaaauauaacuuuuuaccucucaacugcuuuuccuagagagaaagaaggagaaaggagagaaggacagaaggagguagggacagggguagggacaguuuucauccauuaauucuagacuggaacuuagagcaacccucuugagugauucuccaaaguucuaggauuaucggcacgaacacccaccaacucagcuuggucuaaucuuucaaacuaugguucagacucuagccugcucaguucuuucugccuuuauuuauuuauuuauuuauuuauuuauuuauuuaugcuuuucccugccuuauuuucucuuucuuuuauguuaaauacuaaaagugacaaaugcuuucaagugagcugugcaauucaggguacaggaugaacaucauguauccuugucucuguuaugaagcguucuuucauacacucagcauguaaugacagcucugaaacacuuuccaauccauucucacauucagcagacucagaccggcauuuugggaauauuaaucugauauucugucuuuccuccagccaaaauggaaaccagcccaccuguuaaaggcucucugucuggaaaagugguccuaccuugucauuuuucaaccuuaccuaccuuaccacccaauuacaacacgagugaauuucucagaaucaaauggucuaagauggaaguggacaaaaauggaaaagauauaaaggagacgacugucuugguggcccagaacggaaauaucaagauuggucaggacuacaaggggcgaguguccgugccuacacaucccgaugauguaggugaugcuucccucaccauggucaaacuccgggcuagugaugcaggcgucuaccgaugugaugucauguaugggauugaagacacucaggacaccaugucacuggcuguggaugguaaggcauucagaucuguaagaaaggcagcaugguaccagagaagugcggaccaguacuggaggauaucccuugaucuugauaugugaacauguggaaaacacgagaggcuuuguuuuucacugaaaacaaauuuagucuuucaggacagguaacuuuuugugaaucagcuucuuugauugauggagugcaauaaaacacaauaugcuggaaauaaugaaaaccucaagacaugguacaugguuuuuaaaaucauuacuuuagugcuuagaccagccagugauugcauuugaauacuauuaacgcuauucuacauuuuaauuuugauguuguguagauggugucuuaguuaccuucccauugucauaacaaaacauaaugaccaagguaaguuagcaaacaaaacauuuaacuuggggcucacaguuacaaaggguuagagucuuugaccaccaucaugguaaggagcauauggcuacaaaccaucagacauggugcccgaggaagagcacuaacuagguuuggugagugggugugaggauccaaccagccagaaaaagccaguacugaacuaaccauuaguauaaguaguaguuacuuugcguugucgaaguaaaggcugagcuagagcuggcuggagagcuaacugggaagagugcguucuuuuaaaaaucuaaacccaccccugaugacacaccaccuccaagagggucauguuuccuaaguccuucucgaacauuuccaucaacugagcaccaaguacucaaaaaugugaaccucuaggguacauucucauucaaaauaugacauauaugugcacauacauauauagauuuagaacuuuccccugugucuuaauucucauuaugugaucuuuggggguucugaaggucaaacccaagauugugcgcaugcuaggcaaauaaaugcccuaucacugaacuauagccucagcuucuuuacugugauuaucaaugagcacugguaaauuggcucagcauaacgauacauguugccaagccuuacaacucaguacgauuccuggaacccacacgguacccaccagcauuuaccugugccucucugcaggcacacagacacacaaaauaaauguaaaaaacaaaguuaaaaagaaaaauacccaaacaacaacagaaaaauccauuugaguuaaauuuuuaaaaacaccaucuaaaagcuacauuguaaaacuaaccaugauuuauaucacaaugucuuacaaagucaaucaauauuugaguuuucaguuggcccagagcaagaaaucauaguaaagcaaaauguaacguuaacacuaguggcuguccguuaaguuuuguaacgacacauuuuaccuuuaccguccuuuuaauggugguuuuugugucacuugagcuuaaguuggaagacaaagcaaagagaaauugcuuuaauugggcacagacauaaugccgaagcucuugaagguggaauguguuggcaaguuauuaagggaaagccuaauacccagacaugauggaacagauuuuccuccgacucucaguuucccuauaaaauauuuaccuuucagaaauacauaaaaagagguuuuauuaaaacacuuucuuguuuagccaaaaggaaaugguuuaaauuuuaggugcaacaaacaauuuuugauaaaacauccccuaucauuaaauucaucuguuuccuguuguccauguaaccacuaaaucccugagcuacaaucaccauugguuuuaguuauccuaagauuguaccuucauaaauacaugaauaugcauagauguauaucacccacauuuacucucuaaaguucuccaagaguuuaacggcuucuuacauuauuauuauuauuauuauuaaaauucaucuuuaaagacguagcaauggauuugccucuugcugcuuggaauagugacuauccuucacuaaucuccuuggccccaggaugugcuuagguuaugucaacgacugaaaacacucacauauggauugauggcccagccuuaggcagggaggcccucugcucugucccuucucaguaccaauacugaguuauaauucccuugauuaguugaaacuuuagccacuacaagccauuuuaaacccauucaggcuuuuacuuagagcuuaaaaguuauuuagugcacacuagacauauauacucccagacaguuuuagggaggucacaugaagguagagauuggcauuugguaacauuucgagacacgaaagaucagaaagagggaaaggaaggcucccugccugucaguccuuggaugggucacugugcagcucccuuucugugggcacugauaacggaucucaucggcagcauggcuguucuaacucccucaccgcucucuuggugucauacacuugucuugagagagacaccauaugacgaauagcaugagugagagugauagcuagucuuacugcagaagacagaucugucagucccaggaaaugacucaaucagaaggagaguuacacaacaaaaaguggucuugaguacuugaguacucgauagaguuuuaguuaucaaauccccuugccccaaucuguauucugaggugacuuuucuggcauaucaguuggguugcuuuucaugaauuaugauauuuacuccaguuaaaaauggaaauagugugcucaaguccccagacaggaucagcaguuccaccccuuaguugaucuuucuucaggucuuugaaaucucuugagaccuaaagcguaguuuauaacuacuauuuuacaauaccuagaauacagccaaguaacacuugaggcaaauaugccuugcuucucccuggaaaaguguggaggauguuauuucaggucucuuuugagaugaaaaguuguauauuugugucagucauagcagacauacaaaguuagacuagucagacacuggauguggugcauauuuggauagugcauaacaaucuacuuagcauacagaucaaucaaauagauaucagaucuagguaagaaaagauuaaggcucagagagucugacuaguuugugaguagggagcaaaaugaagaugcaguaggcauucucacacagagagccuggugguuuucucuaccuaucacgcuuucugggaaaguaaaugccauauguuuccuguuuccagaacacagccugagcaacagggcaccuagauagauggcauuuugaggucccaucucucaacaagaguuucacauaauaagaaaaaguaacuaugauaauuguguuaauugguauaguauuucauucugaaauuuugcacaguguagcggggggauucgagcauugaaacagucugugguuugcugucuuugcagguguuguguuucacuacagggcagccaccagcagguacacucugaacuuugccgcugcucaacaggcuuguuuggauaucggggcggucauagcaagcccagagcagcuguuugccgccuaugaggauggauuugagcagugugaugcaggauggcugucugaucaaacugucaggugaggccugcagccaaaagcuuuuaagucuuaaucugccagugagggugccacuuaccagucuucugcuuccccagauaucccauacgggcuccccgagagggcuguuacggagacaugauggggaaggaagggguucggaccuauggauuccgcucuccccaggaaaccuaugauguguauuguuauguggaucaucuggaugguaagacuuuggaccuuuuauagcgaugguucucagccuuccucauacuuugacucuuuaagauagucccucguguuguggugaaucccauccauaaaauuauuaauuaaaguugcuuccucauaacuguacuuuuguuacugguaagaauuguaauguaaauaucuguguuuuaugaucaucuuaggugaccacugugcaaggaucuguuagacucccaugggggaucgugagccguguguugagaaccacuguucuauagcuucauuugaauuuuaaaaacggaaagaaagcuauaagccagcucauagaacaggucccugggauuauuauuuacacuccacacagcagcauuuucuuuccaugacugcaugaucuugugguaaaauaagccaaaauuacaguggaaggagaaggaggggcauguaagugguuaugcaggauagaaauaucucagucaauggcagguucuucacaguuguacugcccuuuuagaacauucagaauagaaaacugcaaggguggcaccuauucuagugagagccagguagaaacccugugguggcaaacauuaugaauccaagugcagauaaacaccccuucccccaaccaagaaaaagcaggaugaacuggcaaaugaggugguaucuaaggccuccuuuguugcaaggauuuuuuuuucagaacagucauucauccagccaaucuacacaaucaaaaugacaaaaacaccuacugaugucguuagucugcucuucagagacuuuaaagccaguuuauuuaugcuuuuuuauuauuuuguuuauuaauguaugagagcucuguuggauguacaccugcaugccagaagagggcaucagaucccaugauagaggagugugagucaccgugugguugcuggggauugaacuggaagagcagccgguguucuaaaucacugagccagcucaccaaccccaaaucaguuuacauaaagucuuuucucucuaagauguuauggccuaacuaauuuuuguugugcuaucucucugccagaauaaagaguauuugaguucaaacugagaguaucuaaaagguuacagguaacuuuacuauuaaagggagaaguguagauacuuauuacucuagaggcaguggggccugggagaauggagccucucacugagauggauuaaagucuaaugcaauagccaacuuaauucagagcaucagacaacuuauacucugaggguuaagaagagucacaugaauaaaguauacaaccacaauggcaagcuacaugugacagaccaagccucaugcagaaacaaaacaaaacaacaaaaaacuccauguuuuuuucugcagaggcacaugaacgaauaagaguagucaguuguaaugaaaaaucugaagguaacugacuccucucugcuauaccugggaggagcacaaaaacacauuccaagaacaauuucauguuuuugaagaaacugaggucccaagacuauugucuuguuuucuuggugguuuuuuuuuuuuuuuuuuuuacaagcacuuggaauucucaaaggacuucuucuuggucaguuuuccaaacagaauggguguuucuaugacuuuugaaauggguuuucauuuauuaugacaaguaucuuauaagcccacauaaauagauguauacauuauuaaauugacucauucauguaauuuugacuugguaugcauuguuuuauauguaaaauaaggauagacgaucuugucccuuccagcauuaaaauuuuaugguuguuuguuggguaguuuuauuuguauccucaagcuguaaauaguuauuucuguuaggaaauuuagaacaauuagagaauuuacuuuugaaggaugguauggaaaucaaaggagaagaugugugcagcauuuacuacauuguauggcacacagugauugguaaaucacagcuuuugcguagcuuaugggaaugagagugagggucuuuauucacacugcagucugaggagacaaacauuuugaaccaucccucuguguauuagguucuaugggaggugauguuuuccagcaagggagauuguuaaguguugaaaaaguuuggaaacuaaaacguuucaucccuagagaguucuuagacuugagcugagcggguaagagugcagugcucaagucagcuugagucauggcccuuugagggacaggaguugcuacuagaaccagggcaacaugaagaccggaucauuuugaaugugauuaacugcaugcugggacauuauugaaugauuaaaagauacugcuguugcaaauacauagguuuacauuaucucuccuaauuuguuuggggaaauggugcuagccacugucaguccaaaucacagacagcacucagaaacauucuggccucuacugcuccagagucauggacacacagacacacagccacacagccacaguccuaccauuuggagguuuaagucucugucaaggugcucuguaauguauuucucugcuaggacuggcagugcauuagaagguuugugugcuuggcugcuguuauggcaauaauaauaauaauaauaauaauaauaauaauaauaauucccagaugagauuggugggagcaagcugugacgagcauaauguaaauauuucagcuaaaaauaccccaaacuuaaaaaacaaucaauccauucuaaauagaacuagauuauuuuuuagauaugguagcaaguagccaucagaaaauaguugucuuuuuaaagacauuuuauuuucuguguagaugaauaggaguaugacugaugaggucagauaagcuucuuuugugguugauuugucugauuggcuuagaguuucuuccccucuaacuguggagaccuguguccuauuugcucuuggccucuguuuucuauguagccccgccuuuacaugagccaggucacguucuggcucuuagggaccuuguucucugagauggugcucugcuccuccagagaaccccacgcccagcccaucuuuccaacauucucuguugcuaguauucaacaaaccuauuuccagaauuucuugguuggcuuuucuggcucacacuggaauuucuugacagaaaguuuuucuuuauuuagaguuagugucauauaguuuguauuuacuuuuuugauuucuuuucuucaaauaccauguccagucuuauuucugagaaaaugcuuuaagcucucaguugaggaaaggccauaaguuucuguuuuuauuauuuuuauuuugacaaacaucaaaggauuguuguaggcaugaacacauauaauaaaaaccaagaacugcaugaaagaaauuauauagauuuucuuuaaacuuuaucuuuuuuuucuaucucuuuaaauuuuugaccauugauuuauauauuacuugaaaguuuuuucccuagucuuugaggugucauucaaacuccuaauaggaucauuugaacuuggcacacgccuuugaucccagcacacggaggcagaggcagguggauuucugaguucuaggccagccuggucuacaaagugaguuccaggacagccagggcuauacagagaaacccugucucgaaacaaacaaacaaacaaauaaccaaaaaacuaacaaaaaaaccaacaacaaaaaagaaguuuuaaauguuaacuaaucuauuucaucaaccaaaucuaguuuaucuauugcuuuucuuuugcuguuaacacuaagaaaauauugccagagagccagucauaaaaucuuuccauucagggaauuucauaacuccccccuacucccuaguuuuuugagacacaguuucuuuguguaacaggccugacuaucuugaagcucacauagauacaccugcuuaugcccauuccaaaugcugagaauaaaggugugcuccauuauggccagaacuauuucaugacuuuuguuucucuugccuuuacucugauuaauacauacaugcacacacgugcacgcgcgugcacacacacacacacacacacacacacacacacaucucauauagguucacaaucaucauucuguuaccccagcagcauuucucacauggccuauucuuuuuccccccacuuaauggguuuuccacccucuugaaaguaagucacucagacauauauuuaguuuugcacucuaaauucuaucacauugauugcacugguauauugucuuuuuuuuuuuuucuguugugaguuuugagacagauuuucauauaccaaaggguggucacaaaaguucuauauagccaaggcuggcccggaacucccuaucuucuuaucucuaccuccaagcugagguuauuauagauguauuccuaaauaauugccuuacaauacaauauugccauuuuugcuauagcauuguaguaaaguuugaaauuggaacaugugaguccuucuaagagcuauuacgagucucuugaguuccuaaauuaauuuuagaaucagcuuuccaguuucuauaagggaguuacgauacaguagagauuuuuacuaaaucuccagaucaagugggguauauugccauuauaacaauuguaagucuaaugguccaugaacauacaggauguuuuucaggauuuuuuuuuuaauauuuuauuucauacaagaauucuuuuaguuuucagagcauagaauuuacagcucuuuucuuuagcuuauucuuaauauuguauuuuugaugugaauguagauuuuuaaaaauuuuuucuuuuucuaauuaucugcuuaaaaugugcagaaaucaauugauuugacgauuucacaauuuuacaauauaaucauugauacaauuucauucauauauauauauauauauauauauguaaaaaucaacugcagcuuaguacaagugaaaaauuuagaaagcacauauguaucuuucuagugguucuacucccaaaagagaaacacuggcagccuaaugcuggcccuggucugagcacuaggaaugcugcucugacaguacagaaccuuccugucauuguuuacaaagacugacuuuuuuauagguuguaagacccagucuuagggaacugacacauggugguagcauuuauaaauaguggcccuuuaaggaguuagaaaucaguguaugugagagguuauauuagacaugauuagaaauugauauaugacucagaggauaaugaauacuaauuuuuaacuuggaauuguacauuuguguguauacauguauuuuagucaaaaugugacagagaaagaguaaaaggggaaauccuuugaaaauuuuauguuaguucuuugaagcuaaugauuauguuuaauugcuguuaacacuuuuugaucugguauauuuggcaacugguuuugacucaugugguacuuaaauacucaucucugguuacuuucaaauuauucauuuuaguuauugauaaccugcucacauguaauuucaccuaaauaacaagaauauauagguauauacacauauuuguauauaugguauacauguacacauuacauuacaugcauguauaugauauauauauauauauauauauauauauauauauauauauauauauauauauauauauauauauauaucaugaugaaacuaaaaacaagaguguggauuuugcuaguuuucugaacugauauucacagcccguaguucaggacaaugagcacaugugaacaaaggaaacaauaucugaugccacccacccugcaaauucccuguuucaggaaagccagaaugccucagcuuugaccacugagagccguaaucagcuugagugucccaggcuugcucugaacuuuggcuuuuucacaguucugcugugggucuccugggaggaagcuuuaguguuuggacaccauggaucaucuuucaugcuuuaauguguuuccccaugugucacuucucaggcugccaagaaguaucuuuuucaucagacacucagaagcauggagaaagcaggcguggucuacuuucaagggaggcuugcaguagcuacuggucaaacuaaagcaauucuccuuaauauuuaugaugauguuaaggccuaucacuaagaaaguucuaguuuguaaugaguaagaaucuuugccucacucuggcuggcagaucacucuuguucaucagaagaaauaguaguuuugcuucagaacagaguguuagcagcuaagaaugcccagagcaaugucaccuagaauaccaaacacguacauucuaccuuugagggagagauacaggcauguccuccucucuccacaugcauccauuucaggccugagccaggugugaugcugaggucagugaggcuguucaagaugacaucuccuucuagucuuuuccauguugcauugugccacgucuauagauacaugcagugacuguuccuggugccaacagaguaauuuuacuuaguguguugcuugaggacaugaaaaaaaaaccagaaacaaaaacaaaaugcuuuuuuaagacaagaacuagagaugccaucuauugaacaugugucacugaaugcacacuguguaacuggcagugaccuuggugcuuauaaaccuuauaggguagcuguucacauuguaagaacagggagagggaaggugguuuuuuguuguuguuguuguuuauuuguuugugugcauuuggggauuuugagauuauagucuagucauuacucccuuccuguccugcccuccaacaguucuucauuccauuucucguccccuauauccaagaggaugaccccacacaccccacauuccuuucuauucccuguggccucaaaucucucaaggguuaggugcgucuucacucauugaggccaguguauguguuggggccuugaaucagcuaguauaugcugccugguugauggcucagaaaucucacagguacugguuuguugagacugcuggucuuccuauagggucaccucccuccucagcuucuuccagacuuucccuaauucaaccacaagggucccugacuuuucuccauugguuggauguaaguaucagcaucugacucucucagcugcuuguugggccucuugagagcaggcaugcuaggcuccugucuauaagcacaccauagcaucaguaauagugucaggccuuggagccuccccuggggauggauugcaauuuaggccaaucacuggaucuccuuuuccucacucucgucuccacauuugucccugcaguucuuuuagucaggaacaauucugggucagagguuuuuauuuuauuuauuuauuuauuuauuuauuuauuuacuuacugugggaugguaaccccauccuuccacuugaugcccuaucuuucuacuggagauggauucuacaaguucccucuccccaguguagggcauuucaucuaaggucccucccuuuggguccugaggucucugguauguucuagaggguccauucauucugcuggccuucagggcuucacucccaauaccugaucauguuucccuuuccccccugccccucuccuuuauccucucucaccuaguucccuuccuccgucugccccucuuaacccuugguagaaguaauuuucauucuuuuuugucuagcaguucuuaauggggauuugguuugcuuuccccaguacagauuuugaauuuaaguaaggaaagcugauauguguauuuuggccauuuuuccuaugaauaauuuucuuuuuucucauaaaacuaucauauacuuagacuaaugguaccaucuguuuuaagcaguuggcuugaucuaccuggcuugggucuacaguagaucaacacugugagaauucugugucucuguugucugauauaucacagcauuagagaucaccucugaagcauggaacaggagcccuguuucuguaauacuggccugauaccuuuuuagcuucuucuccauuucaucuguacuccuuccucuuccaguuauauguguguaggugaucuguaaucucuccucugauuuuagccauucaugcucaaucuuaaaagcaucauuuaauuugaaugaaauuuauucugucaaauuguuauucuuguugcccaaauacaacgccagcuuaacaaacuuaauucuccagaauuuugauguuuuacguuaacuaaaaugaauacgcgucucuacuaacuggaucuaguaaugagcauaguaagcauucagaauuugcuuguuaauuaauuagcaggccuagcagucuaucgaucuuggcuagaacuccugcuaacauuccuggugaccuuaugagacacauaaggucuuagaacacaugucuuccuuucuggauagagcaaguaggagaaacugagcaaggagguagucucccuuuagaggccugggaacuuaagcucuucagcgagaguugacaucaacucuccaacacucagccuugugcugccuuguaacuguggccacaacccugucauggcaguccugugccagggacacaagguagacuaagaauccuuucauuucuacugcuucuauccuuucccacauuaaauuccuagggauguuucuuaucuaguuguuugaucaacaagauuaaucuguacggguuguaguaauaugugggaaaagaauagucagagaacuacuguuugguuuuagaauuuucucacagcauguugaauaaucacuuggaaagauuuguuuguuuuaaaaugauuucucaaacuuuauuagcaaaugaaugcuccaucaacuuuuugggauauauauauauguguuuguguguguguguguguguguguauguauauauauauauacacacacauauauguauaugcauauguauauauauacacauauguauaucuguguguguaaacaugcacacauauucauacgcauacauacacaaacacuuauaaauaauuaaacuauuaugguauauaguuuuauuauaugguaauaauaguuuucucaaaauaaauaugugacuguuugcucuaccgcauaagcagcugccuccucacuguaagaaguaucacgucuucccucagcauuuaucaaaucugggagagaaugaggugucgaccuaagcccuuuuccuccuccucuugcaggcgauguguuccacaucacugcucccaguaaguucaccuucgaggaggccgaagcagaguguacaagcagggaugcgaggcuggcgacuguuggagaacuucaggcagcuuggagaaauggcuuugaccaaugcgauuacggcuggcugucggaugccagcgugcggcacccugugacuguggccagggcccaguguggaggaggucuacuuggggugagaacccuguaucguuuugagaaccagacaugcuucccucucccugauagcagauuugaugccuacugcuuuaaacguaaguguuugauaucucuuuuaaaaauacagauuaaaaagcugcagcaaauauauacccacugagguuccaguggaugucgggauggauucuguauucuguacuaagugcauggaggaccuacagugcagugacacaaacagacuuaauaccaccauuaugguuaacacaguagggaguuuggcaagugggauuuuuuuugggagguggggagauaacaacgucagaguggggucuuaacugcaccccagaauuccaaaaaucacagaacacacccugaauugaaauuucuuauuaauugaagccuuucaaugcaauuucacucuuaauauaacaauguuaagacaacagcagcugaguuaaaccuuugaauccuguuuuauuuuuugauaugauucuuauuauaaaaaggagacaauuuaagcuuaagucauugcaggugaguauuugugcugaaauuaauaaugauuguguucaauuccuaccuaaaaaugcaucauacuaucaaauaauacgauucacauaucucauuuuguuucaaguaauagaauaggcgccuuuuggcgauuaaucuugcuuugaauuaauuaaaguacaauacagccuccuugcaugaauuggcuaugcucaguuagauuugccuuguaaaauuaauuuuagguagcauucauuacauauauauauauguauauauauauauuagacauucuuaaauuauuuuaaaauauuagucacauacaguuuuauaguuguagagugcuuaacuaaacuaauaacuagucaauauuuuauuguaauauguacuuuaggaucgguaagauguuagcuaacaaaugccuccauacuuuagcaacagaggccaagucugacaucgaguaucagaacaaugaaaagccaauguaacacaugaagucuuuuaaaccagcuuucuaauuccuuuuguuagaucaauggguaauuaaaauagcuugaaaauguacuaguuuguuauuuauuaguuucuaaagugagcuaugcaggaauuuuuuucagcaggaaaaaagacagauauguagguaaacaguguguuggaaaagauauuggauccaugagcuaauagaagcauggaaaaguaucauaucacagacuuccgucucccugcuaggcugccucugccuaaaucuccacuuuacacuugauuuucugaggguuauagccauauguuguguauuaacuuaauucaagcuggccuguucauaaaaaguccuagagaaagguuucuucucaggccuugaaacaacaaagucuuccauagguuuuguuuuuuguuuuuuuuuuuuucagaaagacaauaauaauaaugaaaaaucuuauccuaaauauagucauauauacauguauacacauauagcauguauauucauuuauuccaaauuucucauuagugauauucaagucaauugguuuauaggaugacuuuuacauuaaguuacuaacuuaaggaaggaacaggcuuggguugguggugagaaggagaugagacagaaaaaguuaaaggaaggcugaauagagugguuagccugacuaucuucauaaaauuuuccugugcuguauaaaauuaacaacagagaaaauuaaauagcauauggaaacccaagguuuucuguagccauagagaauauuauuaaagaguugaucccggcaggcuuuagguugucuauguaaaugaguucauauggguacauaacauagcaagguccuuagguuucaaauauugaccucauuaaauuuaacuuacacaagugguuuauauuuauucuuuuuuuuaaaaaaauucuuuuuauagucauuuaaauguauagucuuuuggaguaaaauacauccugugcccguguaaccugaagucaagauucuaguucauuacaucccuccuuaagacuauaagucccaauucauucagcacauaagaaguuaagaauguggcagagccaacagcuuccuuuacuuucuauugcauuuugcagggguucuuuuaauacgggaauccauaaagacuuuaaaugauuuccaaauaguaugacugauguccagcuuugccacauaguccaguggugacuaagcauggccuuaucugccguuccuaaagugaugucagugaugugcaguugucuugauaaauugaaaagcaagagauaaaugcaugcuguaaaucauuuaccuuuggcaaacauagaaaguguauuuuuaggccacaccgugaauaaacauuccaaaucuuaucuuguucuaaugaccucuuccuuuuaaagguaguucauagugcauuuacaauaucagcuaaugugcacagaauggaauuaccugguuaaauaaauuugaaaaugaggcaacuaaaugcaucugaaaaauaaccucagugaccauaaucuugugaugaaacugcccacuuuuucauauuuuuaaaagggaggcguugcuaaaagauugcaguucaaagcuuuaaauguccaugugauauggcccaguacaguggaaugccagggccagggccaggaaaugggaguugguggguuggggagcagggcagagggaggguauaggggacuuuaggggauagcauuugaaauguaaaugaagaaaauaucuaauaaaaauaaaaguccaugugaaauagcuucagauuuaagugaaucaaaaauuauugaagacuucugaaaauuucauaauacgugucauuaaagaucuccaggagacgccuaaauucauauuuagcccuuguuccuagcuucuuuuucaucaaaguuugaacauuagaaucuuaacuauuuuuaacuauuuuucaaauuuguugaucaauuuaaagagcaacaucuuuacugaacacagauuuuguuugucucugcaucuucuccaucugcaacaauuccauugaugacaacguaugugucuaaacuucuauuuacuguuugaucugguuuuccaauccuuguuucuccacccuucguccucugauuauguuuggaauuagagcagccuuaguuggcucccagcacuucauguacuuuaguaucuauuuuucauguuuauaauuaguuuauucuucaaaucucugaucaccucauuacccuuuuuuugugcccuaaacaauuaugagccauuagccacaaacuguaauguuuccuuacuuuguauuuuaaaauguuuccuguuuacugaauuggacuuaauuaccauccacucucucaucaaaccuuaaaaugauaguucuaauucuaaccccacuguaccgauagaaacagguuccucagaugugacccucaaguauccaaaauguagacagaacaguauaagaguuaaaucagucauuaggcugcuaauacagguuuuauauuuuguuaggaaaaucugccucacgucucacaacagaagcccaguaaggauagcccauaggauauaaaccacuguaagcauguugaugcaaaacaucuguauggcagacagcugcaaagauugggagugagucuuugugggaaaggaagcaugcugauuuuuguuggcuuccucaauaauagcauugagaaaaaaauuuccaaaagccgaguguccaaugugacuaaaacuaagggagggcgcuuuuauaaugacauagaauuguauucuccuccuuauacuagucgucauuagaauaaugccauggaauuuauucauucuuaggacauuucuuuguagacgguguuuuaaaaacaccauuuccuuuuucagaauggcucaaacaaauggcacauauuaucagauacacugaguuuugauggaaaucagcuguuagguugacgaaaaaagccacccaaccccaaaaggaagucugagguuuuccauuccaagucauagaauuaauuaacuuaauuguaagcagacuuucuuaaacagagcucuaaauuauuaaacccuucuuuuuccccugaaaauaaagucacauaaauccuggcuuuguaagacauuucuucccgagacuugcugcuaucaacuuaccaugcaacaggcuagaggagagcaacagaaagucagagucauaauugacaaugacaugugcuuauuuaauuuuuaaaaauaugaguccacuuuuaaaacacuguaaaaauauuuucauggaauuauagagaguuguuaaguugagcagaaggaccugauccaggcugucacuuugcuccaaugcaaugucgccuucuucugaguuaauuucgccagccaugaaaaaugcucaaaggggaaaaaguaaaauuaccauucuguuguuauuaauaauaauaugauuguauuuucucuuauauaaaggugucuaaguguuuguguuauguuuccauggaaacuuucuccauauauauuuuuuuacuguuuccuuaaagaaugcaguuauaagacaaacaugaaaucuggaaguuaagugagguaacagugauggaauuucagaggauagagaauugaauuaaagaaaaauagucagacacauuucagaucuuuaaguuguucgugucaaucaaacuugaccaauauuuguuccaggaaauaaaugcagaagcagauuggguuguuuuguuuuguuuuguuuuguuuuguuuuguuuuguuuuuguuuuugcaagaggagaaaaaauuauuuaacacacuuuucaaggucaggguauucuuuuuggaaaauuucuuuuuuuguuuuguuuuguuuugcuuguuuuuuuguuuuuuggguuuuuucuucuuuuuuuuccuuucuuuuuuuuuuuucuugguuugguuugguuugguuugguuugguuuuuugagacagcguuucucuguguagcccuggcugucuuggaacucuguagaccaggcuggccuugaacucagaaaucugccugccucugccucccaagugcuaggauuaaaggcgugugccacuacugcccagugaaaauuucuuuuuaaauauaaaauaauaaguagugaggugauggauuuguaaagaaguaguguuauaguaauaacacaagcauacaugggcacacaguuucacuagacaacuuaugaucuuggacuuuuaauuuuuuuuaagauuaucaauaccuaauaauaaauuuuagcaacuccuccacacaaauuggaacguauaaugccacauucugauuuagaauaaaaucccaucauuguaucauaaaguuuugacagaacagaugaagccaacaggcacccaauuuuguuuauuaacaauucuuuuuggguaagauacaaaguuuuuaaagucuagugauguaaccauuucuaguagagaggaccagcaauacugaaauaaggauguuacacauacacaauguagcaagaugguagcuguguguuuucuuaggaccuuuccuuguauagucacuagcaaaugauuuuugguuuuuagaaggcacugauucuuuuaggaaauacaaucuuuguaugcuaaacugcuucauuugcucuguguggagagggucuucugccuauagcauugucacuuuccuauacaacuuaaauuuccuuaagcuagccaaucuccauaaauguggagucacugucauguaacauuuuacaaugacaaggcuacuuucacucccuagugaucaaggcucauaguuauaggcugaaaaccuaucauguaguugcuuuacuuccuaugcacuuguguuucaugcuaaagacugaaacaaagaccuggaauaagccaaacacauuguguagauacucagcaagcaguagaacuaccucgaaugccaaccagccucugccagacauguaaucuggcugcaccaagucuacagaguugaaagaaagaugaagacaaauguccaacaccuggaaacaaaugaagaauggguauuacaacuuuaauauccuguaugugaaaaucuacucauauggacagugucaugauuuguguguuacuugguuccauuugauguggcuuuuuguuguuuugcagucugaaacacucucucuccccugaggcacuaugcagcuugaaaagaaggcaauauuugaagaaacuaggagcaggggcucuuagucuccagauaacaagucaaguucuccuucucacuacuguagcucauuacagagaaccaucuaugaaaauuuggcauuaauuacuuuuugguauuugcuuaucuuaaaacacauaaauguucauuuuuugugaaagcaauuauuuacacgaucaaauauaacacuuaacaauacaaaacaacuuacaaguuuaugacuugaucaauuauccucuuuuuuguuaauucgaguuuagguuuuaggcuucuucauaucacagaucacuuggguccaauuaaaaauacagagccacacuuaagcacucacuggucgugcaaccccuuauaaauaacuugucuaauuaacucuuugaaauuaucuuucuagcuaaacagaauauaucagaggcaaccaccaucgaaaugaauauccucgcagaaacuucaucacccaguuuauccaaagaaccacacaugguaccugacagagcuacaccagucauuccauuagccaccgaauuaccuauuuuuaccacacacuucccuccugcaggaaauauagucaauucugaacagaaaucuguagucuauucucaggcuaucacaggcagauuagccauggaaucacccacaacuacucggaauaccaucaacucuugggaucugaaugacuccuuggcuucugggucagggccacuuggaaugccagacauaucugaaauuaaggaggaggaacuccgaaguacaacugucaucucccaacaugcuacuggcucacaggcuguaauuacagaggauacgcaaacacaugaaucaguuucacagauugaacaaauagaagugggccccuuaguaacauccauggaaaucacaaaucauauuucucucaaggaauugccagaaaaaaacaaaacaccauaugaauccacagaagugacccuggaacacacgacugaaaugccaacgguaagcgccaguccugaauuggcaaccacaagucacuauggauucaccuugagagaagaugauagagaagacagaacacugacaguuagaucugaucagagcacucgggucuuuagccaaauccccgaagucaucacaguaucaaaaacaucagaagacacuaccuacucacagcuaggggacuuagaguccauuucaacaucaacaauaaccaugcuuggcacagauagaucacugauagauaaagagaaagaacccaaaacuaaugguaaggugacugaagaugaguuuggucaaucacagccuacaacuaccuucccaucacagcaucuuacagaaguagaauuacuuccauauucuggugacacaacaucaguagagggaauauccacaguuauuuauccaucauuacaaacagaugugacacaaggaagagagaggacagaaacaccaagaccagaguuaaaaaaagauccguacacaguugaugaaauaccagaaaaggucacuaaagauccauuuauagguaaaacagaagaagucuucucuggaaugccucucucuacaucuuccucagaguccucaguggaaaggacagaaucuguuuccccugcauugacaauugagaaguuaacugugaagccaacagaagcaagagauguggaagaaaugacaacccugacuagauuagaaacagauguuacaaagucugacaaagauguuacaagaguucauuugacccacaguacuuuaaauguggaaguggucacaguaucaaaauggccaggggaugaagauaauucaacuucaaagccuuuacccucaacagaacaugcaggcuuuacaaaauugccuccugucccacuuaguacuauaggaauaaauggaaaagauaaagaaaucccaaguuucacagauggaggaggugaauacacucuuuucccagaugguacuccaaaaccauuagaaaagguuucugaagaagauuuagcaucuggagaauugacagucaccuuucauacaucuacaucaauuggcagugcagaaaagucagcuucaggagagccuacaacuggagacagguuucugcccaccacaagcacagaagaccaggucaucaaugcaacugcggaagggagugcuuugggugaagauauagaagccuccaagccacuauuuacuggccccccauuuguccacaccuccgauguagaagaauuggcauuuguuaauuauaguagcacgcaggagcccacuacuuauguagacauaucccauacuaguccucuuucuauaauucccaagacagaauggaguguguuggaaacuucuguuucacuagaagaugagauucuaggcaaaucugaucaagauauccuugaacagacucaucuagaagcaaccaugucuccuggagcuuugaggacaacaggaguuucacagggagaaacccaggaagaaccacaaacuccagggagcccauuuccuacuuucaguucuacugcaguuauggccaaggagacaacagcauuugaagagggggaggggucaacauauacucccucugaaggcagauugaugacagguucugaaagagucccagguuuagaaacaacuccaguuggcacaucuuauccaccuggugcaauaacagaccaggaaguggaaauggauacaaugguaacacugaugucaaccauuaggccaacagugguuucaaguacagagccagaaguaauuuaugaagcagaagguaguaguccaacagaauuugcaucaacuuugaggccuuuccagacucaugucacacagcuuauggaagaaacuacugaggaaggaaaaaaggcauccuuagauuauacagauuuaggcucaggguuauuugaacccagagccaccgagcucccaaaauuuccaacaacuccaagugauaucagugucuuuacugccaucgacagccuucacagaacgccacccuugaguccgucuucaucauucacugaggaacaacgugucuuugaggaagaguccagugagaaaacaacaggugacauacuuccuggagaaucuguaacacagcacccugugacaacucucauugauaucguagccaugaaaacagaaucugauauugaucacaugaccucaaaaccuccuguaacacagccaacaagaccaucaguuguggaaagaaaaacaaccuccaaaacucaagaguugucuacuucaacaccugcagcagggaccaaguuccacccugacauaaauguuuauauuauugaggucagagaaaacaagacagguaagucuuugcuuucaaggcaaucagcauuuucucuugaaaguuaaaauguccaucauaccaaaugcugccauuagaugauaagaauaacuggagugucaaaaguauguuagcuuccugcaucaguacaagaauuggaaggauauguuaaacaguuugcaagaguauuagguacaauuuuauuuugaaaguugcaagaagcccugcuuugucaucuaauacaaccacuucaucauuguuacaucccuucagagcguguagaacaaaauguuuuaauuuccgugucuuccauacauuacuacucacguguagcacuagauggugcuaacauuccauuggucugcaaccauuaaccuucagcacucacaauguagacaguuaaaugauuuugcauaucccuaggguugaccgaacuaucucuaaagguuuguuuuuuucucuuccaggauuuugcaggcuuacacauaaguuguggaauggguaauaggucuacuuuaauucaaauuuaacaguuauaagauauuaacuuuguguguuuguguguguguguguguuuguguguguguuuuaauguagcuuuuguuguuuagaaccaaguacaaucuagcuaagcccuaggaguugcuuggaaucauuaacaacuuuagaaggcgaauuuguggacacgaccucgccuuucuaaaaggcaggccaugauguuuuuauugugauuucauugucuccucuaaaagcuuuuuauuuuaauugccuaauacuuuuaguuaucauuaucaaacaugucuuguucuuucugaaaaccaacagugcaccaucaugcuaaacgcaaaacgccgaguugagaaugcauagcacauacauacaugaugggcuguuucacauuucuuugugucuuuuaaauuuagagcuuaagucuacugguuuuaucaaaucauuugguucaaauuuuaauauaagaauuaaaugaauuaauguccauuuuucugugcuuggcucuaagaagccuugugggaagcaugcuugcuuaucaguuucuuucuugguauuggaaacacgcucugcugggugucacucagaagacaaaugcucuuucaucaggguuaucaggaguccagcuguuaaaaaguaccuguaccuccaauucaauugguauccaguguuguacacagaaacuucauggcuuuuauuugcucauuuuccccaaaauuuucuuucccccaaaucacacaacccugcauuugucuccucagcauaggucuccucuucucagcauagauuuuuagaggcuaggaauaaaacaugauuuuuuuuucuuuugcuacuggugcaguauuuuguaaaucauaaaagguuuccugucuucuacauugcuuugacaucucucuugaaacuguaauuggaaauggaaauguuaccaagaaguagaaguuggaauugcuguuaguuagcgauaaaagaaacauaaaacuguaacuguggggugagggguggggaauacagaggagaggggauugggaucagccuuugauuucugaaucugagaaguucauaccaauuaagucuaugucuucaaaguuuaucuuauuguguuguuagugauguacuacugaguuguaucaaauaguauggaacuggaaauauaaggcaccuaacaacuccuguggaugguaagauguacauucagcuuaggguguuuaaauuacaaaauggaaaaggccugacacuugaccacaucuuuccuccugaccaagugccaccaagugaugccaccaaguggcaccaagugauggcaaccaucaggugaaaagcagaaccagcguguuuauaaacaggaguucaaauggagggucugcaaagucugaggcuguaauaguuuaugcagaggcgugucuuuauagguacauuguggucuucaugcagcugaaccugcagaguuggcuucuuucccccacuucuagaacauaugaccauucugagaaaaccgugaacuaucuggccauuuccaucaggcauguuugcaguauguacauguugguaggggcacggaacacaggcgcagucucucuuucaucuguuuuuuuuuguguuuuagauacagauucuucuuaaaauaugacagcauuguuuguuauuuucagaggucgacaagauuuacucagaccccacuacucauuuagcagauguugcuaguuuucuaacaauaaccuaauuuugugaacuaguauauugaacuuuacccaugaaaacauuaacacagauguucauuuaaguucuaaggcagguguguuaaugaggaaccauggaaagugaaacuuuuuauauuuccauacuggaaaaauccuuggugcaugcauacuguuguauaaaccuauucacccaaaucaaauuuaccuucacauuuacucugcacccaagugagugaaaaugccacccaggcuacaucaaaccacagcauuuauaauuucugcugcacucagagagugauauaaagcuugacuuuuaugaaauaccaugaaacaaaacaugcuacucaaggcaugcuuacaucauccacucagaugcacguuaauggcaacacugguucugcugcugguggguaacuguaguuaacaguuuaaaauucugaaggaacuucucagcccauaaagguuuuaugagcugaaaaaugcuguggggugugguuaacagugguucagggaugcugaaaccuugacucgucuauugcaggaguaguuugcacaccugcacuuggggaaauuauuagaaggcuuucuuugugaacaugucugaagucuguagaauuugacuaagacagagccuuugucagguuaauauguacuaugccagcuuugaguggaaagaaauugccugcuuuauucuuucuuuacugaaacuguagucaaugguuagauuuuuggcaaguauuuuguuugucacaagucuuacuaugauggaaagaaaauggaauuaaauaucugugacuuaggugaucugucaaagaacuagggauaauuaacauugaauccaaaguaguauugauaacugggcacuauauuuuuagucucuuagaauugcauacuugagcuaucugcuauaccuuuguuaaguuuugucugcaaauccggaaacuaaaagugauccauuaaugacauaagaauuuuuuucuuuguauugauugaguaaauuccuucaauuaauuuguauuugaagaaaaaaauacaauuuuuauugccuucauagaagcauacauauuuuuuacagucagugaaugauuaaaaaauauugagaccauggcugcacauucaugauguaucaccaguaucuagauuuacaugaccacaaaauucucuacuauuugagauuuuuuuuuguaugauucaugugccccugucuuugugcuauaguuaccaccaaacacucacuauuucuuuaguuagagauauaaaucuuucaaagauacuucagcacagugacaaccuuuugauucuuaauacuaaaucaguaggaagauauugcaacucucaaaggggagacuaaauggguagaauauucaguguuuacaggauauuauccuauacuugcaagaucacuuuaaugcuggaaaacagaccugagaaacgugagaugagagaguaaagaucugugauggcagaagccuguaaugggcacuuuggaagcugagucaggaggauggcaaaaacaaguacaugcauaauaacaaauuauuuaaugugaguccuaggccccagauguaaaaacacagccauuuucucugugagaguggcaucugucuaucuagcauuuaucuaucugaacugagacuucauaaauagaagggcgaugcaaaaaaaaaaaaaaaaaaaaaaaaaagaggaaauuaagaugcuaucauuuugaagcaugcugaaccaggaaugagguauugaacuaggauucuagaauugcagccccaucauguacaguacagagaugucagcagagaaaggaaggagcggagugauugugggccaguagguagggcuguuugaacaacccauuaaaggagucuauuugaagagaagcaagguuaacguuugacaaaggaauggcaaaauagaguuguuucuacucuguagcuuaguggauauaauuuuagaagaaguuauaaacuuacuuauuagaguccuucacuauauuguaaucaaagacuuccuuacuuuuaaguuaucaauuuuaaaauaucugauaauaucugucuguuuaucuguaucuauaucuauguguauguauguacaucaaaggacucaagugcuagagaacuaaagcaaaauggauagcaauguucaacuuuaugguuagccuuuauuuggucaauucaaaaaguuauauguaugagugcuuugccugaauguaugucugugcuccacuugcaugccugguaccuacagaggccagagagaguguugaauccccugcaacuggaguuauagucaguagucaguuuuggaacugcuguguagguccuaggacucuaaccccgauccuacggaagaacagccagaauuuuaaucuacugaaugaucucuccagcccauauuugcuguauuauuuuuuagaaauaaauuuuuagagaauuccacagaauguauuuggauuauacuugcccuaacucugcucagauccacuuuggauacccaacccacccaauugcaugccaucuuuuuacuuuuuaaauucauguauuugugcugcuccaauguccuuugaguuuagagcugucuuucggaucauggucagccuagcaggaagauuaguucaggaagcauuuugaaguccaauugcccaaauugcuuguuuugaguguaguucuuucuuacuacuuaggcacucaucaaguaucuguaauugcuugaauaugcuguguaggaaaucaggugcucuguuaaaagggaguagaaucuuuugugaagaagaguuuauacuuggugaugucuccuuaacucgggcaagaugacugcaucuaacaauagccuuugcacuugagggaacuauguuauccgagaauaacugggagcuaagaaaacccaugccuauuuacuauaaccuacccaccucuucaaugugaggucagcagaagcagccuccuuacuuacauauguguaugagccauucuggaugugaaguuugugaacugagaaaaaaggugugcguugcugagcauacaaaggcagucagggggacacaacuugcuugagagcugcuccagguaagcuaugguuagccaagucagaaggaggcaacaaggaucacagaacacagugaucucuaguucuuugaucuuguucacuucucugguguuugggaaggcuguuuuguagauauaagcaucgcauacuacacaagaacugagggaacgaaggaucaaaagcaucuggcaacauuuuggaaggcauuuguauccugauuugucauguuguuguuguuuaaaaaacuaagcuggggcaaacuaugucacaaauuuuaaaaaauacagaggauucagaauauuuuaagcaauuugauuaaaaaaucacauguguuucuuuccccccuuaaaguacuacuuagucaauuuauuucaauuaagaauugaggaucuaacaggauucuguccugcuuaagucucuauccuaacauauaagcagugauauugaaauauaagacaauuaaauucuuuucuacagacacacacacacacacacacacagaauugaggaucuacauauacaugaaaucuugacauuaugaguauguucaggcuucuucacuuuaagauuuacaauuaccuaccagggaucugcaguguggcuauuucauuuucgcaauaaggcucuugauagauuuucuauauauauauauuagaaaaauuacauuuuaaagaaaacauagucuuauuugucuucacugaguaggcugcaauaucuuucacuuaauuaaagacucuuaagcuuaaauuauaaauauaaauauguacugugaccagucgcuaggcaugauagcaacuauguuugugucugguuacagaaugacugcaagacuugugcuaugucugcaaaauucugcuaugaaguacuuaaaaauacucugugaauaguugaaggucaguuauccauaaagccugugugaaaugccauuaaaaaaauccauuaaccaugguacuaguauauucaagucaagcuguuaaaauacacccauauaaacauagaaaagauugugcaugcagucuacagaguucugugguuugacucuugagaucuaaauaaaaguuauauucuccuuagaguaaaauucugaaauaaagcacucuuuuaaaaaagcccauucuuuuaugagcuuggacugucaguaacccuguuaagucuuucuuguuagugugaaauagagcagaucacuauuuugcaaugaaacgggacuuugacaauaguacagguguccccccccaccauaugccacaaagaaacuuuucuaguuugccauaauuauagcuguucagaaucuuucagaacaugugugguaaguggggguggugacaggaaagggggaggcagaggcaauuuuggaaaaugaauaaacaaaaacggcugaguaggauuugaugauuuguaaggaauuauugaugguaauucaggccauguggccaagaagaauucaccuacuuauguguacuguagauagaguuuucuauaaacucuguccucauucaugaaauguugaaaguauggaaaaaauuauauauauagggacagaauaaagugugaaaaaauaugaaaauugaaaacccuagguaguuaacauuuuuccauucucaaaccaaaguuaagaaauucaaggaaagcauuuguaaguugacacaaccugaacaaauagccacuuggggauauuccuuucagaaaagguaaauaacagcucuuacucucauucugcauuuuguguuugcucuaguuaagucuuuuuuaguaggaaaauucuaggacuccauauaacacaaagauugugguuucauauuguauuagaacuuuuugucaaauaaauacauuuuagauacucuugucacauagaaacacuacauggccuacuauauguguauuuguuuuuguaugcuaaucacccuauuauccauaaauauauacuaaaccuaacauauauccacugaguccagcugacaagaaaaaaauuacaguauuuaucaagugguaacauuaugcauuaaugaagcaaaacaaaaugaaacccaugagaauguuagucauuuaagccagguucauuuggcccucuaguuaaauuuucaugaaugugugcagauguuauaauuuaaccuggacuuauuuaacuauauuuaaauaguacugaugagaagcugcuuguuuuagugauaaaauuguugcuauuauauuccaacaguuuauaugcaaaggcauuuuaauguggccuuucuaugcuuuguacauugucuuuacauuccuuuuuauaagacaaaguauaccuuuguacaaacuaucugaaauuuuaauugugucuucuuuuauaacuuacaaaugguuacuauacgauaacaguaacagcuaauauuggacagacaucauucauuuuaaugaugcuucuauaaaagucuagguauuuaaucauuuucuuaacuuacuguuaaggauuaguugcaacauuuaugccagaagcagcauguaauuguuuugugcuuugauguguacuggaauuaggcauguaucuaacuucucuuugugacugaaauauuuuuuuaaucauuuaaguauccauaugcuuuagcuuggaugaaugaaauccaagugaauacauuagaauggaugaaaguguguguaaaaugugucuagugugaagguuaaauagaaaguuauaguuagguugaaaaaauagacacccaauauuuuaguaaaaugauucaguggguauauccuggcauauagacaguauguuuuuuuuuuuuuuuuuuuuuuuuaguuauuagggugaaagagaagguggaauuaccguaugugucuccugaagucauguuuguuggcuuucaacauaaaaagucaacacacauccacagaguaguucaguaaauauuacauuaauguacaguggacugggaaaaagcaagaucauacaaaccguccucaacuacuaauuuucucuguucuuauuggauguugaauguugaugccuuccaaugaggaaagaagcagcuuauaagaggaacaaucuagcagaaaacauuuuuggagaugggguaauggaggcagaguugucuuugucaugcuaguuucuucuguguguuuaucagacucauccuaaacuugugugucaguuagggcuaaacagaaagcuuauucuacaauagcauuccucugggcaaguugugaggcccaauguagccugugucuaguccaugaccugguauuuccaaaagcacuguggugacaguggaaguaguguagcuggacuccaucaaggauagccgaaugcauucuggaaugggugaagccucaaguuuucuuuuucuagaacacuagacugaaaguuuugcugguguauuucuggcaacagagaaguaaacggggcauaguguuugcugccauuuggcauuacaacccagaggauggguuuauauguauuacuugacauuuguaauuagaauacuuacauacaacaucaggauugucauucauuaaaaugucaauagcaagaaauaaagcucagccugguccuggcacagaucauaaaagacaaugacauaaaggagaaaaaggcuuccucuggucuuuucaagaagaucuuucccagcccccuccaccacuggauauauuuggucuagggagucauuuuuugaugucgagagauuccuucguuauugauucagugaauacauguggccauuacaucauaaauugggacagaaacaaacuacuuuucuaagaauugacccuuaaggcagauaauagaggccaggaggaauuuuaugucuuuucuuauugauagaauucauauuuaauguauggaacaauaacccauuuuuuaaaaauuuauggucuggugaaauggucuugauuucaacuuuuuuugcagcucacagcaucaucaauugugcauucuauaacuaaaaugucuauauaauuucuuuuucauuugagaacucuguugucaucuuaagcacauuuaaguguuuuucuaaauuguuuccacacucacaaaauggaauuuuucuucuuauuguaauuacauaacagcaaacuugaagagcaagaaccauuugcagaaaggugauuucauguaacuuguaacaagucaaauccucuuuguguguaugagugugaucagccuugucuucuguacccugccaaaucuuccauuuaaguauugugaaaacucuuuguuuuuuucaggucgauugagugauaugauuguaaguggucauccaauagauucagaaucuaaagaagaggaaccuugcagugaagaaacagauccacugcaugaucuguuugcugaaauuuuacccgaguuaccagacucauuugaaauagacauauaucacagugaggaagaugaagacggagaggaggacuguguaaaugcaacggauguaacaacuacuccgucagugcaguauaucaaugggaagcagcucguuaccacagugccuaaggacccggaagcugcagaagcuaggcguggccaguacgaaaguguugcaccuucucagaauuucccagauaguucugcaacugacacccaucaguuuauacuagcagaaacagaaucgucaacuaccaugcaauuuaagaaaucuaaagaaggcacggaauuguuagaaaucacauggaaacccgagaccuacccugaaacaccagaccauguuucaaguggugagccugauguuuucccuacucucucaucccaugaugguaaaaccaccagauggucagaguccaucacagagagcaguccaaaccuugaaaauccagugcacaaacaaccuaagccugucccucuguuuccugaagagucuucaggagagggugccauugaacaagcaucccaggaaacaaucuuaucuagggcuacagaaguagcacuugguaaagagacagaccaaaguccuaccuuaucuaccucuagcauacuuucaaguucugugucaguaaaugucuuggaggaagaaccacuuacucuaacaggaaucucacagacugaugaauccaugucuacuauagaaagcuggguagagauaacaccuagccaaacuguaaaguucucggagaguucuucagcuccuaucauugaagggucuggggaaguagaagaaaauaaaaauaaaaucuuuaacaugguaacugauuuaccacagagagauccuacagauacacucagcccuuuggauaugagcaagauaaugaucacaaaccaucacauuuauauuccugcaaccaccgcuccuuuggauucaaaacuaccuucuccagaugcaaggccuacacaguuuggaauucaaacagccaccucugaguggguuuccgauaagucuuuugaaggaagaaaaagagaagaagaugaagagggagcugugaaugcagcccaccaaggagaaguucgagcagcaacagagaggucagaucacuuacuuuuaacaccagaauuagaaaguucaaauguagaugcaucuagugauuuggcuaccugggaagguuuuauucuagagacaacacccacagagucugaaaaggaaauggcaaauucaacuccuguuuuuagagaaacaauugguguagccaauguggaggcacagcccuuugagcauagcaguaguagucaucccaggguucaggaagagcugaccacucucucaggaaauccccccucucuuuuuacggaccugggcucaggagaugcuaguacugguauggaacucaucacugcuucuuuauuuacauuagauuuagagucugaaaccaaagucaaaaaggaauuacccaguacuccgucucccaguguggagauaucauccucuuuugagccaacaggauuaaccccgaguacuguacuagacauagaaauugcuggaguuaugagccagacaucgcagaagacacugauuucugaaauaucaggaaagccaacuucccagucaggaguaagggauuuguauacaggcuuuccaaugggagaagauuuuaguggugacuucagugaauauccaacagugucuuauccaacgaugaaagaggaaacaguugggaugggagguucugacgaugaacgaguuagggauacacagacuucaucaucuauaccgacuaccucagacaacaucuaccccgugccugacucaaaaggaccugacaguacuguggccagcaccacagccuuccccugggaagaggucauguccucagcugaggggucaggugagcaauuagccucagucaggagcucuguugguccagugcuuccacuagcuguggacauuuuuucuggaacagagucuccauauuuugaugaagaguuugaagaaguggcugcagugacagaagcaaaugaaagacccacuguuuugccaacagcagcaaguggaaauacuguagaucuuacagaaaauggguacauagagguaaauagcacgaugucacuggacuuuccccagacaauggagccauccaaauuguggucuaaaccagaagucaaucuugauaaacaagagauuggaagagaaacagugacaaaggaaaaagcucagggacaaaagacuuuugaaucgcuccacaguucuuuugcaccagaacaaaccauuuuggaaacccaaucacuuauugaaacugaauuccaaacuuccgauuacucuauguuaacaacacugaaaacguacauuacuaauaaggaaguggaggaggaagguauguccauagcgcauaugucuacuccagguccagggaucaaagacuuggaaucauauacuacccaucccgaagcuccuggaaagucacacucuuucucagcuacugcuuuagugacugaaucuggagcagcuagaaguguacucauggauuccucaacucaagaggaagaaagcauaaaacucuuccaaaagggugugaaacuaacaaauaaagagucaaaugcugaucucucauucucuggacugggaucaggagaggcuuugccuccucuaccuacaacaucagugaauuugacugacaugaagcagaucauuagcacauuguaugcugagacaucucacauggaaagcuuaggaacaagcaucuuaggugauaaaauggaagaccaugaaagaauggaagauguguccaaugaaguuagaaugcucauuuccaaaacaggcagcaucucucaagacagcacagaggcacucgacacaacuuugagucauaccggaacagaagaaccuacaacuucaacucuuccuuucgugaagcucauggacuuggaacguucuccaaagcagacccucaggugggaagaggaaacccagacccauagaccacaaacuaugaguggacugaucucuaaugaaaauucuucagcaucagaagcugaagaagcagcaacuucccccacugcuuuucugccucaaacuuacaguguugaaaugaccaaacacuuugcuccaucagagucacaaccauccgacuuguuuaauguaaacucuggagagggaucuggagaaguggauacucuugacuuaguguacacuucuggaacuacucaggcaagcagucaaggagacagcaugcuugcuucucauggauuucuggaaaaacauccagaggugucaaagacugaggcuggagcuacugauguaucuccaacagccucagcaauguuccugcaucacucagaguacaagaguucucuguauccaaccagcacacugccaagcacagagccauauaaaagucccucagaagguauugaagaugguuugcaagacaauauccaauuugaagguucuaccuugaaaccuagcagaagaaaaaccacugaaagcauuauuauagaucuagacaaagaggauaguaaggaccuaggauugacaauuacugagagugcuauuguugaaauucucccugagcugacaucagauaaaaauauuauuauagacauugaucacacuaaaccuguauaugaguacaucccuggaauacaaacagaccuagauccagagauaaaauuggaaucacauggcaguagugaagaaagccuucaaguucaagagaaguaugagggagcuguuacccuuucuccaacugaggaaucauuugaaggcucuggugaugcgcuucuugcuggcuauacucaagcaauauacaaugagucugugacucccaacgauggaaagcaggcagaggacauaagcuuuaguuuugccacugggaucccaguuucuagcacagagacagaauuacacacuuucuuccccacagcgucaacccugcacauuccuaguaaacuaaccacagcuaguccggagauugauaaacccaacauugaagcaauaucucuggaugauauauuugaaucaagcaccuugucugauggccaagcuauugcagaccagagugaaguaauaucaacauuagggcauuuggaaaaaacacaggaagaauaugaagaaaagaaauauggagguccuucauuucagccagaauucuuuucaggagugggggaaguauugacagaucccccugcuuauguaaguauugguaguacauaccuuauagcucagacuuuaacagaauuacccaaugugguaagaccaucugacuccacacauuacacugaagcaacaccugaaguuuccucucuggcagagcucucuccacagauaccaucuucucccuucccugucuacguagacaauggagucucuaaauucccagagguuccccauacaagugcucagccaguuucuacugucaccucaucacaaaagucuauagagaguccuuuuaaggaaguccaugcuaauauugaagaaaccaucaagccauuggguggaaauguccacagaacagagccuccauccaugucucgugacccugcuuuagauguuucagaagaugaaaguaagcauaaguuacuagaagaacuggaaacgucucccaccaaaccugagacuucccaagacuucccaaacaaagcaaaggaucacauuccaggagaaacaguugggaugcuugcugguaucagaacaacagagagcgaaccugucauuacugcagacgacauggagcuaggaggugccacacagcagccacauucugcuucugcagcuuucagaguugagacagguaugguaccucagcccauccaacaggagccugagaggccaaccuuuccuuccuuggaaauuaaccaugaaacacacacaucauuauuuggagaaucuauacuggcaacaucugaaaaacaagugucucaaaaaauucuugauaauaguaaccaggcaacagucaguaguacucuggaucuacauacugcacaugcauuaucaccauuuuccauucuggacaauucuaaugaaacugcuuuccugauuggcauuagugaagaguccguggaaggcacagcaguuuaccuaccagguaagaugucaacauugauacaucuguuuccaaggcugggaucagccccuugguucuauauaucuguaugccuuuuauuguaaugugaaauucauagcaacuuuuauaguguucaggccaagucagagucaaugcaaugagcguaaguauggacacuucuguacuuuacagacaugcuuugcguuuuccccccugcgucuuacagacaacauacuauuguaacauggacaaagugaaauaauggucuaaagcucaauguauuuucaucaacagcugaaauauugccuuguugcauguccuacaauaugucauagcuguaaaaauggggaaaaccacacuuuucuuuuaacccucccccuuuaggauauguucuauaacaguacugaauuuggccaguccuuuaacuuuugagaauaguuuucuuacaaaugccuugugguugguuguucuaucaguuauccuuuguacugcagugugauuccuugcuugaaacauuuuauacaauucugcuaacucagcucuuagucauagugucuuuaguauguuuacauucuaccucuugagaaauuauuucuaauuauugacuauaaaaaagcauagaauugauacuacuccauauagaccauuucauuuaaucuucacaaaauaucuaaaaucucauccuuuuacauuagaucaauguaaaaggauaugacauagguauuuacaaagggccaguaauuugcccaaggaugugcagacauaccauggcagaagugguguuuuaacuccaaacaacccuaaucugauguccauggucuuuuuacugcccuuuuacugguuuucaauauagcauaaaacuaacaaguggaguuuaguauuuuacaaacaguaaacuugacauuuguacuuaguagagaugauaauuuucucaauuuagccugaaaauguugaaaaguaagcuccuauauuccuagagugcuauuauuuaaguaguaauaauaagggaacccauagauaacuaccaucauguaaugacuuccuaggaaaggaaagaaagcaagaaaugaaggaaggggagaagacaggaaaggaggaaaggggaugaauuuuaaggacuguauugguuaaaaauauguuuuaucuuaaauacuuuaggucauggcuauuaaaauuauuuuucugucuuauuaauauuacugagacacacauuuuaccuuggaacucagaagaauacauuuauuugacacuugauauuuuaauaauaucaucauaguuuaauaaaauaauaacauaguguuuugugaauaaaauugaucuaagauaguugacacugggaauauuuuggaguaucacuauacuacaaaauaaugauaacauaguaaucuggccaauacuuauuguauuaucauuaaguugaaauguacuuaagaauauggaaauaauuggcaaaugaaggggaaacaucucuguauuauccagacuacaguacuuacugagacauaguguucugucuuuacagaacuaucccuguacuuuaaucaguagauagucaccugugugagagggccuggccuaccugcugcagguuuagcuuucccaggucuacccaaacuccuuggggaagaacaaugugcuaaaagggcagucugucucuuagccagaacuucuucaaguacacaggaaaaguccccccauacuugucaugugaucucaguguggugucugguggccaugauggggauagaagcagucacaguaccauaaggacacucaccuaaguauccauucagaugugcaugugucacagacugcacucuugucacugaggcacugcacuuuaguaugugaaaaaccaagugcuggggagguuuuaagaauguuuggagauacaggagaaaguauuuuugaaaaaucaagaaaaauuuuagagauacugaaguauacaucugaguuuaccugauuuuaauaugaacuaaaaauggauguguagauucaucaggccuguccaguugccccgauuugaccuaaugcugaauaagguuggcuuugaacuucuugucugagaaugggucacguuucuucuauagccgaugucucaucagaaauuagauaucucuucaugugcauacauuucaggauuuggguaauguaagauuuuugaaacugcaguuguauacauauagcaucuauuacuuuaaauuguuuuucaaaacuuuugaguuucauuuagaucucuggacacuuuuggaguuaaauauuucugaaauaauacucaaguucuccauaaaauccacauaucuagacaauguuacaaaauaaaauauauguuuuagagguauaaaguauuuauauuuaaaaauauccccuaaaguauuauauuaaacuaaaaauuuaugguuugagcuuuuguaucuuucucuaggaggguuaguuuuauucauauuuuauuaagaacauuguaauaaaauuuggggcuucauuuuaagugagguuuuguauuuggaguuguuuuuauacaguagagcuuaauccauguguugcuuuucuucaaguauaguuuaaaggaguacaguuggaacguguuuuuggaaaaggcauguuaauguagcagaagaaacgucagugcacacuuuggaagacaguuucugagcauuaagugguaaaaggcaauaguaauucaaacacugguaacaagccaaucugcuaaaagaaugcauguucuguguacccagccauuucacaugaacuaacaucguuuaaaaaauacauuuccauucacugugcacauauguguaaucauuuuuaacuaaaaucaauugccauuaucaugccaacuaaaucugccauagaauauguuaguugccagaugugguauaauguacuguuuacaaauaaugaugauugaguucuagaaaugaauagaagggauuuguaacaauuaguuauaaugccaaggaacacuccagaguaaauuuaauuuuauauauaguauaccuauaaauugcuaugguaaagcuuaugcuaugguagcaauaagugacauuuugugcuaaaauauauucaaaucugggagaaaaggcuaauuguuuuuauuuuccuggacaugauaggaccugaucucugcaaaacaaacccaugccucaacggaggcaccuguuauccuaccgagacuuccuaugugugcaccugugcaccuggauacagcggagaccagugugaacuugguaagcugcucuuggcugaggaccugcuauguucauaccgcuucagcagcuaucauggaagagaaaaaguguacuuuggaaucugucagcaauuucagggaaucccaugcgacaaugaaaugcauaguaauuggcuuaauuaaacacgauuuugacagguucuguccguacaauccacgcccaucaagguuucacaagcccgucuuugcaguuuugugaacaucuugaaguaacugaaauuucaaucacuggaugggagauuccuacuaguuccaggguugacuggauuuaccuaauagcaauggaaacaaacaccuuaaucuggaucauuucguaauuguuuuaggaugucuaguaucaacaaagaaagauucacaaaagaaaauggcagacaaaagaagagauauuuuguggguauaacauugacuaaaauacaauacaugauagauauacuuacaguaaauuaguuuuauaaaaucugaaagucguauugaauuacuaucuuguaccucccuguaaauaaacguuuuuaccuacuuugcucauguuuacgauuuuauuucagauuuugaugaaugucacucuaacccuugucggaauggugccaccuguguggaugguuuuaauacauuuagaugucucugucucccaaguuauguuggugcacucugugaacaagguaagagcuauuaaagcaucuuugugaugaauuuuagugauguuaauuuucagauuugcccuauaugcugugcauuggaaagauucacagguuguguuaggguuccuuguaugugaauaacccccaaacauguaaacuauagaguggacuugacuguguuuguuuuucugaugugcugaaaucaucagaagcaugcuguguugaauuuaaggaguuuugguaaauaaaggaaauacaauuauaaguauuauuccugggaacacuaucaguguuugccaucucauggccuguaugucacaguuaauucccucaguguuaauugccuuuauuuuauccccauaagcgcuugaggcuuauguuccagggcuuguguccaccgccggccauaucuagagaaugcuuugacacaugguuacaacacauuggcuguggcuugcacauacacuuuguagaugauguuguccaggaaaccacccuaguaaagaagcaacuagguuuucugaaugaaagaaaggccucaaaucucacaauccuuguaauuugcauuugauggcaaaacuaagaguguauuccaggugguuagugauaacagugcuuugcauacugagcucagcaauguugauuuuucuccucuuaaagcuaugcagugguuuggcauugauaagagggcucagcaccaaccuuucccuccaccaaacaaaacaaaaauguaucagacacccagacaaguuggccuggccucucccacuuuguggcauuaaucuagauguucaguagagugcaaaccagagcaaagucaauagucacguggaccgaaguuacuguuacaggagauggcugaugguuauauuuuaaacauuuuuuuaaaauugcaucgaguaagucaguuuuagauuuuagauaugaaaacagaccaagcucaucucuuuaguguaagaaacauacuacuuugccaggcagugguggcacacaccuuuaaucucagcacuugaaaggcagagauagguggauuucugaguucggggccagccuggucuacagagugaguuccgggacagccaggucuacacagagaaacccugucucgaaaaaccaaaaaaugaaagaaagaaacauauuaugacagacacaaaaagguaagacacuuaaacacuccaaaugcauugaaaugaucacuaaccugaagguuuaaguacaaggagcaaauaaaaaaccaaccaaccacacauagaauaauuugcccaaguacuuauuauugaucaccuucuguuuuccugacacugcaacagugaagaugaaguucugagccugaccacauuccgggcuuuggugaaucagugagaacugucgcauugaugucuuagaguuuuccaagugcaucauuucagcugaccaacaacgucugugcccuguguugggaacuaaagcuaagagaaugcaaaugauucacucaaggugauauauaaguaaaaugucccugggcagcucaauucuagaacccaagacuuuucaacauuuuccuacugccaaagcagcucucaaagauagagauacauacaauuacuuaaugagcaucgaguggauuaagugguacuagguucucugaaugaaccuagggccuaguuaccacuuccuuuugcuuugaaaagagacagcgugcuucuucauucauggugccaccuaacuuucaggugugccugucucuuuuuccugcacaucuagccuuccuguuuaauuugcuucccacugucuacccugucuguuuaucuagcgcagcugcacuccugggauucacuucugagcacaggacgauuuuugucucuucuuuucagguugccuacgaacaaauguuuucuucauuaacgacagcacuguugucuaaacaguuuucuauccaaaguuccuaugacugugucauuguuucuuuagcugaccuuugcucuccauuaguaacuguuuaagucucaguaacuuugaaaagggaacauuuuuugguggacuaaucacaaacacuagaaagggcuuuugggacagcagagaaacaggugcagacagauuguuguaaagucaauaccgcuugcuggggcgaggggucgugguguggccaauaucuuaaagcuuagcagcucuguaucagaggugcugaaaauacuacccauacagcauaucaggcagauuuuuauggcaugguugguaagagcaaccuuucagccucugugguacuacucaaagaauugcuggucuuuguguuauaauguuugcucuguuuuuguuuuuguuuuuguuuuuguuuuucuuuauguuuuuuuuuuaaguauuaucuauaggggccugugacauggcucagaguagagugguugccugcuauguacuaagcucuuuggauugagcccaagagacuuaagaggggcggacuuacuguuuuuaaagccaccuaccuuaagacccaagagagcauuugcaucaccagaugugguuccucaucuaagaaccuuccacaccgguucaucucucauaccgucaucucuugauaccccaauagcagucuucagcacaaggcuuucugggaaauaagccacaugcaaacugugaauguaauggccaagcauuugaaguuuacgguuuugcuuuuguggcaaagagaaauauaguuaaugacaauccauuuuaaugacaaaagauagagaaacaaaaagcaaaacugaggucauucaguuuauagaagauaagguuuauuuucugauguauuaaucagaaauuuggguccuagcuuuguucgccuugucuuaacauaaaagacaaguugcgagguugagagaagcugcacaguuacaguugggcauuaucgauuuuggcaggggaaguauucuaaguauucuccaagccuuuuccugcauagggaacucauacauagagaucaguguucuucacugaccucucucccuacuacugaauccuuucaagugaacuuuucccaaaguaaagcuaauauccauagaccaaaauuggcuucaauggggguucuuccagauccuuuuauacugaaccauguagcuaugucaagcauccuuuccuaugaggauugguaagguccaaauaguaucacaagguaaccuuccagugcacauuuauucaaaacaguaagucaaccacugccuucgcccuaccaacagcccuaucagacaagcuggaccaaugacuauuuucagagaugagcuacaucuguugcauauuguggcuggaagcacugcagucaggagaaaaaaaaaccccuucaaucucucaaaaugaaaauugcaaccuauacaaagaaaaauaaauuagacaaggaacacaaaaugaaaauugcaacccauacaaagaaaaauaaauuagacaaggauuaggucuuugaguaccacagcacauaaaacuagcauuugagcuugguaugguuuuuuaaucuguuaauugguaaaacuaagguagaguaaauuuuacuaggaaaucaggaaggucuccuugaugucuaaaauuccauuaaugcuguaguucuguuaauuuauacauggaacuacuucaauguauuugugauauauuugaugaagauuaauauuauuucaauaaagauagucugugggggggucuaaaaggagagggucacaaaauagucaauuuaauauuacuguuauaaaaauuagauauauuugaacaacaucauuaucccauugagauaccagcuguauaucacagcucauugcagaagagaaaacacauucauggacugaguuacuagagugggcgaagguagcuaaguugaagaacuugguuauuaacucaaaaaacuuggugcaccuguacuagaacuucccaguuguuccucuucggaagaaggaaguacacauuccaaacucuguucucuaagcuucauacucaugacacaucuucuuuucauaaaucuuauaugaccagagccuguagucucccugagagcucucuugggagugaacgcuuccagaacuuuugaaaucauuguacaaauauagugucugugaucuuguuagcuggagucuccauccuaucacuugugaaugauuugguuagaaaaguuguauugaaaagaaauuagcagcaauacaaauaagccagcagaucuguggucugugagguuuuaggcuuaguccccuccugguuuugucuccuuugagcauugucuauaauuaaggaaauugcaacuagauagugccuuuucgguccaauaauguacaacccuccacuucacugggaucaguuggcuuacuuuacaauguuguuuuugccacugugaucaaaacuuaugaaucauuuacuucagggccauugcguagauauugguuuggguguccuaucaacacaggaauugaggagccaaguuugaaugacguaggaaaguuuaauaaaucuuggcaaucuuuuuuuccagacacugagacaugugacuauggcuggcacaaauuccaaggacagugcuacaaguacuuugcucaucgacgcacaugggaugcugcugaaagggagugucgccugcagggugcccaccucacaagcauccuuucucaugaggaacaaauguuugugaaucguauguacuagacaugaauuauuuggaaauucacucauuuuuaccacuaucguagcuuucuuuggaacccaguuuaucguaauuuucucagucuucauucaguuuaugaagucucuuaccuugaacuacaaaaaaucaaccauauggcuguuugauuuaagaggaucuucagaucuaguacaagaagucacugcuuagcauaccagcaguaagagguggaacagaagcauauagguugaagcauaagcaguugcuauuugaucuuuuucuuccuuacacaaaggucgauuuuuuuaauggcucaauauaguuaucacaacuaguuaacaccauuucuauuuugaauauuuccaugugaugucaaaguuaagcauaaaguuguuuugaggcuuuugguuuuuuguuuuuguaaauuaaaaaauugagucaugcauaccaguccuccuccagugguuucaugacuuuagaaaaugagcugccugucaugaucacaaagaugugaugacugaaagcuaauaaagucuaauacuugugcuguuuucuggcaucugaacccagaggaaagagggguagcuaggguuuuuuuuuuuuuuuuuaauagcaaauugcuaggacgacugugcucaaaaagcauaguuugacacucaauuaaauguaucccuacaaugccuucuauccuucugaaauauuuuuguuaauucacaaucuggguauaguuucuuuaacuuuauugcaugguauuuuaacuagugacucaugucaugauaaguaccuuugaaagugauuauuuucacaacuauuugaccuucguggucauuguuuuucaaagagaggcguguuuuucccaagugagagagaaucuuuaucauccaguauauuucagagggccacuaaaucuuugccaauggcauugauuaacaggagaaguacauggauacuuucuaucaugaauaaagauagaaaauacuuaauuacagggaauuucuagggaaaugauuuccucugauauuuuaauguuuugauggugauugaaaaugugcuuguuaaguuugagucugauguugggucuucaucaaucacauaguaaggucucaucuugguugucaacuugacacacguggaaagauggaaucuuagcugaagaauugccaccauuagauugaucuacuugcacguuugugggacacauucuugacuguaauuugauaugggaggguuuggccuaggacagacaguacagucguuaagaaaguggucugugcuauaaaagaaagcuagcugguccuaaaauaaagauagagaccaagcaacuaagcaguauuccuucaugguuugucucaauuuaugcuugagcacuuauuuuaauuuucuccaaugauguauuuuggcuuagauauguaagccuaauaaacccuuaccucccuucccacucuaccccccaaaaagaaaaugcgcuucuuaacuuaaugccaaauuggguagaugaaaaaaaaaaagaaucaaucgggaaagacuuuuuuuuuuuuuuuuaugaacaacgaauuaaaaaaucagauaagaggauuuguaacucacucucauaauaaaauuuuuugaaauaguacuuuugaaccgugauaaaacauauguuguugucccuuaggugugggccaugauuaccaguggaucggccucaaugacaagauguuugaacaugacuuccgcuggacugacggcagugcacugguaagaugcugauggaagugaaacaucagugcaugaugcacuaguuuaugucauaguaagcaaugggcgggcuacggucccuucuugacacaaggauggauuacagaacucuuuagaaccacauuggcuagucaucaguggccucucucagaacuguggcacucuuuaagaagacuagagaagacugugugggaaggggaggcaaugagaguugugcuggaucgugguuaucuuagccuuuuuaguuucagagcauaaaggaaaacaauaaacauaagagaggcaagacagucuuuuacaaguacauuuuuuucuuuuuacacaauccccaggaaauucuacuauaaagcacggcucauuuuuaauuagaaaaaaaaaaaaguucgacuuuaaaguaaggaauuuacaaucuuauaaauuuuauuccauuuuaacccugcugaauaaucuuuauuuauuuauuacuuauuuccauuucuuaacauaagaaauacagcuuagaaauacuggcuacauuaagucugcuuaaacuucuguaguuuuuguuuuguuuguauuuuguuugcuuuuccuuguguucuuuguuuuguuuuuaggaaggguuuacugcauaagucagguugcccugccacucacuauguaguacacuaaguccuuaaaucucaauggguaaagcuguuuugagugaugggcaguaaacacaagagaaccuagugguuuaguacuagccauguugugaucugccacacucgccauguucagugacccugcucuuaacugccacuuggggagaguaauuaaacaccuugaccaaggcucagaccagguguauucuagcuaaacgcccagcagcugcaguucuuggucaauccccagguguuucugaaauggcaucaacacugagauccauucagcuggccaauaaauguaaauuaaguucuaaauugauaaagggggaaagccauuaagaauucuuaaaauuuaaauuuaagcucuaguaugugaauuaauuaugugcuuaaaauuuuacuuacugccuaugagucaucuggauuuguguuuggcacaaggacaggguaauucuggaaucagccaggaacuacucuuugcauuuggaagcucuguucuguccaagauucuucucugaacucugagggcuuguuguacaccuggguauagguguccacugaguuuaccuguuagguugacuucuuuguucagagucagaaaacuguugauacaagaccauuaccugagcucaggacugugcuaucugagccaaaauuucuggcccaucuuucuuugauguaaauaacagcauaauuuguuaggauuuuuauugaguagcucucaauaaagcucugcuagucccugcucuguuaucaguaugcauauaaaauaucaguauguauauaaaauuggcacuacuugucacugaagcucauaaguagguuuucagcaagaauuuuuuuuuucuacaugacagaaaaaauuuucagggaggcaagauuuauguugcucccugguuucagagaguuuuagcccacuguagcugggagggcauggaagaauaguugauaauggcaggaguguggugaauucuuacaucacugcagcucaggaagcagaaggcagcuggugcagggaccaggcaauaaccuucaaagucccauuauaaccacucacucugccagcuagguccuacuuucuaaagguuuaccaacuccacccagguaauaguccuucuggcuagcaagcauucaagugaucggcuggagggaaacauuucagaaguaaauuauaacaguauuaguuaaaauaggcauugagcuuuaacgcuuucccuuauuggauucugaugcaauaaacugagucccaugauagucucuaguuaagucuaacgauuacauuuuuuuucccuuaucaaaaccucauagagaagugcagauccuuguaggcugcugucuuuagaagagaaacaagaaugcucaagacucagucuguaacguugcaucgccacuacauguguacuguagaucugagccacuaccccucccccucccccuuauuuuuauuuccugucacaucuugaauaaagccuauauuucuuaaccauguaaaucagcuuuaaaaggccagauuggccucucucuggcaaguauauaaaguauuaaaaacaucuaagaaaauguaacuucucagguuagcuugagauaucauuauucuacuacugcucaagaaagugaaucagcucccuuuuguucaugucuguuaccuuuuuauuuauugaaugucccuugacaauuucauucguauguacuucuauagugcauuuguauuacucauucugauauccuuucuuuucucccucuuucaucuuuucucccccugucaucuuuccuuuucucuauagaucccuuucccacguucacgucuuuuuaucuuguuuugugacacaaugaguuuaacaagaguggccugugugaccuugaauuaagaacuaugcauugaagucucgugugcucuccacuggguacacaacuggagacaaugauuguaucuucccugaaccuagcaguagccaacuuucaggagagggagauagggcucuagagagagagagacccuccuggaugcacacaugacugucaacagacccagacuugagaaggcccaguguaggcagccacagcugcuaugauaccauauuugcaauggcugugccaugcccagaagauaaaauuuuucaacugucuuccuaucuucucccuuuaaugauuuuucugccugaucugugcccauaaauauuucauguaggcagaaagaucuuguuaaauuaaucuaaauauuauuucuacauuuaauauggucucaaaacaguaaauuguugagcauugcacuuuuucaaaagagaaauaucugauugggauauuuugaagggaaaacagaguaacguaacauaauaaccaugaagcaucaauggagccugugucuuaacaauucacacauaucauuaaagucuuagggcuaagccuugccuaagaggcuuuguuuugaagaaggcagcaaacgaaccauguaagcaaguaagguuuaucaaagaaaugauaaaaguacauccaggacaaacugaugcacccuugguuuccucuuaauccagucuuugugucaaguaaauaaaaacaugcuaaggagugucccccgacuuugaacauuugggaacagaagaacacagcugcccaccagucugccuacuuuugacugaucucuggcccacuuuucuccuuuuggauccgcccuuuccucuguccucuguuucuuuccucuguuucuuucugagacagccuaggugucuccuaaacaugcuccuagcucuccuuaacaaguuccauaugugugcaggcuauuggcucaaagcuccccuuuguuucacuguuuauuccaagguuuucugccuuugaccaugucccauauaauggucaagucuucuuuugggaaaacaguaucugcuuacacuuggggaaagugaaucacccaugguaguuucaaggacuuuguuucugcauuagggugcuuccucuccacuuccauucucucacacauguuugacaguugucagagugaugugucuugggagguaagagugguaucaaaagaagcacagcauuugcuauuuaucuaauacuaucuuuugcuauucaguauccaggaauaauuaguauaauccaggauauaaaguuuaauuagaucugugucaauuauuucauuuauugaaguaaacuuugugucuaauaagcucaaaguacaaucauauaauauucaacaucuuacuucauagcuagacuaauucaauucauguguuugugcuaaauuagugaugcugucuggcuaagucaucagaauugccuguauuacucagauuuugauuaauccuuacauuuuacuggccccuguaauaagauuuugcaauauugauaaaaggccaaauucuuguuuauguugaaaaaucuuuucauuauuuauucgggguguuugcccaaugacuuugacaaaauauauuucugaauacaauaguauccaagcuucucuuguaauucauguuuccguuguuauuuuucuuagcacauuucaguuuucacuuuguuucuuggcauuuuccuagucaguucgucccuaucaucaucucugacagcccagcacaccauguacuuuauuaaaaacuggcaaaugacaugggcugggaauuccucuccuugucaacuuacuuacaugcaaagcccuuaaguuaaacccuucaaguuaaacauacauugaagcccaagaacugcaacaaacuuuccuuaucaggcaguuagacugcuagcugaccuggagguuuuuuuuuuuguuuugcuuuuguauuucauugaccaauuguuaaaugaaugacuggucucaaguguuuccccugagauggguuuccuggugucauugacaggccaucaucucucuccacuacucccaguuucccauaucuccugucucauccagaggcagccucuuucugucucucaauagaaaacaaauagguaacuaugggguaauaauaauaaaguaaaauauaauaaaauaaaaaguaacauauuaggguagggcaaaaugaacaaguagaaggaaaauagcccaagagaaggcaaaagaaacagagaccaauucauucuuauauucaggaaucucauaaaaacacuaaacuugaagcuauaauguauacacaaaggaccuuggaguaaaauagagaagaaaaagaaaacacaaauaaaauaaaauaauaaauagacaaaaucuuaacaacuuggagaggguggugggugggggggaugagcagaccccagacaugacauuaugagaagacauaucuccaaagauguaguugaguuuauuuucugcugucuaauguugggcaugcagccccacuuaagaaugguuuguuucccuugacaaaaacuuaauuuucaauuagaagugguuuuuaauuggacauagcuucugcauuagggaugggcauaugcccacuuccccuuuaagaucuaggacccucuuugguguagaccugugcagacccucuguauacugccucagucucugagaguuccuauguauccugaucauguuuauuuagaaggccuuguuuucuuggcauucuccacccccucuggccuguauacucuucuucuccccugugguaugccuugggaccuuagggaacacauuugauggaucaucccacuuaggacugauacuccuuucuuaagauuauucauucagcucccugauuucuauauaaaauucuauuauuaacacugcaaagcucaccaccuucauuugcuauacuuuaagauaugauauuuuaacacuacagauuugaggagaaagaccauugacaacaaaucauggucaaauuaauuaaaacacucauuuauucauuugcauggcauggagugccucucccuaaggcaggguucaacagaucagcauuggacauagggaagauaaaagguuuuauagcucaggaguaggggguuacuaaauggggcauuuggccagcaaaaaagaugggguuacagaagaaaccauaagcauaacaaguuggucauaacaaccucuggaaacagacauguuugaaaggugacagaccauuuauaguuaaggucacagguaaggcauagcaaaauuccugagagauagagauuuaaucauaaaugggaauaaaucuaguuuaucuuuauuauaagaugguuuucaagcccaagauggagggaugcagguugguuugucccaucucuuaguaaaucaugaccucuuacuauucguaguuucauagauuugcccugaugauaggcauguucuaaacucuugcucuaauuucaucucaagacacuugaauaucuucuaagauacacuuccugcuucuccaacaagggguuagaauuuaagcuuuggaucuuagauuuaagacugcuaccauauuuauuuguguuuauuuuuauuugacaucccaggaauaauguucuuauaagagaaugggacuuuccagaguaugcauuaauuucacagugauuagucauauaucccucccucuccacccuccaccaucccucuugcccccaucaccacccccauccucaguagcaucuacucaucagaggcuuggacgaaacuauuucaaaggaaaugucucuuuggaauguuguuguccagaaauuaagcaaggagcugaacugagaauucacuuccuuauaaaauucaagaaaguuucagaaagucuagcuuaaaagaaaaagauucuaguuuuuuguuuguuuguuuguuuguuugucguuguuguucuuuuguuguuguuguugcaauuuuuaagaaucuuucacuccagugaaagauuugcuuuggccaugguaugugggaagcccuccuaggccauuggcaucuuugaguuuaggaagucaucacugauuucucuuuuacucuccagucaacuguagggaggauauagagguuuccucaaauagguguguuuuucagucuguuuaguaaauucuagaauacguuuacugaaucauagggauaucaugucacauuccuaauuuuaaucuucuuagcuuguacuugguaguuauguuauagacugaguagguuaauuaauauuauaauuauuuuuaauuaacucuuuuaugaaaaauccauuuaacaucuuucuaugagauuacugaauccucuuccucauuuuaguaagugugacucagucuugucaagcuaaugcagcuacaaauuccaaacccuucucccuuccccaccaaccuauuauuagaguugugacacagaaagagccacauugauguggguuugccuuuaaauuacuguuuucuuuuuugagacuggguuuugcuaugaaucccuggcugucuuggaacucacuuuguagaccaggcuaaccucaaacucagagagaucugcuuaccuuugccuccugagugcugggauuaaaggugugcaccaccacugccaggcugggucugcuuucaaauucagagguacuuuguccuuuuucauaaaauauacagaucagucugucaagcaauucaguuugagagauaguuuuggaaagaagaaaaauaaugcaauaauagcccauaaccuagaaaagacauuuuaaagggacagacaaaauuaguaguaagucacaacugauaaaccauuacucuuuuuucugcagugagguaccauuaccauucuuuccagagacgaaagacauuucuugggcaaugaaagagaacuggaggugcuaacaauucagagacgugggcugcacuuguuuguaucuuucuaaccucaacgaagggguggcccugauuuggcaggaaaugacucaaaagagaacccucacauauauauuuuuccaaacuuaaguuuuucaaaguaucaaguagaaagaacuuuaaauguuuucacacaaagagaugauaaauguuugaggugaccaguuacucuaaugguaucauuucagcacauugguauugaaauaucauacuauauuguacaacauguauuuugugugucaguuagauuuaacaacauuuuaaaaauuaucucccacaacagaaccuugaagucuuuaagaaccugggaagucuuagacggcuuucuuugagauacuuguagaugcuucaucugugaugugguuuuacuuccaagccaagagccacauuuuuuguucacuuugugaacaagucacacugcaugucaguauuaauuuaauuauguuaaacuuugcgggcuucguuauauuagccccaaagccaagaaaaacauaugcucuuuccucagccuauuauucaugaauagaagacuuuagauuucuuucugcuaaagaccacuacguuguuaaugaaaaauuuuacuucuguugugguuuaauuugauuggaaucaacagcuguuucuucugaacuuacauucaggauguuaugagucacuguguaguccuagaacauaaaacucuugucuauaccuuuugcucuuguugcuuagaugucuaaugauggguuuaaauugcugaaguacaguguuugccaccacuggaaaaucaucuuguaauugacaaguuuacccugcaagugaagaaaacuuaaugaaugcaggaggccccuuagcacugcuucaugaaacuuuagaaucaugugcacauguuuaaauuuaacugcuaauuaguuuaaggcaaugcacaaccauggaaaaagcaaagaaaaugaaguugaaugguuuuuggcacuuucucuggcauuugguuccuuagcauuucaugacugacgacuugugcaaacaagcuugaguggaggcgcccacuggcacagugcuuugcguggauuaagugcauguugcuccuagaggcucugcuuggggccccugucucacagugggaguaacuuacaucccucuggaaagacuguugauaauuauugcuuugucaguuagugagcucacagcauuucacaagauuagugcuguacucaagaguggccagauugucuccccugcacagaacucugccagcuaggaaaauaaugggcacguugccgcuuuaacagcuauccagagaccccacguuaauuuuccuucccuucaguauacugaguuugguagaauccaacugcaggcuuccaguggguagugaugccugaacaaacgucucuuucuccuuugaaacaaagcugcucuuuucuucuucgguugugggcucaacuaaugauaacagaaaaaccauaaccuccuguaaaauguaaauaaaucaggacccagaccagagagcauggauuaggagagccugagaucuaccuugcagggacggcauuugccucacucaaggagaacaguuaaauguguccccugcaggcuacaaacuaaugacuauuguguacuagagcuacccaggaaggaaagauguuuugaguuuuguaauaagaagcucccauggccuuuguuuucuucagauaacgauuuguucuguauucuggaacauacaguugacucaagugauuaccuaguggcaagcuaacugcuaucaguguguguaugcauguccaugugugugcuuguguggauguaugcuccuguguguguguguguguguguguguguguguguguguguguguguucuagguggguacacaggcucuugauaaaguauuuuuguauaugcaacuugcuuguauucucuggagauagucuucuuggccuuggugacaugggcuauauuagggcuuuguggcucucagaguccaauagugguuuaaugggucccagguggaaaaaaaaaaaagaguuuacacaagucagcuuguaguauaggugugauauuuucagaauguaacuuugcagauucauacagcaugcauuugauuuuugugcacuggggcauaauuauuuauugguccuacucuaaagauauugaguagaucuaccagacaugauuauaccgugucugaugaacugucacuguugauguaaaucauuagaugcuauucauagaaacaugaaaaaacaagcuuuuguagugcucgucuuagguagaaaagucagaugagagcuguaauagucaauagcagaauaggauggaacuagaaaauauagccuaucuauuuguaaaaaaaucacaaaacuaggagcacaugccacaguggaggucaugccacaguggaggacaugccacagaggaggacaugccacagaugacacuuuaauuuuuauucugcagguggaguuaauaauugugauucuauauccugugcuggcacucaaaguacuaccauauugagcagucuaugucaccaccugguggucacauuaugcuuuguauuuuuauaugaacagcacuagugucugcagggguguuguuuagguucguauagcuuugaaauguauaauauuguaagcccaauaguuaaaugcaaaaugagaugauuugcaagcacaguaggaaacuaacagguaccuuaagcuucauaaaauccuggcaguuaagguuaaaauuagccccguucuuucuugaaccuucacuuuuacacacuguaauagaagccaacaggucacuuccuugacuuuucuucuuggcaggugaaccaagaagauuucuguaguuuaguauacaaacuuuucuucuguaaauuaaauuaucuguguuuggagcaaaaaggaagacgaagagcugugauugaauuuuuuauggaauauaaauaaaaauuaaaguugaaaauuuaaucaauuucucccaaaauuaucccugaaaaggugucaaguuacuuuuaucaauaggguauguaugauauuuaaauguuuuuagcaccaucaaaauaguuccaaaacauaguauucaauuagcuacuccaggaaauccaaaguauugugaauuuuaaaguauaaaacaugaugacaucugagcugaagaauuauagcuaaauaucugguuggauacagagacaauacaaaagggaccugacagucacagauucaagauuuacaaugccagugauaugugagauacccagaaacacaauuguuagcuguccaggaagagaggccaacauuuacaaagugugcaauugguuuucaaggaugucugcauaauagacaucucagacuucccaccucacuggggaauauguuugacugcucuucuggccauugugguucaucucuaauagauuuaagcagaauuaaucuguuacacaagucuguucgaauaaagacauccucacauccaucaaaugcaugccuacucccugcagaguucagaauaggaagacaaaagaugauauuugaucuccuuguuuaccaagugggugcugggaaccaaaccugggucagcucuaagagcaacagguagucuuaaguacugacccaucucucuagccucauauugaacauuuaaaaauucuaugaauuccuucaccuuguguccuaagaguucugauauuccgauugaaauucaccuaucuuaaagauaauauauuagacuacuuacugccacuuuaaaaauaaaugcuuuauuaacgcuuugagaauuuuauacaacauguuuugaucauauucaugcccacucauuuccuaaauucacuugaaauauuuuuauauauuuucugguaaauuuacacauggagauaguacuuguagaucauauuccugcuucccaacuccucccagacacucuaccuugugcuucuucuuuuuuuuuuuuuuuugagacaggguuucucuguguagcccuggcuguccuggaacucacuuuguagaccaggcuggccucaaacucagaaauccgccugccucugccucccgagugcugggacuaaaggcgugcgccaccacaucgagcuccuugugcuucuuuugacuucuuucagaaauucuaguguauacauacgacaaccucacaaaaacaaaccccaaaacaaaaacaaagacaaaaaacacaccaaaaaaaaaaaaaaaaaacacugaaaaucuaaaaagucaaagaacaacaagacaaaacaaaaccaaaaaacacaaauauuauuuugaaguagugcauugggagaaggugaaccagcuuaugcuuaagagccucucuuacaccugucugguccuccuugcuacccagacauucacacaguuccccagaguuaauuggucuuuauuugugccaaucaaugcagcaacaguuaaugccugauagauaaccuuguauucuuucuucuaaugaaagcaggacuuaaagcagaacccaaaccuacucccccuccccuuuuaaggaauagaggaaacuucuugcuuauuccuaagucuuacauaagucuacaaaaagguuuuaauaguccuuuguaaagaggcaguuauuuguuuuuguguauggaaaggugaauuaaguaaaguacauugcuuggguuggauuguucaugacugggacacugauuaauugcugagauuuugauaucauugaugaugaucaugugucacauauuuuaaaagaugaaauaucauguacuagguauaaauggguauuugacccucuagacuccauauaugguuaugcacgacaagauuccccuuguaauccauuauugaaaauugcucaaagcuaacucugccucccauccaacccugucagucagcccaccugccaugcugacugagacagguggaggaacuccagacaugggcaagaaaacuaauucugcacccauucagagagcaacccauucaguugcuuucaaacaggagguccuucccugagggguuaggaugcugccaggcugggaugucaugugggcugcagauaaccagcaggacaauuuugacaagaaauguaagcauuuauaauuugguauauacuuagaugaauaacuuuagucugcucugaauuuuuucccagaaauaguuggguugguuugaaacagcuuuccuguauguggagacaaguuuugugcaauagacucaugcuuauuauuagcuguuggaguucagccaggguuuuuucaaccauuuuauuauuuugguaggugauauauuugaauucggggggggggugcaguaacugaaaaguaacugaauuuaauugaauugaaauguuugucacgugagaacuuguuuugcagguauagagagcuagcugguuaguuaguuggaacuccuagaguaauuuugucauaugauauaaagcauuaaacaauuucauacugggucaaauuaucuuuuuuuaaaacagaagaaacauuuacaucugacuugacauuccuuuacaucaacacuuugaguuuaugccauuuuuuuuuuccuuuuccaucagaugagaaugaaagaacaaaauaauuugaacauuuucucucaaggcaacaggaguucaggguagugagaaagcagcgucucagagacauaacucuuuagacacuuuggccagcaccuauuguggguaaagauuuugaagacaguuuucuuaacccaugcuggcuucuuagaauaacuccugcuuugccaauccaacacuaggagcagguugaguuggguuaguucggaggagaucacccaagacuacaaggcaaguuugaagcuugccugaacuaugugguaagaacuuacuuuaaaugcacaaagcaaacacacacacacacacacacacacacacacacacacagagagagagagagagagagagagagagagagagagagagagagagagagagagaauaacaacaaagcaaaacagguaaacaccaacagccaagaugcuuguucauaacuccaagugaaaaaaaauucacaugggaggugcuguuucuuuuucucuguuuauuuaaauaauccucacuuuguuacuagaaauagggaaagugagagcuuacauuuuuauaacuggaucuauuucaggaaggauaucuccuaauauuaaauguuagugaaaaauacauuauugaaucuacagucaaguuuuaucuauuuuuacucacuugccauaaaaguuaaauaugcaaaaaaaaaaaaaagauuaaaacagcaaaccugagacaauuuggcaacaagaugaacaaauucaaaucacccuaaccaaggugaaagacacuacugagauaugagcagguguuagugaaacaccccuguaggcauuagacauucuuuuagaagccacagaacaaaaaccugguccugcacaauugagccagagcugccagacaacaaaaacacacauuuugaaacauugcucggugccagaugcaauucucagcaaagacaauuacaucuuuuuguuuguuuguuuaagccccaagaagcuuuucucuggcauagaagucuaaugaauuucagugugagaauggccccagugcucaucagaacaguagguaaugucagcuagaagcacagagcuguugggggacguugggacggugaaguggcaucugcugaggccuguuuccaccagcuuggcuagaaucugugaauacuauugauaaauguagguaauuucauaauauuugcuuucacugauuagaaacguagcuguucauacuuuguagaauuuauaaaguauggaaaacucagugucagagcacuuauagaaacucgauacgguuuuucuggauuuugguuuggucuuuuaugcacaucaaauggcaucugaaaugaugugugaguuugguauuagccuauaucuuaguuuauauuucuuugaauaguuuucaaagauaaaauauuuaaugauuauauaauauucuuuuccuggccacaccaaaauuuauucaaaauauggucuuccuauauaauggcuuccacuaaacuucccuauaaagaguacuugccuaucuuuuguaaggcuacauuauuuagaacacaauuguagauccauacuuuugaguuucuugauagguauugucaagcauuuucagaaaguuuaauucuacuggcugaauuaugacugcagucucccuauaaaauaccaccaggacagagaucccacauauucgguaguguguuaacuguaccaaaaaaaaaaaaaaaacaaaaaaaaaaacaauguagaguuuaaaaggaaaucguacacagccuuacauuguaauuuuuucuuuaaaaggggugaguuguguacaggggggucaaaugcuuuuuagacaaggaaaaaacugccagaaccaacuuauucauccccaucuucuuuuucaucuuccccuucuuccuccucuucuucauccauuuaaucuucaucaucaucuuccucuucgcucuuuuucuugcuccuuucagccuugaccacccccauuugacugcauugggguuuccuuuagcucuguaggcagcaauauccuucuaguacuucuccuucagcuuggcggccuucuucucauagggcugcuugucaucugauggaguguucuuucacaucuuuucuaguuucuuugcaacaucaccaaugcauaagccaggauguuugccuuugauuuuggggggguacucagaacaaaacaaaaagaaggccaaaggaggccucuugcauuuguugggguccuugaacuucuuuuuggucuuuccuuugguggcaggggcagauaaggguuuucauuucuccuucauaacgagccuauucugucuuugccaugucuucaaauuaacuuuuuucuuuagcagacaugguuuuucaccucucugaguacuucuugcuucuucuugugcuccuccuggcccauuugcacaaagaaugcaugaguacauuuugcgucucggcuucuuaggaucuccuuugccggugcuuaguugauguuccuccgcaaggcacacaguugucuagugcccguauggcucucucuugucccacgcugucucuaaggaacucaauguacuguaaagguucaguacauuucuucaacaaauucuuuacucaauuucaaaccaaagaugcauuuaaaauugaauuucaagaaacacuaacccaucuguguuuccucagagacugucacuucgccuguaaauccgaguuugcauuuucuaccagguucaggagacuucuuaguacugcuccuauugcuacacaugaauuagucuuacuagucguacacaugguuaagacacuacacuugguaaagcucaggaguaagucuagaaaaaaaaucauaaucaauuaaaaagacacugaaacuuuuguguuucauuucugcuguuauaacaaucaacaguaagauaaugauguacuuuguucaauugggcacaaauugaguauuuagaaagcuagguuaacuacaccuagacauuucucaaggacauuucacugacaaaguauagcuauuuguuaaacagagccguugagauacauauauuuuccacaaagaguuugaaaguauuuaccaugaaaauaaguucaguucugugaauagaaauugcugaguccauuccaaucagauagccacugggguucagacucuugaguauuuauuuuucuucugucuccauuuguacagcaauaugagaacuggagacccaaccagccagacaguuucuuuucugcaggagaagacugcguugugaucauuuggcaugaaaauggucaguggaaugacguccccugcaauuaccaccucaccuacacuugcaagaagggaacagguaaggaggguugcugcuuggcacuaaaucugcauaucaauagguagcugagucaggaagccaagguuucaccuucagaggugcaaauuagaccugcucuguccuuucuuguugccuaaggcuguuuugcugucccaauagaaugaaagaguuuguuuucaguauuauccuuacuuuagauuucagguuuuuaagguaaaaagguggcauuuauacaggcaaacuguccauaucaacuuuaagaaauugcuggccaaagaccuguagacauuuuuuauccuggugaagaggauacagcaaaacuguugcaaguaucaugcagugggcaguauuguuuuuguaggaagaucuggaacccuggcuccuguucaagugcuucaguugacugagacuauagagcugagaaacugcucuagaggggguuacaggcuccuauucacuacaguuuucaucccaaguauuuacuguuuuuacuaauugcuuaaaauuuguccacauuugaacauuuguaagcauucccuaagagguuuauuuucuaaauaguaguccaugggacaaaacugucaucccuaugccuguaauugagugccuucaacauuugauaaacaaggccauugguaaaguaaguuucagaaugagaauugauugguuaauguuaagcagggaaaaaaaaaaaacaaaaccaaaaacaaacuaauaccaagaaaguugaguuugaaguuuauguuauguuugccaaugacuaauauggaguauagcuguauaaucauuuuucuaaagcaauggacaucccauaagagaauacuacuagugauaaugauuuuaaagcauggauaucucauuccuagggcaaccaagaccuaccucaagaaagaaugcaaauuauaaaauacauuugaacugucuuugaauuaaaacauaauagaacaugugcagagugugugugugauaaaaauuauagggaagacuuaacaucuacaacaaaucguguggggagagagaauauuaagaucucucauccaggguagcauuuauccucaaugccuuaucuccauaagaagcuuucugcuugugcaucucuucagcucuucugcagggaacugguaaaaauggcaaucugaguguuugcuguuuucccuuuuccuggauaacaagucuuuaauaaacuguuugucuuuaucaaauguuguguuugccuucugugaccucugagugguuccagcaucaugcuuuucauuguuguguuuucuaagcuuguuuguccuauagcaguuucacuacagcaacaacguugacacuuugagcagggcauauaucuuugcugugauagacaguacaguuugucaagaauacuucaggcccucugugugaugaauaccagcuguacucuugccuccauauucccuccucacugugccaaucagaagacucuacucaugaacauagucuguaggggcagguacaguuuagagagaaagaaaaaugguugagaacuucaguuuuaaagcuaagaaaguuuuguguaacauguguuaaauuucccaauguggaaugaguuuuuguuuuguuuuguuuuguggaaugauuuuugaaggaugcuaacaguacuucauuaaagaauggauuuuucucucauggcucuagaaaaguuuuauaaugucaauguugacaggcuuuuaaaauggucucuaagguacuuuauacacucauaagccuacaggcucaaguaguucuucuaauuauuugcagguaaaaugcuuaauauuuugaaaagcagcauuucuaagagaacaccuuccuucacaucucucgaccaucuuguugguguuuccuagucaaaauuccuaccugagauaaugacuuggauucuuugcuuuuuccuguaacauuauccuaaaacaauacaguauuuguuuccaauuuuuugaagcuuacguaaaucauauuauauauguaauauguaccuugcuuuuuuucuacucugccuaguuguugagauuuaucaauaugaauguauguagcuguacauucucugcuuuuacugcuguguaagucguucaugagcacgacuacauuuuauugauuaguuuccuugccagugaauauguagacugcagucaguguuuuuacucuucuaaauaauguuucuaugaauauuccuaaacuugcuuuugguagacuuccaugaguuuugguaggacauacuuccaggagugaagaagcugaaacauuuauauguaucuuaacauauuuacuagcaaaugccaaauuacaucccaaacuuguaguaacuuccacucccaacagccaggugugagaggcccugacacuucacuucuccaacauuugauauuauuggacuugagauaugggccagguugguggguaugaaauauuauccuuuuuuauuuaacucacacuuucuugguuauuuguugacuauauuuucauguauuuauuuguuauuuguagaucuucuuuaguacauuuuuuuauucgugacuuuucuuuaacuuuaguaauugauuccucucuccuauuaugauuuguaggguucuuauuacauccucauuucuaaucccuugacaguuauauaguuuauaaauauauucuccuaguuuguaguguuuuuuuuacucucauauuauguguuuuggugaagauaauucauauuuauuaauguuacuuuguuauuucagcuuuuuugugcuuuaaaaguaagucuuuaugaaucguaaaucauaaagauauuugguauuguuugcugaauguuuuauaacuuugccauuuguguuuguguguuuaagcuaccuagaacuggcuuuccauguguucugugagguagggaagcaaauauauuuugucauaugaguaugcaauuguucauguucuaagacugccuccucuacuccucugcuauguucucaaauauaagcuuauguguuuggacuaauuccauccuagcuucuuagccuugccacuaccauauugaacugaauuauuuuagcuuugcaaaaauaaucuuuacauauaaauaguuuugaggaaaucagucaauuauuuuuaaaacugaugaaaaauaaauucagcuucugauuuaucaguacaauacagaaccacauacaaucaauuaucuaguugauuauuuuaaucuucgcuaucaccauagccucccucuaccuuaugcuuguaaguaucagagucguaguauagcuuuuaauauuaugauaaaugcaguguguagguugaauaaagcagaaguaaaucaaaauuaaacccgaauuugucauucaaaaacaauauuaacaagauuaaacaaaucuaauauagauuaaacaaaucuaauauagauuaaacaaauguaaucauuuaaaguguaacauauuaagauuuugaaguauaaacuccauaggcauucccaauuucuggugugcaggaagccuaggucagucaguccccguagcuacacagaccaggcauauagcaugugauugugauaucgaugugugggaaguagaggaagaaugaccagggauucauuguuaucuuuuacugcacagugaauucaaaaccagccugggcuauaugacacucuaucucaaacaacugacaggcagaaagauagacagacaguccugaggcaagaacauuguccacucuucucuguuuuaguauagaauauguaggaccagguaacauuuuauuuauaccucgaaguguaugucuauauuucaagucaaugguguuaaagauuauucugcuuuugcuuuguuuuuuuuuuuuuuuuuuguggcuuuuuuuuuuuuucugggaagugauagugagaguuuacuauuggaaauacaucauugcuccaacucaagaugguuaauaaaagaugagagauaauaaggacgagaauauuaauaggcugcucacugauguuaggugcuuuuuacucuggagauauuuuuuaaaagugacuuuguagauggccauuuagugauauuucauuuuaauacaaauacaacucaaaaugacaugaucugagauaaaaauguacauccagagccucaaucuaaacauuuaaaauuauuuucauucuaaaguucgauaucaaugccuuuuacaaagguauaugauugaggcucugagguguuacaguaaagaaauagagcaagauuaauucugaugcuugcacuaguugaaaugcuuagauuucuugaaaauaacgcaauuugcuuuuucuuaguugcuugcggccaacccccuguuguagaaaaugccaagaccuuuggaaagaugaaaccacgcuaugaaaucaacuccuugauuagauaucacugcaaagaugguuucauucagcgacaccuuccaacuauccggugccuaggaaacgggagaugggcaaugccuaaaauaaccugcaugaaccguaagugguccuuuagaaagaacggacagcguugcuuuaacagauacuagacaccuacauuuuaccgcugugguauccguaguuuaggguauggagcaaguaauacuguuguguuuucuucuuucuuuguuuucuuccauguagcaucugcauaccaaaggacuuauucuaagaaauacuuaaaaaauuccucauccgcaaaggacaauucuauaaauacaucaaaacaugagcaucgcuggagccggaggcggcaggaaaccaggcgcugauccuuaaaauggcgaacaugugcuucacucaucauuucagccaaaguccugccuuuccgugccuuuccuaucaccucaagaagaauuagaaguugguuuggauuaugggacugccgucuggucauuugggguggcuguacucuuaaaauauuuucaaugaaacauggaauuuugaaaaagcgaauaaaaugaaagaaaaugaacgaagaagauaaccauuuucagccuaucuaauuucuuuaguucucucaaugccuccagugcagacuguuuccuguacaccagccuacuguacuauuuuaaaaaaacgcaauuucagcaccgauggccauguaaauaagaugauuuaauguugauuuuaauccuguauauaaaauaaaacaucacacucaguucaggcauauuuaaugaugauuaugcagcuuucaaggucuuuaaucguugguuuggcugcuuugcuauagcuugcuuaggcuggaaaugguuuugucuacccuuugacugucagcaaguuugaggacggcuuuucuggacagccagcaaacagcaucuugcaggucucugcacgugugucagccgcgggagccacacugaugccuggcugauuccuggcugaugaaacucucgcucggagcuccaggguguaacuccgcuuugucauguucccuuuucuucacuuacacgaagcgccugaauggaggacuuuucuaugaccuggaacauuuuuuuaggggucaaauugcuaacuauuaacucaaccagguuucauuuacaauggcuuucuuaacacuaacccugguaagguaacagaucaagauauuuggaauggauauagaucaaggguugaggagggugggggaggggguuuucuuaaaacaacaacacucgugcaaaaaaaaaaaacauuuuguacauauaaccauuuuaauucuuuauaaaaaauuugaauguucauguaugaaugcugcaacugcggagcacacguaaauaaaugaaguaagccauacggauuuaauuuauuggauguuauuuuccccaagaccugaaaucaauguaguaugcuaguaauuucucaguguuaccuuuuauauuuucuucacaguuuaaaaccuuauaauauagguacuuccuucuaaguguuuauuacggagaauggaaauguguuuagcuauccauaagugguauuugcccaucccaagcaagugugaaaauguagaauaguguggccauugcuuacuguuagauggaguguaugugcugacguuuucacuucacccuucaccccuugcauuugaauagugguugcugaagaugacaugggaaucauuaucuagauaauuuaaggcucaaaguuaaaacugcucucagaaagaaggcauuuaaggcucauccauucccuucauuuacaacuaacagaaaaggcaaauaaaaccugaacagaaaccagcuuugaaaugacacaaugaaagcaagcauugaagcaucgugcggugucccauaaguauggucagacuuuauguuuuauacaucaggucaaaauauauauucagcaaagaagaguagaggaagagcagacuggaguugguccuauguugacuguuucccaugaaugcuacuuuagcuuagagggaaugacugugcucacaagcauacauagugucuuagacaugguccugggucucagcaguaaauguaauucauccuaauguguacuagagcacagaaaaucacuguguugacuuacuagggcuuuuuuucuuuuucauuacaaugcacauaauacuucccuguauuuauauuauaacauguauaguguaaaaugugaauggcuuuuuuugugaaugaaaaucuaaaaucuuuguaacuuuuuauaucugcuuuuguuucaccaaagaaaccuaaaaauucuucuuuuacuacau

SEQ ID NO: 7149 - RNA, 1837 nt, Mus musculus
auuaauuaauuaauuuagauucacuaaauuuauuuuuaaaaucauaaaacauuucuuacaaaagagcauuacauucugcacacugcucugaacaaauaccaggcacauguggacuauuacuuuccucccugucccaccccccaauguuacagugaccacaaagcaagguguucacaauaauuacauggggggaauuuuuuuuaaaccaccaacaauuaacaaaaaauaaaagucacucacucugcugcuguuucaaaauuucaauguuaguuuuugcaugcccuccccccaacccuguuuguaaggaacuaaaacaugacaucuggugaacagcaaagauuucacuacaccucaaaugcagaacaccuaugaagcagaggaauguuggcuuuuuaaacagaagcagauuaaaaaaaaaaaaaaaaagaugcaggacuccuucaguucuucacuagucuuagaaaaacuuuccagaauacugcuucacauuauaaaaaagaaaaaauaucuugcauuagaauccuucaacaucugcauacugcuucacacuguucugcagcaaauacuguguauucuguaucuggcccuguguuccuguaaugguaaugauccgaucuucagauccaucuaaagguucaucaauuuugauugaugcuccagauucaugacaaauuuguuuaauccgcugaccaccuuuggcaauaauagauccagccaaaucuuugggaauaguuacuuguauagugauaauagguccgccaagaucaccauaugagccacgaccccccugcauaagaauagucauauccagaaccacccugugguucauaagccauuugccauucugaugggcuccaugugucaauugcagagucccaaguuucaucagcacugaacccaaccaugccaucauagcggucuccaggccuuccucuucugucauaagccauuagaucucccccucuggguggugguggaggaagaagaggauuccgggcucugcugccaccccggccaccucgaccaggaggaggugguggagguccucgacaagggcucauaucaucauaaucucuucuagaaggaggcauaggacgcccacccugaccaggaggcauucugucaaaaccaccucuuccccucauggggaaucccacaggucauccucagcggucaucaaacaucauuguaaaaccaccauaaucauaggucucaucauaaaaguugggaucauacgguugugcacguccuuugauaggagacucagauauaaggugaaggaugaucuuaaugcauucuacaacccuaucagguuuuccuccaauaagaacaacucugucaguagagugagggcagcacuccuggaaaagcuugauuguugucugaguguuuucucgaaguucuuugauuuuagcaccuuuaacaccaauuauuccuccugccagacucugaugaaucaacagucucaacucgcaaucaaagucacuuccuuuauaauguugguacuggccaguguuccuggaggagaugacgcugacgucagcaggauucucgauggcaacaauagcucgagcugcgagcaacagcuucucccagguccucuucagguuuaugauguagauaccgucaccuuuccuuuuguagauguacugcuccaucugaaagucaagguccgugccaccuaaguggguucccgcagcaaggaauuugaggacauccuccuccuucaucugcaggacgucaagggcuccggacauuguguaaguuucccuuuaaguuacgaugggaaucaagaacaacgauguauggacccguucccggguagcgcggaaaggca

SEQ ID NO: 7150 - RNA, 44885 nt, Mus musculus
ucccuaccugucuguuugucauuuaauaucccugucacacaaccgcagugcuccaguucaagauagaaggccaaccauagcuaaugcugacucacagugucuacaagauuccccucagcuuagcucagcaguaccuguaggcgcugugccagcucuacuccccucaggaagagaaagguaagcccagcacacugagacauuuuaagagggagcucauauccccaacuuagcauaagcgcauuguuaugaugguucaauuuuauuagagguuauugcgaaucuccaacuuaucaacuagacuucauccaaaguaggcaguauggaaacaaaccuaggacaagugacaacguucugagaguuuauacccauccuggguaagguagauccugcaaacuggaguccauacugucuaugucucaaguaagcuggcuaaaguuacucaaguauuucuguuucuguucaggaaaacauuucaaaaacugaauucaaagaccaagccuacgcauauagcacuuaaaagccucuucauuucagaagucugaaaugauaacacuaaguuacagcaucuuauaagccccuuauuacuaaaucuuuuaccuuguagaauuaaaauauuuccugaaguuguuuuuuaguucuagaauguucuaugcuaugcauuacucuuaugauauauaaauaguaauuuauaaaauuagaacguggucuaaaguucacauacggcugaaccuugagacaaauaaguaagauaaaaacuguagccagccucaaacuauuugagugggcaugugggagcaggccggggagcagaggagaucuggugaggauagcccaaaccugucuccugcucucaacucugauggagguccucuuccauuuguaaaagucauccuuugaaggaggcuaaccugacacauucugcuuggucuuaugaguuaagacacaucaugguguagaaugauaaauguagacgucuaggagauaaaguacuaauggaagagauaugaagaagaagagcucaguuaauauucucucucuaauaucacacuuuacaggugcuuggcgugugcguguauagaaauagauacuaaauuggccaucuaccuggaauauauguaaaaugacaaaagugaagucguucauauuuaaaaaacugauuggauuccauuauguuuuaacgcuuccuaauuuaaaguucuaaaacauggaauauaucuucucaaagacuccugacaaaggugucugccgcccauggacuaauauuaaacacucaucagguuuuagcccaccauuucacguuuuauaaacucaucauugcagaauacacaucgagcuucuguaauccagagccagaugugauaguguugacuaauuuugugccaucuuauagaucaugugauaucguauccaggcaauuuccaagugucaguacaguagggcugugagaucuugugguuuggcuccaaaucaccagaauacacuuuguuuuuucaucucuucauaacugcauuuugcuuaggcugauauuaaaucguuguauggccccaaagcuugccacauaaaagggcuaaggacacauuuggaauuaaauuacagguagcugagaguugaccauuuauaacacacuuuuaaguccaucaggaguagcauucucuaugaauuuuauacaagaggcugcagcuuccucaauggauuuugaccagccaccaauauugccagcaaaguaagggaggaugcugucugacaucugguucagguacguuaccugcaucaaagagaaaauacaguauguugaguuuuuauugacuuggagaacuuucaaguaagagacugaaaauguuggugagugaaucuggaaggaguuaagaggaguccuuagagaggacacacauuauaagacugugaugaauaggagaucugggggagaugaagaggucuuuccauagccaugagaaugaauuaagacacaaauauuucaucaaacauacggugcacgaauugcugucgacagccuggaugagaaacccagcacaaaugaccucacuucugauguacuguggagaugacgggacagacggcagcacaacugaccuuagugccacgguguagguguugcugaaagguaagaacacacguucuaacucuguaggaaugguuguuagacaggacaguucuacaguaacuggcauucauuaaucuaguuuugugauucuuaggauuaaauucagggccuucugcaugcuaggcaaguuauccagugcuggcuacauccucaauccuugggacaaucucauugucucugcaggaguaagcucagaaaaaacagacuugucuggaugagugguccacaucaaaaccccuucucuacaaagcuagggugugagguagcaucacagggcuggcgcugcucauguuguucugugcccgaacagguuguuaugucaguuuucugccauuuuuuuaauuaaaaagaaaagcaacauucaaacaauaaacugauugauacaagagacucagaaauaaaagcaguccuucggucugagccagcuccaauccuauucccugccuugugaaugacuguucuuaauuaccuuuugcuaugcagaucucuauauuuuauuaauggauauaaguagcauuaccaaauacacauguauagauuguuauacuaacauaguuauuuugcaaauacagcccacaacuugauuuucccaccuaaugauaaacauuuugagacauuuuuauauuugugcucccaugacuucuuuauccuuguuggaggucacauaugcucuggguugugaauuuaucaucauuuauaagaucaacaucaauuuauuugcccuauccuuugacauaauagaaggugagcaccuauguacauuaguucacauguguguuggggauuuucuggggugccacucuuuggaucccaugcucugugugguccagcguacaugagaaggccauauucaaauucuggaucauggacccagcacacaguggaccaguuuagauagcuaauacaucagggccuuugugaauucucagucaacgauuagucaccauuccucuugcugacuuuauugauaacaagggguaggucuugaagguuuuucggauauugaaucuaauaucugagcagaagaaagcugcuucagaauguccauggguccuuugcacacagaucacaauacaugaaugcauaucaaaaugggaacuaaagauucauauauuuaaaaacaaacggaugagaugugauugaagacuagaacgccauccaugguggcuuucuugucuucacauccuuuuguuuccagucuccaauagacagagcagagaugucacaugagccaaauauacucacuugucuuugaggggcuuucuucgugacacaagcaccacaaaguccuuggguuugucuccauuuaccaccgagcaagugauguaauauaucugaucguccucgcucaccuggucuauaacuucacaagaucugugugaacaggacaguauucaaacacaugcuuucuaccugcuagaauacacuuuguuuaguuuuuggcaugaccuccuucuugacaucaguauucaccuguugugcugacccauacaugcucucaugcacacacacacacacacacacacagacuuugcuugaaggcugacuuuggaacaagcuguuuguuuagaaggaguaauuuugcaugugauagaaagguaccagcuaccugacuccaaggucauuucccucaaaacuccagaggaagguaauaaucuuuucacaaaacuauuuguuucuaggaacaguaaaaccuguugaggacaaacgggcuguaaagcaggggaugcccaagcccagaggaaagagugugcggggaagaacagcaacucggaagcuaaaccacuuacuuuugagucucgggccacuguguccacuguguacuggccauacuaugucagaaaagucauauuauuaucucaucuguaugauguagauaguacugucuagggggucauugugagaguuaagugcaaacacuuccugcagaccuaccugagugguaagucgauagacaagacaaguuagcugaguuuaagugaaguaacugguuucuccauugauucauauuucauuuagauggaaugccaaggaaacagaauugugagagaggaguaugaaagaaguuguugaaaggcacggcaucuugucuuugagaugcugcagugcucuguauccuaggaagcuaggccugaguguagucugucacugcaaaauauagcauacaaggcucagagcuccauagccaucccuaggacauguggcaacaccaagaccuuuggugcucaagucccuuucauacagugacacaguacuuuuauuauaacauaugcauauccuucaguaugcucuaagucaucucuauaucacuucuguaauacaaaugguauguugauauuugcuauacgauuuaaagaaccaaguaaaaggaaucuguuuuugcuugaugcugacacaacucucuaacacacacacacacacacacacacacaccacccuucaucuaaaguguuuacaugugcagaugcaggggaaugggagcaggguaugacugaucacacaggggagcagcaagcaucaucuucccccaggacucaugcuagcucagcagcgucucacugagacucaugacuuggcaggaagaggguucugggaagauuuuggauaccuccucagaagcaaugaggccagggaguaaagcaaaagagugugugcuacagagccuggcugagcuggaucucagaaacaggaacaaaaucagcuuugagguugucagugauaucacaacagauguggaccaccaaugcuaacucaauacagaugagaaacagaugaguguaauaauuguuuuucuuuuaagucucaugaagcaguuuaggcagaacaagcucuaaaacuucucuacauuucugaaacaauacaccauguaucaagcaguggagaacuacaauugaaguuaucuuucccacaaugccaggcuugauuuaaaaaagacauuuaaauuuguucuuacauguaaugggggucccauaaaggucgcuuugugaggucagacaagagaugauaagcuaugugggcuggacugcccacaagcuuuucaaccuuaacagauauggcaucuugcuccuccaggguauauauuuuuaucuaaaagauaggaagaaaaauuagaagagaaaaaaauauuguuuacuuuaaagacacaacacaaacacacacacacacacacacacacacacacacacacacacauuuaugcacacacaugaaugggcagucauacauccuugccuguaccaaguaaggcaucuauguggucaacaacaaucucacuucaaucuuggaugcuaguucugugacauccaaauaauacaugggcuaguuaauuugcaucauguuuuguuguuguuaaugaaaaauaaagaacaaaagcuuuucucucuugcuuucugugauauuuccugcuuccacacacuaaagacagagaauagcacaggauguuacaccgauccaugucccauuuacccuaagacuggauggcagugcucucccagaauaucagcaugccuucgaguggacuaaaggaacccaggaaacaaaccaacuaucucuaggacaaacaauuucucagaaggacccacagaacauacuucuuuaguguuauuugcuuucugaaucccaaguccaaauucuaauauguaauaucuguuagauaagcaguagucacucgacauauaauaaaacacuaaugccauuucuguggcucugagcuuucuccuucuccuccuccucucccuccuccuccucuucuuccuccuccucucccuccuccuccucuucuuccuccuccucuucuuccuccuccucucccuccucuucuuccuccuccuccucucccuccucuucuuccuccucuuccucuucuuccuccuccucucccuccucuucuuccuccucuuccucuuccuccuccuccucuuccucuuccuccuccuccucucccucuuccuccuccucuucauucuaauuaucagaacuauguguuccaccaagagcacauuuuuauucugcucauuuucuccacuucuuucaggguguuuugaaguuaguguugaaaauuucuaucuuauaaucauuaccaugacaacaggcugugagaagacaaacaugagguuaggacuccaaccacaggaaucaggcaguuggaaagaaaucaagcugugaagagcuggccucuauugaaucauauaucugugucuaaacauaauaucauccuugcuacuagacuaaagaaacaagaaaucacaacuacaguagcuuaggcagcaaacaagugacuacccacuuauguaaacacaucccuuccaagccuuguauaucuuuauuuaguuccagucuaaaaagaaagaccuagcccagccugugagcacuugaugaauacaaacaaauccagguagaacuccaccuggcugccuucagcacagaaccuaaagaagaucuauugguguaaauccagagaggaacuugaaggccagguaucuccagaccuggcucuccaugcacagccaagccaguggaacuggucguacaguugccuugggauugccugcuuuggugaaucaggguguggggacagauugugcuauugggccauacaguugcuuggaguuucacacuccugcccacaaucccaugauagaguccuaaccucuuauaccuuguaaugugacuuuauauggcaauagggucuuugccaauauaauucaccuaacagguuguaucucaauacaguaggcccacuauaacugauguuuuuauagagaagggaagcuagacacagacaugcacacagggaggacaccauguggaaaugaagauagugaugcaccugcaagccaaggagccuauugaccagcacugcucuagaagcugggugagaggugagguacucaucuccucagaagugaccagggugccuacaucuugaucucaggauagcaguuuucacaagggagcuccuauagauuccuauuguuucaguaacccagugaccaguccuccauugugacaaccuuaggaaauuaaaccagcaauuuucuagcaaguugcccuccagcuugcagauauauuuuauccuugagccaaaagaaguagccaccuucuguuuuuauagauggagcucacugguuaagccagcaccaagauccauaguggaugaaugaauggcaucuauuccuucccugagaaguccuucucauuuuccugcuaccugaaccaaugccacagaugcaaaggggacaaagaaaggcagugguccauuuuggcucucuuuaaauuuuccaaagaaaagccacuguggugguuugaaggagaucuuucacauaagacuccagauacuuggucuccaguugguggcuguuugggaaggauuaggaaguauggucuuguuggagaaggugugucacuggggugggcuuaagauuuuaaaagccuaugccauuuccaguguguucuuucugccuccggcuugaggcugagaugugagcucucuuuuguaccuaccucuccccaugucuuugcucugucauugugaacacuaacucuccagaacauaagcccaauaagacauuuucuucuggaagcugucuugaucaugcugucugaucacagcagcagacaguaaccaauccaugaagcuuggcuucaugggaagauucuccaagaagauggcuucucuuugcucaugggcauggagauggacuccuugcacuaccaaccccaguguuuucgguaacuggaaugaaaugaaauguaaguagcuccagacucagugaggcaagccugcccagcgccuguuaguagaucgcuuucgucauagcaaugcucugcuccgaccucuggaugucagucgggauuacaaggaaaagaaauaauuaagcauuuuagacuguugguuucaacugauauguuguuuuugagauuacauuguagacaggaaaaggaaacuauguugugcagaggccuaguccauagaggcaccaggagauugccauuggugauaagagcuggagcagccagguggacucugggccaauucuguccccuccuucagcuucuuugagauagaugcccucugcucugcauccuauaccagguuguuuuggggguaggcauccaugucuuucuuguucuuguuauauuuucauuuuguucucagacuuaagauaguccaugccugucaggccaugccccucaugguaauuucuuucccagaggacucaacucaagcuuugagcugccuagaaagcaucuucaucuucacucaugacacuaccuccgagcuccuuugcugaacuguuucugucuuucugcacuuuaauuugaucaaguuagagcugucgucugugggcuaaacacuaugacaugccacugguuggugaauagccuccuguucuucugcaauuucaugugcccguaugcugcuucuagauuuaucuuuugcuucuuacauuacuucuaguuauuuccacccuuacauauauagacaauuacauaugauuaaaaccuuuagugcugucugauuuuauuauaaauagacuuuaaauccaauuacauugaaaauaagaauuuuuuuaaaaaguggcugugguacucacuagugaucaagguucuugggaggaaaauguaagaagaccuuggguucaaggccaauuacauuguaagagagcugggguggggugccgcagacccucugggccccuuugucugcguggaaccggucucuagucucggguggacaaaucguaggaugaauugacagacagacgcacacaggagagguuguguggaaucugaauguauuuuucaaaucaagcaucagacuuuuuaugcagaagacaacaaggaaguugggugacauauucgcaagguacaaaugagguaaccggaaucuuacauaaaacagaggaaugcaaacacagaaggucuaaugggaaccaccugggauagaauucauugauaacaacugggauaaacaagggcuccaccuaagauucacuaaucuuagaagccagggucaagggcuacgcgcccuugccauaguuccuauuuuagucuauuguauagcccaccuuccccuuaggccauuguaaauaccuguguauggguguaacucagcuauagucuuagaagccaggugugaggucuuuacucaccuagggcaagggcuuucacacccaagucaggguucuaacuagggaguuccauucuagcuaaccaucucaugaauaaugcaauauuuuaaaaccacagccugaucuacuuccuauaucauuguaaauuccuguauaugugagcgacuuggcuuuuauugauaguguaauaccagaggcuaaaugucacugucuagcucaaggacguucuaggacuguuggaacacugggggaaggcucuagcuaugucagaauuuaaucuuaaaaggcacuuauaauaggaaaauacugaaagagagcacguggauccauacucuagacuaacgcgggaauggaaaauuuagagagcaccccagauuccaagagcgaguuuccaugaaacucuuuugccucgagaguagcuuucaagccucucggcuugucaagcugacucaaccaaagcacguggcaguggggugguaaaaccuguuggggugcucagaagcuagcaagaaagaaagagauggauuucauaucaagaaaagaaaagagaagagaagagaagagaagagaagaaaaaaaaagaaaagaaaagaaaagaaaagaaaagaaaagaaaagaaaagaaaagaaaagaaaagaaaagaaaagaaaagaaaagaaaagguuuaggcacuuuuuaugagcaauagugagaaaccaauaauuauuaaaccaguuccuacauuguugagcccaguagacaauggaaccuaucugaaucuaaagggccuaaggaagacccuggaaggauucuauaguggaaaaaaagaaacaaccaaaacaacaaugaggaaauacuuagaagucaaagucaggacuaaaauugacaaagaguagccuuagaauuuacuuauauuccaaggugagaggccuuucugacucauccacacugaaacacauaggcauugcugaagucaagaugggacagcagguacaaaguuggacugucccaggauagugggacaccugggcauucugguuuuuaguaugguguuucacuaauagugaacagcaguccacagcaaauguuucccugaagcuggcaauccugaucgucuuccaagugucaggcauuaccauggccugggaauacagagguugagcaaaauguccccuagagcuuagagucuaguacuuguaagcacuagcuugcaagagucuuccaauauccuaaauuuaaggccccaaauuauacacacuuauuucaguuugauaauauguaaaaauugaagaaguuacuaagaaagauacaaagaaucaagacaaggaaggcuuccuucuugcaagucuuauuuauuaccuuuuugggaaaaagauaauugaaaauccuaaauuucaacauaacauuuaaauaucaacucacaguaauuguggaagaaacaucacaaggcagaaaagagcucaaagucaaauuagucuuagagaagucaugauaaaaugagcuaccgaggagagaaguuccuuaagucagagaggauuuuggagaaguauguguccuaagcucacuggaaugguuuguauaugguugguccaggucacuuggaugguuuauauaugguuggcccaggucacugggauaguuuguauaugguuggcccaggucacugggaugguuuguauaugguuagcccaggucaugacaccauuacaagguguggccuuguuggaguaggugugucacuguaggugugggcuuuaagacccuuauccuagcugucugggggccagucuucuccuguuuaccuuuggaauaagauguagcaccaugccugucuggcaugccaugcucccaccuugaugauauuggacugaaucucugaaccuaagccagccccaauuaaauguuguccucauaagaguugccuuggucauggugucugcuuacagcaguaaaacccugauuaagacacucaccaagaucuucagguuuggguggcuggagguguggaggagagcaugagaggcaagagauaggaugugagaacaagggccugccaggacccaggagugugugggacagguguggaguuccaugucacccagcagagagguuuauggcuagaacaaagucuauuuucaaaaacuguugcaacuugagcacagcagcaaggagcccucagaagcauggacaucaugccaauuuuaauuugcugugaacagaagcagcacaaacccuggacacuuaccuucuccaagguggugguaaucucccaaccgcuuuuggaugccagauuuuugagagcuuccacauugguguuacuuagggaucccuaaaaugcacacauacaacagugaagcuauaaguucgauauauagguuugggagucaagcguuuucugcuucaguaauggucagugucagcagggguauuauauauugagccaaagugaaaauguugagcauaagguaaacuaccuacugcuaauaucuaacuucugucucaaagucagacaggguaacucugcaugcaucaaguguguaugugccuagaccguauccugaaccaaagcagauagaugcccuucagugcggcauauaacaaugugugugauaaaugaacuuggaccccacauuagauuuuauugucaagagaggaacacuccuccauuguuggugggguugcaaacuuguacaaccacucuggaaagcagucuggugguuccucagauaauuggacauaguacuaccagaggaucccgcaauaucucuccuuggcauauauccagaagauguuccaacugguaagaaggacacaugcuccacuauguucauagcagccuuauuuauaauagccagaagcuggaaagaacccagaugccccucaacagaggaauggauacagaaaaugugguacauuuacacaagggaguacuacucagcuauuaaaaagaaugcauuuaugaaauucccaggcaaauggauggaccuggagggcaucauccugagugagguaacccaaucaacaaaggaacucacacaauauguacucacugauaaguggauauuagcccagaaacuuaggauacccaagauauaagauacaauuuucuaaacgcaugaaacucaagaagaaugaagaccaaaguguggacacuaugccccuucuuagaauugggaacaaaacacccauggaaggaguuacagagacaaaauuuggagcugugacgaaaggauggaccaucuagugauugccauauccgggaauccaucccauaaucagcuuccaaacgcugacaccauugcauacacuagcaagauuuugcugaaaggacccagauagagcugucucuugugagacuaugccggggccuagcaaacacagaaguggaugcucacagucagcuauuggaugggucacacggcucccaauggaggagcuagagaaaguacccaaggagcuaaagggaucugcaacccuauagguggaacaacauuaugaacuaaccaguaccucggagcucuugacucuagcugcauauguaucaaaagauggccuagucggccaucacuggaaagaaaggcccauuggacuugcaaacuuuauaugccccaguacaggggaacgccagggccaaaaagggggaguggguagguaggggagugggaguggguaugggguaugggggacuuuugggauagcauuggaaauguaaaugaggaaaauaccuaauaaaaaauuuuaaaaaccaauuuaauagaaaacaaaaaaaaaaaaacaaaaaaaaauuuaaaugacuaaucccguuuuaacauuuaauucucuuuuuagguauauggauuuuugcuuguaugcaugucuaggcaccacauguauauagggcuagugaaggccagaaaagggcaucagcuuuccuggagcuggagauacaaauggaugugagccucugugugaauuaaaccugggaucucuggaagagcuuccaguccucuuaagcacugagccaucuccccagcccuaacuaauccuucuagcuccauaaaagcucaaguucgcaagcagaucacucguugcaaaucaaggcaagacaccagggaaacaucacacgccagcucguggcauaauguccugggucagaauuugggagcuguucccagaguucaaacccgacaguagaauuaccaauagcugcugccuugucuaacgugguuuagaauggaggguucugcgguucaccuugucauccaagccaugcagguacaaccuggaucuacuaaacaagucagcuucugcuuuugugaugaugcuuacaugaaguauugcagaccauaaaacuguuaccuuuuugcuuauaucccacugugcacugaguggaacuucuuucuugugggaaauaacauauuuccugaaaaaaauuaaaauauuaagaaacaauuuucuucuuaugcuucauacgugaaccaugauaacuucuugauuugcaaucagcuauuuaacaacauucucuuuggugggagaaucaggaagaaccauuuccaggcugggccauuuuuaacuuuuaggaagcauuaggcccuuuccuuucgcauuaugugggugcaaggaccccgggcaguggcucuuuguugaguggcuugucagguagagaaaagccuaugagguccucauacuuuaugucccuuaccugccuaggcgaauucuccuccgugcgauggcucccugguaacggcgaaaaucguccuuuaagaaaacaguaaaaccaaucaguuucuaacauuuuggcccugugacccuuaaguauuauuccccuagaucaaauggggcucugugucucugugacacuuccuggcgauaucugagccccuaggugacugugauggcccuuuucauugccuuucaaaggggagauuauaauaauuucugcuacuaaaaucacacagguuucacucuggaguuuuuagaggaggugaauauuagcacuaaguugauuccugacccauuaauguggugcagcauccagaacaggaugcccacacauaacaguuagacgcagagaggggacacagaaaacacaugccacacagcagcuguauagagaggugcucggggauuucaccaucacaacccaucaccagagagaugugggguggaaagggaagggcccacuggacuuaggcauagaagaaagcaaaccucuuucaaaagcuguggagaugguuggcaguggaaagcugcaugaaacucugugcccacgggucugaucacugaagcuuacguggugacaacugaccuuugaaauggguuggauucugggaaaggugaugaguuucuccuggucaucaacagcauuguaaaugagaaaagcgcuguugauguggcggccuuggcccucggcccacuccugacagucaaaggccucaacacgcacuccgacuuccacacugcaagggaugcaggguggugggcaaggaggacuggggcauggcuggccuccccuuccaccaagcaagucccuggugcuucuccucugaugucaacaagucaccugcuaaacaccugcuaaacaccugcuaaacaccugcuaaacaccugcuaaacaccugcuaaaaccugcuaggaugguauuguaggaggaccugcaggaguggguacccauuuucuucucccacugggguaauggagaaggugaauugcauugugcucaaaacauguuuucuuccuucaaaaccauaguucuaugguuuaaagaaaugaagagcugaaguuugguagaaaagagagauacuccccgcccccuuuuauuuuacaucaaaaagaagaaaaacacuaugugagaccuuuucacuaucuacugagaauaauaagaguaaguagacuguagucuggacccacuguuguaacagcaggcccaugauggaugcugacaggaaggacuaauaaguaugcaaagauggcagauaccaguuggaaccauccagagccagcuggaugucccagcacccuauggggcaaaacaacucaucacaauguccugagugugaagagaguacaagaaggacagaagaccguguggccgcagacugagugaaguuuaacaauaauucgaagguguugugauguagcuccuacacugcccuccagcugaggugagaacaccgcuuaugcucgacucugaaagugugcacaccaagcauacuuuaccuguucugaaagguguuguugacuauggcacugaagacaaggcggucuccaacuguggacgguccccggaauuuaaacauauccacagacuucagaaagggaugcccaugacacaggcggcuaagggaacaaggaggggagaaaagaggcgauggccaucuuccuuaguauucucagaaacaacugcuuuguggaauggcuucccuagacaagcaagcagccuguuuucuaaguaaauaacuccaaugacucgagagaacuauguguggagaggaucugcaugcaaccucagacguuuagggcaacaaacugggcauuucauaaagauggcuccuuggcauuguucuugugcucaguggaagucccucccaaugcaaaugaaugcuuuuuguugucaucaagugucacauucaucuugacaccuccugaugaaaaguccuaggacacugugacuugugaaucaggguagggcaugagugaugacaacuggcggccaauacugcucacacuuguuccucagcuucccuguucagugaauuuauccacagaucaaaaaccaaauuuuuccuugaugaaaaaaauugccuggguuggugcacaaagugagaaaggcuacaaaauauacauuucacagguuuugugcuaauuuagaaaggaaauaugcuucaaaccacuuccacucugccccuagccccaugcuagggccagugcugagaaccuugcagaaaugguggcgacugucuccauccaugccaugaucuggccaccaaauguguuuccgugaugguuugcguggggcggaaggacaagcucgaugcucuggacagaggugcccauggugguggccguuccuucuucuucauuacaaauggaaucugcgaagugaccacagagacaguggggucagccaugggaccuugucuggaauuccccuucccugcagcaaacacaacucugacacuuucagaaaauugacauuguccuuaaaaccuuacaucaaggaugugaguggguuaccauucuguagaguggccuaccucugaaaagcaucacuuuggcauuuuggguugagcuaacaaaccagaagggcccuuuauuagacaggucuagcaaauccaccagaauuuuuauuaaaguaaugguuccauuuaaauuggagccuuuugugguggagaaggacaugggagggcacagaaggguagacauuuugauggaggcaugucauuauuuuguuggcaaugauaguuuuacugcuguaugccaaugcacaaacccaggcugcaugcuuuaaauaugauccaccuaucauaugucaauuaaacuucaguaaagucacuaaaguaaagaagucugaaaucugaggggccaccaacacaacgcugcuaugaggaggagaaagaucucuguacccccaggggccaugccagguuaacagagcucagcaggcaguguguucauguaaacccagcuguuauuaacaggaaaugagccauuccaagagcaauuucuucuaguugaucagagcuuggcucuaggcuccuuuagcuccacuucauaaggggauuuuuagaucauaacuaauugaugaucuauuucuuuuauguuucccuuccuucuacugaucauuccaguccuuugcuuaaaauguggcaacagcuccuuugcccuacaugaacucucagauccuuccugugaccuacaaguucucucuccccguagagcccaugugaccaucagccuccccagccaggccuccuccucucuuuguugugcacguuggccuuuuaucaguuacugugaagaacacugucugugaggucaggguacuuccacacgacccuucugccugcugcacccagcccuaccuuuuccuaugccugcucccacuuaacuugucuuccauccuagaucacaccguugaucucagagaugccuucuuucuacaaaaauccgugguaacuggggcugggaggcagugaagcacuuggugcacaaacuugagaaccugaguuggauccccuaggacccacaugucaaagccaggugcuguggcgugaccuuacacccacaggauuagggaggcggcacaaggaaagucccuggggcuugccacccggcuagucuagaugaaucuggaacugaugaguuucugguucaguaagagacuggucucaaaaaaaaaaaaaacuaagguaaggagucauugagaaaauacuacuauugacccacuuccacacacaugagcacauauuuucaugcacacuugcacacacauauguacacacucagauaaaacuauauguauauaugugcauccaccaauaugugugugugcaaugauuagccaugcuaauuuuugcaauaccagcacuaacaaaaauuuguugaaugaauaaaagaacuugacuuugcucagucauucuacauuggggucccuacucuuaguagaucaccucaaggaaaugcuauggccacacugcaucacguaagaaacggcugcugcuuaugcugggucucauuccucuccaguauuaucaauaugcacguucuccaauuaagugggugugaaauaguauaucauguugguuauaauuugcauuucauugaguacuaaugagguccaacaucuuuucauauguacauuaaauauccuugcuaucgcuuaauuaaauaucuauaucauuugcuucuaucccaccucuggaaguucaauuaacaaauguuagauucucaacacacgcucacauacaaacagacacacaugccauuuauauaucuucuuucuuuauuuugagauggagucuuaucuaugcagccuaggauguucuuaaacuccuuacauagcuuuagucuauuuuaugucuugccuguuucacagccucaaacuugcggugauucuccugcuucagcuuuccaaaugcugggguuacaggcaucauccaccaugaccaauuauguaucuauguugauagacacucucccuguuucuuugucaagcuuuuuagaucaucucuuuguucuugaacugcacauuugauuugcaauccuuuuucauuuaauuaaguacauaaugcuacugugcacugacuccaggaccucacggcugauaggcaaacacucaacuucuuuguuugguuuuugguuuuucaagacagaguuucucuguguaccccugacugucccauagccaggguggccucgaacucagaaaucugccugccucugccucccaagugcucaguuuaaaaguguacgccacuacugcucagccacucaacuucuuauaugaauacuucauacuuuaugaaucguaacuucuagaucuuugggucuuauugauuucagucccuucugagauacacacacacacacacacacacacacacacacacacacauauauauguauguauguauguauguauguauguauguauguauguauauauguguguguauauauauauauguauauauauuaaaguccuauugccuggaaauuaucugaggaaacuucugaagcuggauuaaagucucuuaagucucuucuccacaguguguuuuuauauucugucacugauugcagcaaggcuuagagguccacaucauacuaaaguucacaugauccgcuucuacccaggaagcuuguggauuuccaguaccaagucugcaagaagagaaucuuuggacuggauucucaaaggaaacgauucccccaugccaccagggcaccugccagggcucucugaaggggcggggacuguauguggacuagggguggguccuuaggagauuacagccucccaugacuuccggguucacccuuaaaccuaaaacaaguaccuggguuuuccuacuacagucuguggcauuggguacaugcaggucccagaguaaaugcaggagguagaacagcuucucucugcuaucuuuguguucucaagccacuguugacgucacugcuuuccuuucuuuuugccugcugagaugggcuugcaacaaacuguagauucuccccagauagcaagucuacuacauugcuauaaacaaaacugguuuguuuucugggugguuuuuguuauuguuugguuuggucuuuuaagauacacaaaauccuaaccucuucuaaugucuauuuauugucaguugucuaaguauuauugugaacuggaucuugcuauucuguacaagcuggcuagcagcuccugaguucaagcgaucuuucggcaucagccuugagaguaucugggauucagguggaugucacuguuucccugcucucugauugcaaaauugauuuuauuagaugggauucuaaaaacaggaugaguuagugcugauugagauauuuucaguuuaauauugcuuguccaaaugguaucguuuuauccagaggaaaacauuaacucuguuuauuuaaaaaugccuauaaaucauauuauaaagugauaaaacucuaagugccugacuauuuaaccguugcacuagcagagcauauacccggcuaucagagcauauacauggcuaucagagcauauacauggcuauacauagcagcugggaggaagacuuucucuuuaacuguacgucuucccaugcuuuggaaauuccuuacucugcacaugcacuauugauuuuuaaaugauuauaaaagaauugcaaaauaaaaauuuaauaggggucuuaaaaaucugagaaauuggaggcuggugagauggcucaguggguaagagcacccgacugcucuuccuaaaggucuugaguucaaaucccagcaaccacaugguagcucacaaccaucuguaacaagauuugacuccguuuucuggagugucugaaggcagcuaugguguacuuacauauaauaaauaaauaaaucuuuaaaaaaaaucugagaaauuaaaaaaaaaaacagaauuagucaguuucuucuuuucugaggaguaaugaaagaaaaagucacucccuuccugugaagacauaggcagcacacacaggacaacuggggaaucacuccuuagucagguaucagcugugcugcguaugcagaaguacgcggaggaucaguaucuuuuguguggaagugugucuucuuguagauaaaugucaaucaauggggaaaaguccagagaacaacucaaguucacagaccugacuagaccuaaucuaguuaaacacaccuuacucugcaagccacguaauggaguucaguggcugcccaugacuguuuuaaauaccauucuuucaucaucuugcuuggccaacuacauuuguucuguauuacuuuuuuagaucaggaacuuugaccugaauuugggucacuuuauucuagcucuuguuuucccugugcacauccagagggaucaaccagagcgaggcgcugaggguuugauguuguacugacaaauugcaauucaaauagcccaacccuuaauucuccccagcucccggugauccaggguacaacaacauaauccgaucauccuuuuacaaaaccuaaucucaucuuuccacuuuucuuaugaaaauauagaggcugaaaucaacuuggccaaugcucuaacuaacaguguucauuuccuuccuucacaccucaaaggaugaagagcacuuaaucagucugauguuaugauauuauagauugauguuaugauauuauagaucccauaguucaguaaggacgauccaucuaccuucuuuuagaaggcguuuucuaauuucaaacagucucuuugagaucgaaggcuggaaguagacagaucacaugcccuaucacacccugaaaugucuuucuuuaagaaaaauugcuuuuaagggcuguaucauuggugacacaggaguuaguaauauuuccaaaguaaagcucaaguugauaugacagaguuagguuaaaaguuacuucauugagaagaauauaggauagucuauguucugauaaguuaaguuaaaucaguaagaaacacucgaaaaacagucucuaguucuaaacugaagcaagcacuaaauggccaugagacuucuaccuaacuccacuuccuucuuguagcuacucccucgguccccaacugggucacagaaucuggacucugugcuccuucagucacugucuacauuauuuuaaaaugacucaugugucugcaacuaggguaugaauuuuuuaagugcaaaguucuugcauuguuuuugcuuucuuaugggcaagcauguaggcagugauacaucuguccuagauggaaauaaacaguugaguguucuuuauuucuugaugcugggugugaagaggccagacauccacaggacagcccaugagcucauccacaguugcagucacucucagcuccuccagcaagcacuggaucgccuggccaauccccggcucagcccagggcugccuuuucccucacgagaacucuugcucuagaguucucauaagucaaaaggcuggaaaauuacccuugagacacauuacccuugagacacugaugugaugacuggagaggguaaagcaaauucuuccaagauuuuggauacacacagacuuuagaacuuuccucuaaaauuaccagagaaucuugugacucuuccauaacuuuauucauacauuucccuuaaaaacucaugugguuuaacugcccaguaacagaggcuuuuuuuuuuuuuuuuuuuuccccgagacaggguuucucuguauagcccugacuguccuggaacucacuuuguagaccaggcuggccucgaacucagaaauccaccaccucucucugccuuccaaguguugagauuaaagacaugcgccaccacugcccagcuaacagaggcauuuuaaaaaaagcaaugacuaugugacaaggaaggccaguaaagguggggugacugcacagacucauugagagccauggaaaguaccagcaucuucugaggcagaagagaggaacuuugucaucucauuugccuuccuggaguugcugugguaauaagacaaggugcucuuggcuugauggccuuuuuggcuuuguuuuuuauuaaugguugucuggucugcuuuagagauguucucgggcuggugagauggcucaguggguaagagcacccgacugcucuuccgaagguccagaguucaaaucccagcaaccacaugguggcucacagccauccacaacaagaucugacucccucuucuggagugucugaagacagcuacaguguacuuacauagagauguucucacaguucagauauuucaguccuuaggaaaaauguauuugaaacacaucuuggaacugaaaacaucuuuguaaagaaagagacucuucuuagcgcuguaauuuaaugauaaaguuucugcuuacaaaagcacaacugauaguugcuaucacuguuuaugaagucagcaagucauaccaccauucaggaaucgugaaaagcaacaucaacaugaacacucuuauuuccuuaaagccaacuucuacuucagcaaugaccauaucaaccaacccagucagccuggaaucacaaugaaguuuacuguccuggaaagccaugcccauuuacccugagggccaugaagacugaacuggauccaucuucucaccuacccaguggguuccugcguaguugucccaugaccuuggugauaccuccaggucagcaugagguguccagacuucugacaaucuaccuucucuguguccucuuccuucuccccacucuuuccuggcuuagugccauccuuugccuucucuuucugucuucugugcccuccuucagagucaguagacguggaauuucugugaaccucucuaguucucaggaauggcucgcuucaucuccugucuuacacaugugcucuagaaaagcccccuuccggcaccacggccauagaaagguccaguguguagaccuacucaccgcugaaccugcugcucuccuucauaauguuguugaagguguucucaugcugcagucggacuuuccuucucucugaagccagauugugcuccacuuguucuugcucuguuugaagcaggacagguuuuaagugaaccuagaggaagaaaguuuaucuucaguuucgucauucacugccuccuuaaauuaugggugcccaaugugaauuuugcaaaagcagaugccacaccauaugguuuuuuuuuacucaaguaaauggacuguuuauuggugauuucaugaaacauucuggcgaaaaucuuucuucaaauguuucaauuagaaggccaacaugggcuuuguucuuucucauuugaaagcugcacuuguuuauuuuucucauuuuauaauuuuuucaguggaauuacagaguacaaaauucuauaaaauaugagaucaauaaaugaggugugagauuauaacgccacugaauuuuuauuauaauuuuuccugucuuuugcaaaauuaagacaucagggggagguaauaaaggcauucuagagaaaacuaucuuguaccaagagauagucccaauauggauauaucaucaaaacagucucuaauagggaaacaaagaaucaauauguuaucuuaacacuucagcugcccuacagaaacccuggaugcaacagaguccaggauccagcuccaccagagaugcccacaugcugacucuauguggaaagaucuuggcagcuccaagauaccuucagucugaacuucacccuucacccagauaagggugaaaaaucuagugacucuuaaugugcuguuuaaaguucaagguucccagcguugccuaucucaguuguuggcaugugaagguugaccaugacucugccugaguugccuaucucaguugucaggaauguguacaaugacaguagcucugcauugucacaguuugguugcauggucagcagaauauauuaggcggccugggaaauuauaccuaggcuccccugaaaugaagacccuugcauccaucaugauguguccuuguccgcaaaguacauugugugugccugaaaaggaacuugagagcaagugcugccuggcagaugaaacccuuugaagguggcugggcuauccuuuuuccacugucucguuuccuuccauucaguauuaugaguccuucuuauuacuuggccuacuuaacugcugaaccaaaucuuguuaaucauugccaguuuuauccugggaugaauucauuuugaacagagauccugcuauuucuuguaguacagaccaaaccacagccuuucacaucucucuacacgcuacacuaccgaaugagaaaguaccaacuggaaaaugaguugaucugagaaaggugcuuuagaguuuauguugacugaaguagccaguuacaguagcaccauugucucuguagaaaagggacugagauguccuagcuugagccucuuccgauuguuccuaaaucuaaaaugagagauuugaggcugaaggggggaaagauggccucuucuuccagguaaagcagugagugacguauccaucuauuugcuguugaguaugggaacccuguacccagucccauaacacccuuauucugaaaagucuaaagauuuugagauuuucaagaagaaacuaaagcaagaccucuuuuacugcuuagauuuucauaaacuuaauaaguccaauuuauggcccagaaagguguacuuuuuagauaauuuuuauuagguauuuucuucauuuacauuucaaaugcuaccccaaaagucccccauacccuccccuacccacucacucccacuucuuggcccuggcguuccccuguacugaggcauauaaaguuugcaagaccaaggggccucucuucccaaugauggccgacuaggccaucuucugauacauaugcagcuagagacacgagcucaagggguacugguuaguucauauuguuguuccaccuauaggguugcagaacccuuuagcuccuagauaauuuaaguaagagaugugcuuuucaguuuggacagcagcauccuugggcaaugggaacuugccggcagcacauuuaauaugagguguacaguagaggaccccaggugacuucuguggggucaccugccagccagggauggcggugcucuagcccugcugugccaucagcccagguuuggagcagcugcagagcaugguuagugaccagcuucucuggcugcaguggaagccuggcuuugucccagcugcguuggcauaggggacacgagggagaucugagcaguagaccuggccauugggaaaagauuaggagaaaucacuucaccuacucuuugacgauucuugagugaaauacacucauaauaauuugaauuauuacauuuuucaaauguguugauucccccuaaauagaagcaauaaaaagaaaugguggcauccuaaauugagguagaucuggacucuggcuggcuggaagcuggucaguguaagaaaauacaguauuucuuugaagaguguuuucagccccguuguccuaaaguuuauuuuuaagcucacugacucagcaucuuugacacuuugcugaagaucuacaaaaagugacuggaccaugacuuucaacuccuugcuggauauuuuccugcuuuaaaaaaaaagaauaguucaacuuaauuuuaaacuccauaacccaaaaaagaacuaaacugguaagcgauauuuuugagaagucgacaugacuucugaaugauuuaaaacacuuuuuuccucuuuccuaaauuugguccuuuuauuuuucuuuaagguauugcucucacaagauguucuuguucaguucuauuaugucaacacagaauaauaccaauaaauaucaauaaguaaaacaucuugagcaagugagucuugcaauaagaaaaaaguaacgcuaaagcaguuguuccucugucccuggcucacaagaaaguuaucuguucacacggaaaauguaccuuuucuuugccaacugguuuagcuacaaacguagagaaagccacgcagaggagcuucuggaugcccgugaacuuguccuggacuaugaccuugauacugaucugcagagaaggaaaacaaaccgucagucauccugacaauagauucaacugcgucacacacgucuccaagcuugucuuucaguuuuuaaaugacauaagcauuuuaauuuaucucugugacacuacuaucucagugacaaucucuacacuaggacaaaugaaacucuucugauguuaggaauacacacaauuaccaugaaaaauaugugggaucuagcuauuuagaguauguuauauaaaucuauuacucagaggaaauauuuauuaacuucuagguuaauuuccuuccauauacacauagguuauacuacauauacacaacguaauauuacacacaaacacacguaauauugcacguuuuuaauauguauaugcucaucaauguuuauauacaucauaaauuuaucauguugcauuuggaguucuacauucuaauucuuuuuuuaaagauuuauuuauuuuauguauaugagcacacuguagcucuacggaugguuguaagccuucaugugguuguugggauugaauuuuguaggaccuugcucguuccaguucaaagauuuauuuauuauuauaaauaaguacacuguagcugucuucugacacacaaaaauaggguaucagaucucauuacgggugguugugagccaccaugugguugcugggauuugaacucaggaccucuggaagagcagucugugcuuuuacccucugaaccaucucgccagcccuacauucuaauucuuaaugaaguuugucuugcugcaauaagcauuuuagaaucauauuacuggugaauccuuucucaagaacaagauaccugccagagaggagcugccacagucuuuaaaccuuuagucauuagguuuuauaccccaugauaaugggcacagaguugccauguuagcugcagcuugguuuccuucguuugucuucuuccgggacacucagcaaguaacugaaacauuuugugaggaugcugcaguggcgucucucccucugugugaagagcccugaagcugacucugcagucuugcacuccacaggaaagacgucucagauuuaguauaauaaacacucuccucauaucucagccagauaagcaacacuaucuucugagaauaaugggcaagcugggguaucucaguucagcgcugaguaaugaaugauaaaguacaugcaauucuccauccgcaccaggaacaccauguacaaaaagaaccaauaacccaugacucaccuuaagucacuuaauuuaaaacagaaauuagcauaugcauggcaaaucuuacgugaacuggauaauaaugaaccaaauauaaaccaaucauuccucacuucuauaaauaacccacacccacauagauuuuuauguuagggaaacagacaggaagcauaaaauaaaagaucaaacaagcauagcuacaacucuggagugguaaaguucagacacuaucagcuaccaggacaguggccugagauauguguaauggacaagugcccagagacagggcauagggaauacacugucuuagggaagagcagguaagacuggaguuauacuccaugaaaagaagacaaaaacaagauaagaagaaacagaacauaauauugccuuuucaugcugaagguaauccccagaugucuguaccagaagggacacccaguucugccgaguugaagaagcagaaaucaaacagaucaagggaucugaaauuuuauaggguaccagaaaagagauaucuacauaaagagagaauucuggaaauaugcauauagucuucuugggucuuuggguugcuaucaaucugagcacgcacagcaugaaucucacaaagcuagaccaggauaacuucugagaaacccgcaucaccuuagggagugggagguggacauuuucagcucucccacacugcuaggaaucuucugaguucucccuaggcaagaccucacuggacauucauagagcccacagaggucuucgacuuacaagaggccuuuuacugacuaguuuucauuccaaggggagaagguauguaaggugauggagacacagcguuuagguaauaauauugcaagaagaaguaagaaauagaucuuuaguuuucaaaacaccauaagaacacccuuccaucuugcaugugaacuuugccuguauccuacaguagcugcugucacacugagcuugagugacauggcugagugggggaacaucggcucuuuaguauuccauugugugucugacuacagauuuaagggcuuucugaaaaucaggaucccuaucagauggaagcuuugcucugagcauugagcaguucucuaaaagcaaugaagacaugagccccaacaggcacaccuaagaaacggguaccacucaccuccaugcuugugcugaacgcccuagucacuuuugcucugaugguaauaauuuguccaauucuguuuucaaaaagaaagaaagaucucagugauccuagcacauuccauuuuagacuuagagauuuaguagacacauucggcauaaagcaauuccacccugacuuguuaauaauacacauguaucaaaaauucagguuaaaacuaauagcaaagguaggcuuucaggauggauguuagccauucaaaucaugcuuauaagguuaacagacucccucuauuuaaucagaaaagagcucuugcaaggacgguguacaagguaacccuacuugcaauagauacuuuuugugaguagcuguuguuccccauagaaaauucaaauaagcacacaaguagaccuguaccacugauguuuacuuuaaaaccuuagcuaauaaacaaacagaccagcaaacauacagaaacaaaccaggccaccagucaguccuuuugguagacacagguccucauagcugcuccucagcccacugacucccaacugcuauuguaauucugaaaacauugaggucaaguguuugggucacugaucucuucaucuuaucggaaguuaaaaagcuguccaguguaaacuccuuugccggccucaccccaccugauuccaucugaaccacuuugucacaggucucuucauacucauauuugugggcucaaacccaucgccugucuccuuccagccugugguguaagcucuuaccucucucagccuucauccucucagcuuuccugauuuugucuuucaggcaaugaaaauaguuuaagguucuuucuccuuccaaaauauuuucuuuccauucucauuugucuacacacuugacuuuccuggaagagucacgggucuuucuaauuuauaucguucacugaguuuugacuaaugguggcacggaacuaagguguagagaaugagucagggcugcugaguuugaugacggaagguuuuucucugagguucagauacagaagcacaccaaguccaaagacauagaaaagaacaacugaaauucacuggcaacagaaaccuuugucuuugaauaaaaaacuguccucagugugccacaccagugacaaaaugaaggcuuuauaaugcugcgcaugcaucaggcagcacgccaaaggcucugaaucauagcaauaacccuguguggucaacaugauucccauuuuauucucaacaggaagugggcuucaauggagucauagccagcaacuggcugggccacaauucaaacccugcucuuaucugcgauuaaagcccuggaaacaugguccuacuugggcuccuagaaaggacagcaauuaauucuacuuuaaucacagcagagagacuuguuuagcucuauuaaagacaguuuaugagguaaaucagaugcuuuuccuggaagaaugaccguaucuacuaaaugccuuugugcacacauauauacugugcccuauacacugucucucucauagucuguaacaauacgggcagaaaaaccagaagacaggaauuuacauaugcacauacauauauaucuuuaaacaagaaacucuuguguugaaaauaugaauaaaucaguuuugcaguauacuuuucuuaauguuuagaugaauuuaaguaauguagaaagugauaaaggucaugcaaaacccucacagauggaacuucggucacaaauguccuaugccugugcauuucaacuaagcagcucuguuuuaggcaucuagucccaaaauacacuaguaaaacuguaaacaugcagcacauaaauccacauauugaaguauuaucuguaauagcaaaagcaauucagcauuuauugaugagaaccaaccaaauaggaaucuauacaaugaauaccaaaguaccuguuaaaguaaugaacagcuguguacauugcucuagggugguuuuaugggcugacucuuguauggaaaagguggagaaagugguauaauacacuggaauuuauuuguuaaaaauaugaauaagcacucacuuacauuuuaguguaaaggaauaauuaucagauauaaagguagauaguuaagagagcagaagaaaccuuggcagcaaugaaauagaaacuaaauauaccagagugaaauguauuuuccacauuugagccuacugcuuguaaauguuuuaaaugagaaaucagauacagcaaaacuacaaugcaguguuaaaacauagaaagcaacugaacuugguaguuuaacuucuuuugaguaacuuccaauggcagugauuguggcuauguuuuagaaaggaaccuggguauuuguauuugcugaauuauuuacaaaucaugacuagaauuagcuuuggaauaauucacauauggaaaaggccacagaaggucuugauacgaguauaugugaacugaugauucuuacaggucagagaugaguucuugugauacaccauacuguucuuucuuauuuuauugucugacuugaauuuuucuuccauacaagccucuaaagcaauuguuaagcuaaagaagcuccauuuuauguuagacaucuaucuugguauccaccagucauuuaucuuugacucuggucccuggcagauaaguuuccaguaaucuugacuccacacccaaaacuguagaguuguaucuacuuuuuaugauaugacugauauuuuuacuucuguaacuugcuuaugcaaauauacaaagaguguauugaguugccuuaaucacuuaacuuggcagaacagaacaauuuuuacuugcuugcauauauauugaaguucuucaugugguuuucccuuuuaaaaguacuucucauagcucuccuucacgacaaucucaaauuuggaucagagauuguucaucuugcuaacagauaauugauagaucauuuuaauuauaauuagauugaguuuauagucuuuucccaggggucacaaacuccacaacauuuggagaccccagcaagauuccugggagacccuagacucagcguuagggcucugggauaagccccagagggagcaaguccaagguagacuugggagcccagacugcaacugcuccacauuugcaaaucaaaauuaagaauugccagcuacuaugcuucugaagcuuggacuuaucaguggguuguucuguucuguuuuagagugcccagauauuuggagagacaaaagguaagaucuuaugagaucauagaccuggucucuggggcagagaggauccccaacuguccugguuuuggugugcuagagaauguggccaucauauaucuaaguagcucuauuuuuguuuuuguuuuucccccuggcuguguuguacuguccuuucuguuguucuuuauugucugucggauuugugcuuucaaguuuuguugcggagaugggacucgaacugagcauagccaaauugccccugaacugcaugcuaccuuuucagcauuuuugagaggcacacugcuccuggcugucucugugcuaguucccccucggagcuugcuccauugagcuugcugcaucucuguccucucauuggccccccgaagccagcuguguaagcccuccaaguacaucgggcacuucucuaugcccccuguuugcaagucuuuuaacucuccuucugaagagugccuuucuuuuucccacuggcuguaucugccagcuggcuccugucucuagccauagagcucuggcugggagcucccucccaccaaccaccagcacuacuaggguagggugggugaugcaggcaccccugcugcguaaggucccugcucuacuacccacuguuuccugugcagcugcuccuggccugcacccagaauuucuuuucuccaagucuucuuugcauucugcuugcucuggucucuccugcugaucacuggauucaguuuuucagggauuaggugguuuuuuuugggggguaugguuaaucuuaaaauauuguuuuauguguucugccuuauuagaaggcuggcucugaaguugagguagggccucccuauuccaacccaagcaaggcugucuaaauuuccuccaaaauuucuguucuaggucauaaggccaucugacucuaggacacagagagaaaaacaaaacagauggaauauaaacuuucuuuaagacuuguaaacuuauugaauacaguuaaaaagguguaaaauaaaaauuuguaaagaaaagaaaaacaaccugaugccaauguuuucuaaguuccuguaaaugccuggauuuuauaguuuucuguuuaauggccucaagguuacagauacuuaaauuauucuacaauuuaaugauauuauaaaauaaaggauacuuauuuucacgugcagacacauaaaaacugguuucaaaauaaaaucaguauacaacuucucaauagcaacucuagauaugcuugcuuacaauccucuggacuuguuaaagcuaacauuccuucagcugacggagauaaccaaggcucuugacccuucagcuaagaauccagaaacuccuucuagcugguuguacacaauuagguccuaacugugagaagucucaaggucuucuggagaaaguaggguauagaggcuagaagcuaagaauaaggauggggucuuccuaugcagcacugaaaaguugugagagccugggcaaaggcuccagauaucuaacauacaccuaggaaaucuuuucuuacagcaaaugguaaagucauuuauuacucuuaugucuccuguuauuucaauuuaaaaaaaaaaagaguuuauaaaacacuuaggaggguuaaauguuaauuacagaugucucacucuuuggcgucucccucacuugcuugguucuugauuacaaaaauuguucccucauccuaaggggguauuagauaauauccggggauauucaaaacucuuguuaaacuauaaacuuuccuucucucgggaucucaaaggcuguugcaagaggauguaagcagaggaguucuacaaaauuccaagccccccaaauuacuuaaaacuuguaacaaaaaagguaauaauuaaaaauguauacgcggguaauuguaauuugcuauuguaugauuuuaugcaacuugaaaucaacucuggcuauuucuuuuuagacuaaggagcaagaacauguccccaagauaguuuggauuagaauaaauauuuuuauauggugauuuuuguccugaaauuuuaaaauaaaaaacagcauauguuuaauggacaaaauauauuugauaaauggagcuuauaaauuucuaaggcuuauucagauuaacaacaauuaaauugaagauuuuuguuuagucucucugucuuugauaacuuuguuaagcuuuaacuacuuggauaaacuagucauauaagaaauuauaauauuggggcuggugagauggcucagcaguuaagagcacuuccaaagguccugaguucaauucccagcaaccacaugguggcucauaaccauccguaacaagaucugacgccuucuucuggagugucugaagacagcuacaguguacuuacauauaauaaauaaaucuuuaaaaaaaaagaaauuauaauauucuucaaugauauacuauaaaagacucaaaaaauaaaauaaaauaaaauaaaauaggguuuccaaucucucuaugggcuguauuuaugguuuuauaaaguugccagucucucuaugggcuauaauuaugauuuaaaguuuuauuuugauauuaagauagcuuugauucaaaaauuauaauuuuaaggcuaaaauucugauuuuauuaaagcugcuaacuuauuauaaacuauuaaggauaauuaugccauacaacuuaauguucagucaucuuauaaaugauuaagcucuuuaaugugcucaaaucuaugcuuguaaucauguuaaaugcaaauguaaauucauuuucagggacaagcucuaucuuauuuucuguauguguuucaggguuaagcccaaaacaaguaccuaaaaacaagcaaagucuauguaguucauauacauugcauagauaauggacuucaaauuuuucagaggucugaugaauauggcauucaagguguuuacugagaaaaaaaaacuuacuaugaaagaccccaacuccuuguggugaccccuaguucuucaaagaaagugauggggcacugcaacucuaccuggauugugauaacucuaaccacugggaaaacugccccaaugucucaccucaugugccuguaggaccuggcccaaacuguggacaaauaggacacuggagaguugacugccccacuuuguguagacaaaguaaugacaguucuccaaguucuagugccccaggaaagccuuuugggucuucugggcuacucucuccccagcaaagccauuuggcaccacaggagccuggugggugacucuagguaaugggcacaacucaguaauuuuaaugauacauaggccauuuggaguacacuuccugucaugauuuaucuuucucaggucucugaugacauuguuggguaggcaagcuauagcuuugucaacuaagcagccgcaggcaaccagcuccuuccccuaagacugcagccaccuugucuguucauuucauauguaaaaacaaaaacaaaaacaaaacaaaaacagaaacagaaacagacuuuuucuagcgcuacuaggucuccugcugagaaaaggcagacaggucugccuugcuaacaagcuucauauuagagaauaaauggguuucagauggaauucuuuuuuuuuuuuuuuuuuuuuuuuugguuuuucgagauaggguuucucuguguagccuuggcuguccuggaacucacuuuguagaccaggcuggccucgaacucagaaaucugccugccucugccucccgagugcuggaauuaaaggugugugccaccaugcccggcucagauggaauucuuuacuguuccuuuauuuaaaagaacaagcagucacacacacaaaaugucccuuauaauuuaaguuauuugcacacaucguaaguguuugcacccuagaagcagagacacuuauuaucaucuaccaagugggaaaaggcccuuaaggaugagaugauaggaaguuugccaggccucacacuucaaagcuucagauacuaagaguuacuuaagaaagcugagaucaaauuguacuuagaacggugaguacuuguggacaccaggauucuuuuuuuccacuaaguguuucuuguuuucuaagaaaacacagucacugacuccaaaugacuaaggugcaaugaacaugaacugcaaaugauccaauaagcccacaggaagggaagagaacacccgccacuuaccucgcuguguccucaaacagaaugucauccauggaggcugugacacaggaaaucccagcaugcuuuucggcuuucaaacaaacaaacaaagccaggucaaaguaugccauguuagcagcucugauuaaaggguuuagcaaagaggaaaacaaauacauuggagcagauuggcuuuggccacucauccccucucucauuacagcaccacacugcccacacaguuagguugaccuguauuuacaugcaggccuuggcucugccggugguuucuauugugugaugauuacuguacuuuuucccaaauccuaacuugggaaucucuaguuugaauuuuaaaaccagugcucaggaaaucuagcaacuauaaguaacaauuuugcaaguucuugaugacucuaauuacuuuauauuauuauuuauccuucuuuuauuuuauaacuagacaucaaugcuguacccacugucucauauggcuaguagcugaauauauuuaaaucaccgaugacugugaacauggaggucccucccacacccgaggggguccuucugggaaucugaggaugcagguggcccauguucacuaugaauuauuaccaaacuggcaucgaugugucuacauagagacgcuguggaugacauguugcuaaggggugaagaguaagggugaagaggcccucaccauuuuccagggucuauaucugcacucaauuuguccagaguuguuuugauuauuaguuuugcuuaacaugaaaauaccagaaguuaugcuauuuggaacugauuuagaugugaguuuaugccagcuuuguuuuugaaaggcauuuaggccuggcagugguguugcaugccuuuaaucccagcacuuaggagacagaggcagguggauuucugaguuugaggccagccuggucuacagagugaguuucgggacagccagggcuacacagagaaacccugucucaaaaaaccaaaaaaaaaaaacaaaaaacaaaaaaaaaaaacaaaacaaaaaaacgaaaaaaccccaaaaaaaccauuuaguuaaaguccaaacaaauucucauugacuuuuuuuuuuuuuuuuuguuuagacaaauucuuucuacauagacuaggguggccaggaaccccuaaauccacucccacccccacccucucacaccuuagccucuuggguacuaguuuuuuuugcguaucauuuuugcuugacucacugccuuuuaacgaacuuuuagcuucauucuuaaacuugaaggcuucacaguugauacacauuacaaagaagugacagagaauuaaacuaaauucuuguucgcugcaaagaauggauuacaauguauuaacugaucaucuuugguaaagagaagcaagaaaucaaccauuuuggaauucuauauaggaacaaugggcacauaagaggcuugucaguuauaagacaguuuagcaauagacgaggauuuggaagcgucaaacucuggucuuguucaggguggacucaguuugaggugaauauggggcaugcucaguugauuuccaggaacuaaguggaaaucuuuucagucugcuuagagguccuuauugauccauucuaagaugauauccuuagagccaacauuguccagagaaguauuggaauuuucaaaaacaugcuguaaaacauugauuuuuaaaaaguacauaauaaacacugaguuggugaagggacagaguguugaguuaaguuaaaauguucuuauuaauaaaguaugauuguguaaccaacguaauuugccaauuuuaagugauuggaguaauuagaaugagguaaccacuaagauaagacuauagagcucuauugcacuuuccaggagaauacuaugcuuacagagcacagugacagacugcaugauggaagggggagaaucagcagcaggugacagaacuuuacaaagcauuucucuuggucaugcaccaagccauacaugccagccauuggccaugcaccaagccaugcaugucagccauacaucaugcacuaagccaugcaugucagccauuggccaugcaccaagccauccaugccagccauuggccaugcaccaagccauccaugcaugucagccauucaucaugcaccaagccaugcaugucagccauuggcagugcaccaagccaugcaugucagccauuggccaugcaccaagccaugcacgucagccauuggccaugcaccaagucaugcaugucagccauuggcagugcaccaagccaugcacgucagccauuggccaugcaccaagccaugcacgucagccauuggccaugcaccaagccaugcacgucagccauuggccaugcaccaagucaugcaugucagccauucaucaugcaccaagccaugcacgucagccauuggccaugcaccaagccaugcaugucagccauuggcagugcaccaagccaugcacgucagccauugggcaugccccaagccaugcauguuggccauuggcagugcaccaagccauacaugucagccauuggccaugcaccaagccaugcacgucagccauuggccaugcaccaagucacacacgccagucagagaagguuaguacuaucauugguuccacccuuaaaugaggaaaucgaucuuagaaagauuccaaugauuguucuagugguuuuugacuacauaaaauaggaauuuaggaaagaguuggguugacuaggcuaagaaugcuuucagagagcaccucacugaacauggccccaacagccauacuuucuacuccacacuuguaggaaccaauaaaaaggaaaagacaccaacaugagaggcuaacauuaggucccucacucauggacaugaucacacaaagucuuuucuuuguuuuccaagugugccuggaaauuagauaagcaugccucaugcuugucacacugacucugguggaguccaccccaaacaugucuagaguuugacacuuccaaauccuugucuuuuugcugaauuauuuuauaacuggcaagucucuucugggcccauuacucccacauagaguuucaaauggcuccuacauacccauuacaucuuuugauucccuucugauggggagguggucuccacugauaugaauucuaaaggaccagauuguccagauucuuagcauuuuaauuguaccuuuauacuuucaaugacaguagaaauacguaagagauauuacugaugucuuaggaagauggaaacacacuagcugaaugauuauaaucuauguauucauacuaugguuauugauaagguggcaauaguauccauucuuucuuaucaucaacuaauacuuauugaacaccuguucuaugccagcaucacuccagggugcuggaaaugcagccaugaccccaguuuccaugaaguguaaagggaaagccagagauugauuacauagauauacaaugacaaaauaaguuacauguucuuaagaaaacagagcccgugacucauggaacaaguggagguucuugaguugagaucugaagcaugagccggagugaaauagaaaagagcagggagcauggacaggaaggcugcugagcaggcagggcugcaguuacgcgagccugagagugacaggcaggcagagagugguuagagugagccugaggcuucuguggcuagaauggagaacuugaggaggaggagugagauggagaugaagggaaggaaagcuaagaccagacccuggauggggccuggaagcucuugcuugucaucauucagaaucguuauuauuagauauuaucugcugugaucaguuaccugaaaacacuaauguaguugggcuaaccaggucucugcuguuguggaugagguuggugguaauuucaguuauugcuacacugaguacagccuuucuggcugcuuuuaagacuuuuucuuaaacauaacuaauuauaauaugccuauauaugauaauuuuuaaauuaaucuugcuugguggucuauggauucuugauucuaacuguauggcuuucagcauguuugggagcauuuucuccuuugggagaccuuaugcauaucuaaaagcuuucuuuuauuuuuuucaugauuguaugaaacuuuguguacuuguguaguacgagggguuuaauuccaaccuuauacaugguaggcaagugugcuaugcaauugggccauaaccucauuucuguaugagagaucagauacuacacauuauuuauuuuuacauuagcugacuuucuccgcagccauuuuuauauacaauguauuuuaaaauuuagaugcuguauuucuguuauugaguuucuauauuguccucauaaaacacuuucuauuucauuuuuugagauuuauugucuuuuucuaaucuuuaaaauaauauuaucaauuuccuuguguauaacuauaauagccacaugaaagccuuugaauuguaauucuagcaucaaugucaucuauagauuaguucccacugauuaucguugaagaacaagucguguuugugguuuaauuggauguaaggguuuucuauuagcucugagccauuguugauuuguuauugaaacaaugggcucugaugaacucuuugaaaauaauuacuuuugcuuuuguuguuuucuugaauaaacagaugguucaguuuacuaaauauaaaccauaaagcccugucguuuuugcgacggguauggcuccuucauuuucucuggucuuucucuggucuuuacuuggaaauuugaagucuacccuguauacacaaaauucgaagugugccagcuaucugcguaaggauuaccagcaaagccauuuaccuccuugucugucucucuucauauuucaguggaugugauuuccucaaaacauuguccuuuggauguucaaauuggcaaaccugcagauuucucucucucucucucucucucucucucucucucucucucucucucucucacacacacacacacacacacacacacacacacgcacgcacgcacgcacacacacacacacacaccuccucauaaaagcuaaacaaagaaaaaaagaaaaguugggucacugcuguuuuucucuucugaggaugacuuccauguaucucgaacacuuucauucacuucuugguugccugaauuugccuuuauuugcuguucucuccugaguuaauaguuguuauugauguggcaaagauuucugauacgaaguacuugaccaaauuagaggaaaaacccuuucagccuucaguaaagaaacaaaggggauguaggagugaucuggcugugacaucugucaccccauugaucgccgggguugauucugccgaucuggauggauggauggauggguguccccucccugccucauggauccauguguguccgucccaaggcugcacacugggucaaacaggaugacuugucuuuggacaaggaaaaacaaguagcuguguuuccuuacuagauccuccaaacaaacucgaaagucaauuuuuaaaggaacaaaaaguaaagacaaaaaguaucugacaugaugaggucagugguuuccagauguucuuuagauguaguguggaggugagaccagaauacagggagaagaccuugagcaucgcucugaaacccacaaggcaggaugguggggucggagacuaggcagugguguggagguucagcacaggggcugggaugaagagauuccucuaauguggcauuaguaaauccaaacacgagaggguuauguauuaaauguguggagcaggaagacacacagauagcacgucaagguugaguccaaauaagggcacgguuaugagucagguggcacucguuaaaagugaacauucagaaagauucaucaauaccauggagaaggaagaguggucuugagagaguuaaaacaagaaguggacauggguuuggagcaugccgcaguaaugguuucaagcuucuggucugaaaagacugaaagaauacggaguagaugacagcugucgggccuaaugcuuaugugaucugagcuguccgauucuuuucuuauauugagaaagauguuuuggaaucuagcagugccuugaggacauggucaugggcauuauuuaucuuagaagauguaaguauacagagcccuggucaacagaacucugguugaaacaaugcuagaaaaacauuaccaguuaugaaguuaccaauggcaauauaauuacuaaagcauaguauaauugauuaccuauagucuuccugugaucuaaguuccccaaaaggucaaauuagaaucucuuaaugccaauuguaaucagugccuuggaaauagauauuauucuuaucagcaauaucaaugauuucuguaauucuuuuauuuacauauuucugauuucuuguaacauuguucuaacccaauucaaaucuuguuaagacugaaaccgaacaaaucaacaaauaaaacaaaaggacugucauugaaaauguagccacauuuuacggaugacuaacaggugagaguuaguacuguauuaauccaagaagaagagcagggguccauaauguuuugaacuuuacuugaguugcgcucaguauauagaaugugacuagaacacaugacauguaaaguuccucucagaucuaauguuuuucaucugaauacauuuuugcccagagcaagaaccagacaguggaaguuuagcacaagggucaggacuucagagacucaugaaccuggggaaacggagaaaggacauugaaacugaggagcaaggcaugggaaugggcaaagaaggaacagcagguacaaaguuucuuauggagaaaagcuuggcaaacacuagaaaaaccccagaaggcugccaaugccgcaaccagacagucuggcggggaggcaguuaccauggagauuauuuguaugugagacacaaugcuguacuuauucuuaguauuaauggccucugguggaacauccuauagccaaucagucuacuguccuaagcuaggcucugaaucaacucaugucuaucuauguggcuccucagagaaugaguucuccacuacaagagcaucugugaaaaauggggggacuuuggguuuuaccucagggaugaugggaagauacagagagguccugagugggaaucagagauaugauucauguauugaaaguucacugugcauagauaagagaucccagggaaucgagauagcacuaggacaccaaaagacuuucuucugaagggagcguggcaaggcuugcuuguauccaagacuaucacugguccaaagaugagagaagucagcaugggcacaggaaauucauguacugcucaaccuaggcuuuuaguuagaaagccauuuauauuacaacacacugguuuuaaaagcaggccuuucuuuuaucuuuaggcguaagucggucacagucagaucauaaaucauaacaaugcugagcagcugccuuuucugggguggccauagcacagcauuauggacuggguggcuuggacaauagacauucgguuucucagaguucugaaggcugucagguccaccagacuggugaaaacucucuuccugguuugcaggccggcucuugcugcggccucacgugucacgugcuucuaagaucuaaaagacuuagugcccugagaugagguuguguucuucucaucucuuuaauccucgauuauacgacacagccacaccacgguacuugcugucacuuucaaaauacaaacuucagagauggcauggagagagacaucauucaguccuuauuagaugauuuugugccaccacccccaacgcuuagugcugggauggaaaucacaccggccucaagcaagcuaggcaagcccuucgcaacuggauuauaccagcaggccuucuuacucccauucucucucaggaauaucaaguuuccccugccugccuaacaguaaaugguaguaaacugaacacagaagagaaccuggcaaaggagcaaucaagcuuuuaaaucaugaaaagcaugaauucugaccaguugugcaagaacacuuuugcuguugcaguaaauaauguaguuguuuguuaagaaaauauaguaacaugugcacauuugugugugugugugugugugugugugugcgcgcgcgcgcgcgcgcgccuaugagacuacaaagugaauugggguuucaugcuugcagugugaacacuuuuuccagccucaguucuacuuagucaauaaacucuaucuuuagaauuuuaaauaugguuaaguacagauauacgcaaucuauauagcaaagucuuugcguggaggcggggagaggaugucuucacuuuguuuugugaguugaaaggaauccagccaaauaaacaugugagaaccacuagucuaggucgcugucagcagcuaucuuagucauuccugucugcggcugcucucagcucugggaacacugcccuuuacuuugcuuccuuccuuuucccacgcucucucuggcuuccacgccagccuagcgcaucccuaauuucagacacuccaguccuucaggauccccggacaguaucaccucccuggccaccagcagcagcccuccccgaccgacggugcccucgcgugggccggcaccuacccgccaggcaagcggugguguccauccacuugagcagcugcccugcgcucagcucgccgcgggagucggcaugagccggcuggauggccuggcucaugagcaccucacccggcgccaccaucgacuccaucguccuggcugagagaaccc

SEQ ID NO: 7151 - RNA, 12003 nt, Mus musculus
ucaaucagguagaauuugagaugaaacucagaagccaccagucauuccauuaugcugcagugacagcggcaggacucguggaauguacguuaaauaugcauguauucaucaaaucagacaaagaagcuaaugggucucugauuaguguucucacucuauuauggugaugcauccauccuuccaccacacccugccacagcuacagcaggcggaagcagccagggagacuaauagucugucaugccgucgcucugucugaggaaugcacacuggcuuucuggcuagaauuucucucuugaaaaacugaaggugaaaaagaacugugaugcuggaagacucuuuaauauuaauaauuucuaauucuuuguaucaaaacuaaagagagccccuuuuaucucuauuaaggcuuuuacuuuauuauuuuugggaccaauauuguuuuuaaagguacucuagagugaaaguaacaaugaucaguucaacaaagacaaacagcugauauaauuuuauucaguacuaagaauuacagauuuugugacaacauauaaauaaauuucuauuacaaaaaauugauacucugaauuaagagcauauaacaaaauauuuuuugauucacaagcugaaaggcaugugcuuuguuuaggggucaauuuugauucauaauuuacauuuauagugaugacugcuauaaucagguauagaggcauuuagucauuucuaaguuccaucuguaaaauaugcucuuaggcacaguacucuggaugcuggagcacgguuauuagugugaagccaaccugggcuacauagaaucugcuucaaauacagacagacacacaggcacagagagauagauagaccacacacacacacacacacacacacacacacacacacacacacacacacacacacauuucuagagaguguaauuaaucaaccuguacgccuugauagauugauuguaggcaagcuaccaaggucagaguggugucuauaacacagcuuugccuccacaguugcccagcuucaaucgcuaaaggcugaguuuggaaaguaaccuugaggugguaauuaacaauuguaccaauuaguaucaaaaauuaacaacuuuggguacuuugguuuuagguuucugcaguuugggcacauccagcacgucuucauagucugcacucauacccuuugcccagcgaccaaccgugaugauccgaucugcagagggauuuaaaaaaaaaaaucaagauauaaaaacaacaguaaucaaaugcuuccacugagagugguauugguuuaguaaaggaacuaguuuugacaugaauaaucacaaggagagaugacuccaucacugcaggaaagugagcaauucuguaauugauuagaacccuugauuuccgaguaccacaggcaauuucucaucccaauuagggaaaugcagacgcuacuuugcaaugcacggauugaugagagcucccucacuucuuccccgaguucaucacugaggacucggugauuccaaggcccgugaauagcaaaaguuaggaggcaucuguuuuaaaugcacgcaauuccaccugcaaaauuagacagcagcugcuugucaguucugccauuugggaaguggcaauccucccaggagggagaauucaaaucccacuucaucauuucaaucucacuccuacaccauauaaaaaugaucuccuucucgccaggauuauaaacaagagcugguucucacauucaaacauuugggcaagagaggcaaaccgggaggacucagccgugagcucggacuacagaaaaugaaaagaaacgugcuuuucuucuaagaagcacugccggggguccugcugccuuuccuuacuuguguguaugcaugugagcuuauguguggggguacacaugcacauguguguaugcauagggaggccagaauacaaccaggugucauuccacaagcaccaccuaccuugauuuugagacagggccuuucacuggccuggagcucaauaggcaggggaggcuaacuguagcaagccccagaaacccaccucccucugccucacuggugcccacacgacaaguauacaccgccacgcccagcuuuguagucaguucugggggcugaacacagguccucuugccugggccacauccccaagccuccuuugcuuucuuuaacacgagauuaucucuaucuauucuaucuaaugcuggcaaacuaaaggaauagugaucucuccuuccucagaaggcugcugcaugcagcagugaacacuuacaauguucuuaaugaucaaggcuaauauuucacuggaaaaaaaaggaccagcagaugcuguguugauaacacauuuuuaauaaguuuaacagcuuuuugcaaacauuugggaacaugcaaagcaaagcacaugaggacacucaggcuuaggaauuuugaagauuaauucuguauuugaguuuuaucuuaggaaucaauaugguuugcuaaguaagagaauaaguccuacuauaauuaauuucauuccugagcaaacaggaaagcuuguaagaugccuuucagaauagaguccugcagcuuaccaacucacuuccacagagaacagaucugacugauguccagggacucaggacugugcugacugcucauaggaaauggcgaggucacugucgucgugcagaagcaguugucugcaagccaccagugccucugaguuguugcuaauggaacucggugagagcagagagaaaaaccucuuaugaacggaagccuaggagcucaccugaguucugauuuucucggcaaucuuucuuaaaauguuccacggagccacagaguuuacagcugccaccuaguaaaagagcagagucaccgagucccauaucaucccaacagggcuuguaacacugacgcgcaaucucaugucuuauuugaucccaauccccgaugacuguaaagguagcccgggucaggaagcagggugggugccacuacuccuuuuaggaacucauuugccacuccugaauuucaaaacacucauugguaccagcuguuccuccuuauaccugaccuucuagacgggcgugagaagaggaacaugacaggaggcacagaagucuagaggggaccauggagagggaggcgaggugugcagcuuucaccuggggacauaacuuaugucugcacccugaggaggaugccaguuucuauccaguggcccccaagagguuagucagcaccaccccucuaccuuacaggucagacggggcagucacuuacucaggcaaaucugucuuagugccuucuaucugccuguccugcuaaccugaaaaaaaaaaaaaaacaaaaaacacucccaucugucuaauuuaagcaauauuccaggacggugagcuacaacacuuggcuuuuccaacaagcguuucacauaauacucuagccuucucauaaucaugcuggugugagugccuucucagaaaauguccccacaggaugcuaaccugacucccauguaucagaugcacuucaacaacaacaacaacgacgacaacaacaacaacaacaacaacauuucaaucuggcuaaccaugaaaagucauucuugcucauaagucaacuuuccuggcccuuccucaugccacagugaagagagaugaggcccuugaacaaugcacacacuuuaaaagugacgaaggugacaagcaagaucuaagaugccacagauuguaaagugugucauuacuucacuaggcaacaaagaugccaaucauguaggacccaucaauggcaugauacauucugauuucagauaggaaacuguaaaaaaguggaucuuagaaucaauaaaaccaaauuuccuaaucccuauuuuauaggcgacaaagugagguagugccaguucacuaauuuggcaaagaccgcagcuggugagugguguugagacugacuccaagagcuacgcaguuuuccacuggacuggugggagcaggaccucaagacacaacacagagaugccuaggacccaacagcaccagcccucuccgucacaggcaacgaccccauccugcaggucuucagauacaacaguauuucuugcaggcucuuaagacacuagcugaaccaaagacaagaaaguuacaugaagucccagaccaugagcaaggagaaaucucagaaacaaauaucacaacaaaacaggacaauacacaccauugucucuugcagaaauggugugcuaaccauggcauuagcacacugcauggcuuuucaaaucuuuuacuaaugugagauugaaauucucugccuuguuugagcuuaaacacccacagauuuuaaacauuuucucacaaauaaugccgaaguaaggaguccaagaauuaugccauaguucuuccugauuuauuaauaaaucaaacuacaauauaugaauagcccagcucagaauaaguacuuggcaaagguguucaagguuucaucuuuucagcaacuuauuaagcagcagauagaauaugucagauuguaauucugagcaauggugacaugucuaugacaugaggguaauggcacuuaccaucagcauagacuccuuugguauuaucagggcaggaucuggacaggugucccauuucuccgcagacaaaacauuuugcaaaaggaaauucaccuguaagauccaauguucucauuauuuuauuguguguaugacaaauuguauaauucacauugcuuuaaaacacuguaaacagaaaagacaucucuucagcaagcuggcuauuuaaugcucaccuucccucagcaccaagcaagaagcuacaagagaacauaccaagcgcggggucuacguuagcucugcacuuggacaucucgugcuccguggacccacagcgguaacaaaugccggugcccauguccugacucucuaguacagcuggacagucagcaauuccguggccagguugucgacaauggaaacacaccugggaaaacaaaauaugaguuuccacauggugaaacuacucuccugccugcacuaauuuuucaucaaaacuaucuuuacuuugcauuuuaaaguuuuaagaaaaaaacaucaguauuguaucuguagaagaaaguacuuuccacauucccagucaagugccauuucuaucacaagggcuuaagugcuucuuagaauuaauuccaguaaucuauuaauacgagucacaaaaugguaaauggcuuuguaggaggcaacaguucaaaugaauugagcaaguauggaccacacaucuuuuacuaaggaugccugcaccagaaaacaaaaggcguguauggggaggggucucuguggaagucagacaaugacuaaucaguacuuguauuuuuaaauuucauagcugaaugaagcuggguucagugucuccauugugacucagaucacaaguuaggagcuauccugguuggucaagcaguguaaguggcuguguuacaguggcugaguggagccagcccaggagccaagguuuaucagugcugggaggcauuggagucucauuaaaguguggguaaggaauuauggcacuggagauccacaacguuaaggacagcauugaggagcccuccacugacugccuagcaagcgcaggucugcagucacuagcaagaacaggaaggucaagaaauuccuagaauagcugucugcucacauaaacagaagaguuagacaaacagcaugaauggaaaacccuaucgcaaagacuuuucaagucaccacuggccaaaugcuguuacagaaaaucuccucaaaauggggacucugacaugacaugaacagguuuaggcaggccaacugcuucaaaacauuaaggccaugauaacccagcauacuuaguacuuccugguucugacucaugcccaucaaaacucgguggggguuuccuggagugucugaguaccaggaagugauggcccacguuuuguucagcaggacugugggauggaagagagguguaggagaagucacagccuauuuggugaggacaggaggccgaaggccugguagacucccguuauguuaacaguucacaggaagaacagcaauguaucucaucgaaaugcuugcucucucuaacaaagugauuagccgaaaggaacucuggagacuaagcaaucuacagauucaaugcaauccccaucaaaauuccaacucaauucuucaacgaauuaggaagagcaaucugcaaauucaucuggaauaacaaaaaaccuaggauagcaaaaacucugcucaaggauaaaagaaccucugguggaaucaccaugccugaccuaaagcuuuacuacaaagcaauugugauaaaaacugcaugguacugguauagagacagacaaguagaccaauggaauagaauugaagacucagaaaugaacccacacaccuauggucacuuggucuucgacaagggagcuaaaaccauccaguagaagaaacacagcauuuucaacaauuggugcuggcauaacugguuguuaucauguagaagaaugcgaauugauccauaccuaucuccuuguacuaaggucaaaucuaaguggaucaaggaacuucacauaaaaccagagacacugaaacuuauagaggagaaaguggggaaaagccuugaagauaugggcacaggggaaaaauuccugaauagaacagcaauggcuugugcuguaagauugagaauugacaaaugggaccucaugaaacuccaaagcuucugcaaggcaaaagacacugucaauaagacaaaaagaccaccaacagauugggaaaguaucuuuaccuauccuaaaucagauaggcgacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacagcccugagauuccaccgcacaccagucagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauacagaagaugucccaacagguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaggaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuugcuaaacacaugaaacucaagaagaaugaagacugaaguguggacacuaugccccuccuuagaauugggaacaaaacacccauggaaggaguuacagagacaaaguuuggagcugagacaaaaggacggaccaucuagagacugccauauccagggauccaccccauaaucagcuuccaaacgcugacaccauugcauacacuagcaagauuuugcugaaaggacccagauagagcugucucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacaauaugaacuaaccaguaccccggagcucuugacucuagcuccauauguaucaaaagauggccuagucggccaucacuggaaagagaggcccauuggacacgcaaacuguauaugccccaguacaggggaacgccagggccaaaaaaaaugggaaugaguggguagggaagugggggggaggguaugggggacuuuugggauagcauuggaaauguaauugaggaaaauauguaauaaaaaauauuaauuaaaaaaaagaaauuauguauuagcaauuuuggucaucaaacuucaaaaaaaaaaaaagaguugguugucauugacuccaacguauguggugggucagagcugucaucuaagagagaaguuggugggaauauuaagaugcuaaaagagcaaguaaguaaacuauggcaagagggaaucugucuuacauugauuccgggaugugccaguagcauagcaaaggaugcagauacuuauucacgauggugacauucacuacggugacaaugagggacuucguuggcuacaggagcaucugguuauucagagcaucacccagacugcaugacguccaaaaaauaggucucuucugagaacucuggaggucaggugugguggcacaugccugcaacuccaguacaugggaggcacgggcaagagguccccuuaagucugaggccacccuggucuaccuaguuaguuccagaucagccagagcuacauaacaagaccccaucucaaaacaaacaaaacauuccaaccaaacaaccaacuaaccaacuaaccaaccaaccaaccaaccaaccaaccaaaaaaaccccugacucuagcaaucuacuucacauuuagguggaaaauggucaaaagcacaaagacuuuaaauguuuaaacaucaauuaaauaauuguucacacgcuaauuuguauuuugaccacauauaccuauuuucaaaaaauuacaaccacaaugaaaaacauggaauuaggucuggacagugcugguauuaagagcacugagugauauuccagacgaccuagguucaauucucagcacccacaaaagguagugggggcucacaacucucuguaacuucaauuucaggggaaccaauggaauuggacucuuuaggucuccugggcaccaggcacacaggcuggauauacccaaacauaaaauaaaaauuuauauuacccaguguggauaccuggccucucccaaccugggaaguuuccugccuuagcuucuaaaaccuaucaucgugaaacacauuucuugaagauuccauagcuuucauguagaaagaauuacagggaccuggccucuuucuugugaacaaauauuuuauacauaauaacaaaagagcauccaaguaaugggaaguaccuuuaacuugggacaucuagaggguuuuccacagcuauuuaaaaagguauuaccauaacacagugguagggcaaacauagguuuugaauucaguuugacugccaccucuagcauggaucacauggcuuucaucaguuacuuaaccuggauacacuucuacugugcuuucugccuguaauaugggaauacuaucauguguguaauauuguuaugacaacuaaccaguguacuguguguguguguguguguauaguaagaaagcacaagccuuuaaaaguggcacuaggacugcagcaauugggcucuguuuaaacauguauugugugaccagaugaguaacacuuucuaguugcacaaagaagguagcaacauacagucaugagcgcaccauugcauucuucuuugccgccugucucuuuagccgccuuccuucccgucgacuguccuucuuuaaggccacggcaauuucuucccucacuuccuggcugucagcugcuaucagcuguccauugugaaguaccugugaguucugcuucagguacuccaugaagccguucacgucuucauucaaguacucuuuuuucuuuuuguucuuuuugcguuuugcuugaggugagucauuucuaaggggcagccuacugcuuugacacugcuuacgauuuggaaggcuuuggucugcucucuccacagaccccuucuucauguccucccaugauguugcugacaggggucgcuuacuauuugaaguaguaacucuagcccaccuggucaugguuggaucagagguacuccacuaaucuguaagauaagagcaaguagcaauuaauuaauuauaaauugaagauauacagaagucauuacuuaucaaauauacucacauuuuaaacuuuaaaccauuaaaacucuucauuuagguagggguacagacacaugguaugcuguguagacauuuuucuacaguauuuuggcauugaacagagagguucuacuucaguugaagaaaacaacauaugcuuaguuaaaacuagaaaauauuuugccagcaaaugauuuuuaaguuagaaaucauauguaaauacuguaaaugguccucuuaaacccugccgucguccuggccauuucuuuuccuaccuuuaaaccagucugccuucucccaaucugcuugcuuaguuugccauuucaaugcaacuacuugcaaagcacauuaguaaacauacacaagucuuguccuuucgucugucuuuccccuguagauguauaaaggcagucuauaaagugucuguagucacauggcagucuucucuuauuuaaugagggugacugccauuugcagucuaaugguuuuaagucauuuucuuuuuuuuuuuuuuuuucgguuuuucgagacuggguuucucugcguagcccuggcuguccuggaacucacuuuguagaccaggcuggccucgaacucagaaauccgucugccucugccucccagagugcugggauuaaaggcaugcgucaccacgcccggcuuuaagucauuuucaaugaacccauuuuagugauccaaauuguaaaauaaacuucacauuaagaaaucuuguuuguuuaccuuuaauaaaugcauaauuagagauuuucauuuagaaugcagauguaagcaguuuuaaaaggaguguauuuuaagacgaauuauuuggcuccaacauaaaauugaguauuuuacuuugcauacuaccuagcaauucugagaacaguuucuuuuucuucuuuaaugaaugaauacaccagacacaaucaaaggauuauuucaacuaccgaguugccacuuucagggcagcauccagugugccaggcaacuuaaagccuuggcaccaggagucugcaacaugcuuucagggccggugagugacgcuguaugccacuuuacagugcaccggucccccgucaccaagagggcggauccuccucccgcacacccggaaugugagacucugggugucuggagggugacacgggacagccggacagcccuggugcccccgcacgcgcggcaucgcuucuccaugcccgccccagcacugcgacccgcgggcacccuagcaggccugcggggcccgcucccagcaacggagccggcgauccgacaagcuagcucccgggcucugcccucgcgaucucccgcaggaguccggccccagucggccaagguagcacagaggcgcccacgccuuaaccggugguacccgcguagcuccuuaccgggucugaauccuccagagcagcugagacaacgaaccagagaagcccggccccggaugagaucgcggccauagagaccggaagugcaccgucuccacgcgucacuuccggcaggccaagcaagggaagcgugagguguuugugggucuuaaacuggggaagguggcuggcuugugccaguuugugggucguguaguguuuguuuguaagggcgcugcacuggaguccccggacacaaagauaaugagcgcccagucugugcggucccagaaugugcagucuagaugacggaaggacucuugggaggaaggucuuccuuacacgguccuuugaauuggacaauauauuucaaugaauuugaaauaguagcgaaauagugagagagagagagagagagagagagagagagagagagagauagacagagacagagaca

SEQ ID NO: 7152 - RNA, 143476 nt, Mus musculus
ccugagcggaggccaggguaggucuccguucuugccaauccccauauuuugggacacggcgacgaugcaguucaauggucgaaccaugauggcagcggggauaaaauccuaccagccuucacgcuaggauugccgucaaguuuggcgcgaaaucgcagcccugagcuguguaccacuugcgcagcuuaggccccgcccccaccaaggcccgccgcgcauccuauuugugcagcuaaggcuccgccccuaccaaggcccgccgcgcauccuauuugugcagcuaaggccccgcccccaccaaggcccgccgcgcauucuauuuguguagcuaaggcuccgcccccaaggccggucccgcacagguugaggcgugcgcgcgcgcaggcgcgagaaagugcggccgcgcgcucgcgcuccuagcaggccggcucuucugcacacugcaaugccccgcgggaaauccgcgucgggaggcucuacugccgccggcccaggcccggggaggcaaacgguucuaagccgguucuucaggucugcgggaagccuaagauccagcgcguccuccacggagccagcagagaagguaaaguacggcuccgcggcgccccuagcguccaccuaggcgaaggccgucccgggcggguucugucugggacggggcggagcuagagggcgggguggggccggaccgcuaggggcggggucaggguggggcgggugcguagccgucguggccggaagcggaggccuuauggagagcuuauuaaugguggguagggcuaaggggcggggccagggaaggcuuaagguggcggcuucuucugguccuuguuuuaguugacuuuuuuacccgaccagcgguaauagauuugaggucuuggugcuuccagucgguagccggaacccgagccagaaacuucuaucguggugaauggcgaggacuggccggccggcccaggaugcguuuuuuaaccucuguucuucauucuuuccuuuacauuuucccuacuguauugaugguugaagaggagcuuuauuuacauaugcuugcuuggcugacuagaagaaagcugucauuaaggcuaguuucucagaauucaaaaccaugugcucugucuuucugauccccgugccagaauaucguuuuacuguacagauuuccaguguaagcauuuagauggaugaaguuucuguacaugcuuauaguuggcuacuuccuguugcuugcagcccaucagauaguucaaagcaaagcaaagagaaacaaaaccaaaaccccaucgugauacugccacaaacacaggcccaaggauguuucccacacuagcuggcaaugugucacacuuguucagggugaguuaaggccucggucauuucccagacugaagauguagaaggugauuguaacgggcaucuccuguauuuuacugcaguugcaaaucaguuuaagaaucuuaacccauuucauuuauauuucuuuccaauacugacuaaugcucuacucucucuuuuuaaggcuuuuuuuuuauuucuguacauucacuaagauucauuuugcacucaccacugagaggauauuaggcaaaaguuuuaaguuuuucauagauuaucugccaacagauagucucaggacaucuuuuaauagugaauggaagcuuugaaacaggaaauacauuggucguuuauuacuccucuuccuucuauaauuuugcauuuugaaaauagauuuuuuaaaauugaucuuguagaaguauuuuauuuaacauaugaguaggaaaguagagaauuccacauaauuuuaguagaaugugagguaaugagagacuguuccugccaguuucugucucugauggcaaaaacagucacccccaacagccuuuucagaguaaaaaguagaguggcaggcaggaacuuacuaucauucugcagcaagguuaaauaacuccagagacuucaagcuuuagaauaguguuaauacaccauuuccaaccuucccgauacaggugacagaaggugacagcaggaagaggucacugggaaauggugggcccacuaagaaaaaagcaaggaaaguuccagagaaggaggaagaaaacaucucaguagcagcucaccacccuggugagugccagagacuaaguauucucagcugcuggcuuccccagaaggcagaggggaucaugggagugcugagcuuuguuuuccuguguagggaaggagcccugcugcuccucagcugcugguugagaggcuaggcccacagaggagcucaguucucuuaguaguucuuccaacuuucucuuuuguucacuauugcuguauuuuuuaaaaaguguguauguguguuuugcgaguguguguguguguguguguugugaguguagaugccugcauaggcacgaggcauguaauccucugagagcuggagucacaggugguuaucagccaucugaugugguugcuggcaauucagguucucugauggaagggugguaugugcacuaaccacuggacaaucucuccugccauguuauguuuuaaaucuugguuauaaagaugaaacauuugcuaaugaucuauuuaucacauuuauuugugugugucauaguacauagguaaaagaggucagaggacaauuugcaugaguuauuucucuccuuacguugugugaguucuggcuuugaacucagcuucuaagacuuguugguaagcacucuuaccuaggaagcucucuuccaguccccaaugagccuuugcugcuguuguuguuggagacaggguuucucuauauagcccuggcuauucuguagaccaggcuggccucgaacucagaaauccaccugccuuugccucuuaagugcugggaguaaaggugugcgccaccuuucccugccccagcgagccuucuuauuaucuaucuuaacucuuucauguuugacuucaagagcuguacuggugaacagagccucuucaugaccuauaccucuaacccugcucaugaccaucuugucuccugcaucuaccauuuugacuuuuucaucccuuuuauuucugcauccagucagcuuuggcucuuaucauuuuccugggauaguuuauaaccagaaauucugcauauuacaccuuuccagagaagucucuaguccgugcugagugggagaaaggcucucagagcuugaagggugagaagaauguaggcucaguuuacuuugaaucaguucuuuuuauuucagagcuuuccagacuccaugguggccccauucugagacuuaagcauuuuguguugccaauugaauuggcuuuuugcuuuucuaaggauugggugugacucuuguguacugaauuagugacuauacaucaguucccugucuagcuucauauaccuggccugucugucauuauacgcaaagaaacaagaagcagaguuccacuagaguucugcuuuuuaaaauuaaaauugcacugcuuauucuuuuauuguguguuuauugugugugugugugugugugugugugugcgcgcgcgcgcgcaucugugcaugggagccauauauguguagaggucagagcauagcucgaaggaguuggcuuucuccccccaucuuguuguuucuggucaucacagaacauaggucaucaacuuggugacaccauuccugcagagccaucuugccagccucuuugacuauacuucucuguggauuucaucagugaaugaaauuauauguaugcuuaaaugggucaucuuuaccuugaacaugguguucuuuaucacauuauagcuaggugcauugcuccaaugggaauguccuucugaaaaauucuaugcaaguuaugaauuguccuagugaagccaaaauacuauugguguguuuuuuucuucauauuucccaagaggcaaagaaaugucugaggcccaggauuguuuuaaagucccuggaaaaguugaaagaauucugcugugauucugcccucccucaaaacagaguccagacagaagcucuucgggagagacuugaaguucugccaagguguacugauuuugaagauaucacucugcaacgugcaaagaaugcgguuuuguccgaagauuccaaaucucaggcuaaucagaaaguauguaacugcugcguaggugaauaacuagucaccuggguucugaaguacuuuucgcuucuuugagguuacacaggaaaauaaaugguuuccauauccagucauccuugcuagaugagagaacauuugugucuuagcuuuucuugcuucuuuucagcauuuaagaguuuuacuuuuauuugggggagaguaguugguuuuguauuaagacacaacaccuacaggcaguccugcuguacuguguggguuaggaacauucaugugggguugcuucucauuggcaguuuacauauuuugcauggggaaucccagugggcaucauauacgugguuuuuucaguugaaggcuuggcagauacagucaguucagagguaaagcaaaugaguauaggcuuuauauagauggugaccagcucugcauugcaacaauguugcgaacucgaaguaaccagacagaaguuucccuggaagccagggaacuaaguggauguuauuacaggcaauaggccauugcuguuguauuuucuuugagacagggucucacauacaacccuggcugcccuugaacuaacagggaccuaucaaccucugucuucuaagugcuggggcuaagcuaaagguguuggacaccuuaccuggauugaugagcuggugggggucauaggaugcaagugagugguuaaaagcuaccauauuguggggcagucagugcagagccagcagcaccagggcucgugacagguuuccugaauucacaguugaguucacugugcuggcucuagggauauaaaagcauaauaggucugagaaauauuucugucuucauaguuuuaaaaauuguuuaauaucaauuuguuaguaucacacugauaaauuuuuggggggaggaagucuaucuuauuccauaaauguguacuuuuucuaaaaauguaguuuuugugaaugggaauuaaauuuuauguuauauagcauccuuggauuuauauaaaaccauaaaaacaaaagggaaaaaucucauaaaaauuaaagauaauuguauucugauucaauaaaccacauuucucuugccacgagucugcacuucuucuuuuggaggcuuguuuguggacuaauggccuuucuuuugcugagaugaacugucugacaaaaucaguuuaaggacagcuuuauuuuagcgcacaguuugagggucugguccaucagagggaaggcaggugcagggcgugagacacaucugcagucuucccuagucaggagcaggugagggccagugcuccgcucucuuccuccugucauuuagcauaugggaugcugcugccguguucaaggcuggccgccuucccaguuacugagugaggggagcacauugcagcuugauuauugagaugaguugagucucuuuggaagguuacugucuaucaguguguuuccugaaagugcccuggacaaguguugcucgauccuguccaacacuucugggaauaaauaccaagauauuaauugauuuucaaaauaaaaaauguaaagcauauagaacguuaaacuauuuagacuuucagucuaguuauuuauagaguuuacuuuggcuuucuacuuugguuucuuuaauuuuuaaaguuaucauagagaguaauuguuuuccuuuucaucuugauaucacaugucauuuucacuuguaccccuucccccacugcucucucuguguuuuuuuuauuuuguguuuauuuuauuuuggaaaaguuuucagaccuguagauaaauugcccucagaaugccuuuagaaaccguucuguguugucacccaguguuagcuuugugccaaacuugccuuuauucugagaacucaacaguucaguuggugcuuucuaaacuguauacaucuuuugguuucuaggacagucaauuuggacccugcccugaaguuuuccagaagacuuccgauuguaaaccuuuuaacaagcgauccaagagcgucuauacaccguuagaacugcaguacuuagauaugaagcagcagcauaaagacgcaguuuuguguguggagugugguuacaaguacagauucuuuggggaagaugcagaaguaaguuauucuuucuuugccuuccguuuucuuuuucucacagggucaugcgaugcucccugcauuggcuuugaacuucugauccugcucagccucgacacccccaaguucugagauuaaagguguucacgacuaggucugcuuacaaguuguguuuccaagcacuaacugauacuuuucuuauguagccauagacucuuuuaauagaucuuauuuucugucuuaaaauauuuuauuuauguaaccuguguguauaugugugcugugugucuguguguguguguguguguguguguuugcuggcucacuguaugucaacuugacacagcugaaaucuucagagaggagggcgccucaauugagaaagugccuccauaagaucagucuguaucaagcuuauagggcauuuuauuaauuaauuuaauuaugaaauuuuuagcugggcaguacucaggaggcagaggcaggcaaaucuuugaguuugaagccagccuggucuacagagugaguuccagguagcuagggcuacacagagaaacccuaucuuaaaugccaccuccccaauuuuuuguaauuaauuuuguaauuaauggaggagggccuagcucaggugguccuggguguagaagaaagcaggcugagaaagccacaaugagcaagccagugaacagcaugccucagugcagucuuccuugcuaccagguuccugcuuuguaugaguuucucuuacacgcguucucgcgaccggccaggaagaacgcagcaaaccggaaucuucuguggcaaaagcuuuauugcuuacaucuucaggagccagagagcaagagagcaagagagagcaagaaagcaagaaaaagaacaagaacaagaaagcaagagcaagaaaaagaauggcaaaaccccgucccuuuuaaggagaauuauccuccgccuaggacguauuacucccugauuggcugcagcccaucggcccaguugucaucacgagaaaggcagaacacauggcgggaaaacugccccugcacgugugcagauuauguuuacuacuuagaacacagcugucagcgccaucuuauaauggcgaaugugagggcgguuccucacaaguuucugccuugacuuucuucagugauggacuaugauauggaaguaaagggcaaauuagcucuuuccuccacagcuuucuuuggucaauaguguuucaucauagucgugugaccccuaacugagacaagaugcucuguagcaucggaaaggcguguuuccucuguauaaauggacacaccaccuaagaagcccuguaguggcuucuacuugucagguauuuagcuggucaauuuacauaacaaugucuuguuccauuauacucucaggcucuuacuagagggaagacugaacauuuuaaggcuuuggaaacauuuguguauuaugaggauauugaagaagaacaguuguguuuuugggauuuagauauacagauguuggcucugaagucacccuguuggaggugcccaaaguagaugaaaccauauguguuauacaggggauaucuuuuaaacauuuuaugaugauuauguauuuagagaaauaaaugucagagccuacauguaugcgacaugaugaacuguuuaaaaaaugaacaaaccuuggacaggaagccuugaauagacauuauugacaugccuuguaucuacacuuuuuagauugcugcccgggaacucaauauuuauugccacuuagaccacaacuuuaugacugcaagcauaccuacccacagacuguucgugcauguccgccgacuuguggccaaaggguacaagguuagcuuuggcuuugauuugugggaacggaauugggauucucuucuagagagugaaaucaugucuuaugaagugguauuagccuuagaucuugggauuaugggaaauuaauaugcauuauaguuauuagcauugugucuguauuucuuucuuucuuuuucuuuuuuuuuuucugaaccagagucuaaguuguaaagcccaggaugggcuugaacucauacucacucacaguccuccaagcgcugggcacauaggcgugcucuaccgugccagcccuggaguguccgccacugcaguguguuucuuccuuuaucuacuugccaguugcuugggguucuuucugcucuacaucuggacauggaggauguuuccuuauuuucauugcuucagaaagaacauuuuaacaguuugaaacuuuguuaaaaaaaaacagugguucacuggauuuggcaguaagugugucuuauuuuuguugaaggugggaguugugaagcaaacugaaacugccgcauuaaaggccaucggagacaauaaaaguucugucuucucccggaaauugaccgcucuuuauacgaaauccacacuuauuggugaagauauccuuuuaggauagaagcuuccucuuucuuguuguagggggggauuugcuuuaaaaugacaaauuuaacugaacaguuuuuccuuuucucuaaugacagugugcuugcugaguuguucaggcacuccucuguggugggugugucaccgaggagagggcggguauguguccauugucacagugagagcagaguacauuguacuuuaauagcaagaaaaagaaaugagagcaaucaaccauccccuugugggggcguguuagguguccagggcuuugcuggcuccgcagaagcuugcuaacaugagaccugaaaggaacuuccugacuucaugugaaaacaacuccagaggcgaaauuaagacacaauuaaaugugagauugucuucauuaauugacgucauaaacaaauuauugaaauggguaguugguugaaauuuucucuugcaggcuucaguguguacaaucauuauaccaaaguuuaucauugcucauaaauucuuuuuguuaguugaagcaaaguaacuucaaaagcauaauaauaagauucuuaguuuuuuguucugagauacagucucacuguguauuacaggcuggucuugaauuucuucuuaagccuuucugguugggauuauccuugucugggcaacauacuggacccauuauuuuaugaagugaaauauuuauuuagaagauaagaacaaggugcaauuaaaaagauuuacuagauaguaagucaagucucucuuuuuuuaauuuuuucuuuuauuaaaaauagauuucaaauccacaucuuuucuguuucuuuuagaaaggaaacaggcaucuaauaaauuauaauaaaaucaacuacaaaugauaaagcaaagacaaaaaaauuagaauaggacaaaacuaaacaacaaaaacucccagagaagaagcaacagaaacacauacagacgcagaggcgcacaccaauagcucacacaggaaucccacaaaaacccagcuggaagcuuuauugcuuauauacucaaaagacuguaaaauuaagauaaacaaauugcuacuuccaaagaugugguugcguuugucuuguuggccgucugcugcugggcauggggcaugcuacccuuacgagugguuggcuuccccagugggacugcauggagaaaacaggaugauuuuguccagcauaagcuuuuacccuugagaauuuugguuaaugggauucauuuuuuacgugucugagcaugcacacuccuauauguaaauguaugccucuguuuaauauguuaaaauucucuugauguuucuagaguccuaggcacuuuagagacgggcauuuauguaugcucuuugaguguguguccuuugcuuuguguagcauugcuggguuguuaaggagucaagugccacggucgacccagcaaaauggguucauuuuugggcucccacaugguugcaggugcaccucuagccccuuuggaauugagaagauaauaguuaccuguccuuguaccuguuauaguucagcgaagagacgccaugcaacugugacuguccuuggaagaaugcugcgugaggaaauaacccuuuaucacuuagugggcaugaagcagcaugggauuuuucuuuaaucauuacuacaugugaauccucucaucaggcuggaugauucuguaaauaucgaugagguaaugacagauacaucuaccaacuaucuucuguguaucuacgaagaaaaggagaacauuaaagacaaaaagaaggggaaccuuuccguugguaucgugguaaguccuuggaaggugagagugagugguggguguucgugguaccucgugugccaacguugucgugagcgguacgucaugaggauuuggaagugcucccagggaccuuacuaggaaagcauuucccucacaacaguacccaucaaguaauuaguugcgguuuucuuuucugguuacuuggcccucugugcuggugggugguucagauuguucagacuaugugccauugaaaaugguggcagugaugggcguucagggggacagggaccugauagcacgacaaaaugcuuuacccagcaugcgcauggcuagcaaagggcuccagagauguccucuaacguguggucuaaugggagcgguuacguggcuaauuagauucugagggauggagaguuaagggagacaauuaaguggccggugcaggacagcaaacuaaaguaauacagagauauguccaccccgucuuccggucagugugauuuaggagcuguagcaguacuaauuuugcauucugcccacucuugagcagauuuauccacuuacaggucuaagacugugccccucaggaguauuagacucccuuauaaccacucuuugugcuuugucaauaucuacagucagugaccagcguuaacaaacauuccuaaagcaucagggucuuccguguaccguuuaauacauuauucauaccacacaacugugcuaaccugacauuugcuuagccaguaagcucuucucucggggaguuagcaagacugugagagugggggaggcugaaaugaauguuucccccaugagauauacuuucuauuuaauuguagacaguuggccccaucuacaaacaguaaggccauuugcucaucggcguuagcauauguaccgugcuguuguaaaucuaccuggagcucagacugaauggucgcacaggagacacaggcccugcucuagcaucuagcaguagcauccugccacugccaaggcuggcuguagcggcugagcagggauaugaacaguuggagcaguggucauugacccuaagugguucuggcucucaucguugacuucagcagucucuuuucuggcucacgguggguguccugagcucugggccaaggcugcacuugccauugagcucuggaaucuuuucuuugaauucugguuugaccaccuccaacuuuauguacaaaggaagccuacuauguaaguguuuugaauuguuuuguucccuguuuuauauacaaauuaaaaauuuguuuuucuguuuauuugcugggcacacuaugaggaucggggucacacauguaccauggucaugccugcagagauuagaggacacuucaugagaaucaguucuuucuaccccgugaggaugaaacagaggucaccaggcuugguagccaccccuguaucggcuggggcauguugcuggccugaaugugacauuuauuuauaugcuuuagaucuuugauugcagugcucuuuaaucuuaugacccacauguacucaccccucuguugcuggacacauuagggggcuugguaauuuuugccucuguaaagaauaugguagguacuuuuugcaucuuaugcauauacccaagcucucaugaguguauaccugggaggaauugcugauguaaacacugcuggcauuuucuccuuuccucaaugaugccuggcucggaaguggcugucacuuaguugauugcauuaacaauauaaagauuugugacacuuguggcuuuucauuagugcaaacuguccuuuucucuucaucucugaggugucagugguagagagagugcagccuggggaguagccgcagauccaucauuuuauugcuuucagacuuugguuaagcaacuguacuaaguucuucaacucuuccaaaccuuggccccuuucagguuuucuuacguugucacacuggggugacagguagucuuggcuguuuuacuggaaacuagauggguuucauucauuguguuauguuugauuucugcuauguaagaacuagacuguguugcuuguaugcaaucaguuugguuacuggcucuuuguccugauaacuugcuuucuguacagggcgaagcugaugcccaggaacgcuugaagacuuggcacugucaaguccaccaggucccacccuguacucagugugucucaugaaacucccacuuaagccuauugcauuaauuaauuaauuaauucuguguauacauggcaaauguguggcgcccagaagacuauacuggguguagguucuuuccuucuaccauguaaauccuguggagaucccacucagguccuuaggcucaguagcaagaccuuuugaccuauugaguccucucaccagcccucagccccuuuuagaugccugugacucuaacuuacaucagagucuuaaaaggcagauggauuuucacuuuaaaagcugagcgcauuuuggggagccugucauuaaguaggaccgugcuugugaugugucggugcagcugggaugcuuucuguguuccgugcuaugaugcuuacuguugcuuccagggagugcagcccgcaacuggcgagguuguguuugacugcuuccaggacucugcuuccagacuggagcuggagacucgcauaucaagccugcagccuguggaauuacugcuucccuccgaccugucugugccaacagagaugcucauccaaagagccaccaaugucaggugaggaaugaucuuguucacacuggagugacuucccaaaccaaugcuuauucuuacagaaauuacuuaugguaauuauauccuaaugacagaguguuuuuguuuuguuuuccccgagucagagcuucucuguguaguccuggcuguccuggaauuugcuuuguagaccaggcuggccuuggacucacagagauucaucugcuuuuccucccaagugcugagauuaaaggugagcaccacuacccuggcuccaauaauagaguuuuuaaaaggaaaaaacuguauaggacuauaaaugacagucauucuaaagggauuuaucauauuacuuaauuauauuguuuaaagauuuaugaauauauucuacagguaaucuagaacuuauuucuuuaaaugucuguauaauuucugugcugcgaguuucucuucagcaugggagggaccgaggaguuuuauuuacuaggccuuauaucacagcacuuauuuugaagcaaguagaggagaagaugcaugugugagacuggacacgccuugcuggauucucaaugcaugccguguuagcucuacaggcaggugccucuguggaagagugagagaagggcagggagcauggguaggccugugugccaucuacaugaaggaagggaugacaagccacugacuaaaucaaacugauuuaaagucaggccuugauuuuacaguuuguuuuucugaugauagcacuaauaugcacuuacuuagaagaauuaagaauuacaaaaagaaagauaaaauaaauccaguuccacaaauacagaaguaacugcacuuugguguuuuauuucuuuauaaguauuacuuuuuuauuuguaaacuuagguucauguagcaaauauagcuuuguaccuguauuuagcuuaacaauucccuguuuucucaugggaaauuucagacacaugaauguagacauuucagaagagacuaagggagcauuaguguagugagacaccaccaguccauccgccagugccuaccugccccaggccggagccagucccggucagccacacccuucuuucccuggggugcuuaucuugaagcaaauuuuagugacuacugcuugucuccuuuugucugcuaauauuucaguaaacacuucaaaaacaugaugugucugacauuuguuguagaguggaccgcgaugugucugcugcuuucgguuguguuuacaguuuuguugcucagguggugcgguagcaucugcagacgcguuugugugcauucugaauuccuucccgaauuucugagucagaaguuagaaacauuuauacaaauugugguugcuugcuaaauugauagauaauacugguccaggggcuucaugaacucuuuggaacauuuacagggauuaucugaauaaucuuuauuauuucuauuauagguugaaaacuguaagaaaauugaaaaccccuuuuuuguucuugauucucuucuguguucaacauugaccaguuaaaagucuaacaguucauuuaugaggggugcugaugcuggagagcuuaaaguugaauaaauucuuagacuuuuaaaagaaauuccuaaguguaagaacauuuacuguguuucaugccuuuaauauuguuuauuuuccuucauaaccaaguguauauuuaauuaauuuagauuaaucuagaauuuggucauuuuaaucauuguguuagauuucuguuuucuaauuauuuuuauaaaaauuaauaaaaguuaaaguaaacaagaagaaagccaaacccugucugugcagaagcagacagugacacgaugcgauuuguuuggcaaggaacuuugccugauggcauccucgugcucacgucagaugagggucagaagccuggguuuggcaugcuggagaugcuggcugacugggacucaggaaucuaacgacuucaggccaucuuaguguauuucucuagcuagcauuccugguuuauaauucugcucacgcuuacugaccaaguaagccuccauuccuggucaauuuucuuucuguaccuuuugcucaugaagaguggagaauuaagccuaugucucuaugagaaccuguaccuaauuuaugucuauagagaacaaggugguagauuuucagacgucacaaggucguagguuggauggaaaucugucucuuugccuuagugacuuugaguaaucaauuagacuaucuugucuuccuguguccuuguuguauaaaauacaggaaguaagagugcucacuauaaagaugaguuguaaagauaauaugcauaaaguuucuaggauagggccuggccaagaaaacucacuacucagggaaaauaauugucuuaguuccucuucuguugcaugauaaaguaccuuguucaagguacuuuauagaaagaaggauuuacgugggcuuaugguuccagaggguuagaguccuugauggcaagagcaggaggcugagggcucacacuugaaacacaaagcacaaaacagugaacuggaaucaaggccuugaaaugucagaaccugcucccaugacacaccuucccaaacagccaccaacuggggaccaaguguuccagugcuggagacugaggccucucauuuacaccaccacaaacauguagccauuuccccuuuacuauugcggcucccugcuuacugguuuuuuggguggcaggaugcgguucaggauacauguauauauuguuuucuuuuuaaauuuaaguugucauguggcccaggcuggccuccagcucccuguguaucugaggggugcccgaucuuccugccuccucuuccuggaugcugggguuacagcugcaccacacccgccucccuuagucucuccuggaacaucuauuagaguacauugugccuucuuuuucuucucuuugcacauuucuuuuaggauguaguuucucgacuacuguuagguuucuuuuguuaguuuugauccuugauauuuauuuauuuuucaagaaauaaucuuacaacuccuuuaaaacauuuaacaauuauauuuuaauucaagguggaagggggucagugggucaaaugaucgaucgcugugcaagugugcagaucugaguucagcuugugagcacccacgcgggaagcugugugugacagugaaucccaucauccuaguguggggcaggaggugggagcucgcagggcuccucagaggacccugcuguuggugcugacccuugauucuugugugugcacacuugggagcacccuagcccuagagacgggugagcuggagacuugccaaggaccuugcaagaaaaguaaacacauuuuuuuuuuuuucccccagacaggguuucucuguguagcccuggcuguccuggaacucacuuuguagaccaggcuggcuuugaacucagagauccgccugccucugccucccaagugcugggauuaaaggcgugcgccaccacgccuggcaaguaaacacauuuuaaguaacauauuugauucgcuauuucuacuuguuguuuuuagugaaguauuuggaccaauuaagucccugugcuuuugguaacauccuauuauuuuuauaauuugaaagaucuuuucucaucuugagagcacuuuguaguuuuaccuauguuuuauuuuuaccaaaaucuuuuuaaaauuuuauuuguaguacucaauuauuauuauuauuauuuuuuuuuaugguuuuucaagacaggguuucucuguauagcccuggcuguccugggacucacuuuguagaccaggcuggccuggaacucagaaauccaccugccucugccucccaaguguguagugcucaauuuuaaauuuacauuuucuuuauuucaucguaugaggugaguuccuuaauuuuucuuauuagagacaguugcuccacuuuaaaacccacagagcucaggaagaauaguuugccagacuucuguucucaguuggcuuacaggcagcaguguaacguucaauuuucagauaagaaaguuuuauugugaguuuaguggugucuggugucagugcugacauguaguuucuuaucucucagaccuagagucacacuguaaccccgucuuuuucugcacuagaugagaaggugaaagcuccaguuuuugucagguacugguggguauuuuacugguaacaaagauauuacauauuauuacuaugugagaagaugcaaaaguugccuggaauuauagcagauuuaauauaguuuaaaaaacaguuuuuaaaaauuuaacuuuuuauuccuaacuuuaaccacaagaggucuccaaaggauuuuauauuuuguguuaagauuuuucuuuuuuaagaauaugaaauccuucccauuuauuucucaagcuaguugcauucauuuuguauagugugucauuuuuagaguaaaacaaauagacaaagaugaucgucagcggaaucagacacuccugaauaguggcagacuguuucucacgugucugucagaggggaucaggcauccuauuccauuaucccauugguugucaaauuguauagagagaaaaaaauagcagcaguuuugagauugcuuuaguuuagagaguuuuauguuuauagucaaaagaaaaggaacgaaaaccauuacuuaaacuaauaauaaccguuacuaauaguauuuacuagcucucccauugaguccugagccgagcauggugacugucugaguucacagagauggacguacccuggucacagcaggcuguggaggagguggguugcauagggacauuugcaggacggaagacuugacuggaugaaagagaggagaaaggugcauaguguguaaaaugaaacgauucagacucgggcacacggcgagacucuugaucagaggaaaugcucaucuuggcaagugaggaaaacucauagggcuuuaaccaagcaaugcagggaaggagauauauucaugggggagagucagaagaagaggugggugagcuuacugccaggagagacacuagagcuuggggaaagucaguaguugaaaguaggaagaaagagagguaaggccagggcgaguaggaggugggcuguggucauaugugugugaguaggaaggaggucaugugagugugaguaggaggugggcugugcucaugugagugugaguaggaaggaggucaugugagugaguaggaagugggcuguggucaugugagugugaguaggaggucauaugagugugaguaggaggugggcuguggucaugugagugugaguaggaaggaggucaugugaguaugaguaggaaggagaucauaugagugugaguaggaggugggcuguggucaccugcugccaggcuggauuugguggcacaugccuauaguuccagcauuccagaggugaggcagaggcaggcaaaucccugucuauggagcgaguucuagguucuaggacagccaggacuauacagaaaaacccuuagugggaugggguugaagaauaagagggaaaaagggaauuugucucauuaaacuguuuaauaaucugauguuauuacauauuugauggcuccagguuagugacuacaguguucuaaguuuaauaagauagugccuuggacucagaugaggccaucaacaugauucuuaggucucaggagccgacuaaccgagggaugccuuuucaagcacugaggauuaugggaaggaacagcuaaguaccucagucugaggggauguugaggcugggcaauguaaggacagggugugggggugggagugggaguggggagaaaggcuggcugagacaucagcugugggugcagagugaccugucagagaugcucagugccggggcagggggcuggagugcccauccgggaggguggggcuuuauuaagauguuucucaggcuaucuugcugaguccuguuauagcugcuauacuuugugucagaauuuguucuucugcaauuuaaauaacauuuaaaaaucuacagagacaauacauuuguuuuucaagugaaaaaauaccuuucuaaaaaggaaaacggcugggcgugguagugcaugccuuuaaucccagcacucgggaggcagaggcaaucggauuucugaguuugaggccagccuggucuacaaagugaguuucaggacagccagggcuacacagagaaacccugucucgaaaaaccauaaaaaaaaaaaaaagaaagaaagaaaacgauuuuguuaaacuucuaaacuucucaauuugauauauauuauuuuuauaauuuauggcuuaaauaucuaaaccuaaaccuuggugcuguaugucauuuuuguaauaauaaagucaagaguuuggaacacagaugggcguauguacaaaagucacagaaugaaugggcaguuguuggaugugaaggaggaugcucugcuugaagugagcuuuccuagucaaguggggccgucagauacugcuuuuuccuuaauagcuuccccccaucucuuucuguaaguaccgguuuuauaaccauagcaaaauaaagagggagguagcaauuuuucagacgucuucuucauuauccauaucauccacagcaaaacuagguucuuuuucaguucagcauugcuguacuucaucauaaagaaucgguucuuuucaacauuuuuucuguuuuuaaauauuuauuuuguguguauaaguguuuugccaugcaugcaugucugcaugucugguacccauggcagucaaaaaguguagaauccuguggaccuggagguuuuggaugguugugaaccaucgugugagcgcaggaaacgaaaucuagguccucuuccagagcacaaguacacuugcuuacccaaugagccaucccccaacaccucagacaucacugcugaugucaaugcugauguuucucuagcuccuccucuuguccaggcuuccucuuguucacucacuguuacuguugcucugauuucuuucuucccuuccucccagacucugauaacagcaguauuuaacugguguuuccuugguccuguagguugucuccaccucacugguaguucccucccucuucuccaggcagccaaucaccaagcuuucuaguuugaauauugacuuuucacuccugaauuuuuuguuuggguuuuuguuguaucuuuuaauuucugggcagagauuuuuuuuuuaucuuuuuauucguuucaagccuauguauacugacugguaagacaugaauaguuaauuuugugugugagugugucuaucugggcacacaugugaaggucagaaggcaacuaugaugugcauugaggggaucgaacucaggucaucaagcuuggcagcaagugccuuugccuuuugaccugucuuguuggcuuuugaaacauuaaaaagaacaacccagcacugccaguuucucuguguccauuucauacauauauacagugcccugugaucauggucauuuccauugcucucuccccacucccucccucccaaccaggcccucuccuacucagaaugccuauuuuaggucccauguccuguguucguagccaccucugcugugaguccgugaugcaugugaggccuuggcacugucagagauucugacguugcugcugugcggcuguugguccauugauuuuuuuuuuuuuuaauugaguuugucaucuuccuguuucuuagugugauagaguuuuggugguaauguguguuuuuaccuacugugaggcaagaauccaggccuuacuuagacugucuucagagcuuucugauuuagcaaggugggcugugcugcaucauuacugccaaguggagauacauucauguucccucugcagccucuggugggugauaugaguucuagcuucucauguagucucugugucauucaguaggggggaccucaccaccacagugagugacguacaggcugccugugugcucuccauugcucuaccacggggccugaggacuugccagggauggauaucucaguuucuuaccauccucugaccacaccagcaagggguuuggugcuucuccagcagguugagacuggagccuacccugcuaaguccucccuagggugggugaagguuggagcauaguuuuccuguagccccuggcuagaguacaggauuuauugucugaaauguugaccuucuaacauguggcuuuccuagcucaaaaccugguuguguguggugaagaguaacacgagggagccccccccccccccccccgccuugucuuuguucagcuugagggcccuagauggucugucucuguccgcucugucucauggcuaacacaggggaagucggacuugucaggaggaacacaggaacacauuuccauuccuuucuggguagaagccccuuggcuagguuguagugauugcucugugucaccuuguuuccuuagaggugucuuaauauaauuaaaucauuaguacauugauugucuugcagagauuuauugcaguaaaguugacuuuuguaguugugugagagugauuaaaacuguaaaauauucuguggagcacagucaguggggcccauccuggccucauucuccuaacuucacagcaggggucuacaaaaggcaguggugaauuucaucagcccuccuucaaagugacccucaccuucuugcacaccuuguccuuucuugucauugcacaaaacugagugucaguuaaaauauuagaagcuaccuuaguagcaacuggccccagagcccagaaaggggguucgucccgugcagaguccgaggcacagcgaaggggauggcugaguuaccagcaagcaccccagcuaccaccgacagccaucaagccacaccuggccugcuuaccugagagaauuuuaagugacuugccuuuuuuuuuuuaaacuuccauaguuaaauauuuacuaaauguauauuuaaaacaucuaauuagugaacugaaccuguaauuucauaaauuuuuaugguguagaaagugucuuaaguuggcauugagcugauuuagcaagagugagcaagcuagugacaugcucacuggcagagguggaagggagugacugcaggaggcgaucugagcacuuagggacagugccacacucacccgcaccuccuuagauucucucacuugaacugaacgguguauaaaucggaucacuauuuaaaugcuaaaacgaagccaaguagaaguaaagagacuguaagugaugagccugaggcccacaugggcccuucagcucuccaaggugggccauccuccauguuuaugacuggcuugccuuuaggauauuuuauucuaccaucuagguaauuuuauuaauuuaggugucuagcaguaagcuuuaaugaaacaucuuuucugacgucuaagaagaaucuugguauguuuuuccaguagauccucaccuuguuacuucauccucugagcugcaccauuacaugcuuguucaucauugaaaacaguugcugggcaucgccaugcacggaauuuguaauuaggcgguaacgguacaaaacaggguaccgugcaguuuucagagaggauuuagucauagggcaaagcugagaucaaugggagcgcucgcugguugugggucucuggaaagucccugcuccuagucugaugggugguggaugcugcaguccagcacuugaggaguucuuugccuucauuaaauaacaaacaaccaaaagugcagucagcucucaccuggaaacugggaggagucaguaacggaugucacuggagugacagcggggaagguggagauuuguuuguuuguuuguugguuuuuggaguguugugaaugaaugcugucauggaggcaggacugagcuguggcuuagagaggaaagguuugcagcugaaaaggaaggguggggaaagcguggccugaaggcggucacagcagggcugggaaaaggggguuucggugcaaaagguagaugaggcuacugguuacagcgcgauuucuuaaugauccccuuccaguuucguuuucucuucuuuuguuuucuuuuucucuggagcuacugacuugaaaagagcaaaugaguugugucugcaguagauuuacugacaguagccaagcaagaaaaaacccagcagacuuggccuuguggguugcugcagacagggugccccaggcagggcugcacugcccaagcagacaguucaggagcaguugugugagaagcagccuuuguuucaauaaguugacuugaguuuuuuaaguacccuuucucuuaugggaccaagggugugguggcauaaaguuuccucaguaacuaaauacuuugcuccucguguuuuguuuuguuuuguuuucuuauuucagguggauacaaggagacugcauggcagggugcagcuaaugauggaaaaggaaagacaggugaaaaaggcaaagaguuaaguuaagggaugcaguugcacuugggagcuggagggagaggaagcagaaguucuaggaacugagaagggaauguuugcauggccccugagaacuccugcuggaaguugacuuagggacugacggguaggaagugcggguugcuugaaaccgcugaauuugugauaacuugcuggagcagagacagaaagugguacccucucagaaauacgagguaaccuaggacagucacacagcaguagcauaggcagcggugaugugaacuguaucuucgugucaguccugccuguaaagaacuuguaaaaugguaaccauucacugcaguuaacaaagacuguguuaucuuucuuggggacccaguuucuuuugcccugcuuuuauucuguugaaguagagauaauuuuccugcaccuauaaaauguuaauuucaggacuaggaguguaacucagugauggagagugugcucagugcaaacagaaguucugagugacaugcugagcacacguaggaagcccuugauagaguaauugccacuuggacaguuucuaguuacuaaguaaggguaccacuuauauaugaauuauuguauaggugccuauacuuuaccgucuuuuccauaacucuuagcuauagcacaaaacuuaaguagagcgagacagaagacugcccuccgugcagagugaaauccuguuucugcugcacagugggagcagccuggucugcagcuugucgccugccugccuugcuccuacuuguuaccacagagggacauguggcuuagacuccucaucuccuggggcaagcugugcuucugagagaaguucucugugcuucuucccuguuuccuuccucggugucugucccucugugucagcagggcagacacuuacuucaggggccuguauuuuagucaccacuguccuacccuguauaguaaaauagcacuggugccagaguaccgaugugucacacauucugauuaacuuaaaaaugugcaguucuacacuuaaacccuggcugcuuguaguaaguaaugcugagucagcugucaccauuccccacagaguccucuggggucaucaugaugccaguuguuugagggugucuucuuucuaacuuaaaauguaggugucccuaccuagugcagccuggauugcuggugcuuuauggcuuuccccuugggaaugggguaacuguaugauuuuugugcguuuguccugagagacucuagguugccgacuuagaagagagguaagugggccuggagagacagcucacuauguaagagcaugcacugcucuuagagagaacaauuccuagcaccuguuggugccuuacagccccuguaagugcagcucuagagaauccuaugccuuuagucucuguggacucuaguacauacgugagcauacuacggcccauaaacauacaugaacauaauuuuaaaaagugaacauuuuaaaaaugugguaaagagaaugaggcagugauuuuuuuuuucuaguaagauucauaauuguaaguaauuccaauuugauucaaugcuucuacauauuuuuuagaugauucuuuugugugugugugugugugucugugccugucucauuguguguuucugucuguccauuugucugccugugugcaugcacacaaacgugggugcuuauagaggcuaaaagagggugucagaucccuuagaacuagaguucuggugguugugaacuacccagucaguguaggugcugguccucugcaaaagcagcaagcgcucuuagcugcugagucagccaugucuccagcucccaauucaaugcuuuuaaauaauauuuuaugcagaaagaguaaaauggcccauuugaguuugauuugcagaucccuugcuugcauuaauuaccauauaccugaggucaggcaugcuuuuccagucugauuuccuuuucauuuauguuuagcauuccgaagcuauuuagaggucacacuguacuuuugcuacacuuguuucuuacuaucuucugcacccuaaccauucaucccgugguucuccagcugcuguccuguaaaugcagcugugguucuaagcauggccguccuuuggaguacuuacuagcuaauaaaaaugcugucucaucagguuuugcucugugaugcaguaguuuauagaagcuuucuagaguugauauauuucuaguaauuuguaucaaguuuguacaacauuagcuuaaaaucaucuaugguaggucagaguauuggcauucuagaaacuggcagauaccaagugauucuucuuggcgucuuccuuguuauaauagugauuuguaagcucgugccugaggcgcuguugauccuucuaguggaauugcagcaacugacuaggugugugagcagccuaacacgguuucacacaggagggcguggucccaagucaggguggcagcaguguugcuuuugaggcuaggaaggaagggcaguucucagcugucuucuuagugucuccccauaucacuguccucugugcuugugacauguacacauuucugguguuguuuuaaauacuggaguacagcccacuccaaugaucucacugaaacagacacccauguaaagacuccaucuuagguaugcuaggcuauggauaaguucauggggucacaguuuagccuguaacccaugaaugcacaucuguacaugcauuauucauuguucuaugaauucuaggaaacuuauucugaaguugcucuugguauaauaucagaauuaggauuucuggagaaaaccauuaguuuggaugaggacuuuaggccccuugaaguagccuaaagauggguuuguuaaucagccucuggacucgaggcauauaaccugagugaaauggccugguuuuguuuugcugaaaaaaugcuuuuaaugcauggaagacauuuugagaaaaauuuccagcuaucugagaauguuucauuguuguauuucuucauacauacguaaaauggaguuuuuuagaaaaaaaaaaaaaagcuuuucaaaggcuggcuuagaucuuagggagaaacauuuuuuuauuuguaaauuuuuuaguguacuaugucuauauauuuguauaaguucuaguugacauuuaauauaccucaaguuguguagauauaaaauauacuuuuuaaauauauauauaauuuuuugagacuggcccuuugaaaacucugguccuggcugauuuggaacucacucuguagaccagacuggccucagacucacagagauucaccugucucugccuccagacugcugggauuaaaggcgugugccaccauaacuagauuagaauguccaucuugaaguccaguauuuuuguuuuaaagugaaagauaugcaguuuccuggguagauacuggaaucaaaaucuuacucagaaggguuuggaguuuacauuuccaugggaauuuagucauguuaguuuaagacuuuaaaaagucuuuagcuuuaaauuauauacagcagauucaaaaguuuuauuuguagucagcuuuaaucaguugugguuuacaugcaguaagcuuugcacauuguaaguuuguuucagucacugcuaguguaacauccugcagccaucaucccggguaaagcuccgccuucucuccagacuuccucugccucucucuggcuccucucuuuaucuccaaccuucacuacaacauugaugauaugaucacuggggucagagagcagggcagggcaggcuguuuuaggguuucacacaacuggaaucauuacaguguggacucuuugaugucuacuuucuuaccuuugcucaaagaaauguguaguuguguugaauguaugggaggaaaguuuguucucuuuaauuggugugcaguuuuauuuuagacgaauauaccaggguuuguugauuuuucacuugccaaauccuuggguuguuuccagcuugugguuauuuucaggaaagcuguuaagacuacccucugugcucuaucuucucacagacauacuuuuuuggauagaccuaggaguggaauugcuagguuagguagguaaacauauauauucaucccuguggaaaacaaaaauauucuuuauagcugggcgugauggcgcacgccuuuaauccuagcacuugggaggcagagguagguggauuucugaguucgaggccagcuuggucuacaaagugaguuccaggacagccagggcuauacagagaaacccugucucgaaaaacaaagcaaagcaaaacaaaacaaaacaaaacaaaaaauauucuuuauaguaauuccauaguuuugcuucucugcugcagugugugaguacuguagcuugucugcugcagugugugagcgcuguagcuugucugcugcagugugugggcgcuguagcuugucugcugcaguguguguugucugcugcagugugugagcacuguagcuugucuguugcagugugugggcgcuguugcuugucuguugcagugugugggcgcuguagcuugucugcugcagugugugggcgcuguugcuugucuguugcagugugugggcgcuguagcuugucuguugcagugugugagugcuguggcuugucauucgcaucuauugucccauugugucuuuucacuuugagucacuguaaugagcaaauugugauuucacauuuggguuuuaauuuaguucucucuggauagagugauuucauguauuuacuggauguucauccauguguccucucuguccauuuuaucucuuggauugcuuguguugcgguguaggaauuauucuaggucaaauguuuaccacacaugccugcguacauacacauucucugucuuugucccucucccuuuuucucucucccucucucucucucuaccucuucuucucucuuccuucucccucuccccccucugauguuuuuuccaagcuuuuggcuuagcuuuuaauuuuucaugaacacagaagaacaaaagauuuuaauaucaauauucccuuuagugaggucuucuguaucugaguucugccuauucuagaagcaugaagacuuuuauauuuucuuuuuguaaagguuuauauaguucaaguuuacgguuuuagcuuuaauaggcauuuugauugugauggucugagcuggguuguuaaggcucacuuuucuccuuaguuugccagcuguuucgauacuguacguagagaagaugguucacacacauucaguuauaggugccaagguuuuaguuuaaacuugacuuugaaaagggagcuaggauuuuauagucucauagugaacauuauagauuucgauguuuuaggauaucaguuaaaagaaucuuagauguauuuuuuguuuuguuuauuucauauuuaaaagaaaguaaauggugagaugagaacuccaaaaccucaagagcgugugugugugugagugugugaguguguguguguguguguuucucuuuuuuucuugggggggugguucacgguggcaguguagaccagugugauugugucuguuaggucucaaacagaggacaaguuucagucaguacccguggcucuuccugguccuucccaccgugcccccaacccucccucccggauggcugaucccugucugacucagcaguuuuggcuacacuguuuucuuggucaacaacuucuuucuugcucucccucccacucacaugguccaguuuagucuguggcuauguucagccuggacucucccgucugccugcuuucccccuuucauauccaauaaaacucuucucuguacuguagaguagucacauucuccucuuguuauuucaguuucuauuuuagccccuaccccuucucugcccagcagaaggcuccaguuucuauuuaaaaacaaaacaaaaacaaaaacaaaacaacaaaaaaacccuaaaaacaaaaaugacauuuuugaacacguuacugaccaaagccucaguugaggaugaguuuguugacuucuauguaaaaagcuugaagaggggcuacagccugguugugcauggcugcacuuaggggugcuucucuuuguccucuccuuuugugcuccuuuucauggucagcaaggugucaggaugcugagaucugcgaucccaagcucaaguccaggacauaggaaagcucuuuggagcuuguauaaacugagaacaugaccgcuccuacguaugguugacaggaagguuuuugucuagccagaggcgucuggaagaguccagagcagagagaaaaaaggcagcggggagacuggacagaaccgggcaagaacaggggggcggggagacuggacagaacugggagggaacaggggggcgggaagggguacagaaagagaggaaggccaagugagugcuaguggaggagaccaagggagaacaagaggaaggccaaaagagguacuaaacaaagacagggaggaaagcauacaaaugagcguguuguggauuuuauuguggcauuuuucacacaucuuguccuuguuuauccccuucuccuaccccacccaucugugucuguccucuggccucuaagauuugaccuuaguacaaggagauaggaauggaucaauucgaauucuucuacaugauaaccaccaguugugccagcaccauuuguugaaaaugcugucuuuuuuccacuggaugguuuuagcucccuugucaaagaucaagugaccauagguguguggguucauuucugggucuucaauucuauugaaucacugauaaguggauauuagcccagaaacuuagaauacccaagauaaaagauacaauuugcaaaacacaugaaacucaagaagaaugaagacgaaagaguuuccaccuuucucagagaaaguggcuuggacugaauuucaccugaggaaucugggaggcuaaggaggggagacuguggaaugagacagucugagaacagaauguuugcaagaggauaguuaauacacauauggccagauaauuggcugagcauucgccaugcuucaggagagucucgaggagaacugaacauuuuuaucaaauuuaauggguuucuaaccccuuaucugcuuaccaaacaaagcccuaauucgagcagcgauuaguaaccaggugccuccuucgcuugcagagcuugucugaaacacugagcucagggaggucagucacugcuucuccaguugauacauaauagcggcugcagcaggcuucuggaagguuagguguguauagucgccagcagcagucucaaccuuucuuaaccuggggcccucuaauaguuucucaugcugugcugacccucauccuuaaaauuauuuucauugcuacuucauuuugacucauaauggauauuucauaugcaagauauuuaguaaacuaccaccaaaggggucacaacucaugcaaguugagaaccacuggcccacaggaaggaacuccauaaaggccccuguguuaggcuguuguggucucuagugucauagaagaaagucauuucucagcacuugagacaauuucccugugguuucuuccuaaaucauguuagaccuaugugggccuccaggcgaacuguccucuucaacucgugugucauugucucuuugucacaaaucgagccacuguaguagacaucuuuaauucaucuguacccuuggcauuauugauauuuuuuuuucuuucuuuuccugaguggcugguguauucauuugaagaugaauagcaacauucuacucucuguauaguucaauaguagccgcaguugugaccacccgaauguucuucauagacaauauugccagugccuaugacccuguagcuucucauguucauaucugguagugugacuccuuuagcucuaggcaaccacucucuacucugugucaauacaguugccuguuuuggacauauugccugaauucaaacgauaugcagucuuuuuauggcuggcuuuuagaaauuggcuuuuuaaaguuagcauacaaaugagcguauuguggauuuuauuguggcauuuuucacacaucuuguccuuguuuauccccuucuccuaccccacacauaugugucuguccucuggccucucucgcugauccuucccucugaaccucugcucuccuuuuucccuguuccccaacccugaaguucuccccaucccuugucaccaugcucuuguucauagucuauacacacaugugcaauugugcaccuguaccccuuacccccggaccaauuuuccuaugauagaagcaugcagugcuuguuucucugagccuggucuucguuuaacauaaugauauucaggugcauccauuuucugaugaaugccaugguuucauuuuucuugagaguugaauaaaaucccauuauguauauggacuauauucucucuuuguguuugucuuuugauaaacgucuaggcuggccuuguuucuuaacuauagugaacaaugccccaggugcagguguaugugcagguauuucugggcuaggacuucagauucucugaauaccccaggagugggauagcagguccacaggaguucaguuuuagcaaccaccaugcugaucucaccgcagugguggccacagcuuacgugcucgccagcagcaccugaggggucccuuuccccucacauuggcuagcacuugucaucuauuuucuagauguuagccguggugacagaaucuuaaagcaguuuuaauuuuuguuuuucugauggcuaaggcuaucgaauauuuuaaauauuuuauuacugguuuaucuuucuuuuuacaguugcuaauucaguuuauagcuauuuauuguaggauuagcugguuuuagugauccuuauauauuuuagauagcaagucuaauagucugauguauaauugacuugaagauuagguuuuaucaacucaacacaaaacucaauccaggacgaagucacaauugagggauuggggcuaucaaauugaaccauaggcaugucuuuggggcauuuucuugauuaaugaugguguguggagggcccagcucauuuuggguagugcuaccaaugggcagaugagccaucagaaggguagcugagccagucaagggaaguaggucaguagucaggguucguccagucugugcuguauuuaguuccugucucuggcuuccugucuugacuuuccagugauggaguaaacugaaacaaacccuuucuucaccaaguuccugcucaggauuuaucauagcagcagagagcaaagcagggccgugagaauggcucucuuccauucuguaggcugcuucuucacucaggugcuuguuugcucugcugugcggaagcauuucaguuucaugccuagcaucugugaccagcuccuuucaccugacauaccuuuucucuguuguguaugauuuucucuguuguauaugauugcuuuuuacuaccaaguagugguaugguauacuauaugaaaggcuaaaauuuuugcugcuuuucaugauaaacuauauggauaugugucuuccacuagguaaauagcugggaauguaagugguaggucacugguaguuuuaugucuugcuucauuaaagagccuaaugcugucagcagugucaggcauucgcuaugggucuugccacuuauuguucauggauauggggagcuauuauguccuaaacuauuuguuauguuguagcuacuucuucaacaauauucugagcacaguuccacccugugaccacucagggcugccaccaccuccagucucuguaugucugacucauguuaacccuugaaguauuggcucuguuuccuacucuacgaucacuuagcagaagccugaucuauacauaguugauuuaauuucccugcauccaccugagugcccugaagguuuugcauucugccaucacuuuuauucauggccacuucuuagccuucuucauuuccuguugacaaauucacuuucaacaucuguguauaaaugaguacagcuguuaaaggaggaguguuuccaaaucuguacugucucccagucuuucuucugguuuacugauguauuugacagaaaacagugucuaucuuugugauguuuaacaugauggguugauccauugugaaaugauuacaacaaguucccacauccaucacuucauguuauuaccuguuuggugauauguaacuagucacuguuggacauugacacugcagaauauguucauauuucaaagcagaacuaauguuuguuuaacaaucaccucccugcucaaccuguccccccuccucugacagccacuguguagucuuggcuuuuuaaaauucaucucuuauagauggugcauguaauggagacucugcagugccuuucuuccugccuggcucuguucacuuauaugccacccagaggucugccuauguucuugcuuguaacacaguuucccuuuucucucauauggcuaauauuucaugguauguuuuucuuauucuucuguugguaaguauagacugauucugcgucuuaucuuuugggacuugucuaccaugaacuuggaaggguagagguauuuuuaagauccagacuucauucccuagaaaauacacccagaagugggguugcuagaucagagcauaauucuaguuuuuaguuuuuagagaaccuguucuacauggugucugccagaacuuuccucccugucuuuguuuaguaccuccuuuucuauaucaccacugacauuuaaaaaagaaaucuaguguuacaguuuugacuugguaaaagucagacauuuuugauucuugacuucccugaugacuagugaugcuaagaacguuuccacacacguguuggcaaucuguauuuugaauguuaggaaacaccuguucugguucuuuacaagaggaaaugccccucuguuguucauuuucaggagucugguuccuguuuucuugcuguuggguuguuugaggguuuuauauuacaguacuucuacauucugaguggugaugcacgcugguaguuaggagagaaaggauucugaauacaguaaaaagaagacuucugaaggggguuauuuuagagacgcucggucaaaauggaaguauaugugucuuauuugaaagaaacuuaagauaugguucaaauauagggaauaagacaguacugcuagagguuagcucugggccaggucagcauguaaucaaugccaaauccuuccagaaggucaggcauggugcucagggugaccauggcucuaacuuuucuugcugccaucccccuguaguuuuauuaugugacuuuuuguuguuguuguuguuguugauccucacagcuggcuuuguuuugauucccucccacccaccugcucuguacccucuuauuugaugaagaaacauaguugauuuuccugaguuuucagagccugggucucauggcuaugucauaaagucuaacuugcuucucaggauuuucuggaauuuuaguugaauugagcugcuuaauaaaauccaggugcuuuuauuuggagguucuuuuggagagugagaggacuucauauguuauauuucccacuagauggcauauaguugucucuacauaggaacugaauaguuccugacaugagcuacuaaugaacuagccacuuuuuaaaguggacaccuggcuuuaaacacauuuaguauaguuuaauucaguguauuugcuacggaguguguuucuuccucaugcucaaauuggcccuuaauuagguaaugagggcucuugaaguugguuucugagucauuugccaugacucugcuauuaacuuuuuuguuaauacauaacaagauauuucaguucaccauccugucuuaucguuaucuuauucuauuccugaaguugaccacuucuucaaacagcuauaguuuauagugggacgagauaccugaagguucaaggagguuccuuauucauagaauuagcuguuauuucuaggucuuuggagaagacacaugcauaguuaacaaauaagccaccuaaagagcguauaaaguacuucagauucuaauuugggguugcuuuccacguagggucuucagccuuucuuuugucccuccauuuccucguguggaagauucggauguaaguaguuaguucuguuguuacagugucaggugcuugauuuccuuaaguuuuacccucacugauacgcauuccugaaagcagcugagcuugcugucuaugcucucucaucucaugucuccccuguauguuugcuuuguuggagugugggcucuccucucuccccucaugucugccuugguggagcaggggucgcucuccccccuucccccaccgccucccaucuuuaauggcagcgccucugcuaugcugagucuucaaggcuugauuuugugagcaaaugcauauuaaauucucaccacgaauucuaaagucugguaucucuagucugugguuguccgaacuucauugucuaagugaguggcucuuaaacauuagugugcauuccauucaccuggaggccugugaguguccaguuaucagaugacaucagaugaaaguccuuccagaguccugacuuacuagugaugaaccaguuucacuccuuagaguguuuuucaugagcaucuggauuuaaacauuccugauauuuaggccacaaucugagacacagcguuugggugguucccacugcaucugcuuuuugugugcuuguuuucugaaacagaauuucauguagcugagggugaccuugugcucccaagucucugaggugcugggaaugcaagcauguuguaaccauguuggcagauucuacaugucuacuaaguucccggggugggguucagcauuguauucugggagcaccuguuacauguuuaguguagaccaccugcccuguucuaggguuucuuccuccucuuccucuucuucuucuuccucuuccuccuccuccuccucuuccuccuccuuuuucaguauuuuauagucuuguccccuuccuuuugagucggccauugguuuucauuuucucuguagguuguucucugugguaccuguucagcuucguguccuucugcuuuccuuccccucuggguuacuuauuuuccuuuuuguuagaguuaucugaguucuaacaguauauuucugaggauuuguuuucuucuuuuuuccaacuuguuaucccagcacuagagauacugaggcaggaggauaaaugguauuuuuagggcauccugggguauguagcaaauacaaggugauccagggcaacaguagugagaccuugucucaaaaacaaaacaaaacaaaacaacaacaaccaucggcuuguuuuuauaguuauuccuuuuaaaauuaaguucuagguuuuuuuuacuuuuauggagauuugacuuuuuauuuuucugacauucugcuauuaucuauagacauguuauugugcuuuuuuguccuugaaauaaguuggcuagaaauugaccuugguucuuuuuuauuaguuguuuuuauaugaaauucauuuuccugagcucuuagaagagaauuauagaugaaaguaacucuucuaacuugacgguuaucuuaguuaggguuuuacugcugugaauagacaccauggccuaggcaagucuuauaaaggacaauauuuacuuagggcugccuuacagguucagagguucagaccauuaucaaggauaauggauggcagcauccaggcagguauggggcuggaggagcugagaguuccaccucuuguucugaaggcuucuaggagaagacuggcuuccaggcagcuaggaugagggucuuaaagcccacgcucacagugacaaaccuacuccaacaaggccacaccuucuaacagugccauucccugggccaagcauaugcaaaccaccauaacaguggcagucguauuuguuguaucuuaagguaucaucauaacuagcccgguucaagaauuuuaaauauagagugugaacuguggcucaucugugcucucacguacccaccgucuagucuaguuguugaaucccgucaguguaucaucaagucucuuugaaguuguccccgccauuggcccuaacaauuaacaauuuuuuauccauuuuuuugcuauaauuuugcauucagugcaucuuacaguguguggucauuugguuucaugucuaaguuagcauaaugacuuucugcauaauguuaacuauuuaaaaccgugguagcucacuuauuacuuugucugcucacuuuggauucuauuaaugagaguaucuuuacagugugagauucuguuuccaaggagugcuuuagugacuaggaagaugauccacuuguaaacugaggauuuaaguuugaccccagaacccagguuuuaaaagcucuauaugguguuuacuugcuaucccagcacuggggaggcagagacaagaggguccuuguguugugcuggcaaaucaacuuagcuuagugggugagcccaaagccaaugagagaccuugucucaaaaacagugugggcagcaucccugaggaaggauacaugagguugaccucagucugucacaggcacaugcauacaugugcacuugcacacacaaccccucccccuaugaguccuuuggcaguuuugucaguuuauaggucuuagaggcuucuggucccuccacaccuuacaguagacugugugugcucguggucaguuguucacaccuugcaguagacugugugcucauggucagcuguccauaccuuacaguagacugugugcuuguggucaguuguccacaccuuacaguggacugugugugcucauggucacuuguccacaucucacaguggacugugugcucauggucaguuguccacaccucacaguagacugugugugcucguggucaguuguccacaccuuacaguggacugugugcucguggucuguuauccucauuucacacuggacugugugugcuccuggucaguuguucacaccucacaguggacugugugugcucuuggucaguuguccacaccucacaguggacugugugugugugcucguggucagcuguccacaccucacaggggacugugugcucauggucaguuguccacaccucagaguagacuuugugcuccuggucaguuguucacaccuugcaguagacugugugugcucauggucagcuguccacaccuuacaguagacugugugcuuguggucaguuguccacaccucacaguggacugugugugugugcucguggucaguuguccacaccucacaguggacugugugugcucauggucaguuguccacaucucacaguggacuguuugcuuguggccaguuguccacaucucacaguggacugugugcucguggucaguuguccacaccucacaguagacugugugcuccuggucaguuguucacaccucacaguggacugugugugcucguggucaguuguccacaccuuacaguggacugugugcucguggucuguuauccucaucucacacuggacugugugugcucauggucaguuguccacaccucacaguggacugugugugcucuuggucaguuguccauaccucacaguggacugugugugugcgcuuguggucaguuguccacaccucacaggggacugugugcucauggucaguuguccacaccucacaguagacugugugcucuuggucaguuguucacaccuugcaguagacugugugugcucauggucagcuguccacaccuuacaguagacugugugcuuguggucaguuguccacaccucacaguggacugugugugugugcucguggucaguuguccacaccucacaguggacugugugugcucauggucaguuguccacaucucacaguggacugugugcucguggucagcuguccacaccucacaguggacugugugugcuccuggucaguuguucacaccuuacaguggacugugugugcucguggucagcuguccacaccucacaguggacuguaugugcucauggucaguggcuguaccauucuugccugugcuucagcuccuuacuucuugcuacguuugcaguaaguaugguugcuguuuggugccagaugcuuugguguuccugucuacuucccucauggcugcagacaguguauaagucuuacugcugcucaucccacuagcuugcauuugggauacuuaaggacacugugcaguuacaguguauuguuuguagguuuugauauagccagucuguucucuguuucauggcaguauuugaauagauguaaaaaugguguguaugguuuuacuuuuuacaguuauguuuuuaaagacuauuuucuaagcaaaaauugaucaguaacauuuuugauuaagaaaaguaacaaaauuauuacaaugauuucuugauuuuguaaagcgaguugucuauuuucaccaguguccugaagggaggugucuucuccguacccucauuuguguuuguugcauugucuaucguuuuagguuauaaacuagacuaagaacgugagugaggccugcugugcguccacaugagagauuuuaucuuugugguuauguuugugaguagcaguaaguuuaagugagcugucucuuucucagccaugagcuuuuugucuaggacuuaccucaucugcuuagcagagaguaccgagccucaggcugcuguuuaauuggccuucacagugggacucuuaaaccggaccuuacacuuuccuuauucacaagaaaugucauuaaaaguagaaaaaguaggacuuuccuuuagcuuggugcagggaaccauaucaagaauuuccuuaagcuuuagguagggaccaaaaagggccuacagagagagcaaagaggaagcugggagacuuucuaguucgucaugaugcaggugugcacagucuggcuuuauaagcaccuuuguagucuuagaucuuccgauuccuauaccaggcaggcacuggaauagcugacaauaucccucccugcugccuagugccucuuaugucagccauucugacuuuaagugucuaaaucgguggaucuaacuuagugcacaugagaauuucugacgcugggcucuacaccaucugucuauacugggaaugagcagagccaaagcaauguagaaccucccuggauuaucauagcaugucagugcugaauauggaagauguaaauagaaaggaccgucucuuaaacagugaacauuccugguaagguaaccuuucuuucuacaucaguuauuacauagcuagucaaaaucucaguaaaguuuuuugugaaacugaguacggugaacuggaaacuuguaaggaucaucagagaauagacaagcuuuggaagagcaaguuaaagucucuuggcuacccagacagugcaucacagaaagagagacccugcaaugugagauagaggaacagaaacaccagugcagugaauugauuuuuuucauauuuacuuuuuccucuuuauuaaaccucucauauauuacaucuugacuucaguuuuccucccucuucuccucuccucccccagcuucucuccucccccucucccccuccccccucccccucuccuuagaaaagagcaggucuucaguggggagggaauugaaacagggucacaccuagagggaugugaaauagguagugaaggagugucaugaauugguaggucaagaugcagugcucuaugaucauaucugauugaaaauaguuauauggagagucaaaucauauuucucacccaugccaucuacaaaaauaaguucaagaaaauuauauuugaaaaacaagugucaauuuuaguagaacacauaagauuuaguggacuacuuagauggauuuacaaguaaguaaaguuugccuucguaaaucuuaaaaguauaacauugugccccaaagcaaacugcagacuuagcaaggcaguacucaggaaguuagaagcacgggccaagccgggcagugguggcacaugccuuuaaucccagcacuugggagguagaggcagguggaucucugaguucgaggccagccugaucuacagagugaguuccaggacagccaaggcuacacagagaaacccugucucaaaaaaaaaaaaaaaaaaagaagcacgggccaguauuccaugcugcagagccuaagagcacacugaguccacgauugcguuugcauccuaaggugcuagguaaaugugacuggggugacgacugcaucugauauuuuacuacuuugaaauaaaaguguuugaacauaguacguaaugaacuauugaugaugagugcauuucaagccauggggaaaagguugaauaaaccagcacuuacagacuaugacacaucuuccauccuucaaaagaaugaguuauagacaaggcauuuacacagcagagauuuuaaagaaauacuauguagcgaaacaaauugucaucucaucggcuuagaauacagugaagaauagguuaugugagugugugguauguguuuguuugugucugaucagauaaacaguaaagacuggaggggucugucugggcugugagcaugugagcagccuuccagggauggaagaaagaugaggagggggagucagggaaaaugggaacuguacuguccagcacagaugaugggguuuuguuuauuuguaaaaacuuuuauuuguauuuuaaaggguuacauaauuacuuuguuuaagagcaagaacugaccugaggggaaucgacuguauaccugacugguggcugggaugaaacuggacuuuguaaaaagucagcaaggcagaguugccucccuccucaaagaacgaacucuucaauguuuuguuugcuauaauuucuaaacaacucauguggucacauuaaaaugcuuuaaauuuuuuucuucgauaaacuuuauacuccaguugcuuccaguuucaaaggguucuuuuugauauucaauaugaaguugucauaauguguuaggugcuguaaaauggcaguggcuaaaaguaacaguugagcuaccuuacgagaugagagcccuuuccugagagauuggagucuuccucucucuguuuucaacgugugcugaagacaauaagaaaugagguugccuuuuguuguuauucaaggcugacaucuuaauauacauaauucaagaaaauggggaaucucuccaaauuucaauuuuucucuuuucagugugcgggaugacaggauucgaguagaaaggaugaauaauacuuacuuugaauacagccaugcuuuccagacaguuacggaguuuuaugcuagagagauaguugacagccaggguaaguauuuuauucauguuacccuuaugccuucaauugcacugauaccagauguggauaaagacacgaguguggcucucaguuuucugacaaguaggaagcaaguagaaauccgugggagcguccgagggcacaacuccuguucauggacucaugugcaauaccauaggaacugggccugcuuggcacgugucuguucacccagugcucagaaggcugagccagggggauuucuaguguuagccuagcuugguuuagugggcaaaacccugucucuacagaagagaacaaaccacagagccacaagaagagaacaccagcagcaugagaauaccacuauaaagccuccucccucugacuguucucucuccugcuguaaagccuccuccaucuguccucucuccugcuguaaagccuccuccucccucugacuguucugucuucugcuguaaagccuccucccucugacugcucagucuccugcuguaaagccuccuccucccucugacuguuugucuccugcuaugaagccuccuccucccucugacuguucugucuucugcuguaaagccuccucccucugacugcucagucuccugcuguaaagccuccuccuccuucugacuguucugucgccugcuguaaagccgccuccuccuucugacuguucugucaccugcuggcuagacaaaugcuuuucagugaaguuacaagugacaaucccuucaucuucaacuuuaaagacggcucaugucauuacuuaauagaauguuugauaaauucugauggggucuagcauuuuagaagguugguugccugaauuauaaugcaagcacauuggugaguagauucaauaugugugguaaacauuacuuguuuaaaaacucacauuggcugucacauaguaggguauaaagugugugcacuuuuguuccugucagugcacuagguucugucagcauuaguugcaguguuggcaagguggaaaggcacuuccuguccugucaggacaaacuuggccucucugugccacacgcuguagaguacuuacuaucagcccuaucccugucuccuguucaaggcuuacugucauuuccaucgccucuaaaucccguuuagugaaugucagagacuguauccugcaucugaaagcagcauggccuagcaucaagacugcaucuucagcucaguuaaacacauccuaagacaucacaaguauuucugggccacaaauuaacugaaagguuguggcauugaaaguggccugccuacugagcaugcguccucagugugagccgugcucacagcagccuuuagggaaguccaaggcaucaguggggcuuaaguuuucuuuccccaggugacagagucuuaucugugggugugaguugcccugguuuagggguuucaggcucuugaggaaucuuuccacgcagucucugaaggagcuuggcagaguguaagagucagggcacucaggaaaggucagcacccugggucugaguauguuucuuucuaagccaaguguaacucacugacuucaaagaauucuuacuggagauggugcugccuccacuuuuagaguuuccagggaaacagaacuaugagguaaaaaugaauucucaguuggaggggcuguucuccaguucuuauacccuuggucagugguucuuaaccuuccuaauaccagcgcccuuuaauacaguuccucguggaguggugaccccaaccauauaauuguauucauuggugcuuuauaacuguaauuuugcugcuguuaugaauuguaauaugaauaucuguguuuucugauggucuuagucaauaccugaaaggguuguuaaaccucuaagguauagagacccacaggcugagaacuauugcccuagguuucugaacacuuuucgcuaagugaugaagcauuacugguagacagagggcauuuugugauccuuuuuaacgucuguaaaaaaaugucaaacaacacaguuguguaugaagaaaaaugaggacguuucugcccgugaucauugacaguuuggcaucaucuuaggauugucuuaggagugaacgugucugugucuauguggcauucacagucaguguguuagugugacaaacacuaagcagagaguaaggcagagaagaggguugaacuuuuaguaggcuagcagcaaaagccaugcugagaagauagcaugugacagaggugugcacaggaaaggaguugcgagccaugguauucuccacagaggcacagugaguggaagcuuacagggcacagugagucugcacaggguaacugaggaagaacacgagggacgagcuuaucaauagaagagauggacgaucacuccuguggauaauuugucuaauaaucucauguccacauuuaaaagaauucuuugguugcauuaagaauaccugauagugugcaggauagagcaggugacuggauggaaagccauuguaauauuuucaugggcagggaugugggugaccacauauugcucugucaagcuaggagcaaugugcuguggacagccuucauguuaguugacacagcugucagucauucuuucaaaauggaaauuucuuuaucuugauuuacugaaauguauuucaucuuuguccuguagauguuuauuuagguugauuauaauuuuuuuuuacuauuguaaauguuugucaauucaccuuacauauacauguuugauauauaguuuaaaguauuuauagugagaguauuuaaauuuuuucugauuugaaaaaauauguuacuuuucaaaaaugauucggucuaauaaaaaaaugaugcaugcacaugagaaggagaaaagacaagaaaugucuuuuuuuuccaugcugucgcuuuuuuguaauuacaguuugguuuccaaaugcaagcuugguauacauguuagaaaugauuauuuuuguagaugaauuuuacuuaaauauauauauauuuuuuaaaacaguaauaccauugaggaucuguauucuguuuuuaggcucucagagucucucuggugucauuaacuuggagaagccugugaucugcgccuuggcugccguaauaagguaccucaaggaauuuaaccuggaaaagaugcuguccaaacccgaguaaguaaugucacaaaagaucugaaagaagaaacuucaaagcccacccuaaugacauacuuccuccaacaaggccacacccgcuaaaucucaagcaguucuacuuccugagacuaaguauucaaaugcaugagccuuugggcccguuuucauucacaccgccacaguagggauauuauauauauauacucagaggcuuaucacuaacgguacaaggaugaacugcuugguacuguugcuagaauaauaaaaauaacuauuaacuaaacuaccaaauuguguuuguuguagagaaaugauacaucauucuacugcagauaucaguccugggaaggcaugucagcccaccuguuggcaagugagaccagccauagcauagagcucuggguuugaccgagagacucggccucaaaggauaagguggaagagggaccuaggaagauuccugauaucaaccuugggucuccacacacaugugcucauucaacugcaugcgcacaugggcccacauacauguaaauaugucacacacuuacagagcacacaugcaugcacaugaaaaggagaaaagacaaaaaaaucaaaaaacugcaaauuuucuuauucuugguuuccgugauuucacagaccaccaaguuggugauaauuucaaaccuaaugauugacauuauaggaaaauacauucuuaauaaccaaggugcaagcaaaggcagugggcaauuucuugccuuucugaugcccccuucaccagcuuguugguggcucugucaggagucauccugguacagauccugcaugagcaagccccucccauccugcagaggcagugagcagguaggagcuagcucacuaaaaugcuguuaucugaggucuguguuagucaaggguauggggagagugaaagaaaagcagguuccuugggaauccuguauuuuaguguguguuuuaauaaaaucggccaucauuucucugggaacaauuuagucugauuuaaggcacuuaaauacccaccaacaguaaaguauuguguuacauuuauaggauaauguauaaccaugaaaaugaccugcgugaucaacauuaaaaucuuuauugacaauguaucaagccaaagaucaggcugggcaaaggaacuacagguuuuuauauaaauuuaaacacuucuagaacagaccagaccaggacagaacauauuuggggacaauagugagaaaugcacaggaauggugaacaguuucagaacaguuucagucccccgccccucauggacaaggaaggaaaacacggcacggcugagaaaguaguauagugggauuguaguugguauaguuuuaagucaguguauuagauuauucuauacacacgcaguagugacuucauugugccuaacauuccugaaagaacagcucauagcaagaaagauuaccucggcucacaguuguagaguugucagucugucaugguggggaggguaugguggagcaguucaugucauggcacugggaggcacuggagggguggggaaggagugagugauguaagacuucuagcagcccaccuucucccuguacaccucauguaucccauugugaacacaggcagggauuacuacauccagcucacuaggccagcgcuugccauagucuuuggaaguaccauugccgauccccacacaggugucugaguacuucucaguccagucagguugacaauuaagauuaaccauuacauguuuuaauguggcugagagguuuuauuuuuaaaaagcuuuguggcauaggauuuaucucauuggguucuacuuuaagguccaaagacagucuuauugaaaaagauucguaguugggcauagaugguggugccugucuuucaucccagcacuugggaggcagaggcagguagaugucugaguuccaggauggccagagcuauauagagaaacccuguuuaaaaaaaaaaaaaagaaagaaagaaagaaagaaaaaaaaaaagaaaggaaaggaaagaaagagcgaaaucugcuuguguggcugacgcuugaaucagugacaaggcgccuaccgucugacuuuugcacagcagggagccugggaaugaggcagacagaaguuuuaaggcagucucugcuguguuuaggaguagaugaaggccaugcccucuccuuuaguuaaaaauaagaacagcuccaggucauaaaacacuagcauuguuugcguguuaaucuuugaaaagcuucauuuugaguucuguaagggugaaucuuuuuuuuuuucccaagccuaacuguaaccagcuuuauuaaagauacuuuucauaaacaaucgugguauuucaggcaggacaugggcagacaaucaacaauaugcaagaacuuccaaauucccuuguauagacuaccaaaaucagaaagccacuauaaaacccaaugaagucuucauucagugcuuugaaaagggggaaguagcuuagagugaggguugacaucucacauuaaggauguugucuaacaacuuuucacaagccgacccugacuuucggaaaacaagcauggcagaauuaucaaucugaaguuccacaaucuuuuauaaaaggaaccagugcucuucugagaacacuggaugaagucacugcaaaguccacaucgcucaauggaccgggaaaccaauuuugggggccagguuccaacaggucucugguuuuuaagggaauuaagucuuauguuaauaguacagggggaagaggauauaaaaaugaauuuauagauuucccagaccacaaggcauuuugugccuugguggccaccuugguugagaccaggaugucucuccugggagccaacaggagccuuucaaaauuaccagggaaagagguuuucuguccucaauccagcaugggagagauuuuguuacugacacaugauccuuccuccacccaguaaugaaguguucugugugcuaacaauauagcuaaaaaaaaaaaaaaaaagaaguaaaaugaaauuaugcauuuuuaugaaacuugauaaaaaauaguauuucaaacuguacagucaccagagguacacaguuaucaaaaaugcacacaugucacuuggcaucuccagcaccuuaggcuuucugugccuggucucuuuuggcaucuccauuuucugcaggauuauuugcguccuucccagcguuggcuuuccccuuccuccccuuggguaccuucucucccuucuucucgggggccuuuuuaggugugggcucuggcuuuggaggagcagguuuagcagacaaccuuucgggucucuguggcuuguccuucaccuugguuuugucuccuuuagcauccccuuuagccuuucuuuuggacauggugguggcaggggacgucggcgcugaacacggguauacaggguauacagcggcgcggguuuggucugugugcguguggggucuuccccgcugguucuucacucugcuccgugaaucuuuugauuacacugaguaccacugagcuuuuucuuuguguauuuguggugguaguguggcauuuucucugugcauaccuggaggucagggaccuaguauacaucaaauuguugccuuuguagugguuccaaagauugaaagacaaaaacaaaagaugcaaagaccugcagagcgguggaucuucccuuguguaugccccaauagcauucuauaggcagacaguaaagacaguguuaaagagaaggugagacauuguuuauuucaaagaagacuuaaaugccauuagaaaccaagauucauacauaaagauggugaccaaacugcuacugucuugccuaaauaugaacugcaagcgagguacucauuagggagcacguagcuucccucugaagguaauccugaaaguaugacucuauaucuuaggcuuuggaaaaagagagcagcugcccaaggaagaacagauacuuccuugggcaugaaauccauuuacagcacugaacuuggaaacuuucucuucacgaaguaugcuuucagagaaaaauuaaauugaaauuugcauuguuuggcaaaggcuuucauagacguugcugugucacagagaccuugaucugcaugcacugaaaagucauuauacccuuucaacaguuuuagaugguacagagaaaauacacuguauuagcaauuguugauaagcauagaugaaaugggguuuuauuaaguaauacaaguuuugaagucacaaaauuguuuuaagaguuuaaguagcuuuguucugaucaagacagcauaguagugaacagagaguguggcacuagauaguaauuacuauaguuuggaugcugaguggccccagaggcucaguggagucagugaucaagaggcucagaagaggauccugggcuccuggcuccguccugucucugucguugcuuccugguuaugcuguaccaucugggugcugagccgaaugucauggaccugugugacuaugagcugaugucucugaaacugugagccaaucucaaccuuucccucucauaaauggguguuuucucacaauaacuguaaaacuguccaaugcaguugugacagauuuaagugaaguacuaaacuaugcgauucugaaggaauuggcuuugucacuguugaaaaugugucuguuuccauauuugguggcucuuguuaagauucauuugcuuagaacuuccaguagaauagggaugaccauaacagcaaguaaagucuauauucugagaaccgucgaugaaacgaauuaaagagcgcccaaauaaaguggacaggcaucccagguuccgggacugggaggcgguaccacugggaucagcucccuaaugaucuacaaacucacugcagugggugucggaguccacagggauuuccauaguggcuguagcagucugcacacccaccugcagugcagaugggauuuccccaccuccucaccagcacuuguugucauuuguuuuuguauucuuacccuucuaauuggggcgugaugaaaucucaaaguaguuucaguuuguauugcccugaucauuaagcacuuuaucaguaauccaggcugagcuggaacuuggagauccuccugccccugccuccugugugcugggaugaaaggugugagcagccacugaggggcuaaaagguauuucuugccccccccuuauuuugagaacuuuguuuacauauaacaccuacccuuuuugguugcguuguuuguuuucuugauacuuuguauuggaguucuuggaacacccugucugugauguauagcugagaaugggugucccgccaccccccucccccucugcucuguggaguucccccaugacccugguaggggucucuggagcuggguguaugccuucauucuacucguuaacagguuuaucgguggccucuagagaaugucccauuaguugucuauacguaauuaugaaucaaguaggagugaaaguacagugaaacugagauguuauucuacuguguaacauaaaaaucccacaugauugccugucucaaacuuagauaaccaaugaauggauucacuguaaaacccacagagaucuucugcucaggcacaugggagaguguuuugauuuucauuucuaauuuaaaguaauauuugaauaggcucccugcagcugucgaccacucaggucagauaugcgucuacuacucuaaagcucagccuccuuuauuguuccagaaaguagaguaaaaguaauaaagccccucacacuuccucagcgagcucugucaagguuauuuucuccucuaauaaaacuugagaacaacgaacacccuguguauuuuuguugcugaaauauuaaugaagucuuuccccacaugacucauaagauuucuguccagauucgcucugcaugagcucuggcuaugcauugcuuuggagauucauaucaaagcacacaaacuuuggcaucuucaugacuauaaauaauucagaacuccuugaauauuuuagacuagugaucaaauacuguauauaguugaguacccgggaaugccagcagauagaacuuucuuuuagaaauguagagaauuccccauggaaacaagcagugacaagaaggaaauuuguuuuguauuuggaaggaagaguccaagccccauuccagaguuuuuaccaaccccacauuuggggaauucccaggugcagugaguccucgaugcugcuaagaauuuaugagcuucaggcgcagucuaguugaggauugcccacugguccauaucuuauuucacucaguggagguuucagcuugaagaaacaucuugacuccauccaauuugaaauuuagauuucuuguuccauuaggauauaaagaaaaacagugacaaaaagcccauggccaaacaaacaaacaaaauugcauuuuuacuuaacacauccaaaagcuuggguuccugugacugaaggguacaggaccuucucagugaaggucugggauugugagcuaacacagccaaucugaugguucaccuccugguuucuuuuuucauguuguugguauuaaaagccuccaggaauuauaugcagauaacaucucuagaucuccuuucugauuccacguucaagggaguguuuugguccagaccaaauucuucauagauacuucuuggcaggucgguacucagaaagcucuguaaguucucaguucuuuacuguuuuuauuuucugacaacacuuuacuuaaguaguuccuuuguaugucagauggcagagcagcauuucacuguuaauuaguggcaggccagcugguggaucagaggcugcuucuacacucuaaccucaagcgucaugucucugggaguagaguuugggcucaugggacuauuauacuauucuugugaggguuuagguagcuaaggaauauuucugaaucauaaacacauuuucacucuagagagaguacaaaauuauuuccugcacuuuguguugagugacgcuucuuucauagucuuucucaugccagcuauauaaucguaaccucagaugccgguuaccaguuucucccucaucacugugaugcuauugacaggcaagacucucaggaggugaugaggccauuuauugccuuuguaaaaggcucauggacccacuaauggcacuaucuaugaggaacaggcccuugcagacucuagaucuguuggaucuuugauuguuagcuuccaggccccagaacugugagcaguaaauuucucuuguuuauagguugccaagccugaucuauucuguuauagcacugcacaggacuaaaguaguagcugagcacauauuuuggauuuguguuugauucaggcauauguuaacuggucauuuccaggauguaaccaguuaaaucugucaggaacaggaaucaucaggcuccauuuccaaacaaacaaguagcugcuuaguuaccaacucagaauccagguugcuagccccgcugacuuugaccuuugacuaugaauccgugugaacaccuguuagcuaugcagucagacacuacauaauggacucuuacucuaaaugaggcuuugcacuucauagccgugcuuggugcuucauagguacuuuuaggaccuucugaauuaaacguaaagccacucccacuuaggaaggugguggccauucauuaaccaucugugguuugcugcacacuaugugagaaggucacaccuucaugugaaaagaugaguguggugcuugagcucagaauccuugccuucaaggagcuuagauccacuaaagaugaugcaguugcaauccagauuacuguaucucaagaaaauuaacagcuaugaagaggacagaaaggcuacacacgugugcugucagcuuguaagguugucacccucugauuguuaauuaguuaucaccguacgaaaggcagaauaaaucuguuguuggccuugguugggggagucuucuagaagcaaagaggucccuucaagagccccacugccuuggguacugauuguacguucucuauauuucugggugagggcuuguuucuauccauggcuugggaaacuggaguuuuauguagauguccccaucuggaagugcugcuaggaugugguuugaacacaaaugaccccgaguuacuuuucucccuuuauaguaaacuauuaguaguggggcuugguggcauguguuuuuaaucacaguucuuggguggcagaggcacaaggauuacacauuuuaguccagguugagauugguacaaaaaacaaagcaagcaggcaauucaccaauucuaucuaaugcugcuggcuuagcugauaagggaaacuaguaacucguugauuaauacuuccuuagaauuguacauguauguucaaauuaauuauuaaggauaauuucaaauuaguaaaauuuucugggaguuucaggaacacaaggaguguaugaaucccaacuguguuuaaagaaaucacuuuuguuacuuucuguucuacacucacuaaaccuuggccacguuaauguauauuguuaauuauagaguaaguuacaucuguugcacacguuggaauguuggguaaaagauauuuacaucuuuaccaagaugagcccaugcuagaagguacgggagggaggccuuaagugugcucacagauacgggagggaggccuuaagcgugcucacagauacgggagggaggccuuaagugugcucacagauacgggagggaggucuuaagugugcugacagauacgggagggaggccuuaagcgugcucacagauacgggagggaggccuuaagugugcugacagauuuucauagcucguugcacaguuuugcuugaagauagcaccguguccucugccagugauaaaaaucugucugguucuguucuuggagaugugaacagcuuggaauguuguccggcuuccuuucccuucugaguucuugcccuuggugucacaggcagcagaugaccgcauccugccaccguuccugguuccagcugauuuccugucaaaauccuaauuucugucauaguacuauuggauuguuucucggcucuaauuuuuuaaaauagaugugcucaccugugcguuuauugaauuucaccuuuuucaggaguuuuaaacagcugucaaguggaauggaauucaugagaauuaaugggaccacgcuaaggaaucuggagauccuucagaaucaggucaggcugagacaagggcuagcugauacaaaugaugugcagugagcaaauaaaagggagcuggagugaggcagcaggcugcccucagguguacugcccguuugucaccaugugacacugaugacgguggcccuacucgggguggacggacuauagagcuacuggcuuguuugcuuagauguuugguugguuuugauuguuugagagaggauuucucuguguaacccugguagucuuggaacuuucucuguagaccuggccgugaauaaagagagauccacuugccucugucucccgagugcugggauuaaaggcgugcgccaccacugccuggcagcuuuaaaaaaacaaaacaaaaaacaaaaaccuaaaggacauagcaugcuguuguuuccauauauauuucuuagaacaugugcucuuucaaacuuaaugagaagugauugucuucaugugguugguaaguguuuuuccuacacuguuccugcuccaucucaggcaggccuacuaggggcaguucucaaauccagguccuaaggcaaaggucaccuauaauuaagcugugugucaacgccccuuccaaaucagggugugaguucugauagagacagaagcugagagcuaauguccucugcuuaccuugaagguuaccaggggccuuucuuuaaacaggggcuucaggauaguuuauucacaguuaaccaaaacuaugaagucuuuuuuguauacauugaauauuuugauauuuuaucugugugcauggguauauauuuucuuuuucccaggguagauaagcagcucuuaggagaaacacguuauuugggcauguguauuguuuaaaucaggcgugagauggagcucagugguggaacagcugccuggcacuaacacuggaaaaaguuaggauagguggaugaaguagaacaccuaaacagcaacagaugcaguacugcccugcacuguacuauagaaucgucucagugauaaaacuuguuaucugauuuuuuccagacugauaugaagaccaaaggaagcuugcuuuggguuuuagaccacacuaaaacuucauuugggagaaggaaguuaaagaauuggguuacccagccacugcuuaaauuaagguaaaaggaauucuuuguguguauguguuuaaacugggggauauaaaauuguaaaauuaaaaguauauucgcuucuuuaaaacuaauguugccauggcuaauuagaucacagucuucaguuggaacaauugaagcugucuacuagcuacagagccagccccaucccccacaccagucaggaucaaaacuugaugggagucugugggcauuguuggggucauggugcucagugggcucacuucaguuuuugagaugggauuuauguuuaaugauauugucacauuguuuccuauaaaagguuccccuuguagcuuuaucaggucugcugaguuuaagcaagaagacuguucagugugguucucuagcuucuuauagauggagcauguuagcaggcauggguuccagugcuuuuugaaaaucacauaauuuauaucgcauucccuuuuaagacuccaucuuuggauuguucuacuugaugauuuggccacuugcuucgguacugccaaaaagcacauucaagauuuaguagcagacuguguguuaaaacauuaauaagagcuagaaagauuaaagcauuaaacaagggcucagaggucgaaagcacucguugaucuuguagaggacacaaguucaauucccagcaucccacaugguggcuuacaaccacucacaacuuuuucugguccccauguguaccaggcuugcugucauguguacuuggcuugcagggauauauacauacauucagguuaaauacccauauacugaaaauaaaucuaaaagauugaaaaaugguauaaguuaaugaguauuuccuuugugagugccccccucugcuuguacuucaaaauuugaaauaccccaggguucuccucucugacucaggaacuuaucuguggucauggcuucuccuguaaccuauaggcugaugauauaccagaccuauauaaagcaaauuagggacgaaaaauuucuucaaugaaauagugauuuuuuuuuuuuucacuguugggguuggucaaacccagguacuugugaaauauuagguaauuucugaacuucucuuccacugagccauacccuuaucccugagacaguuucuauuauguuucaauaaaaucagaaguuuuggccuuucauggcuguuucaucugccugcucucaucuauuccucaucaugugucugcccguagugcuuggauguggagaagcugucccacaucucgugaucuugguacuuggugguuuguuuagcuggaauguucuuccuuuuuccuucaauuucuacaaaguuaacugacaauacuuuaggucucagcuuaaaacguuacaguuuuagcaagguuuuucucauucaaauagauagcauauugcauacuauguauuaauauauaauauaaauuauauuccuuuucuuagcuuuugauagcauauagaaucuuugucuguuuuaugacuagaugauuccauuuaaaaauuuuaggaugccgaguaagaugugaaagcugggcgugguggcgcacaccuuuaaucccagcacuugggaggcagaggcagguggauuucugaguuugaggccagccuggucuacagagugagauccagaacagccagggcuacacagagaaacccuaucucaaaacaacaacagcaacaacaacaacaacaaaaaaagcucagcggaguaagaugugaaaguaaagcccugcccugcaaggggaccuugccuuucuaggaaaauggauuuuagagaaaccuugggaaaggcagcuuuccuuuauauuguucuuggcuuuagcuuuacaaaauuugcccaaagaaacuguuuucccuuuuauuagaauauguguuuagccaagaaugaaaauauuguccuuaacucaguguggcagcauuuugcauucuugucaaaucucuguugacaucaugggagaaguuccaacucucagaacuaugcaaaaagucaggcuggucaaauagagcucugugugcuuuaaacagugugugagagcucuuacuccucggccucucaguacaggcggguucuuucuuuuucagcaauauuugggaccuauuugagguuaagcuuauaggaccugaacuccacagcuggagauguuuuaggauuuuauuguguugaagagacaccaugacuaugacaacucuuauacuggaaaauauuuacgucgggcuggcuuacaguuucagagguuuaguccauuauugucauggcaggaaacaugauggcagacauggugcuggagaaggagcuaagaggucuacaucuugguccauaggcagcagaauugaaaguaacacaguagccagacuugagauucugagaccucaaagcucagucccagagugccacaccucuucaacaaggccacaccuccuccagcaaggccaugccuccuaauagugccaagcauucaaacacaccaguccguggggaccuuuccuauuccaaaugccacaggugguauggauggucuguaaguuugauugggcuucucugacaccguaccauggacuugaugauuuuaaccaugacgaugaugaagguuucuguacggugagcugguucuuugaggucuaugcuucuuucccagcuucuggcaguuugcuggcaccuuuugcuucucuuggcuucuggcugcauuuccuagaucacugccuucauggucuagugguguugugcuggugugcauccagaguaaguugauccuucuuuuuaauagauaaagaaaauggagccuggcuacuuauccaaggcaucuagccaagcauguaggugaaugcuuaaaagcacaguuaaugagacuuaaagcugaaguccugauuuccuuauuuaguuuugucauuuuggauauguuguuaccuugucuaugacucauuucuuccccuguaaaauaaaaauuacaaugaucauaugaaauacuauuuacaauggauuaguauguguacuggguaguuuugugucagcuugacacaggcuggaguuaucagagaaaagagcuucaguugaggaaaugccuccaugaguuccagcuuuaaggcauuuucucaauuagugaucaagggggagguccccuugugggugguaacaucucuggacugguagucuugguucuauaagagagcaggcugagcaagccaggggaagcaagccaauaaagaacaucccuccauggcuucugcaucagcuccugcucucugaccugcuugaguuccaguccugacuuccuuuggugaugaacagcaguauggaaguguaagcugaauaaacccuuuccuucccaacugcuucuuggucaugauguuugugcaggaauagaaacccuacuaagacaguaugcuucuuaguuugaaugccauggucagaagacagcuagcuguacuaguuacuguaguaaaaacucagaagcaacucacugguagggaucuaaaaggaaauugucuagucauacauuguucuaguaccagcaguuaaaaugggugaccuaaucuacauauauccacauggaugaauugaaaaaagaugaaaugauaucacuuacuuaagucuuauaauaguaauaucuuguuagauucagaggcucagauaggacuguaaaaguaugaaacauaaacagaaaggguguuuauuggcauuagagcacugaucacuuccaggaagguagaaauggaaaugaggacauggguuacacaguguuucccaugugcuccugugucaguaacagauguguuguggaacgugugcugcauccuccccaggcguuugugugcuggcuaguuuuaugucagcuugacaugaggcagaguuauuuagguugaguaacucaauuaagaaaauagccucacaagauuggccuguggacaagucugugaggcaggugauucauguaggagagccuaguucacugugagugcuguguccccuagggugagcuguaaaaauguaggccgagcaagcuggggagcgagccaguaagcagcacucuuccauggcuuuuccaugaguucuugccucugguuccuaacauaagaaccuggucugaaccccuucacgaaggacaaguccuucccaaguugcuuuuggucacucuguuuaucacugcaguagaaacucuaagacagauaauuaacuggacuuauaauaccaggcaugggucuuauggacuugauccaaucgacugagagcagcagcugguuaccucacaacagucuugccgcuauugcacagguagacacguauuguauggcacuuugguuuugugguucgucggcuucacagcucgauaugacaauccaugcccucuacccuuacccucagcaacuugcauggugccuuccaguacuugggaugcuucuuacagggcguuaguuuccaccucagauccagcuugguuuucucugucuuguaaccaacauaugcagugcccucggcaauagguugucuguuguuuguuuguuuguuuguuuucucauucuggucuauaauuaagaguacugacaaguggccauguuuuggggcgggggcuggccuccuuccucuaacuagcuccaauugaaauacaccacaacuaggacugggaacuuuaauuuuuaacccacugcuucucgcagcauguuaacuuccuuuagucugucuuuugaguuuuucuauuuggauuacaagauuuuuuucucccuauauuaccuuuuaguacuccuucauuuggguuaacccuucuccaugcuccucuuguuucugcagcucuacaauaccugcggaaacuucccggcucuucaacuuucuccuuccuacuuuauuuuaauuuauauuuuuccacucucccuuucuuaaagugccacaguccccaguuuccugguuuccacagguauucaguucuccacauuaaacagacagagguaaagccaacaucugcugugagaaagagcguguugucuuuguccugagacugggcugccuuuuucaguacuuuuuuuucccccauuucacccauuucccuacacauuuccuuuuuggguaaaucacacucuugugugcgugaacugcauuuccugucugaucacggcugcuuguguuuccuuacuguugugaguagcagcggugcauacggcuguacugcugucugugguaugauagacuguacuacagcugggccauccauaugggaguuuuaguucuaauuuuuaaagaaaccucuagauucauuucuaaaauggcuguacugguuuauacuccaugcuagugguuuuuggucauuuguguucuuuaugaaagaaaaaaugaaaacuuuccauguauuauuuauuuugcaaaaacaaaacaaaauuacaaaaaauuaaaaauggugcugcugcuaugcuuugccaccaucaguaaucaggugaaagcacgauucacacccaagcccaucuguguagagggaacucugucaaauuccuugcuuggacacauacagcaauaguuguaaucggcccauuugcaggcucugaggacggcccucccacgugggaucuaucuaggucauucuggauuuucugcuuccugcauuuucuuuguguagggauaucaggagaaccuuacugaggaauagaugaugaucgugugucauuccauaucaagucggcagcagcagcagcacuacccagugaaugcugccuguacaggugggcagcauucucucucucucucucugucucucucucucucugugucucucucugucucucuguuucucucucugucucccucucugucugacucacucacucucucucugacucacucucucucucucucucucucucugguuuuuuccagacaggguuucucuguguagcccugacuggccucgaacucagaaaucugccugccucugcuucccaagugcugggaucaaaggcgugcgccaccacugcucagucaaaaugcuccuuuauuuaaugagcuguucuggggaaguccugagaauuuaggaagcucaaugucauguucuuguuguguacauacguguuaagccaucauugaucacuaaagguaguauguugguuauugaagccagcuacuaacaggaccucccaaauucggugguucuaacagugaaaguaauguauuuauauguucauuacauuaaaaacccaaggucuuuccauaguuuaaaaaccaauguggucuuucugguuuagagugggauagaagugugaugucacagauguucugggaugccguaugagucccuaggucacccuggacagugccagagggaggggaagaaggaagcacguguguccguccacagagcccugucugcuuguuuguaggggagggagagggauaaguguguccugagugcccagcaguccacugagacacccagcgauggcuucugccccugcugcugucuccacuucauagugcaacuaucuuaucaauucaaacaguaacuuaaaucuuuggguggucucauuaauuuuuuagccuccuuucaccgcucccacucgcccaggucacauugcauaacuccagcuauuccuguguucuguguccuaaagucgcuuuuuuuuuuuuuuaaccaaaagaugaagcaagugugacucuguauccuuuauuccccgugacguagcgagggccuggggguggaacacagcaccccucacgcuuuccuucacuaggauaggaugguuauuuugcacuuguagugcuguaucagugacaugguauuacuccugcucucaaggaaucuaguccugcuuggagcugugcaguccucuaguaaggagagcgacgugcagggaagggagcuucggagucaauacaacuccugucccgauacauggacuccuuaggguacacaaagaaagaagagugcuuuuagaguucaaggcacuuuguagaaaaugguaugaggaucaugccugcugacuuuaugauguacucagauugcauaaaugaacgauuaaaaugaaaggaaugggaaccauuaggauuagcuccuuggcuacaucucccugugauuuucauacagcagagaguacauuuucaugguaguuaauucuguugaauaauuaaauggcucuuauuuuggaaacccguaugucuggauuauuaaugccccguuucuaguuuauuacccuggcuuaaaugacgagguaauagaaauauuacauauuuccuuucacuuaauauuaaauuuauauuaacagaaguguuacuuuuaacucucuagaacuacuuaaacuuaacaucaccaggaggcuuuauuaauucucugugguuucccacacucuaugccaacagcacuuuuauggggcucacucagcccagggcgauuauucauucucacacuggaaaggaacgugucaggugcaugcugggagcugugacugauugcuacugccuucacaccugugcccucugaccuuugaaggugaacgggaaguguggcaacugcucuucacugcucuuuugaacuacuuuucaaaagugaaccuauugggggucuuagcucaugucugcccaccagggcaugaggauuaaccccucacagggccaggaacaugggguccuuccucuccuugguuacccagcucagugccuggggagaugcaggccaacggugaugucccagcaucaaaggcagcguucacugcagcagcagcagcagaggaccaagggagacugcugagaaggaguggauguuuucaguuuccugguccucuggauggaucuuucuccacgcuuaugcuuuuccuuguggggcuucccaggcugaccauccucagagugcuggaggaggacuuccucaauugugacuuugaaacaaaaacucaucuaugugagagaacugcuguuuuacaaucgauaauagcuacugcuauuuauugaaacugucugcuccucucuguucccauagcagccuccucacauucagcccuucucuguugcuuggcuggcuuuaugaagcagcuucuaacugauccucagccugaccagaccaccagucuugguucucaguuuagugucacagcugcuguguggcuccaguugcuuuuaggccacagugcugcucuggcccccugucaugguucccacaucccuggggcaucuccccuagucuuuuauagcucuucaucuagaacagugcugaagucccagaaguccccucugaccccugaagacgucuguucauaucaacaaccacaaaugagacagagggaagagguugggguguagggggagagauuaaaaacaguggucauaauucuauuucuauuucaaaauggacuccugaaacuagaugcaucucuguguguuucacuguuccuggaucauaacacauuuaucauuccauuuuaucauaucauugcugauuuuuaaaacggguucuugguuuuuguuuuugcuaauacgguguaaguucauauggacaagauuugcaaaguaugcgcuuuacaauucuacccugacaccuccuaccugcuguauuggugcuuucugcguacucuauaauugucuauuagguaaaugaauguggucaguacagcaauacuucagucuuagaaaaggacucuauguuucuaguagaaggcuacuuuuaaaaaagauucauuuauuuuacuuuguauaugaagagagagagagagugugugugugugugucuguguguguguaacagugaguaccuggugcccuugaggagaacaucagaccaccuucagcugaaguuacacaugguugugagucauagggaugcugggagucaagcccagguccugagaaggaagcaagcucuuaaccacucagccacaccaucugaccagugcauuagcaucugaaguugguuggcuaguuuugaucauccaccuuuaaagcaaaccuuuuuaugaaaaccaagcgaugacagcaaaacuaaaccuacuagacaugagucugugugcaccuuaugucuuccucaagugcucgcauguuuaaauugcagagauauccucaugaaaaguaaccaggaaguuccaacggcaucaguaggagcagcucuguuggcugaacuauuagugauacuaacauuaucaaccagcucaucuccaagugugaaggaguccaguggccucaacaaaggcuucuuuggcccaugguugauagugaguaaucagccauuuacgggaccccauguccauuguucuuuggcaucugcaaugaaaugguuccggcaccuucuuuccuugguuucggguguauaauauugaacgaccaauggagcacuaauguggaucaucuugggauaauaucuguugugguuaguuuuaguugccaaccugacauaauuaaucugggaaaaggugaucucagugaaggagucuauguauguaggguaguaucuuggagagugggaggacccagccacugugggugagccauucccuagguuugggucugaauguuaaaggauuggagaaagagagcugggcagaaguauauucucuaucagugcuugacuacagaugugaccagcugcuucaaguuccugccaccugauuucccuacacugcuggacugucaccuggaauugugugccuaauaaguuuucccccugcauugcuuugccaggguauuuuaucacagcgacagugcagaaagcucagacaucauuaucauuucucauccuuuugacagugcugcuuccuguuguuugucaggcuuacccaaccuuucacugacugagcuaaucggaugauucucauggcuccccuacugcuuuauuuuaauuucuuagaaggccuuuuaacuccuucaauuaaaaaaaaaaaaacccuccaaauuacgugaauuguuuuauuuuuaaauccuugaagucauucuuuggucauuggcauuuuaaucuguauacagaaguuaaaaauggaacuauugcuacuuaguauuaacagauuugugcuaagcaacaccacacaccccuuuacugucucccugcccacauaggcaucuguaauuaguccuaacauguuuucucaaugcgacuccucacuagucucaguauaacacuucaaauuacugcuaccugcuucuuggugcugaagauuccaggugcggcucuucuuguucacuuacuuuaccagaaauaaccaucuuuguagguauuucuuaaggucuguuuauaguuauuuccauuucuuucauaaucuauacccuacucccuacccaaaugcaucccagcuugguuuucaagacaggguuucucuguauagcccuggcuauccuagaacuaaguuuguagaccaggcuggccucaagcugagcaagccaggggaagcaagccaguaaagaacaucccuccauggcuucugcaucagcuccugcuuucugaccugcuugaguuccaauccugacuuccuuuggugaugaacagcaguauggaaguguaagccgaauaaaacccuuuccuccccaaauucuucuuggucaugauguuugugcaggaauagaaacccugacugagacaguuaccuaaugaucagaacuaaugauagcauuguguuguaagcccagcuuauauuugugaguucuuguaagaacacuaaaguuuaggcccauugcuauucacauuuuauaccuggaaaaaccaaggugaggcuaaguaauaaaugguggaaccuaagacuugggucacauuccucugauuccucaaauucuuaagcucuaagcugaaaaagucuguguuaguaccaaaaugauucacauuaugcuguggccugugacgacaccaggcuagaccaaaaccugcuugcuuugugguuuucagguugaaacuaacauaguauaauauuucuaucucuuaaggaauuuaugguccugugucuauuuuuuuuuuuucugcuagaacucauaaagcugacuuagguuuuuauucgagucauuugcuauuaucuuuauauauugaaaaaaaccuuuaauuuugagauaguagcuaucugugugggugucauauacauucacagaugguaucuuuuaaaaagucuguccucgaccaucuguagcaucaaccucaucugauccaauuggugucauccuucauuuuugcagggauuaguuauugaaguagaucuucauauguauuuuauaacauuuuggguaaauguuaaagcaaaacauugauuuauuuuaucacaacaguccuauggaaaacagcuuucgucuuuuuuuuuuuuuuuuuuuuuuuuagcucaguuugcuuuauuucauauguauccgugggaagcaaguugaauugaaauaaacaacuguuuauugaacauccugugauauucugugauccuuaaguugugggauguuuaguguagugucacugcaccuuagaaaggcauggcuuuauggguggauucgaggcuguugaguuguaguuaacugaacuugcuucauggggauuaauacuuugcuggccuugauggacacagagaccccugccuggacagaaguuaggacugguugugaaccagcauaucggugcuggaaagagaacccagaccuucugcacgaucagcaacuguucuuaaaugccaaacuaucuauuucuagacccucaccuuauuuaaugcuugaugccccuguuuuucacucuuuucuccauugguuuauucauuuaaauuguacuaagggccugugugcaccagacaugugcacucgccagugucuuuuguaucauaguagucuauagugccuguauagggaguuggugggcuacaauucacugaggauacauuuaaucuucagguuuccguuuuauguugacaaggccuucacauaucuucccaagugacuuaaucacucaggguaugucaccauugaugagguccuacaacccuguuuuccugugucuucugacaucacagucuccacacuuucuauuguuacuccucuaucuuugauuaggcucuauuuccaccaacgaugcuccauucaacagugcuucuaccauaaccacuucaucuuacugcucaagguagcccuaugagccaugguagccaaguuaucuuagcaaacacaucccaagucuuaaugguuugacuacuugagaacuuuauuugguagcagauguggaaguaaaguguguucuccuguagucaugagcccagguagauggcaucaucguguggcuuacagcagugcuuugagcaaaggcgggaaggauaguguggaagguugcacaggacguuuucaucagccaggacauagaggugauauccaccauuccuguccucaguucacugaguagaacuugaguacagggacauggcaaaucucagaggagacuugcugggggcacaggggucuuugcauucacagaaaaguaucaagaggaccaggaauguuaagaggacacagagcuaucuccccaguggaagagaugaaaccaaauauuugcauuccauccagaaagcagagaguugauuuuuguuagcaaaaugguaaccuuuuagguaucuggggagacucuucccucccuaggccauuacccauccuuagggaagaugccacuuguauuucauggccugcugaccucuaugcuauuagucagauaccacacuagauucuaggccucuuuagcuauaaagcccacccucaugguuacauguacuuugucaaagaguucaucuauaaucaugccuucagcucuauuguguaccuggaauugaacugaucagacugauuguucccuugaaacuuugucccaaauuguucuggguuuuaaauaugcuggcaaagaccauucuagcauuagacucccuaaagucugauccagauugacaaagucgaucugcacuggguuuucagucuuaucucuuugcaggguuuagugcucugucugacaccugcacaccggacccccucagagacagggaaaugugcucuguauauuugccucaugagcuguucuucauccuaauuuguuugugacuuccuuguauggaaccuguguguuauuaagccacaugauaggaggaggcagggaagaauaggaugaaagcaucuuccuaggccucuuuaacugacuguggcauaguccuugacauuaaaguuggcaaugucuauagucugaauuccuaacaucgcacauugcuguuauucuguucucacagggaaauaaaugcccgacuugaugcaguaucugauguucuccacucagaauccaguguguuugagcagauagaaaaccuucuucguaaguuaccggaugucgagagaggacuauguagcauuuaucacaagaagguaaguggugaaaaucaagccuccugagacucagugucccuuagauaacaacuggagguccugauggaaaaccacgugcaucucacuagagcuuauaaguagcacaagaaaacaacuguagcugcagacauuuuaauuguacaauuuaaguuguuuguauuccaguauuuauagucacaaaaaguuuucucacuucuugagacuacagcaacacagaaguacuucuauuaaaaugcaagaugcuguguuaugucauccaaguucagaccauugucaaaaugagaaacuuacuuugaucugcaacuuugaaaaagagaagccuuaauuuuuuaauuuuuuaaaauaaucuuugcccuaaacaaagggaaaauccuuuuccauccuuuacccuaagaugguguccauccuugaugcuaacauguguuucuuggauacagcagcaggauaaauccuguguuugaauccuuucuguuaguuuauuuauuuuuuguugccagaauugagaccauccauguugagaguuaucagugagcaguguuggcgccuguugcugaguugugugugugggcaucccacccucuauguuggggggggggcgggcguccuaccuucagugauguguguagggcagcccacccucuguguuguguguggcagcagcccacccuuucauuuuugcugguuuuauaguauucauuccuuguguuuucuuggaugugguuagccucuucauuugaaguuuaccuuccaguaucuucuguaggaccugguuuaagauacugcuuaaauuugguuuuaucauggaauaucugucuucuccaucuauuguaauugaaauuuuuggaagcuauagugucggaaacuaaaaaaggguggcccuggggaaggggaagacccacaccccgccagaguuccaccuaugcucuggucagucaggcaugggagggcugcuaucuaccuuccacucauccccggguaggcaucuaagcuucugacccacucuucgugggguggaaaggggcagcccuaccugggagcccugggcuacuuugcuaaagccaccgggguuaugggagagagggaugagggaagagagcuucccaacaccugcgagagugagcacagcagaucuugaugagcagagacucucuaugguuuuagagcuuuauuauagaaaggcagggagaaggagagaagguagaagagagacggggcagacuagacagaaagaaggaguaagagggagagaggagaggagaagacaaagagagaggagagagggugagggugaggaguaagagagcaagcaggggcugaacaacccuuuuuaaaauauucugucuuaucuuauuguugcuagguaacuagggaggaguuuaguaugaaggucagaaguuugggccauugccuaugugacuucuagccaugcuucuccuguggggggcgguaacuuaggcaggggccagaguuccaggagcaugagggaaugccuaccaugucaugaaggugaauuaucacccuucgggguucagaccucagcucaacuggagaccagccugucuguacguagcccaaugccccacccuauagcagucagggcuggcgucugugauaccucagaguuuucagaccauguauccaggcccuucugcucuagaggcuccauugagaagucagguguuacguuuuguacuggcugguuuugugucaacuugacacaggcuggaguuaucacagagaaaggagcuucaguugggaagaugccuccaugagguccagcuguaaggcauuuucuuaauuagugaucaaggggagaaaggccccuugugggugggaccaucucugggcugguagucuuggguucuaaaggagagcaggcugagcaagccaggggaagcaagccaguaaguaacauccuuccauggccucugcaucagcuccugcucccugaccuguuugaguuccaguccugacuucuuucagugaugaacagcaauguggaaauguaagcugaauaaacuccuccccaacuuguuucuuggucaugauguuugugcaggaauagaaacccugacuaagacaaauugguaccagcauacugggguauuccugugacagccugaccauguuuugggaaggacuguggaaggaccuuggaacuuugggccagaagauccauuugguguuaagagcucugucgaauguuguguaggagcuuggaagacaauguuaagaacagugcagaagauggaggccuggcuugugaaauuucagagggaagauuaaagacuuuuuuaagggccauugcuaguuugauugugaagauucugugguucugguuagcuggggcuaaagaaucaauugugauuaacaagauaccagaacuacuaaagcaaaaacuuugcauuacugggacuauugaugcugguuagcuggagcuaagaaauuagaggugauuaagaagagaccagcaucauugauuugacaucuucugggaaguguuuucugagagcacagaggcuguauuccagagguagccaagguuguaccuugugcuguggcuggacuugguaaugucuaagaguuacccaggugguacugguuuugaagacaugaaggcguaacgcagagcagcugaggcucggcacugugagggccauggaaggccauuggugaaggugcagccuaaguugcaauugaugacccaggacugaaggggucaugcaaaggaguugaggcuuggcaccauaaagagagcuaugagaggcuauuggugaagccuaguuacaguggaagacagcagcguuuuggagaugccaguaccauuagaugaccaccaagaacagcagcagcaguggagaacaggcagcuggagccuagaaugaaagcuguguguuacaaaggacaggacuggagaagugacccaagcccuuggaggagcccagaagagcgugaguuggaucccagacacuggacaguuggaguuuaauuuuugcuuuugauugugacugugcccugauauuuuucccucuugaaggaagaaaauauuuuaguggaucccacaguuaagagacuuuuaauuguaaaaagacuuaggauaguuuuaaaaggauugaacuuuuaauauguaaagacugggacuuuuaaaguuguuuagaucuuggggaugaauaagaacuaagaguugaggcguacuaguguuguguuugugugucaaguugacaaggggucaauuguacuggcugguuuugggugucaacuugacauaggcuggaguuaucacagagaaaggagcuucaguugggaagaugccuccaugagguccagcuguaaggcauuuucucaguuagugaucaagggggaaaggccccuugugggugggaccaucucugggcugguagucuuggguucuauaagagagcaggcugagcaagcuaggggaagcaagccaguaaguaacaucccuccauggccucugcaucagcuccugcucccugaccugcuugaguaccaauccugacuuccuuugguggugaaaagcaguauggaaguguaaguuaaauaaacccuuuccuccccaacuugcuucuuggucaugauguuugugcaggaauagaaacccugacuaagacagucuuuuaaccuugaaucuuuuaauauuaucucuuuguucuauaugcuuacuauuuuugguuauuguauguuaagagggcuuuauuuucugcucuagucuacuuguuguucugucugcuucuuaugccuugaucggcaucauuaugcuggagaaauuuucuucuaugauuuuguugaaaauguuuucugugucuuugagcuggguuucuucuccuucuucuauuccuaagauuuacagauuuuguuuuucuuuuuauucacacugccccagaauuacuggauguuuugugccuggaugguuuuuaacuuaaaguuucuuugaccauggaauccauuucuaccuugucuucaugccugagacucucuucuuucuccuguauucuauugguaaggcuuccucugagguuccuauaagagugccuucauuuuucaguuccaguuuucccucaguuggguuuucauuaacaaucugccuccacuuucaagucauaaaguguuuuguuuuucaucccacuacacuguugguguuuucacagauuucuucaauggaugcauucauuucuuuuagggcuucuaacauauucaguuugcuuugaacuccucccauuucuuucauuucucaggacagacuguaguaggguuuagucaaaacuuuguccuggcuguuacugugcuuuuauucugucauccacgcaucuggguuugggaucauuguaauuguagguguugauaucugguugucuuuguuggguggauguuugagccuuaguuuuguugcccucucuguuucuuacgggagagugucaguggugguugcuuugagggaaugcuuuugagauccugccagggguggacacuaucaucucgauauugggagugacgcuuaggaaugaagaugagguaaaagggggcgcugaggguguccacaagaagcagggugugccaucaggaucugcuuaguccccuggguauggggcccauuuucauucaaaccaucacagagagcuaggaacuuacuaugacaaaauuugugcuuaaauccagcauccuggccgggugugguggcccacgccuuuaaucccagcacucggaaggcagaggcaggcagauuucugaguuugaggccagucuggucuacaaagugaguuccaggacagccagggcuauacagagaaacccugucucgaaaaaaaaaaaaaaaguuauuuuuggaccaucuagagccugccauaugcaggguuccaucccauaaucagcuuccaaacgcugacaccauugcauauacugcaagauuuugcugaaaggacccagauauagcuguguccugugagacuaugccggggccuggcaaacacagaaguggaugcucacagucagcuauuggauggaucacagggcccccaauggaggagcuagagaaaguacccaaggagcuaaagggaucugcaacccuauagguagaacaaaauuaugaacuaaccaguacccuggagcucuugacuguagcugcaaauguaucaaaagauggccuagucggccaucacuggaaagagaggcccauuggacuugcaaacuuuauaugccccaguacaggggaacgccagggccaaaaagugggaguggguggguaggggaguuggugggaggguaugggggaguuuugggauagcauuggaaauguaaaugaggaaaauaccuaauaaaaaguauauauauauaaaaaaauccagcauccuggaguaugugucuuuugaccacucccauguuugauguggauuuucaaaugcuauuuugauuuuucuucugguucacucuucacaaacaaacuuuauuuacauuuuacuuuuugccaaauggaaauuuauugcauacuuaauucauaguaggcaguuuuuaaaugcccaaauucuaaugugauuaauuuucauuaguauuuacuuuuuuuucuuuguguuuucuuuuauuuucuuuuuuuuaauuggguauuuauuucauuuacauucccaaugcuaucccaaaagucccccacacucucccucacccacucccccacccacccacccccacuucuuggcccuguuguuccccuguacugaggcauauaaaguuugcacgacuaaugggccucucuuuccacugauggucgacuaggccaucuucugauacauaugcagcuagagacacgagcuccaggggguuacugguuaguuuauauuguuguuccaccuauaggauugcagaucccuuuagcuccuuggguacuuucucuagcuccuccauugggggcccagugauccauucaauagcugacugugagcauccacuucuguguuugcuaggccccggcauagucucacaagagacagcuacaucuggguccuuucagcaaaauauugcuaguguaugcaauggcgucagccuuuggcagcugauuaugggguggauccccggauauggcagucucuagaugguccauccuuucgucucagcuccaaacuuuguaacuccuuccauggguguuuuguucccaauucuaagaaggggaaaaguguccacacuuuggucuucauucuucuugaguuucauguguuuagcaaauuguaucuuguaucuuggguauucuaaguuucugggcuaauauccacuuaucagugaguacauaucauuugaguucuuuugugauuggguuaccucacucaggaugaugcccuccagguccaaccguuugccuaggaauuucauaaauucauucuuuuuaaaagcugaguaguacuccauuguguaaauguaccacauuuucuguauccauuccucuguugaggggcaucuggguucuuuccagcuucuggcuacuauaaauaaggcuguuaugaacauaguggagcauguguccuucuuaccgguuggaaaaucuuauguauauaugcccaggagagguauugcgggauccuccgguaguacuaugaccaauuuucugaggaaccgccagacugauuuccagagugguuguacaagcuuccaaucccaccaacaauggaggaguguuccucuuucuccacauccucgccagcaucugcugucaccugaauuuuugaucuuagccauucugacuggugugaaguggaaucucaggguuguuuugauuugcauuucccugaugauuaaggauguugaacauuuuuucaggugcuucucagccauucaguauucuucaggugagaauucuuuguuuagcucugagccccaucuuuuaaugggguuauuugauuuucuggaguccaccuucuugaguucuuuauauauauuggauauuaguccccuaucugauuuaggauagguaaaaauccuuucccaaucuguugguggucuuuuugucucauugauggugucuuuugccuugcagaagcuuugccacuuuaugaggucccauuuaucaauucucgaucuuacagcacaagccauugcuguucuauucaggaauuuuuuuccuguacccauaucuuccagacuuuucccuacuuucuccucuguaaguuucagugucucugguuuuauguggaguuccuuaauccacuuagauuugaccuuaguacaaggagauaggaauggaucaauucgaauucuuguacaugauaacccccaguugugccagcaccauuuguugaaaaugcugucuuuuuuccaccagaugguuuuagcucccuuggcaaagaucaagugaccauagguguguggguucaucucugggucuucaauucuauuccauuggucuacuugucuguugcuauaccaguaccaugaaguuuuuaucacaauugcucuguaguacaguuuuaggucaggcauggugauuccaccagaaguucuuuuauccuugagaagacuuuuugcuauccuagguuuuuuuguuauuccagaugaaucugcugauuggccuuccuaauuuguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguucuuaucauacagaucuuuaacuuccuuaguuagagucacgccaagguauuuuauauuauuugugacuauugagaaggguguuguuucccuaauuucguucucagccuguuuauccuuuguguagagaaaggccauugacuuguuugaguuaauuuuauauccagcuacuucauugaagcuguuuaucaggcuuaggaguucucugguggaauucuuagggucacugauauauacuaucauaucaucugcaaaaagugauauuuugacuucuuccuuuccaauuuguauccccuugaucuccuuauguugucuaauugcucuugcuaggacuucaaguacaauguugaauauguagggagaaagagggcagccuugccuaugggaauuuuaucagaauguuaagcaccucuuuuaagguaucugugguacccaagaggacuuggauaauuguuccccgugcuuagguuaaauuagaacaaaaugcagagcagauuuggugaugccaguccugaggaagaggguguaggaguugauugugucaguagagucaguuguagcacuauguguugugcuguggcuuugcuggcagugauaugcauggcaauguccauguugacauuggacaguucugugcuugguucugcugugcuccagaaguacaaagccauguguuauuuuguauccguggcuagugccugggcaucagugcuauuaccuucaccagucaacugaucuccaggugccuugccuuuacaauuugaaaaaauucacugacagauguuagaggccuuccuuucuuuuuuucauucuuuucuuuuccuuucuuuucugaucuuuuuuuuuuuuuuuucucaagaggaaguaagugcagagcagguuuuguuugagcugucaaucagaagagcagggccacauguccauggcauggaggcgacaucgucuugccaaucugcagugauucuaggcugccucagugccugucuuuaaaguugacuuggauguuugccucacuaaguuuuaugcaucucuuacaguuuccaaacucuagaaaaaguuacaguuuugaacuguuucauuugaaaagugguccauguguagugcuucuaauuuggaauuucugauuguauauaagagaaccuguggcucacuuggaaucugguccuuggcccacuucuguguuucacuggcuucagaagugaagagcugaaacgagcuguuaacaaaccaacguuacaaagcccgcgugcucuaaaccacagcugcugcagcucuugaccccggaaucugcuugccaaguaucacuuuaguuuauuuuuuguuuuuggauuuuuugugggguuuuuuuuguuuguuuguuuuuuguuuugguuuaaucgagacaggguuucgcuguguagcccuggcuguccuggaacucacucuguagaccaggcuggccucaaacucagaaauccgccugccucugccuccuaagugcugggauuaaaggcgugugcccccucugcccggcuuaguuuuugguuuauuuauuuauuuauuuuuuauuuuuuuagagcaguaguuucccgggcucugcuguggcacgcuuacuucagcuuugaugccuugcugcuuuccuccaagcuugugccguuugcaccaauggcgaguggcauccgggcacagaccuuacuaguucuguggagcucacaaaugggagugggcugccuagaccuggggcuguagaauucucagggaggugcuuucaaggugauaaugauggaagaucucaaagaggcuuaauauggaaagauaaauaugucuucuuauauucaaacuucaaauucauaucugagaaaauugggucacaggaacccguauuagguguuaaauuugguaaaugcauuuaaggauaaggauguuccaccaauguuaagcaaagaguuugugugugaaucaauuuccagccaggcuguacugggcucaagccacacauugcacgugggucuuugccucugacacuuccugggucugugcuugcgguauaauugccuuaacagaaagauccacacuccugaucgcucucuccuucaguuuacuucuuguacccucaugcuuccaagcucuaacacagggaguuuuaacuuaguuggauuuguuugguuauuagauuggucuacuuuauuuuuaccuuucugcaaaaucgaccgauaaugacugaggcaaguacuucacgaaugaccuguccuuuguauaucuaucucaggagaaagaaaaucauaauuuuucuccuauuaagaaguucaucccggaagccuggcuucccgaggguauaucuccaugcucuacgagccuuguuaauagcuaugaggacaugcccauuugcucuucaaaaagguugugcuuuuccugagaguauagaaaggugucugucuuacaccuugggugacaugcguauuaauaaguacaucuuugacauuugaacagacggcgaauacugcccugcaguuuuaguuuguuuuauuguuaucaaauuugguguguguggguaguggugguaggaggugucacaacuguuagguuggcccaaagauagucacuugagacacgaguauggacagcccagccccucagggcaaaugggagcuggaucuucaguacuucucagaaggcugcugccccaguaucagagcagaauggcuugacugaagccuucggccgucccgacaagccagagccuccccuuguaaauugcuucccuuccgccuguaauagauuauagauccuuuuccuuaacacugcucugcccaauuaagcccacccuaaaagcccccucguguccccgcucugacagagcuuuucuccccuuuaccagaguggcuuucaugcuuugguucucuccuuaagccacacagcagucugugccccaaagucaggucuguccacccguccucagugagucaauuaaaagaaccaaauuaaagggaguuguguuuuccccucuggacucuucuggaugcugcuucucucguuugaacauuucaugaaaucagaguggcuauuucagugguucuuuacugcacccuggccuacaggccuggacucuauuuaguucacacugaucuugaacuugcagagacccucccaugccagccuccugacuguugggauaacagguuugagccaccauaucuagcuccuauugcuauuuagauaaaaaauauuuugguuucuagugcucuacccaagaguucuucuugaucgucaaaagccuaugucaacugaagucagagcuucaagcauuaaugccugcuguuaauucccacguucaguccgacuuacuccgagcacucaucguggaggcuccugagcuccucagcccaguggaacauuacuuaaagguucugaaugggccagcugccaaguaagugcgggcuuccacuuccuuccccaguggcuggcugucggccagugcugcuugugguauaugacguugcuugaguauauuuguaauuggaaacauuuauaguuguuuaaacgcacauaguugacagucugggacaguugaaguacuuccccagguaucagaugauaaaaggacaaaguucuucuaaagugagguagugccaguuuauuaacucagaagcggguguccaguggcccuuauccucguuuuguugacacccuggagugcuugucccuguauuuagaagcuguagcugcuccuuuaagggagcaguuuuacggugugucucacagggagccggguuuacauuuguuguuauuuucugacuaggcaaaugaaaugacaguuuuauuucuugguuucaccaugugaguugugaauaaaauaaaacugauuuugucaauccucagaaguuaaggaguguuuccauaacuauucaguggcagagcuggaaucagaaccacguuugccugaguuccagucuguuggcauuucaucaugcuaugaaauugauaacuguucuaauuaauaugcuuuaauauauuaccugaauuuuucauauuuuagaguuggcgauaaaacugaauuauucaaagaccucucugacuucccuuuaauaaaaaagaggaaaaaugaaauucaggaagucauucacagcauccaaaugcguuuacaggaauuucggaaaauauuaaaacuuccuucuuuacaguaugugacuguaucaggacaagagguaaugucaaacaugcuuucacgucauaucuguuuuccuggaguagaaaagccauuuuauaauuuaaggucuguggguagguuguuauaagcgacgguacggggaaacuacugaacuagacugcucccugggcacaaagauguauugguguuccagcugccaagguccuugcucggagcugagagaacaaaauggugggaaggcaggcagacuuuauauggcagucagcaggguggggaucugagcugaugccgcuguggcuguccacgcugacccagggggauguguccuugcugacagguugaccuuugggggaagguuaagugggguucccugaggauuaguguuguuccuggugggcagaaaccuuaagggauuugguuuucuaguaaacaguacuucaugggagccguaacucaccugccauguucugcuucugcaacugccaggcuuucugcuccccucccugaucaaaccgugauaccaugguaacacaguuaugccccacuuuugcagaaaguucauauacuguuaugugugucagcggcuaccaugcaugucaauggaaagugcccagcauguggacuuugcccacauuacaggcuugaguccaggaggaugaacagucagaggccuauguucgcacuccugcaucuauaauaguaaaggcuuuccuuccacccgcgagucugucagauuggugguuucucugugccuugcucaagagagaaaugucuaucucucuuuuaauuuuuuuaaauaagaaacauuuaaaguuauuaagggaaauaagacaguaagggagaggaaaugggcuccaugugaugcugaaguaaagggaugcaggugccgagaaggucgcagccggccuggcagugauaugauggaaaucuagcgauugggcgguagguaggggcaggagagccaaaggcuaguguuacccuuggcuguucaaagaguuugagaccagccugaauuauaccuaucugaaaucaaaacaaacaaaugguguaaagauuaucagcauaccuggcaaugguauuagccuagguugcuauagcauacuuugaauaacaaugugacauuuaaccaagaccuaaguaggucccaggagaguaacuggagagcuuacuagaaugacagggcagaauucuuuuuuuuuuuuuuuuuuuuauuuauaaugccauuuuuuauuacaucuuuucccaagaauuuuggaaauaauuucuuuuuuuuuuuuuuuuuuuuuuuuucugaucuuaauuuuauuuuuuuuuauuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuucgagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugcuagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaagagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugauaucggauaaaaucgacuuccaacccaaaguuaucaaaaaagacaaggagggacacuucauacucaucaaagguaaaauccuccaagaggaacucucaauucugaauaucuacgcuccaaaugcaagggcagccacauucauuaaagacacuuuaguaaagcucaaagcacacauugcaccucacacaauaauagugggagaccucaacacaccacuuucaucaauggacagaucguggaaacagaaacuaaacagggacacagugaaacuaacagaaguuaugaaacaaauggaccugacagauaucuacagaauauuuaauccuaaaacaaaaggauauaccuucuucucagcaccucacgggaccuucuccaaaauugaccauauaauuggucacaaaauaggccucaacagauacaaaaauauugaaauugucccauguauccuaucagaccaccauggccuaagacugaucuucaauaacaacauuaagaauggaaagccaacauucacguggaaacugaacaacacuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugaguaccuccaagaagaaacgggagagagcacauacuagcagcuugacaacacaucuaaaagcucuagaaaaaaaggaagcaaauucacccaagaggaguagacggcaggaaauaaucaaacucaggggugaaauuaaccaaguggaaacaagaagaacuauucaaagaauuaaccaaacgaggaguugguucuuugagaaaaucaacaagauagauaagcccuuagcuagacucacuagagggcaaagggacaaaauccuaaucaacaaaaucagaaaugaaaagggagacauaacaacagauccugaagaaauccaaaacaccaucagauccuucuacaaaagcuuauacucaacaaaacuggaaaaccuggacgaaauggacaaauuucuggacagauaccagguaccaaaguugaaucaggaucaaguugaccuucuaaacagucccauaucaccuaaagaaauagaagcaguuauuaauagucucccagccaaaaaaagcccaggaccagauggguuuagugcagaguucuaucagaccuucaaagaagaucuaauuccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagaaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuugaaaagaucaggaauucaaggcccauaccuaaacauaauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuuuggugaaguagcuggauauaaaauuaacucaaacaagucaauggccuuucucuacacaaagaauaaacaggcugagaaagaaauuagggaaacaacacccuucucaauagucacaaauaauauaaaauaucucggcgugacucuaacuaaggaaguaaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaaguccaacucaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagggcaauugugauaaaaacugcaugguacugguauagagacagacaaguagaccaauggaauagaauugaagacccagaaaugaacccacacaccuauggucacuugaucgucgacaagggagcuaaaaccauccaguggaagaaagacagcauuuucaacaauuggugcuggcacaacugguuguuaucauguagaagaaugcgaauugaucuauuccuaucuccuuguacuaaggucaaaucuaaauggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauacagaauggcagagaagcaccugaaaaaaugcucaacauccuuaaucaucagggaaaugcaaaucaaaacaacccugagauuccaccucacaccagucagaauggcuaagaucaaaaauucaggugacagcagaugcugguguggauguggagaaagaggaacagggcagaauucuuacauuaaccucugggugguggagucagcagagaaggggauugcugugagaccuugcagagcuuucuagaccacgcauucuuuuuuccaguggcuuuucuuuagcaguaaaacucauaaacaaagggucuaccugcucguucuuaggcuguuuggaaaagggaauaacuggaaagaaguuuccuauccuggagcagagcgcaguauaagccgugcugaagaacaaaggcuaagaccugaggacaggagugugagcacggcugcucgccugacucugcugugccucccguucuucaugcugugcacgcauugacuuaaugggcagcggcagucccuggagugggcguuugagcugcuccgugguucucaggcugcaccuugcuuuuaugggcuuuucagaagguucaccaagccuucaucaccaccucccacgguuaggaugcuuccuuccuggcgccuugaaauuugauaucugccuuugaucuaguuacucucgggauuauuucauaaaaugccagcgugccuucacugagcauucuuaaacccaagaauuauuuaguauaguuaguaauuuuacuuuuaaucaauaauacuaaauuuuggcuuguuuucacuuaauuuuuaugacuacauggucauuuuuguacuguucuuuuucuaaaagauacacuuuuuaaaauaacuuuauuuuuauuuuaucuguguuggugcuaugcaugcacguagauccccuggaacuggaguuacaaacaauuaugagcugccaugugggugcuuggaauuuaacucagguccccuggaagagcagccagugcucuuaaccacugagccaucuuuccagcccuggacuguuaauucuuaacuguagaaugaguauggcagacuugaaacuguauuaaucaacuuuuauauaugaaauguuaauaguuucaaaaucuuugcuugguauggaaauuaauaaauauuaaccauuaauguguauaugcauauaugagcacacugagaggacacaacucugacucauacuacaaaugaggugugguagaaguugacuuccuucuuguucuugucagagaagcucacucauggagagagcacaguuggguaugagaagguagucccuguaaggcucagggaauauugcagaagagugaguggaaaaaguaugagagccuaagaaugagaagaguugcagugccaucuucugggcauccaucgugguugggaguggagcucauaaggccccaaucuuccuuccugaacaguugguaguugacagcuucucggggaggggcaaacagcaagcucauaugcuccaaagggcagauccaaacacgagcucaagcauauggucuugguuaaaacuauuggucacaaaacaaaagauaugaauauggggaggggaccuauaaagaggauugggagaugacaggggugagagagauaaaagggcuguggaguaaacagaaugcaccaaauauaugugugaaauugucaaaggacaaaucuaaccaauuuaagagugacuuugaaacugggcagugguggcgcacgccuuuaaucccagcacuugggaggcagaggcaggcggauuucugaguucgaggccagccuggucuacagagugaguuccaggacagccagggcuauacagagaaaccuuggcuugaaaaaucaaaaaucaaaaaaaaaaaaaaaagauuuugaaaagguagauuccuguaaaggaaaaccauauguuccuggaagggaagaaaugucuuuguguucuaaaagccaaagcuaccuuucugaggguucguguaggcuuuuuauaugacaacuguucugaaaguccuauucuguucagguugggggagcacagaauaauggaacauuuuauagccuuacauauguagaguuggagaugacucagugugugagggcccuugcugcacaagcgugaggaccucaguucugguccccagcacccaugcaaagcggaaaaguauggcugccuuaaaugcaucuguaacuucagcccugaagcagagugaggggguuacagacagcaggacccuaaggauugcuggacacccagcccagcugagacggagucccaggguccagugagacacccugacacagggaaguaggacacagagagggacagggcagcgcgcgcgcacgcgcacacacacacacacacacacacacacacacacacacacacacacacacuuuaaacugaagccuacugaggaucagaauucuuaagaugcacggauaguaaugaaugaaagaaguuauuagggaauacugaaacucccucagcaauaacacuggauuuauuuugaacauuuaccacuaaaaauguuuacuaaguaauguuuacuaaaguauugcagcagguucgaaaaagccuuaggauguaccgugguugcaugcccauuuaaauaucucacuguucauuugcauuuauuuuaguuuaugauugaaauaaagaacucggcuguaucuugcaucccagcugauugggugaagguuggaagguaaguuuaaggccacuuuuaguucuagcaugaguuauggcauguguaucugugcugacugaccaguaccagcuauagucuugaagcaagaguaguuuuccuccucugauuuucugaugaacuuugaaucagagaugauuuucuuugucauucacuuagaaauauuuugaagaacaauuacuguuugccucaugccugugagugcugugcauaacagggggagguuuaaggaaccuucaacuguaagaugacugugguuguucaagcuuuuugaugaauguagcaccugacauuucuuuuaagaaacuggaauuucauuuucugcuucauugagcuucguguuucuuuacucucuguguuuuccuuggcacgcgguuauaguaguucuuucuuuuucuaacuuauaucuugaccugaugaguauaaaugauagcaguauuggggagcauuuuguccuugguuagcaucaguuccuugacggggcucauucaggagaagugugagcaucugaguagugcgcuggcuggaaucucugcugcugcuucucuuccuaugucugaaugacuggggaugaaaauauauuugccaagauaaguagggagacugguagugaaaugacagaauuuuuauguuaaggaugaagggaaauuaugacaugguggcauaauggugauuagguuauguuaaauaauguaacuauuauccguugccauggcagcagcuacucuaggcacacacauggguuucuuuaacucgaauaccuuguuuuuccuucugccacugaagcuguaaaugugaguaguguugacuugggggauguuuuuauacuucgagcauccuucccuguauuaacuuuuguccuauagggcagacagugggugaaaaugugcuuuguaaagaggcacuacuuaggggaaaccaggaaaggggauaucaguugacauguaaauaaauaaaauaauccaauuaaaaauagggaaaagaaaaaaaaaagagauacuacuaauacccauauuagucuguagaacaguaacucgcuaagcaacugcagaagaaaacccugugauaaauugcuugcuuagagcucuagaucauguaacugaggagcuguaaguaaggcagaaguugaugcuggccuccucugagccugcagucccagcagugcaaugaacuggaaggccuguugguggugaggacuuguuaccauuuacucugcuuggcagccagagccuugcuaucaggcuggguuugaguaucaucaguuacacuugcaguauccaacagcuaaguuaaggacaacuguggggaugugagguaggagcugggcaucagagccuugagcccuucuaaagcguauuucccuggguuggcugucagcgggggcagcuuccacuccuugagucucguaccuagguauucugcuaaacacugaggccagggucccugcuccgcugcaguucauaccaaguccguuccauuuggacaagcugucaaugcuggucaaggccuuggccuagcauuucuaacuggauacuugcccccauguacugacugccccuucuugacggagaaaguggcuuacccucaagcccagaggagcuucugggcucuucccucccauccagggccacugggccugaagagcugucuuuuuuccauuauagauucaugggcugacuaccuuugugauguauuauuuccuuuuugcucugaaguauuccaaguagaaaaauauaaaaucucaagagcgacacggucuucaccagugugucgcccuuccuugucacacaucuuuuuuugccgcacuugcuucugcuguuuuuuuccuuuaguauaauggagaaaaaaggcuuuggccaugaagaaaguuucaacucugacuuugccauacaaauauaauuuuaagaacauuuuaaagcuuccugaacaugcucguauuguuaaaaagucaaaacugggaccauaauuaauguucucuguuuauguucaagguucaccagugaauaguaacugcuuuaauguucugaaaccauggcugcauugauucugauaaccuuggcuuccauuuuuccccuccuuccucuuguagcacaaaagcugugagccgcuuucacccucccuucaucguggaaagcuacagacgucugaaucagcuccgggagcagcuaguccuugacugcaaugcugaauggcuuggcuuccuagagugaguuugcagugagcaaaacgcucucagucugugcucugagaaauggauuggaaaauguucucacaccgcccccuaaacaagcagagauugcuucugugacuuccuaguagauagggaggggggggcauaugucuuccuagacucaauuuccaguacccugccaacaaauuuuaaucccauuguuacauuuuugagaguauauuugaugcauacauguggugcacauacauacaugcagauaaauggucauacauauaaaguaaaaauaaauauuuucaaaaaacgaauauauuugaguuuccccaauccccugccucgauuuuuaaggaaauaucuaauuaacuuuuacuuuuuuucaacuuauauguuuuuauuagauauuuucuuuauuuacauuucaaauguuauccccuuuccuaguuuccccucuaaaaauccccuauccccuucccccucccccugcuacccaacccacccacucccauuucugguccuggcauuccccuauacuggggcauauaaccuucacaggaccuagggccucuccucccauugaugaccgacuaggccauucucuguuacacauacagcuagagccacaaauucuaccauauguuuucuuugauuggugguuuaguuccaaggagcucuggggguacugguuaguucauauugauguuccuccuauggggcuucagaccccuucagcuccuuggguacugucuuagucaagguuucuauuccuucacaaaacaucaugaccaagaaguaaguuggggaggaaaggguuuauuuagcuuacacuuccauacugcuguucaucaccaaagaaaguuaggaguggaauucaagcagguuaggaaacaggagcugaugcagaggccauggagggauauuucuuacuggcuugcucagccugcucucuuauagaacccaggacuaccagcccaggaauggcaccacccacaaugggccuuucccccuugaucacuaauugagaaaaugccccacagcuggaucucaugguggcauuuccccaacugaagcuccuuucucugugauaacuccagcuugugucaaguugacacacaaaaccagccaguacagguacuuucucuagcuccuucauuagggaccuugagcucuguccaauggaugacugugagcauccauuucuguaucugccaggcacuggcagagccucucaggagacagcuauaucaggcuucugucagcaagcucuuguuggcaucugccuaguaucuggguuuggugguuguuuaugggauggauccccggguggggcagucucuggauguucauuccuucagucucugcaccaaacuuugucucuguaacuccuuccauggguauuuuguucccucuuggaauuguccacacguugguauuccuucuugaguuucauguguuuugcaaauuguaucuuaaauauucuaaguuucugggcuuauauccacuuaucagugagugcauaucauguguguucuuuugugaauggauuaccucacuuaggaugauaccccccagauccauccauuugccuaagaacuucaugaauucauuguuuuuaauagcugaguaguacuccauuguguaaauguaccacauuuucuauauccauuccucugcugagggacaucuggguucuuuccaguucuggcuauuauaaauaaggcugcuaugaacguaguggagcauguguucuuauuacauguuggagcaucuucuggguauggcauuuagucauguuucuuuacucuguuuuaauuuagaauaaucugccauguuuuuucauuuuuaugauccaggacuucuuuuggaagaauucuucuuguauuagggaauggcucacauucuggcuugauuugacacucagcuguucauauccacaguguuaggcaguguugugcugcugugugucugcucuugggcaaacaauaguguuuguaguuuguuguuuccugccuuguaaacacguccaggauagugcauucccacugacugcucugacguugggaagaagugugcaccauugacuucccugaaaccaugggacuucauauguggucacuucacaguuuacaaaagaauagugagaugcacguguaagaagucagucuuccacagcaagccggaggggaggguugcuuugcaguuuggacuggaccaagcaugugcugucugguuguugaugagcccacaggcaugccugugagcagagagcuguuagucucucugucuaaaaccuuaaaugguaaugguucagugaggauggcagggauccuguuaaagugacagaagacaaaagguuggggcauuuggaagauagcaaggagauaccggucuccucuguucagagaacugaguuauaagaacaggaguagacaccaagcuuucuccuuauuuccccugagucuuuugaggugacucagagucuugugagcagagauacaagguuaucuguucauuuuuuucccagcuaacuuugacucucccauuuuagggggcucuugaaucuuuuagguuuucuucuuuuuccauaguagauuuaccgaaagcauaaaaauuaaacuuauacauuccaaucuuuugagggcuacauucugaaggaucugagaacuuguucagcuaacuugguguuuuugacugcagacucagaacaguagcuaguucugcauggagggguugcuuuucaucccuuugucuuucaaacagaugauucagcgguuuuaugcuguguguacuuuuacguuuuuuucuuauuucauacauggcaagaaagacaguucaggaguuaagaguauaaaagaaaauaaaaggaaacuuaugcaucaggcaucagacaucugaucacaauaguuaggaugcuaagcccauauaguaagacccucuucuaaaauaaagaagaaauagaacaugaaguauggaacauaucaaaguuuccaauuuacgaacugacugaaucucuuuguggccuuuuggcuaagaucaagaguaaaaaauuggcugagauguaucuagagcauuaucguuagagcuccgcucaccauagcacugauuguuuuacaugcuccuuauugagguggcagauggcgugaauaccaugucauaaagagauagccucagugaaccugccaucagaggauucaguaccagccaucccagcauauuuauuucuuacugagguucuguugugcauuagucauaaaaucaaggccaugaucacugcugggaaugaaaucuuuucucaaaauaugucucuuggguuuuagaauauggacuguggaccuuuucucacuucuaaauucuuuuuuuaaaaauuggauuauauuaucucucauauaauaguugcucagaauauaugagaaaugcauuuucaaagaagauaagauaguuuccauuccuauuaaccacacaaaucguugaaugccauuugcuaguaaacgucucuggucagcauagcagcuuugaacccguggguccuccuuugccuccaugggcccagcaucaaagucacugaaaucagugugcccggacaggagccuggagcugcaggaugacagaggcugaggcugugcccggacaggagccuggagcugcaggaugauagauagaucgcugaggcugugcccggacaggagccuggagcugcaggaugacagauagaucgcugagguugaccuuucugugacauagucagucuucccacaugcugcuuguucauugauuucguuguuucuccucuucuuuucgagaugaaccuucauguggcccaagcuggccucagucuuaucauguuacuaaagcugaucuuaagacuucugauccuccugccuuaccucucaaguccuaggaucccaggaaagagccaccaccauguguggcuccacauguuaccugaauugcccacauuuagcuuguuguucuuguaaguaugaaugaucuuuuugaaguuugaugagguguacaguaauauacaugaagacuaaacaggguaugugugacaauugugauauuuacaguuuaauaaugguucuccuuauugaugucuuaugucauugacauaagaaagaaaauaguugccuagauuuaaauaauuuuauucauccuuuguauuuuuuuauugacugaauugguacccacuguaaacaauaucacuuacauccuuucuacaauuagaugaucaucagaagcagguaguuaccauuggcuguuggguagggccgugguggucuuuauuagacccgaggagaaguuaguggaaggaaguauaaaaugacacuuugugcaaagugcauuggcacuuaugugcagagacggagggacuaaaacauuaaauaaacuguucuggcaagagaggagagccaggauuggacuaauagaugagucauuaauuuaguuaaaaacagcgcaggccacagacuaaagugugaguaagaagacaaauagauauagagcugagaucagacuaggaaugauaagggauggucacugcaccaucuguagagaaggggccucacaaugaacauccacuauggucauuguguagccgucuguagagaaggggccucacaaugaauguccaguauggucauuguguagccgucuguagagaaggggccucacaaugaauguccaguauggucacugugcagcugucuguagaguagagaccccucaauguccaauauggucacugugcagccgucuguagaguagggaccucucaauguccaauauggucacugugcagccgucuguagaguagggaccucucaauguccaauauggucacugugcagccgucuguagaguagggaccucucaauguccaauauggucacugugcagccgucuguagaguagggacuucucaguguccaguauguuuaaaaguacgagacauuuuucagguaacaucugaggaggguccagcugauauagggacauaaacacuguguauuugggauuugcgcaaacucuuaggcuauuaguaaaauuccuaucaccuauuuuaaugaacuuuaguucaagaggaauagguuaauuaauuaauauguucuaucuaguuggauaaauaucuguauaaauacaugcguaaaguauacugugaauacaauuuuuaguuuacaaauaauaauaaauauaguaguacaugaaaacgucauuaauagaauacuuuugauaauaaaacaaaucagaaauggagggcuuuuuuuuuuaaguaagagaaaaucaggaagaacuaaucauuguuguaauuuaauaagcugagaaaugguguaaaacuuuuaaguagcaaauagacugaaguucagcacuucugagauccacauuauuuuuauauauaucuaaauuuuuuuaagaaagauauucaguaugacacuuccccaguuuguguaagggauaucugaauuacaucauauuuucgugaauaaggcaacuagguacagaaacaagcaacaguacuaacugaaccuugcagaaucacauugugaggugcagccauaguuuagaauuggaggugguggucugagagcaaucauuuacuuagugugugauagauaggccaugggggucuagccaaguacuguuaacaaaagaaagcacagcaaauggacaacgucguuuggauguaggcucugcuguguguaguucuaugaccugggucacugcuggguucaucugaacccugugagguuuggcuaaugaugcugugcugugaggacugacuguguggcugagcacaggucccgccagugucugggcagugaggaguguugccuuccgcuuuccucuuggacccucuggggacuuaguucucauucccuuucuccauucccaaagagucggggucaucucugccugugcuugaaugucguuaauuuagcagagccucaguuucucucagaugacaacuuacucuaaaguuuaagcucaguucucucuuuacuuaaaggauauuucauucugagcacuuagaauugucuugggcucuuuuguaccauguauauugaguuagggccuuggaugcccgugagcugaguaugaccuugaacuccuguucucucaggucaucuccugagugcugggauuauagggguaugcauugugucuggccaguuacacucacuuucaacacccacaauuuaucauuauauuuagauguguauaguuuguacaguauuacauauauauauuggaauaaaauacuaugacaugagauaaaacagauuuacagaacccaacucuauaaacauuucuauucacuuuuugaauaaaucuuuuaaugaaagucuugauauuuuccaucaccagguauuaagauagcugaagagguucuuauuucugucuuguccuuaacaauucuuuauugcauugucuguucagugcugguaguguggacuagauauuagggcuauaaaguuaaguuagacagacagacagacagaaagacaggauucugccaguucuguauaagagguaacaauauaguugcuccaagguuggguguugcuauaaggaggagugccuggggaggccgacacaccugaguaguucuugaagcagugggaggaagcagagugaacugauaucuacacugaaaucucuauccugaaauaaaaugucacagucagauggaauguguucaucugugacauuguacauuuauauauacuuacauauauauaaauauaaaacugucccaaacaaagggaacacucagucaccaguuguguuaucauaaacgauaguucaguauacuguccuuccccuuuaccugugagacauaucugcuuauuucacuuguguuuauauugcagguaggcagauuguugcacagcugucaugggucaagaagucagccugcuuaucuuguugucguuucuuuaggaauuuuggugaacauuaucacacuuuguguaaggcuguggaucaccuagcaacuguugacuguauuuucucccuggccaaggucgcuaaacaaggaaauuacugcagguaauaccuuuuucauuucucucguuuaccaugccuucagauaaaaugggaguauccaauuaauuucacuauugcuauuauaaaauguuguaguuguucagguguguuaugcucuugguaaagcugcauaucacauguauggcuuaauuugaaaaauaaacuccuuccuuccuuguuuuaugacugacaaaugcagauaccugccuuaacucuggaacugacugcuccaauugaaguuuuggguuuauguaaaguuuuuaaaugaagcuugaagacuccuuuugcuguuagcuuugucuuggaaacuuaauaacauguuucacuucaaaacuacaguuaaaacuuaaaaacuacaguuauaagagcuuguacaugaacgagggacugggaagauggggguucuguuguggggagggguuccgugagcuuuugugagccucuuguugagagcuagauucauaccacucuucuuuaauggccucugagcaucccaacauuccuuauucuccucuucauaaaggauacuagaguuccauagaucuaagaaacaauucugacuuuucaauaaguucucuuucaaaagccuuucuaguugaagcuacacauuucaggaaaguuaggagacuguuuagcuucuguaggaacuaagaggaaagcccgugaaggugcugccugaccgagccugaggcccgagcuccgaguggacaaccugacugucugucuucuuucauauugguuucuucuuuguaguguguugauuucuaaagaauaauacucguguccuguaaucuccaguguguagagguguuaaagcaagguuguuauugugcaguauuucuucuuugugagagagcguuggaagacuugguacacaugcuauguucucuaauguaauguauuguuucauugcccacuugugaugaauauaucuauauugcuggucauaacagucguguuuaaaauagauucuuggcauugcaguuacuuccuaguucuuuaucauaccaaaggaauuucaagcauacguagugaugccuaaucaguuuuacacacacacacacacagagacagcugaaucuucuuuguaguaaacaaggaaaaugugaaauguauguccuauuuaucauggauuauugugaaaaguuagaaucugcaguccauugauuugaguaggaguucuuuuacucuagauuugugaagggagauuucccugacagacuguuucugaauuaagcagaggcauguagugucguuuaaauaagcugucccuauuugaagcuuugcgcccuccucucuuuaucccuccuuacggcaccuucaguuauuugcuguugcuggaagugccugcaugaaaaccacugucuaaaugguuaugagguuggauucauugcagcaaauuaaaaauuucaccaguguguaagauagacaaauuguuuuuucccugguacuucuuagccuuuugcauaaguaggcauggcuaacuuaagucuccgucaguucagggaccugaagcucuuguagaucuguuaguguugcuugucauuucugcucguuuguuugcucguuuguuugcuuguuuguuuuaucagauuuguugacuguguggugaucucagccaccgccuguagaagugauuuaugcuguacccuucuggagugagugcgucuaauaagcauuggggacauugucagucuugugucaccuguuccagaucagaagcgaggugucaggaggugccugcagcuccuccugacuccucuuauaccuggggcaguacuucacagcucuuucuccaggccaccgcugucgcaggucagcuuccccgugccuucagauaccucuccuggugcuacuccccugggccuccauucugucagguccugccugcugcugccguggugguuuccaggucccuucagacagcuaucugcguacuucaaccaucuuuucuguuuguccuuaguccaaagaguguucuagauuaucaaguaagucauuguuaagcauuucaaagaacauuucaaacgcuaaauauuuuuccaaauuauauauuguguauuuuauauuaggaaaaagccaguguggcuuggggaagcuacggaaauagucuuauauacuuucuacagugcauuacaucauccucuuuucagaaaagaaaauuaacauggcuguaaauagcugugaaacaggaagcuugcauuuaaaguacauuuuaaauuguaugagaggcaaacaaacacauuuuuuccuaaauuuucagcuuuuugcgaugucagugcaugugagccgugagccaucgucguuccaacagauuacuugccuucacaauugcaagcuuuucuugcugaugcugucaagaugaucuuauuacugucuuggaaccuuuagguuacccaagccucaccuuuauuucaggccucucugucuaauuuguauuauguuuccuuguuucccuaacaucguuuauguuguguuccucugugacaguuaaaaaagaaagcugcaauuaaaaauauaugaauuauaguagcugcaucuguucauauucagaugucucauucuuuccaggaaacauguagauguccuccauccuccccucgcuggcauaugacacaucggcaugcccagccugucuucgugcuguggcugugcuguccuggaguagcaucccagggcugugcaugucccugugcgccuucccugagaggcucugucacuauguaauguugauagaauaggucauugcugauuagagccacacugugacucugcacaccagugccacagaggugacacccugacuucacuugguagagcaccuagaauuugauuuuaaaauuuauaucucuuacauguucuuucuucuuuuucucuuauaauaaacccauaagcugcccucaaaauaacagucuuuaguaauauauauauauauuacuauauacauacacauauauacauacauacauacauacacacgcacacauauauacauauacacauacauauauauguauauauguguguguauauauauauauauauacacacacacacacacacacacacacacacuuaacccccuaaacuaguuuuuuucuugucauuucaugugugccuuuauucuaauguuuuuucuguugcugugauaagacacucugauuaaaagcagcuuggggaggaaaggguuauuuggcuuacacuuucagguuacagugcaucucugagggaagucagagcaggaacugaagcagaacccgugagggaacacugcuuaccaguguucucuggcucauguucagcuaagcuuucuuacacagcucagaaucccugccuagggauggugcugcccacauggacugggcccucccaccucagucaucaaugaaaacaaucucacagauaugaccacaggcuagucugauggaggcaauucuucaguugaaauuccucuucccaggugacucuagauguugucaauaaaguaaccaaggugcccucccuucaugggugaccccagcuuaagacacuggggucacuguuugaaaaauagucauuuuagaauaaugguagcacacaguaaaaaugagauggcuccauucaccacugcauugucaaagacuagaaaucgugaguauaucaauccaguugagggucugagaaaaaccagugaguuucauauugugcugguaggaagacauguuaauagugacuucuuucuucuauaaagaguguacauacccggugacuugcaaauucuauuucaggaauugaauuuaacuuagugaaaacccuugaacacacacuuacacacacagaaagagagacagacagacagacagacagggaagacugaguguuuagcacuguuaugacguaguccaagugucuaccaucauagagcaguuuacuuauacauggguagcugccucaaaagaauacugagaauaugaugagaugugagcugguguccucaggaugccauacuguaaacauucauaagugcuaauuccaaguuuuuaaaugucuuccagaggacaaagaaaaauuuuacuucuuuuuuuuguuguuguuguuguugguuaaaaaaauacauuuugccuuauuuuaacccagaggcccacuggcagucuuacaagucugagaaagacuuggcauuauuggugaucugaggaaucugcaggacuuaguguuuuauccccuggggacugguucagcuuccuucaccaguuuacuccagugcaggguacaugacccagcaagggacuccauuacucuauuuuccuguuuuuaauacucuuucccaaacugcuagaacaucauuccagaaggccugaaagaacacagauaguacugcuauaaucugcuuccgacuucccugggacuguugagagccuacccugucuacccacagaggccagggggccguaguccccuucugcccacagcuucagauagugugaagagggagacagaguccgcccuugguucugugagaaggcucugguauaaacaguugggccugaugagggcucaggccacaguguggauguguagaguugcuaaugcuguguuacugcuacugaugugucaagaauugauuguaaauaauuggauaaaaugaaacgugcucuucuugucugacuuucacacuggggaccgcucauuauuuaauauuugcugaugagagccuggauuaucccguuuugcuaagagauagaguuuucugugugucuguauuuguucaacaaaauuuauuuacuuuaguuugcaggcaggaaauugaaaggaaacagaugacauuuagugaaagguuucauuugauugauaauucuaauugcuauuuaugaaucuaaaaauggaagugauuuguauuaugaagguagcuauucuccuuaagaaaaagaugaguuuugagcaguuucaggaauuauccagcuauuccauuuuuguugaugcauguauaagaagaaccauaacuauaggcuacaaccuccuagaaauaaauuaaaaauuguaauuuaauauucauaggugaauacguugcauucagcacacuagccauucuggguauguauccucugaagaccaagaaagaaaugaguaaaguuuggugugccaugccuauuaaacgauagaucagggauagaaaacucgccuaacacgaaugaggccauggucucauuguauaauaauaauacuuacaaacauugaguguuuaauaauauuauugcacaaauaaucguauuuguucugagguugauuuuuuuuaaauuuauuuuauuagucucacuuuuauaaaguuaucauuaaaauagauuuuaaaaaauuaaaaacgaguauccauuggguaguagauggugaaaucuauuuuuauguguagugauucuuuaaauaagguauugagugaaaguguuugugggugguguagugaaauauuucaaauggagugcaaccagugccauccguguaugaacaugacugugcggaugcaggcuaagaaaggagacaucaaacugacuuaacugucaccuucuaagaaaguguucugaccuacauagcuuugagaaguagaauaaagcuuggugcuccuaacagaggaccuggguucaauucucagcgcccacauggcugcucacagucacccacaacucccaggcgcucccucacauggcacauauucauacacauaaauaaauguaaaaaauaaauaaauucaacugauagauauaaagacuuaaaaccaaagaauaacauggcagcaauuuuuguuuuguaucaaaaguagaagguacuacagaagugccauuggauuuucucagucucuuagcccaaacccaaugccauuuauguuaagaugauaauuuaaucuggaaauggcuuuacaugacuaugaagugaugugccaauggucugaacuguguuuagugaugcaugucugcugguuccuugcugguagguccagaugagaggagagagguccugaucccgccaggggucucuccagggcugagugggauggcgaguguugaagguccaaaagaaacacacugagccaggagucuugucgaagcaggaauucaauuuuauggaaucagauacuugcuuauauaaguuuggaccauggggagggggguuuuggugggguaagauaacguaggagacagggaaguaugauggaggguauagagugguugacagggccaauggcaaagcucuacauuugcaauggggugggggguaggggacagacgcagggccaaacagaccuuucuuagucauggaagugacugagacaggucucaaaacucgagccaggcucagguuuguccuucaggcccaaaucagggccaaaaagggucccaacacaugugcugacuugaucuuagaugaugacagacaaaugaaaacugaaaucgcaugaagauagacuucacaaggcuugcugagucuuguccuucaaugugcugcuggucccaguuccugauuucugacuaguugaugaggaguugaacucuuagucuuaguccuuaccucaugugcucuugaggucuaagacuuuguugucucucuucccuauugaguacugaagguuuucaugcugugucaguauagccaggguggcuucaaacucacagacgucuccgggccucagccucccgugcugagauuuaagguguaucaccaugccaagcuagucagugguucuuuuuaaaagcuccuuuugugucuucgaguugaugaaacuuauuuuuucaggccaacucuacaagaagaaaagaagaucaucauaaaaaauggaaggcacccuaugauugauguguugcugggugaacaagaucaguuugugcccaacaguacgaguuuaucaguaaguaccucaugacacccaaaaccagugugugguaaggauuauaacuuuguaucaaauauuuucauaucugauuuuauccucaacuuuaaguggaccaaucccaggcauaguuuuuuuguuuugguuugguuuuuuguuuuuuuuugagacaggguuucucuguauagcccuggcuguccuggaacucacuuuguaggcuggccucaaacucagaaaucugccugccucugccucccgagugcugggauuaaaggugugugcaccaugccuggucccaggcauaauuuuauuuucaccaauugugcaauugguauaauucccaauggaaaauauccguagauacaaagauuuagcaacuaaagacaauuauguuacuucuuguauauaacccaauaaaaauacuuuauauucagaaauauguuaaugauguuggaauuauacaacgccuuuucaaauuuucauuagcauacggcauuagcauguucuauguugcacuauuuucaaaugcucugaaaacacauaagugauuagcuguucuaggcuagagaucucuuagaggacacugaugaugcuacauuaguaccccagaguaaagcaagaucucagagcuguugguauugucagugauggcaagauuuaggaagcggggaacagggcuuugggaaggagagcaugaaacaagauaauggguaagaaaaguuagaguuguccacaggauuacugagaccaucuaaacugucagcuggguuucuuuagaggaugacaucaaggaugcuaacugagguuuguggaugccugcaguaagggcaacugugggagggcccuaaagaaacaaaaauguguggauccugaauggaaaagcgcagcaagauacagccugugcaugacaggagugucacagagugguuggauacagaguauuagagagcagucuaugcaugacaggagugucacagagugguuggauacagaguauuagagagcagucuaugcaugacaggagugucacacagagugguuggauacagaguauuagguuuuuaagucagugggagaacugagcuguaagagagaaguuugcaggguguugggacaguagcagcauuccaaguugggccccagagcaaagaccucugacgucgucguuugagcagucauacgugugugaaguaagaugaaaagcuuugaguucugucuacugucauguucccuaucaugccauacaggguuugauaguagcuuccaaucuguguguugggccuguucaaacuguuucauugaagugccacagauggagugguuauagacaacagaaguuaucuuucaugacucugaagacagaauugaagacagggugggugucuguaccuugugggagcuggcuuuguacuuuuaguguggcaccuuuuauuguguccucacuuggugggagaaggggaggucccucucagucccuguauauuaaucacaucuuaaagacccuugacacugucaucguaggauuuauaauucccugagaacaggggagaggcauagacauucggaccauagcaaccagauguguaugcuaucaguugucauauaaguuaauaaauacuaaucuuaauugucuuuaaggcaaagccuauaugagaauaagaccuguguuuuuaguuuucauagcaauaguauauagcuucucuagagagaguaauauaguucuaauaucuaauagcuuggcucguauuuaauggauaaauacccgugaaacauguuguguuucugcucaugccuguccacagauccaaggaucuuacccuugccacugcuacuuuauuucuuuuuuccuuauguuuucauuuucuucuuaaaaaauaaucuauuauauuuuuuaauaagucaaauuugaagaauuaaagcagccuucuaaucaaggagcauuuuaaagaaucauuaacucauguauuuagaucuuuacaagguaaguguaguaguuuuuccugguuagacagcuuagaaugucccagaauauucguuucuuuuacauaugcuuuuccuaacuugaguaggaguugauauagccuguugcuauggugaagcgcauucuguuucucaggguauaaauuuauauacagggauguuguagagaaagaacuuacuauguaagauucuaucuaaaauguacucugccuauuaacuuauaaacuauacccuggcagaaaaguccucaaaguuagguagcauuguuacuucugauaauuacaucauuuugagaauucaccuuucuuacaucuaaaugaugcuagcuuuccugggcucuguguuaaugaaaucauuauguucucaugagcaaagaaagucuuucugacuuucccucucucaguuuuaggaaucuuuucugucuccgcuuuguccuccaucugccuccuccagugcaguccuccguucacuuccccuuguagccucugcuaaccugccucgacucccuccugcuugcccucaucugugcauuccagcuguuugggacucacagaacugccuuugggcuuggcagaugguauucccuccacagagaauguccuccuuccccaucucacccauccugccucccgccucgcaucaucacaagcucugcuguuucucccucuuagaugccuccuggcuugaagccuucccucaccagugcucugaugauagauccuacaccccacacccacugcccugugucgccccugcuuuguacugaugcuuguucuuguuggugugcuucccaaaggguuccagcuugacaaggacaggcaguguacacgucuacacuguguaggugccauaccagugcccacagcacaccacuaauacacagcaggcuccuacucacaguguuacugagacgccuucagcaggcuccaaaucucacuugaaauuuuucuucuuuuucuucuagaaaauguuaguuuuucggaauuggggauuuuucaguuuacagaauauuacacugaagaaauagaagaaaaaugagauacuacagcguaacuccucuucauacccaugauagacuaauucucagaaugggaaagccaugucaaggcugucugaguugagccuuagauaauuucuugaaacaugggcauagucuagggcaaauggugcuuuucacccaugcuuacugccuggaaaacauaggaaaugaugccaguuuaacuccacacuggaauaaaacaagagagggaguuggcucuggccaggcagauguuggccccagggcugugacugucccuuaaggguuaaggaguugguaccuguacuggcuaguuuugugucaacuugacauaggcuggaguugucacagagaaaggagcuucaguuggggaaaugccucugugagauccaacugcaaggcauuuucucaauuagugaucaagugaggagguccccuuguguguggugccauuucuggacugguagucuuggguucuauaagagagcaggcugagcuagccaguaaagaacaucccuccauggccucuguaucagcuccugcuuucugaccugcuugaguuccaguccugacuucuuucagugaugaaaagcaauguggaaauguaagcugaauaaacccuuuccuccccaauuugcuucuuggucaugauguuuugugcaggaauagaaacccugacuaagacaguaccuuauauccucaugaccuuguaaaaaaauaaggacacacugcuuggggcagucauauuauggacuguccugugacuauuuguuuauugacccaaauggcuaucuggugggugggcuuuugaaagcagugcgaguucuuguauuuugguuuugagauaagugauauaaauucaacuguguugcuuuaggaaguacuguugcaugggagagaaaaugagucuagugugcaaagagaaucuccaggaagccccugaacuguggaucucuuuagguugugggaaaucuacugccuaagugcccuagaggcaaguacuaggguccaggucaagaaguaaccugagguucuuuaguccucaguacugucuaugguguguaguagacacauauuucuuuguauauaagaauguuugaagcugguaagaaugaggaccaacugcccaguuuccucuucccucccaguacaaguuguuuuagaugcccaguaauacuugcuuuggcuacaaauuaaauguaacauuaguugaaucaacuguagucauugacuuuaucccuaauuaccaaguacaaugauaaugccuuaccuaaaacaucugaguuuuaagcuugacuucauuuccuggcuagauuauacaaauaggaucacugucguguguguguguguguguguguguguguguguguguguguguguguuuuauauagugugauaauuagauaaaugaacugaaggaugaaagugaaggaggaagauuagagaugcauuuuuaauuauaugugugcacaugugucugugugugaguaugugcacauggguguaagugcuuguggaggccagagagcucaccagcuccacuggagcuggaaugguugggaugccugacaugggugcugggaacucugaagagcugaagggacaucuaaccugggccaucucuuagcuccagggaaguaugaaugguacuuacuuuguauuauagggcuuguaucuuguaucuccucucuuguuucugaaacacugagaaggcaguuguucgauacuaacuugauuuauuaaccuccauauauaugcauguguuucugugugagugcagcucuguguaugggugcucuuaggggacaaaagaggacaccagauccucuggagcagaguuguagguagcugugcaccaccugaugugggugccaggaagugagcucagguccucugaaagaacugcaaaccucuuagccacacagccauucucucucacugaugcugauuuccuuuucuuacaaucaccugcgcuggugucugcccugagguuucuuuuucuuccugucucuaacccauggccaucaauugaacucuuguucauucuucaagacccaaaauguuauuuccuacuucacagagccuucauuacuacuuuacccagaaacaaguuguccaugguaguaugucuuuccauccuaaaguuccuuccacauaucacauuuucuuauguaggcauagagggucugaguggugauagcaaauaaaaauucaaauucaguucuaccauuauuuuacugucuccugagaugggccacccaucaccuggccuugguuuucuuaucuguaagugaagagcgggaaaccagccuugcuucuacuguucuaccgaaugggagauggguaggaugcaaggaucaggcaggguuaaaccacugcccuggcaucucaggggugagccucacugucccuccucacugcucccucucugcuccuuauucaucuguccuuaaaugugcagagacugacugggcuugugcagaggaaggcuuugucuguagcuugccauugauugacauuuucagggaauaaagcacuuuaaaacugacauuuuuccugcuggcccucagcuacuauaaaaauaguucuaccacauucuauaaagauggauuuuaguaucugugccugucaaggacagaaccaugguuuacagagaauucgcucuuugcuagggcuuagaaaugaacaugugacaauuuugaauucuuuucuacuguugauuuuggagcuacugugacuuccugucuucuguuguacccaguggcagagucaaggaccccaggcugaaaccucuccccugauuuuacagugucucuaccuccuugccauugagcagaagucccuugcaagauaucuaucagcaguuugcugcuaguagcucuguacugcugggcaagcuucuuggcuucccaaggcuuuguacuucuucaccuguaacaugggaacauagggaccauguacguaccugucauguuuguaucaggagauggaggcaggagaacugcaaaacugaggccaggacaggcuauauaauaagacacccccacccccacccccaugaaacaaacuguccuaagaacuaaaugagaagaugcauaugaacuuguguguguguguguguauacauucauauuagauacauaugcacuuaguguguauguggguggucuggaaggcagagcauugacauugaguggcuuccucaaucauucuuuaccuuauuuuguuagacaggcucucucaaugaaucuggagcuugcugauugaacuuggcuggcuagccagcaagacccagggauucuccugucucugguaucuguuccacuuugccuggcuuuaugugugagugguagggauccaagcucagguuccccagcuuacaagcacuuacuaacuaagcugucucccagcccuuugugacucucuucugcuguugauuauucgucuuucccagagaauauagcacuuaauguugugaguacuuggguauuucagguucuagucuacaguaugagucuugaauucugaacucagcauugccauucaugcugaagccagacuccugagagaggugccucuccugcaaaggagucucagucuccccaucucugugcaagugugggugaaacucagccuugguuucuaguggccccuaccauccaccaugauggguagcacucuguccaccaauagcuaagccuccuaggaugguacuuacaucuuguguuugccucuguucauucuuucaucuauuccuucaucucucugcaguuucuugagacuuucucagggccugaccucauguuggguguccagucuuguacacucccauucgcuucagucagcuuccguggguacagaguucucaucaaguguggcuucuuucuauccuguuaaguucuuugcucaugcuaacaguggcuacugacuauucucuuagggaugcucacucagccuucugcucuucuggacagauuuaagguauauaaugaauguaucuggaagccuaugauguguguuaucucagauaacaauccuaaccagaagguagaugagcacguuagaugggugugugcaguucuuaguacuuaucuuccuuacucugacaucuugggauggggaaaggacuuauaucuucccuauuuuuauaaguaguacagacauugcuuuuaaaauguaaaugugauaaauauuuguaauaucuaccuuuguaccacaaauguguuacccuugguaccacauuugacuaugaaacaucuaccaugggaacuuucuagcagugagaugguaauaacaaguggucaaggaaaagucauuucagagaggaaaugaaaaugugacccugguuaagggacgucuguccugcccagaccuguggaaaggcuuugaggcaggaguaaucuuauagccaaccuccuggcuggucacugaagagcaaaaauaagucuucuggcaccagaggaaccuuguagacagguggacuaaguaagaaagcaggcaaagagaccaagaacgccugcugcaucugugcugugucuagggcagguucugaaaagaggcagucaucugugcaaggagcagugggccaaagcaggugccaugguuagcucgggcuucugagaagaugcacugcgccaucggaaucuuuguguccccuccagagucacucuuagaaauccugagcaccgaguugacggugguaaggacuguuuccagucacuggaguugguuagauuguaagagaggauccuccugcauaggauuaguacccuuaagaaagggcccgagaggguucaugugccccuuuagccuugugagcacccagccagaaguuggcuaugugcacagacacagauccugggcuucucugcauccagaauggggaaauaaauguuuguuauguauaagcuaagagagugcaggguggcauugagaaaggaagauaaaaggagggggaggggaaggaaaagaaaggcaggucagccuugacugugacacuuggacacauuuucagugcucugagagucuguggaagugacagcuuuuugugaaaaacaaguucugucuuaguuauuaagacugucacuuugucugucauacagagaguggacugugguaaaggaacaccggaaaggcuugccgagagccuugacagcugccuacagagcagcaacagagguggacacaggaaguaguuaugugucagugccuggugacucaucacugcugugucuccugcugguguuuauacugccucuuauuggagguccuuuaggguugauuagaaaaaugccauuugggucuggagagaugacucagcuauuaagaacacuuccugcucuuucggaagaccuagauucguuucccagaacccaccugauggcucacagccauccaauugaagggaaucuaauacucuguucugaccuccacaggcacaaggcauauauauauauauauauauauauauauauauauauauauauauauauacauacaugugugguaagcauauaugcacguaagcaaaacacucauauacauaaaauaaauaaaucuuuaaaaauaucucuauuuuaaaaaaaagaauaugccauuggucacuugaaagcaguugaguuuagugagcugaaaagcuaauuuuuugucugagcucgcuccucaaauauagggguguucuggaacauucuauuccauaguaacugccucucuacccacacagcugaugccaauggcuugcccagccucgcucuucugggugugugcaggugaaucuuuggguagaguauagaaccucugcucugguauaguugucuauguccuauaacugaauuuagguugagagcauuuaguuuaccugucuuuaauuuauggauaaaaaacugaggccuacaaaacauaucagccugugcaaacucucuugcagaaaccacuuuugcuggcacagcagcccauguuugauucauaguuauucuuuuaaagaauagcuugagguguuguuaccuucuucuuggccuguaauuguaagugauuuacaggacuuuauuuauuuauuuauuuauaccauuccuguucaucccaaugauagaaaaccuuuugguuuuuuugauaccuuauguaaauaauagagggcugaaucaaagauaucaagggaaaguacucccacagaaugaugauuuccccuacuguaugccagguuccuguagauaaggcuuugcauccuauuagacagugguauccucauuuauguaguucccauuuuauggaugaguuucuuuuuggaggaccuaacaugguagaauggaaauguucuacacauuuuggccucuuauuuaccuuuuaauuuuuuuuuuguccuauuuauuuauuuauuuauuuagguuuuuucgagucaggguuucucuguguaacccugucaugccaccaccgcaggcuuuauuuaucuuucuaaaacauagcugugacugucucauacuucauagcuuguauuuuaaauuuaaugacacagguaaauccuacauuuucaaaaaaagcauuggacaauuuuuagccaugcuauuguaucauauuaaacaguaugaauggacccuaguugucccuaaaaaaaaaaaaaauuguuucuaacacgcuguuauaaguguuuaugccgcagugcuucagccuccugaaaagcuacaaagggggccccugggaaaugauucggauuccccuucccuuuuccuccccaaguggacaguccucaaagaggaaauaguuucuuuuaaaaccacuuacuguauuaauaaaucuaacccugcagguaaggcagauagcagcauaauucuguggguugauaguguguggccucuccucagauccguuguaaauaucaucucaccucuugguuuccuucucucucuuaccugcaguugaucaaacccaggacuuugcacuuguggaucaaacguuguucuacuaauccaggccuggaugucaggcuccuuaccugaaugauggcagagacucuguaucuagaauggcauccuguauuagaugagggcuuugggauuuuaguuaaguaauuaaaaauaagcugaugguuagacaauggaaggcagcuuucaguaauuuuuaaaacacaaauggggagaaagccugccucccagguacucugugcaucccaucucuccgguggugcagccaggcucagcuggugcauaugccagaccacuguuucugugcccagugcuguggaggcugugucuguuagaagcaguaacagccacuguggcuuugggagguucauggcaccaauacacacugguuacuaccuggaugaccugcucuaauuccaccuagggagcccugugggagucuugugcuaccuaccaguggcaagaaguaagcacaggggcacacaggccagcccuccaggagggccacaggugguuccacauguuggaguuugggauagggccgacucuuacagucaucagucagccagaacucaugcuguggcucuagacuggggucuagcaaauauccuggcguacuggacuuugugauauccuagaaguagguuaccagauuuagcaagugaaaguauagcagauaaauuugaauuucagauaaacaauucuuuuuagaauaaacauguuuguguuugauuugcuuuuuaugccaaaauguuguuugcuauuuaucagaaauacagguuuuauuacuguccucuauuugaccuggcaacccuaguauauccaaggagaauuugugaagguccaggaugguaaaagagaccuuguucaggccuggucaauagcaauuuaacaauuguuuuaaaauuuaacagcuaguuugacuuauacaugcauaaaucaucccuuauucacuuagugaccuaguagguuucuacuacugugaagaaacaccaugaccaaggcaacucuuacaaaugauaacauuuaauuggggcuggcugguucugagguucacuccauuaucaucaugguaggaagcauggcagcauccaggcaggcauggcccuggagaugagaguucucaucucguuccaaaggcaaaugggagaagacugucauccucaggcagcuaggaggaagcuuccuacgcccauucccacagaggcacuuccuccaacaaggccacacccacuccaacaacaccacaccuccuuauagugccauucccuguaccaaguguauucaaaccaccacacuuaggaucaugccuuagugagaaugauuugaggaguuaaaaauuaucaaguauguuaaagaauugcuccccuguaaacugcuaguucacagaugcauugaauccgauucugagggagcucauugaugugaucuugguguuaguauguauaugagcacacagccuauuuuuuguuagucuucuacauggguacuugggagcacugugccagagauguuagauagcuaaccuugaauguucguuuccuggaaccugggguuggaaggcccuuaggaauccaccuacugucuccauggagugaaguuuucauuuugagcuuucuuuucuguccaacgcuguucaucacacucauaucagacauuaaagcaaagcacuaaaucugucugcccgccagcuguauccauugccucuuuagcugcaucucaagauggaaggcuacagccucaaaucagaacagcacaaugcagucucucacugguuguuaggaucaggaaaugagcaugauggucaggaaagccaguuacaagcuaguuggaaauaagcuuccacgcacuucagcccuccuugcuauuuuugacuuugcaaguaucaaaauguucccuggugcacacaauuaaauacuggaaauagauguuagaauuuagaagaacagauacuucacacagcaagugcauucuacaucuuuuuggcuucuugaaacacauaggacacauccguuucuguggucacccugcugugugugcagcagcaccaagccucuaaacuacaguuuagaacccgcucauaacuucccccacuccauuauccccugcugcuucagcuucugcuuccauacccuccugaaugauaucaagaguauuacauuuuauauaugaauuagaucauguuccuagcuuauuuaacuuaguauagugcuccuuaguuuuauuuauuuggccacaaauaacagaauuuaccaacuauuuuaugacugaauaauauuccauuguauguagguauugcauuuccuuugccuuuuuguguguugauaggcccucugacauugaugcacuguugccauuucuuggauguuaugaaucuugcuacaauaaacauaggaauacaggugucucugcaacauacagauuucauuuugcuuggcuauuuaucagcuagucuuucagaaaaauguuaggaauagcuuguagaucuccuucauaaugcuucugauuacaccuucccgcuaauaugcuuuuagaucugugcuuuccuugcuacaaauaggcuauuuauauccuuugccugucccccauuacuucugcgcuguugagagguaggaguuauauaagacgacugcuuuuucauguuuuguuuggugauuuaacaacuucccucugacaauuuauaucuuugucuucucccuugccauagcugucucugagcugcuguaucauacuuuaucuguugauaaacauuugugcaguuuccaguuuaaggcaguugugagcagucucuuccuuugguuuugguacacaccacacaauuaggucugaccugggcagauguguuuuaugcuuccacuaaggaacacacucuccaccuuccuccuacauuuucuucuaaaaguagcgggcuugcuuuucacgauucauuuuuucauccacccagacuccguuuccugagauuugggaccacgcuuauuuccauacagcuaaccauuucccugccaucauuuaaggacaacguugucuuuguggcucaccuguaaugccucccauggaucccaggugucuguugccugguuggccuucuccuacagcugcacacauuccuacuugaugcuuucucuuuuuaaccugcuccaggaugggugaacauguacgccaguucaggacuggccugagaggcaaggagcgcugccaacaggcuucucugugucuuuuguugugugucauccucauuuccauuuaguguguguacaugggaggaggauugcuuggcuaugucuauuuucagcuuuagcagauauuacugaaguuuuucaaaaugguaugcaguauuuuucuuccagaauaaaaauuccagcucuucucucaucuuuggcagaauuugacauugacaaccauggcaggcuuucuuccuucucugucuuguuugauguuucuuguguguguguuuguguguguguaugugugugugaaguggugucauuuucuguacuguaaucggguauuucuucauagucuugacaaccaucuguguaucuuuucucaucuccccuaaaaugagauggagccaaauggaagauaagucaucgggggugcaacccucagaaaggauuaggucuucuggaaugguuauuucucauaagaauguccugcauacuggccuguccucagcccucacuuccugucagcaaaaugaauuccucuuguacacauucccacuguacugaugucauccacugugaaaccuuuaccagaccugagagaaagucaauaccaugcuguugaauaucuagaacuuugaccuuaaugagucucuuucuuuaaacaauuacccagccccagcuacuuuguuauaggaauggaaaauggauuaauucaauagcauauguaaauaugccacaaaguaaugcuuugccucaugaaguccuguuugugggaugaauuguaaauaccacaagaacaucaaaacaaaacaugagccaagcaugguaguggauucuuaugauuccaguuuuuggcagguggaggcaggagauuaaaauaugaggccaaccuggucuaccuacuaagccgaaggccagccuggguuauauaguuaaccccuaucccagucugcacucccaaaauauaaaccaaccauucgaaucccuuucugguucaguaagugaaauucccuuucucauuuguuuguuuccagcaggacucggagagaguaaugauaaucaccggaccaaacaugggugggaaaagcuccuacauaaaacagguugcacugguuaccaucauggcucagauuggcuccuacgucccugcagaggaagccacaauugggauuguggauggcauuuucacaaggugagugcuccuucucuuugaauguaacucucuuuuuguguacauguuuggaugaaugguuuacauucaccauucaggagaagucauuugucacugcauauguugauaaggaagacacccagggugucauuucccugaagaacuuuuuuuaccccccaaaucuuuaaaaugaguccuuuaaguaaaaucuuaagaagggaaucaauaucuccucuuaaacuuagcugaaagacuaugaagaaauggaaaucaauauuuaaacagagaaaagaaguucuggugugccuuccagugugggaagcugaaaccugcucccuccucauuuuugagauagaaguaccaagcaagaucguuaauucaaauuuauuucugcucuuaaacauugcauauaacuggccagggcuuacuaauuucaguuuguaaauuuaauuucaugcuuucuuagcagugugaguagaguauccugguuuuauuaaaaagaauuuguaguuuacccauuucauaucuagcaauuuaucaguucuugaauagucuguauuucuugugugauauguuugaguaaauacugaauauauaagcauaacgcuauguaauaaccagguucucuguguagcauguuuguuacuguccagcuucaugguuaaacacuuguggugaaaccagaaugcacuaucaccagaaugcacuaucaccaguauuagcgaccuugagcagaugcugcagugccuuaaagucugcauauugaaagaauccuuugacuuuugagggccuuucugaagagugugaucauuagucaaagaaggaaggaaggaagggccccuucagacugaauggcaugugcaagcaucagcauuagacacagugagguaaggaacugaaggcagacccuccaggagagcccaaaaucagucaggacuugaugagcguaauaugaguugucagagguaacaguacugugcacaucuggguggagaaucuggcuaccuguugaaggcggagggggugggguaucauaaccuguuugcugcugcugcgucaaugugcugagucaauacuacagacuagaggggagagggaagagaaaugggggggaggggaauggaugcaccugcauucauauacauauggaagccaaaggucaacuucagauguucuucaugaaucaggaauauucaucucauuucuuugagauggggucuuucagugggaccuggaguuugguaagcuaagcugacugaccagcaagccccauaguagucuucugaguggguuucuccacucguuauauuuauaaauccaucugcauggauacguauauuucuaggccuuugcuuguguuucaugcaugugcacacauuccuuggugaguauuuggcaugguuucaguguuucacaaauguaaacaguguugguaccuuuguuacuuaagugcuggggcuuaagcucugacuccagaagacacaguggcuuggcucagccaucccaauucagcagugaaaggcagacggggaagauacaggguguggacccccaugcccguccucuaaguacugaguugagcuuuagguuuaaacaaaaaagggguugaagcucaagagagguuugcauaaugaaguggucuuggucugguccgugauggcgacuuaauuuugccaaucugguuugcagaugaugauugucccugcucuaagccucugugucaugucauuccugugguagguagcuuuccuggaggcaccuguuaguuggcagggaguuucaguugcuuagauacagaaugaaggcagagcugccaggguuucauccugcucuccguuacauuguggguccgagugaagaauuaaugcuuuugagcaaaagcagcuucuaaguguguguggcacugacuuacacaucauguacuguacauaagugaauuuuccccagcucaucuguauugagggguagaauugcuggauuguaaggaacaugcaucuuucaaguucuccaaggcggccauaccaguguaggagcagcagcacgugaaguuuguccucacauuuuaauguaaaauuagaauacauaugugcuuaacuuugcuuguugggacauguucauuucuauuguuuuaauuuccuuuauaugaaguaccaucugcuagauuuuuauuguuuuugaugccagggagauuauuccccucccccacguacacauugugcuuauuuacaaaaagauucagagagugcccuguccaagaucccucaugccugccaggucucguguuauaauccaguggcugcuuccuccuucaucccccuuuggcuugccugccuagacagcagacucuaaauucaaggcucagguauggaagcaaguuugaucugguuuccccuccuguucugaggugugaggguuucucuacggucauccuuacguagcuacuuguuuagauggcuacuuucuaagcccaguccuuaagauuuccagccggaaucucugaggugcuacgcaagcaguggcacuuuaaaaguucaugucagagcagccucacaguggagaaucaccacaugccuugucauccuuacuuaguacgcauugcaguucuuccaguaaaaguaagugguuauucaaauuaaaucauugcuacucaaaauuccuuuuuguguccauugagaaacacgcuauagcuaaacugaauacgauguuugcauaagguuuggcuccagacuuuaagcugcuuguuuuuauguuauauuggacaucuggaacauugggcuuaaauguguauacuccauaauuaucaauggcaugucugcuguggcucaugagugcuauaggaaguaaauggagggaaagcugccgucaggcagaugguugggaucuucuuucuugacuauuauaaggucacacggcuaaggaaugauguccuucgucauuagcagaucuuuuuaaaguagguuuguggccagcaucucuauuuggcuuuaagugauguauuuaagucaguauauugggauuuaugugcucaucagugagaugccuguuuccaagaaccauuagcaucugagcgcaucacugagaucaaaucuguguuugucuuccugaugucugagugcaaguuucagccuuauacagccucuuagauucgguaauuaaguuugagaaaagcuaugaguuauuaagugugguuaggaagucauuugagaaaaacaauugccaucucucaucaucauuucuguugaugccagugaaauguuuguggacagaguguuuaugauaacuggccccuagugaauaauaugauggugugcugccaacaugccccccuguuuuauaaacauuuaaccucugugaccccgucguauucaguguggcaugaguguguuuguccugaaauagaauuaaaggguaaugggcccacaaggcuuauguuaugucaaauguuugcuuuugagcagacagccaauucauucauccugccuaguucaacucagcaaauauuuguuggacacaaacugugaaggauaugcacagugcauccuucagggaaagaaagaaagcgucucaaaugagccugugucuucucaguuguacccacacuaaagaccccaugauaagauggcauuuaccuacaagaacaaguucuuucuucaguggcuucaggaaccuugccuugggaaggccucugguguguucaguuauguagugaacaugagaugccucacugcuauuuuuuguugggaaguauugauuuaauaccuguauuugggucaaaauuuccuaaagguuugaugugacuugguuucaaagcauaucgagacagaucccugcuugcaguucuccaauguacuuuucagaugggugugauggaggggacccuuaaaaacucugguuuucuucuuuuguuuuuuuaagacuuuauuuaguugagagcaguuuuaaguucacguccaauuuugagaaaagaguagagacuuuuucccagaggcucuugcugcccucugucagccucgccuggcacagugguccacggaaugaagcuauauugcugacuagucaucacccagagcccaugcuuggcaugaaggcucauuuugguuuggacagagucaccauccugaaaauccucugugccugcuuauucauccucccuccacccaccugcugggacucauggacccucuuacacugcaucuguagacucuuaagaguaucauguagcagauggaauguggcccucuugcucuguaggcucccuucucugggguaauuguauugauguuuccucuaggucuuccagggcuugauaauguguuucuuuuuacugguggaugguagucuguuaucugcauuaucacaguguauauuggcuuaccauuuucacacuaaaagucaucugaauuacucaugaaguuuaauaguuaucaauaauuugcuaaaaacaagccuguaaacauccacauguggaauuuuauguggacauguuuaacuccuuuggcaaggaucagaaagcauacuugaucaguccuguggcaguguauauguguuugcuuaugugugccauauuugccucauauguacaaagcuacuacaagugaacaaaauuaaaucuaagaaaucuuuggguauaauaauaauaauaauaauaauaauaauaauaaugguuauuauuauuacuaauuuguugaaguauauucagcucuuuaucuguuuuuauucauuuauuucaaggucuuaccauguagccuaagcuggccuaaaauucaccaucuuacuaccucaaaugcauggauugcaggcaugagcuacccccggccacacuuguagguuguaaacugacaacuuauaauuauagaaaguuauuuggaacaaaauaauauucuggcuagugaguauaauauguacagccuaugauaacaauuggcaugcugugacuucagguacuugguguuguuuguggugggagcguuucauuuuuauucugaguucuuuugaaaugaacagcagucuauacucaacgcugugcaguagaaugcuaaagaaaguccuuauugcugguucaugaccccgugcucuucacggauacuucccuggucuuuccacacccagccucugugaccccauuccuuacacacccaucucugugauccccauuccucacacacccagccucugugaccccccauuccucacacacccagccucugugucccccauuccucacacacccagccuccgugacccccauuccucauauacccagccucugugacccccacuccucacacacacagccucugugacccccauuccucacacacccagccucugugucccccauuccucacacacccagccuccguaacccccccuauucuuuacacacccagccuccgugacccccauuccucacacccagccuccguuacccccauuccucauauacccagccucugugucccccauuccucacacacccagccuccgugacccccauuccucauauacccagccucugugucccccauuccucacacacccagccuccguaaccccccccuauucuuuacacacccagccucugugucccccauuccucacacacccagccuccgugacccccauuccucauauacccagccucugugucccccauuccucacacacccagccuccguacccccccuauucuuuacacacccagccucugugucccccauuccucacacacccagccuccgugacccccauuccucauauacccagccucugugucccccauuccucacacacccagccuccgugacccccauuccucauauacccggccucugugucccccauuccucacacacccagccuccguaaccccccuauucuuuacacacccagccucugugacccccauuccucacacacccagccucugugacccccuauucuuuacacacccagccucugugaccccccccacccccauuccucauacacccagcaucuaaccuggagcucccagauucguguuccugggacucagguucugccuggugcuggcaucugaacuccuucucuucggcuugugcagugagcacuuacugacugagucauuccugccuuggcucucggcuucucuuuuuucuuuuuuuuuccaacagugccucucucaagccuuacaguacugauccuccugccucaguucugggauuauagaugugcacuacaguacccagcucuagguaucguagguguuuguaguuuuguuccacuauggggugauuaguguuuaugucuaccuaacggcacugucaguagacagguaggugaagagcggaguugcucuugacgguuuauguccucuaaguauuaucuggugccuucacauauuuuaguaauugcagccuuuucucuucuuagauuguaugauuuagauucuuuucaauccccauugugauuuuguuuuugcuguuuauuuuuuuaaaguaugggccaaguguggugucauacaccuuugauccaagcacucaggaggcaggaacaggaggaucucugcaauuucagggcaggccucgucugcccaagauuugcaggacaccuagugcuauauagugagacucggccucaaagcaaacaaacaaaaaauuacagauuauuuuauuacugaguagguuucuuaccuuuuguucaaauuauccagaaaauaagaagcucugugcccauacuggacagaacucuagaaauauuuuagcaagguggaauaaauuggaaagaaugcaaaauacuuaaacaucuugaaaaaccuccuaaauaaaggcuacaacaggcaauugcuuucuaauucucuuaucugagauacugagaugggcaaagucauaguaagaaaagagaauauaguagauguggcugggagggcugagcagugacugucacuggaagcagagcccguaugagagugagggucuaaaacagggccguggagacacugcccacacagaagaaagaugguacauuuuguuauuugguuuaucacuacccuuuaaagugguaagguaaaggaaucucauuguaacacaaguaaccaauguuucauuuggugacuucauaguuaagcccugacugagcauggucucccucacauaagcauguccuugcaaaggccagcccugugaucugaagggagaaagacuggaucaauuucuauaacugagaagcauguagcaugcuaacccaaauaucauuaaaaauugucugucagaauuuccuagaaguauucuugauuuuuagaaacugauucaaagaaguaaucauugcuuucuccaguuauguuuuaugaagcuuuguugaccuauauacggguuaugggguaggagggggggagggggauuagaaagauuagucagcugccacuccuaaaaauaccaguugauuuugucuucuuaaucacauaacuguaaccuucugucugcucagaguggacugacuccauggagaaugcugaagaaugcauuuuucauuuuuauuacaauugagcauaaaccagacaaguaugcuuaccuguguucuggaauucccuaaaucucuagcacauuuuaacaccugaaaaacuccagaaucaucauccaguaauaugucuugugauuguugauuuaacacaaaguuauaaacuuucaauuauuuuauacaccuuauuuuacugcaaaaaguuauuuuagauuaagauauaagauagugaaagaucaugguugacuaaagggaacagauaaaagagaacaguagauaacaucagaucuguugauuguauucggccaaacucaaguacagagacacacauagugauguauuuuaaguuaaggaagacuaacaguaucaauaaaccauuuaucaauaaaccauucccauguaacagacaguccccagguaacagacaauccacacguaacagacaguuaccaugccuggcuuucuggacaggaaauuuacaagguucugggcuuugguugggauuuccagaaacaucuacugccaucaugguccuuaauggcacacacagccugacacaggguuaaggggugaugaguucugcuagucuccucagggaggaaagcuuugaagagaucagcaggagacuuuacguaagcagaaguuaagaaauaguaauagaauuuuacaaauuaugcuccguuagccuggguuuaacuauaucaccgaguuauuauaggaagggcauuucuuacauuaacugggucauuguaaaaaaauaaauuuuuaaauguaguuuuugacugaauggaaaauacgaauauuguugaaucuagaugucaaacuuuaauuaacaacucucauauuauuauaagcuucccaugggagcuuuaaaauuacuuuugauauucaucaaaagcacuuaacuuuucauguuucuuauaguuacauauaauuuauuuuugaauaaacucaacacguauaagaauauuaacuuuuauggucucauauggagaguauaacuuuaaacccuuuugcuucuuguaaugauuuccacaaaugaucagucauuccacauucagugcagugacuuguccacagugcagcagcagggcccuggaguuuagguuagggacuggucagugggcuuugugcuguauuccuauguaauccauguucauaaaaccauggccuugagccgugggcauuagaggguucugauugcugugucugguuuauggagugacucuccuguuuacagauggggaugcugcucccacacagaagggagccuccuuguguaagguggcucuggcgugugugugugugugugugugugugugugugugugugugugucuuuguguugagaacugaacucugagccauaaacaaacaaagcaagcacucuaccacuacccuguaaccccagaucucaguuguuuugcuuuugagauaagguccuuaugagugcuugggcugauguugaauucacucuguuucccaggcaggacuugacugccacucaucauccuguuccugccucccauagagguggggcuaccacaccaugccuaccuacauaauucauuaauaacauaguuuuaagaguuacuacauauuacacuugaagcuccuuagcuaggugacaacugauuuuuuuuuuuuuuaaaugucaacaaguagagcaaugcucaguggcuuuagucucaaacaagagcugaaaaacuuggagguggggugugguagcugagcauggauuuagcaucuggaaggccguggcuaauccacagaacuagaggagaaguaggggguggcgagggcaagggaagaggaggauugcaaaugucuucucacaagcucggccuuccuuuuagaaauccccauuagugcuucagaguuaacaguaagcuaagcuggccacuuucugugcgggugcauaauguacauuugcuuuauguauuuuauuucaguggucccuaaaggcaccccagucagaccucuaaagguaccccaaugauaauaauggggagaaugccuagaauccuuuagccaccauguuguagcaggauuuuuucaauguuuuaaucuacuggaguugggaaccaaggcuuuaacuacguggccuuuauuuaauggacacauccuucuucaucuuugucccagaugccuagaggaggaaaagaaaaugucaccaaauaaccacuaaugcucucauccauagcuaacuugcacacacccugaugaccaugguuuagcacaagucuguuuuaauaagaguggcaugcagugcagugccauuuaucccauauagucacagaagcagugugcccugauaggaaaugcaaaucuguaacggauagcgaggggaggcuuccugagccugcccaccuccagccccaccccugaucccuagagguggccuuggaaccuuccuggguugguuccucugaucucacuacuucuugugacuucucagaaagauuuauuauaccuguaagcuuaaauuuaucagcuggcuaucauggugucugaccucucacuacaaaaucugcagggguccuuuauuccuuucugaacuucucuccuuccaguuugacuucugccuugagcucucuggcauucuguugcuaaugaucucuuguguggggcugggguuugggguaguagaagagauugagauaagguuucacuaaguagcccaagccuacuacuugccacgagucuccuaccaugaugcccacuugcuguguugcuucuuggaccauuuuauaagcuaguuuuauuauuauuauaaacuaaaaaagcuguuuauauuauuauaguacaguacaugcacauucauguuaaaauaacauaaauuacgcacacauguagugcaugacuauacaugaguaggucuguaaaauucuaagauaaaacucugugguuugaaggaaucuucuggccgucuaaagugccucugauuucuuucuggccguuuucauuuccucuugauugcugcgauuccuuauuuuucuuaaguacuauuuuuucuucccuugucugucucaaguacuuucucgucuaggcaucagaguggcuaguauucugaggucuagaaugucuuaaauagccugcuuugucuucauauucuuuuuguaaguuuagauaaaauaaauguccagauuuuaaaucucaaggcuuuuuccugcucuuccaacauggcuuccauuauagaugaaauuugggucauaaucuuaagucuccucccuuuguucccaaugagaguuuucuuugaaauaguuaguauuucuuaaaauccugcuauaaaacuagaccaaaauguaaucuaaccauaaugcucagugucuugccuuagcaggcuucugucaccuucuggcuuaguccacugugucugucuccugugcuugucuacagccguggacauuuguguguccuuuccagucccuggcuugucugucuacaccgucagagcuuucucuggcugcaccucccagguuaaucaucauagcuguccucggcaucugauugcuuaacugaucaugcuuuuguuuuuagcuugcagggcuuccuuguuuucuuuugucuuuuuuccuauggugucugucagcccuuuuccuuccuagucuauuucucuucaauguagacucaacccaugaaagucucacuguuucccaguaauagcauaggcuaguggucaagcccucagcagguggacuauggggacuuguaaaguccacguugugacuguuaucauugucagacugagggaaguaucagcauauggacagaaaacguggcugcacuguggcugacgaagcagcguuucaggagaugcuuucuguucagugacuuuaagauggauagaaucggcagcacuugggagcuguguccaccuguaggccucgucucagucuccugugcagguggcuccagcaugcugcccgagacucagagugaccaugaaucucugcagaauguccgagugcugcaggccagguguggcgagagccugguguggaacucuggaagcagaacuaaguugauaagagcguuucccagaggagcaguuagccuucugagaagccaacugugagcuaaaagccugaccucuagauugugcaguuaguuacaugaccuuacucuguaaccuaguugcuccuuuucaccuucccuggcucccuuuauacugaauaaaugucuucacaaaugaaugugacauagaaccuacuguaaccuguguucuggaagaaauuucaggaacuacgguuccaugaguuaagaaauacccaugguagagccuucuaugagacaugcgcaguacguagguuauauuccaggcuccaggagauuucuuucaagggauagccuugagacuuuuggacucugcaauguaggagcuguguuuacaugggaaccucuugugagcugcugaccaaggucacuaaaugccuguaaguuaauucuaggaacaauaaauugugugaaaauaaauuauuuuauauauaguaauuuacuuuuuaauuacccugggguuuucauaugaaaugcuggaaaaccucucuacuguacaaguccuacugcuaauagauauuuaaacguagcaacacagagaaguauugauuuguccugggaacaccaagaugucaguuuggaauuugaagucgaacuguccauuacucuauuauucauuuuuuauauccaacacauguuuauuuaauagaauuucaauuauugcacacacacauuaaauucauaaaacaauauuuggccuccuaggaagacaacuugggaaucaaguguuuucaucuugcuuguaggaugggugcugcagacaauauauacaaaggccggaguacuuucauggaagaacugacggacacagcggaaauaaucaggagagcguccccacaguccuugguuauccuggaugagcuggggagagggacaagcacccaugacggaaucgccaucgccuaugcaacucuagaguauuuuaucagagacguaagcauccaucacagcuuuacaguuucacuaacuaauauuguuugaagcuagcauauuauaauagcauacauuuaaauaggagaugauuaacaagucuguuaucuuuuguggagagacaugaacucuggucucaugguuauuguauaacuauaguuguaaagccuucauguaaugccugcaugcccccuuccccuucuguauguguguaugugcaaggagugugcauguguguaugugugcaugugcaagaaauaugcacguguguaugugugcaugugcaaggaaugugcauguguguaugugugcaugugcaaggaaugugcaugaguguggaaguguauguggauagugagccccauggagucuccggggaaagagacuacaaacucacagcaccacacccagcuuuuuacauguguggcaagcacuucacuaccuuugucaaugaacuaaauagccagaggagcuccggguuuuguccagacauuuauuaggaugacaugauaaugauaacaugcaccuuccccguaaaacacuuuccuuuuuuuuuuuaauccuaauuugaaaagcuacaucucacuacauaugguaaagguuugguaaaguccccuuuuaccaccaacacauuuuaacagcugcuugaccuccaggaggaaguuacagcagaaugaguuugccagcccugaagucuaguucauaauuucugcugugcucuacuguguccguggugugacuguuagugaaugaaugucacugcucaccgggauuccgucauagcaacucuggguguuguucaauuccaucuuugcuagcugugacaagcgugucagugggaguagcugucaucugaaggugggacaagggcuacaggacucccugcuaaugucgcucacacagaagcuggaaagcuuggugcuggcacuuagcugggccuucugcucucuuuucugggucucuugggcaucuguaauaaaacgaagccaggcuuccucaaaggaaagcaguucagagacccagagagaacaggaaugcuaucccucacaucaugguugcacacuguugcugcagccugucccuuccaccgucuagcaggcucagcauucuguugagucucuagaucaaguugggaagaaccaccguugacagcagugacacuuccuaagccuagcauggccaggcuucucuguacuuagcugaucuuugaugccuuuucucagaaacacaaaguuuuuguucaguguguuuuuaauuuuuuuaaaauuuuuuauauauuuuaugugaguacacuguagcugucuucagaagcaccagaagagggcaucggaucccauuacagauggcugugagccuccaugugguugcugggaauugaacucagcaccucuggaagagcagucaguucuauauuuuuguugugguuuugcccacguauuuaacuugaauggugccuguauagaugaaacuuaguuuuuguuuuguuuacuaaauuucaaauuccucuuuuuaauuucugguaauaagaaagcaguuaaauuuguguguuaaucacaguguuaaugucauaaaggacaaagaagaggggggaaaaagcauuuuugauacuuaagaagacauaugagucauacucuguuaguaaguuucuuauuuauaggaauuuuauucugguuauauaggugauguuaucugcagcuaauugucaaaugauuaugacugaggcuguggcucaguggcagagcccuugcccacugugcgaaagcccuggguucaguugucaguacugcgggagggagaggugauucaggaaacaugucugugcuugcgugcuuaugggugugagcgugcaugcgcaugcaugugugucuguuugcccaucugccuuuauaggcuagagaaagggaaggaacgugucaagauauuaauuuguugucuaagccaagaguauaugguaguuuuuguucuuguagcuuuuauaaagauuugaaauuuuaaucaaaacaacacuauaugucuuacuguuuuaggugaaauccuuaacacuguucguuacccacuauccaccagucugugaacuagaaaaauguuacccagaacaaguggggaauuaccacaugggauucuuggucaaugaagaugaaagcaagcaggacucagguaagagagcccuugcauagcacaggcaaauaguccugccuuucaguuugcuaacucaaggcuuauaggaguuugagcuuauugcuuauuaagaauauaagcugugaguguccauuauaaagaacauuugucaguauucauuugcuuuaaguuuugaguugcauagaguguacaucuauauguuugcaaacucaguccuucccuguuuaaaaagcaacccuuguuccagaaggagggguuccucuuaguccccacaguuuuccuugguuuuuauccuaggauaacauagccaagugcagaggaucuuuagucaucuuuaaaguguucaccaccuccccagugucacuuuacaccgauuacuuaccaccagccauaucccguaguggggaugcguggaucucagagagguaaaguggcuugcccaugccuggcccagucuccuucuagguccuguuuucccagcuuucccaguacugcugccaucagaggaugacguguuuguuucucugagaaagaacggcauuagccaacaggaaugaauucaaguaccauaaguagccuaguaagcuguagacuaucccugcucgguaguaguuuuuuuaagcuaccagccugugguaguuugcacaguugguaugcuguaauggaaaauccauuuuccaaggcacuccagagaccaaauuuaauuuaaaaaaaaaaaaaaaaaaaacuaaggacagaacuuagaaagaaaccaggcagauggcccaaauaaaacaaaggauuggaccuaagauaagugcacugcuaggcacucacugcuucuccugggcccugagaagcgccucauaaauucucucaugaaguuuugcuucuuauuaaucugcauccagugugacagaaaauggcuugcaaguaaaacccacggguaaacaauguagaguucugcagcagguagggccuaaggcagugcuacuaagagcuuacagccccuucccccaucacauuccucccccacccccacccacuccuaccccccugccagccuacagcagaaucccauccucuagagugucuggccuuuuauuauauugauuuaaacuuucuccaugaacauaacucuuagggagacuaggccuuccucccucugccucucccaugcuucugagugaugugcaccguucccaccucuggagccacaggucagcuuaucagugaucucguuguguuaguugggaccucaguccucucuccccuuuguccucauucaccuuguugucccuuuagguaugugcauuuuagcagugacagcaagcacccacuccucagaugagcaauaacuacuacuggguucuaagaaccaagacugccuaguuuuuauuuuugcauucuuucguuugcuuugagucuguagcggaauccuccuuugccuccugauagcuuugaaaacagcaucuguacggaaugccagcauaacugaaccuguuagugccccuggagucccuccugcugcaccccuugguggcucuucucuugugagcuggccgcugugcgagccugcugcacaccugcaguccucaggccgccuuugugguccccuagagagucucuuacuuucucuucuaaguguuugaguuccaguaguagcuugaucacagugggguuaugcaggcuggcaucucagcacaguccccagcucccccucuuugugauuguccuuguucugucuuccugcuuugcuugcuccagccacaggucagugggcagacaguuaucucuuugagauacuacauagcagacucccagcuagaacaggggcuagcgcugucugaggcuuucguuauucuacuuguggcccuggguguugagcucagacucugguucaugugagcaugcacucucccacugagcaauaucuuguuucuuucuguaacccucuuaggagcaaggggccuuuuccccaggcgccuucuagcagcuuaggaucauuccagucucauuuucggaacagaguugcaucuaaaugagaauggcagaaaugacuuugucucagaaucaggacucacuuuuggagcuagaugugaggaauuguucugauuaaguggacagcuguuaauuccucauaauacaaaagucuuauuagauguggaauggauuuuggguaggccauuacuaauaucagugaaacaaaguaaauguucaagguccauguuucaaggagugcgugguugccaaagcaauggaucagcagccagaaaacaaacuggaaaaucuuagacaaaaguggguaaugcaaggaaugccucuacccugguucuuaggaggugaaggcaugaagagcauuucaagauguuucuuagcuaccuggccaguucaaggccaguguaggcuacaugagacccuaucaaggggguaaaccagacuugucaucugauuuuuaauccaucucuaagcaucuauaaaucuauaaaaacgaacaaacgaaaaacccagcaacaaccucagagagaacuugaucggggcuggugagagaacguaguggaguaggacacuugcccagccugauucugagcucagucccugagacugacuuccaaaaguuguccucugaccaccacgcagucucugugccacgcaugcaaugucccccgcagcaaaaucaaaaaguauaaaagauuuggaaauuguuugaucagauuucuuuaauaacauucuugagaaauuuggccuuaaaaaauauuuugcuaauuuucuuuauaauagaaacuugaauuauuauauucauagacuaacagugauuagcuuuuaaaauauccccuaagaaagggguguagcuuguaagaugagaacugacuagugagaaugugggacacugggugguguuuacucaucuccucccacuuguauccucuggccuccauauuuuugucaucacauacacaagugcauauaguccaccaagaagguguaggcuugagacaaaauguaacuagagaaagagaccccuagguagcuguggagagugaccauguucuuucccuuaaagucaugaaaacaaucaacgcugaaguagagaccagcauuugguguuagacucccacucuauacaaacaugauaaugauguggucaagguugaggguaguauaauauauuauucaauuaaacuauaggucauagcuauaguaugcuuuaaagacauuguagaaaaugugcacaaagaagauauggucuauagucccagcuccugaagaggccaagguacaggaucccuugagccaaaaguuuguggugaccuggguaacacagugaagccuguccugaaaacagagacuuaagaaccauuguuacagcuaucucuauuguuuauauauagcauauauauauauauauguguguguguguguguguguguguguaucucaaaauaugguacaaauuauauguaaagggaaaaauaacaagucuuggaaaaugugucagcacauccauuucugaggaaggcgcuuugcuccuuacaggcuggcaguguaugcuggccaccagcgugcuuggacagagggguugaacagaugggugcacgaacagaugaaugaguguugccuugcuuaagaaagaccagcauggaagcuagauuagccuggaaugagccaggacuauuuuagucuuaagaugagagguuugcauuuuugacggcuacggguguucgaguucuucugcucgugcgcacggaagaguagcaaaaagccauuaggguucacugacucccuacucccucagcugugcuccccuacuccagccauuaggguucacugacucccuagucccucagcugugcuccccuauuccagccauuaggguucacugucucccuacucccucagcugugcuccccuacuccagccauuaggguucacugacucccuacucccucagcugugcuccccuacuccagccauuaggguucacugacucccuacucccucagcugugcuccccuacuccagccauuaggguucacugacucccuacucccccagcugugcucccccacuccucaccuguucuuugugcuccugcucucauguggagguaagagguauucucagugcuugguauagaugccugagucuaggcuauucucaccuccuacuucuugcaaauacaccgagaaagcuauuaucuuagucugcuucugaguucuuagaggagguaaauuccauuguccccuuccacugcuguguucacaugucuuggcguuuaucaguggcuguuaucaaagcauacacaggugacaaauaagaaaauaagggagggaagcccuuggugaaucuacagcuugugugagggucccagaaacugccucggagcuggcuccucugcaaccagaugugaugcaguauuuuuguuuuagagcuucaugguccuguggugcuuuagguuugaaaaauggacuuguauguagcucuaucugugcacgguaccugaggauuuccuaguucuuaaaaguuucaaauuuguuggugugugugugugugugugugugugugugugagagagagagagagagagagagaaccucuagggccuuugccuggaaggcaggcaguuccuggcucggcuucccaaccgcucucauggcuuuguucaacccccaggguauagcaccaacuugguguugacaagccacagaccuuacagaccuucccugacuguugaugagcgacaggucucaacaugagccuuuuuacagggcagcccacaacaugacagcuugcuuucuugggagcaagaaagaauguaaggauacccaagguuccguuguuuuucuggucuguucuuuacagugucauauuuuguccauuagaagugagucacuggguccaucucauacucaaagggaggaaauggccuuccuaacagauguggaaauaaacucuucaucccaaguggcccuugaguagcccuguccccuucggugugcacaccuccucuaaccagaauuucccugcuacuugagcugugggacacauaaugguuccuucccuguuuagaagaacaccuaaaccguucucuuuuaaugcagaaguucagguuuuacaguuguugacuauucaagacuaugcuaggugagccaagccuccuguaagcaaaacauuuucaaaacuuucuuaaaucaauaaaaucaauaaaaccagcuacagguggagagaaaaguauguuuagaccauuccccugaacagaggccgugcgggagcucauaucuuccuuccuuauccccugggcucgccuuucaggcaucguuugaucgcgguuucuccccucuuuauuucauaggugacauggagcagaugccggauucugucacuuuucucuaucagauaacccgaggaauugcagcgagaaguuauggacuuaauguggcgaaguuagcagauguaccuagagaagucuuacagaaagccgcgcacaagucuaaggagcuggaaggcuuagucagccugagaaggucaggauguguccauuuuguucuucgcucugguuccuagggaagcuuacaagcugucuggaaagagggggaggacuguaaaugagcacccagugccucuggagugcagcuucugugugcuuucuuacggccagaggagagccgcuuggggcaggcgcagaugaauucagucuuuguuugugccaggucuucauuagguggcaaaccaucuuuuuggucuuuuuuuuccccccccuaaagaauuaacuccaugugcaccaacacuuuugcugcuggagaaccacaguuaaagguuacugagcucaauaucagaacucagggccugcacagagcuucucuuacacacugccucaaaagugggaaauagcuuucagaauuaagaacucugucagggucagggaccaauaaaaacugccuccguggguaaaggagauuaucagcagaccugacggauccugggauccacaugguggaaagagaaccagcucucauggguuguccucuguguacacugugacauguccccucccccagauaaauauauuaaugacaaaaagaauuccaaaagccuuauagaacucugucaggacauggggcuacagacauggcucagcaguuaagguugcuuguugcucuuccaggggacccaaguucaguccccagcaccuacacagacauggugcacauaaacuaaugcagacauagguucauacacauaaauaaaaugaauuaauuaaccuuggggaaaagaugacuucuuucaggauaugaacaaaacccuauauggcuauacauggugaguagccaugcucucccguuacccacucaucccguauuuccgaguugggugugacgguuauaauuggguugcuuucugcauucucgcuguccucuccucaccuccaccauuucugagacugcuuuucccccuugccagcuagucaguauguagucagcucaugagccagccuuagucuacuccuggaaugcaccuaaagggaggugccaccaggaaagcauccugugaacaagcaauacauuauggccuuucuugaacaaccaggaaguagccugaguucccucaaggaacuguuagaaccaccugaccauaaauaaaccaagaaaacguuuuaaucuaauuggaaguuacagcuggauuaccaguaguuccugaacucccuaaggauaauacuuaguucugagaaucauuuccaaguuucaguauuaaaauauugcugagcaugguggcauacaccuuuaaucccagcacucaagaagcagagcaggcagauuacugugaguucgaggccagccagaacuacauagugagacccugucuugaaacaaccaaccaaacaaacaaccaaacaaacaaauguuaauauuuaugaggcuggagagaugauuuggucauuucccaguacccacaggugacucacaacugucuauaacuccaguuccaggaaaucugaucaacaucagauucuguccucugagggcagcugagugcguguugugcacauguuaggcacacacacaaacacuugaaaucaaaguuucauguuacucucuguaacaugaaaaaugaagaagcagcugcagcuugagugcuguguagagagcaugcacuucucugccucaguuuccuuccauagcagcuguguuccagugccagcugugggugguggcgugcagagacugaccaaguccccagcaccagaguaccacaugauggcagcuuccugugucagcacugucacaccaggggcaaggcaguguaaucaacuucaggcuacuucuguuacaagacaaauuaacauaaaacauuuccuggaagauuaccaaugggagcucaaaaucuaaaccuuaaccuucugcagacuccaaagacgcagguagucuaacaaacugccgccuccgaggguuccgcugccugugagggggcaccugcuuaauccagcacucuggaggcagaggcagggggaucucugugaguuagaggcugaucuagucuacagccagggcuauauagugaaacucugucucaaaaaaacacaaaacaaacaaacaaaacaaagccaagcugguaauaaaacaguucaugcuuguuacuaccauagccucagaagcuaaagucagaaaauuggaacacucagauuauuauagacauucauuuuuccaccuaaaaugugacauuuuaaagucuucagaguuuucuugauaaggugggauauuacauuaagauggaauauuucugaucugcagaggugguucagugguuaagagcacugccugcucuuucagaggacccagauucuaguuccaacaccuacauggcagcucuuaacuaucuguaacuccaguuccaagggaucugacucucucucucuuguggccuuggugggcaccaaucaugcacaugguacguaaacauacaugccaggaagcacucauacacauaaaauccccaaaaguuuuuugaagauggaauauuccaugcuuuaucaggacccuguaccuauuuucccuauugauuaaaaguguuuuucacaucaguucucuuggucagauaaaagaaagcaaacuauuucuuguacgguaugugugaguaugcuauaaugguaguuaagaacuaauuacacgcucaucacauacagaaaggauuacauacagucaccuguagcuuccuggacacacacagggacaucagcugccuuuggcagaguuaagaagucaugugcccucccugcaggcaccauuuuagaaggcggcaggaagacagucaugguaaucaauaacugggucuuuuaaugcagcuguacccccugcguggaggacaccgccacagcuuccuggucacagagccugugcugucccaucaaucucuuuuccaaaauaacuaauaauuucuuauuuucuccaggaaaaggcuugaauguuuuaccgacuuauggacgacacacagugugaaggaccugcacacaugggcagauaagcuggaaauggaggaaauacagacuucucucccacauuaaaaugaaaacugcauuuuuggaguaaaauacagagaacugaagauucaaacuguacaaaacaacucuguggcaacagccgucucuguggucuuccuuuugagauggcuucugcucugugaagggagcuuuucaggcucuuguccuccugcuuucagaagaaaaagacaauggaguguaaaggccucaauuuuccuaggcaguacauuucauaccaaagcggguucuucuaaguaaaaccuaaaacggagguucuuggugccuacauuaucagaggggcagugccuauuuagguucagacaauugacaacaggcuaaucugacaggaaccuacuuuugugagaacuaaagaacuuuauaaugccaggguuugcucaccaaacacauaaacguuuuuaugagaaggagaaucgcgaagcuucuagaagccagagcacaggaaggaaaggccacaugaagugugaagggcuaaaugucgucaucuuuuuaacagcuugaagguugguguauaaaauuauuuugucauuuacuuaaauaaaaauauggaaugaauacuugcucauugcau

SEQ ID NO: 7153 - RNA, 34407 nt, Mus musculus
uagguggacgcuaggggcgccgcggagccguacuuuaccuucucugcuggcuccguggaggacgcgcuggaucuuaggcuucccgcagaccugaagaaccggcuuagaaccguuugccuccccgggccugggccggcggcaguagagccucccgacgcggauuucccgcggggcauugcagugugcagaagagccggccugcuaggagcgcgagcgcgcggccgcacuuucucgcgccugcgcgcgcgcacgccucaaccugugcgggaccggccuugggggcggagccuuagcuacacaaauagaaugcgcggcgggccuuggugggggcggggccuuagcugcacaaauaggaugcgcggcgggccuugguaggggcggagccuuagcugcacaaauaggaugcgcggcgggccuuggugggggcggggccuaagcugcgcaagugguacacagcucagggcugcgauuucgcgccaaacuugacggcaauccuagcgugaaggcugguaggauuuuauccccgcugccaucaugguucgaccauugaacugcaucgucgccgugucccaaaauauggggauuggcaagaacggagaccuacccuggccuccgcucagguauuggccgggcugggcucgggaaacugaggcgguucacugaguagggucaugcacuuggcuuggacgcgcgggacgggcgugagcgguaggccuaccggccucagccagagaccaagcuaccgguucccgcggugaucccccugcugugccagccuuugcucacaggcucccuggccgggagcaaaguccuguccuugagcgggcagcaacaccaccccccacacccacaccggacuugcaccuuucgucgcugaauggagccugagcauacaugacggguuaacuguuucucuaacuuucaggaacgaguucaaguacuuccaaagaaugaccacaaccucuucaguggaagguaauguagaguaauuaagucaugagaauuauguuugcuugaagcaagauuuacaugguagagguaugaguagaaagucuccccugggaaucugggaucucuguuucuugcuagaaauuuuugugcgauucccagauuuuauuaaacauccucuuagaauacucuauguuugaaauuuuguuagcaagugcauauagcucgaauauaacugggcagaaucggcagcaaaauuuagcacuuugaauagagaccugagccgguauuuagaauuguuacugaaagacagaagacuugaguaaauggagaaaaaugcaggggagaagaggcuaaaaauaauuuaaaucuguuggcuuuaggaagacacggugggaugaaggcuguggucuucagugaggcagucugggugacugacuuuaaaagaauggggaguggugugcaauaauuauaaggcaguuucccauuacuugugauuguaaggacauucgcuguaauucuuccuaacagacauguuugcuuauugcuuaucauuguaggagaggagggcagagcugaugggaaaaagaagucagcaguguagauguugaacauuaguagagaacauaguaggucacuguguagacagguugacaaaugccaucuugggggcguggcacaaaacaugcacacaagccaccuauucauguucucuacugaguagccuggcguugggauuaaugagucugauggccagcugugcugcucuuucuacgaugacuccucaguucuuagagggcacacugugagcaaucucagcacagcaagauuuguuacacaucagcugcaccuccagcuccuugccauuguggaccagaaaguucuagagccgcuaggcagcaugugcuuggcuuucuuguuguuccuguaaccaauguuggucaucaggaucuggcccuugaaucuucucuguaccccgcugucagugccucuggguuuccaguuucccuuaauuuucacguaucagucugacuggugucugaugaacuucuugguccucuuuuugaugaucuugggcuucaccagaggccggcgaacagccaugaugcagcaaaacagauggcagccaccuuguaggcagugccaaagaagagcugcagaugccaucuuaacacagucuacucugaguucaaauccuacuacccgaauaaaaagcuggacacaguggcacauuuguaauaccagcauuagggaggcacagacagaaagaucucuggggcuugcucuguagccaauuugugggcuccagguucagugagaaaacuugucucaagaagauagauaaagacacccagucacacugccuggccugugcauauggguuacacaaaaauauaaaagcuuuauauuuuuacccaguuuauguugguuguauccauuuaccuucucacucccccugaguccccuucuccuucccuaagucauguucuacuuguuauuaauaacccuguguguggccauugacuaggaugugagcaaucuacaaucaguccagaccagaagaugggcucuccaucucccagcagccaucaacaccaauaccuacuggaggggccucaggaacccuccuccauacuugaauuuugccuggcuugaucuugugcaggagccagaugagaacugaugcauacauaugugagcccugucguggccgaaagucagccuuucacagcucucuuccccuucuaccaacucuuacauguuuucugccccugucuucugcaaaggucccugaccucugaauauagauagguagagaugaucuuaaauauacauagagauagguauuauuucucugggauagaugaaucagagacaaguaguuuaagauggugaacacauucaaucucaagaauuccaggauuagaaccuguucuccacuuuagacacuaauaaagcauguaaggauaucaagugaauuacaaaauccagucaaccugagcccuguggacugaaauuaugcaugguugcaauggauuaaaaccuaaguaaaagauaugaacugcaugagccaaacugaaaaauugaacuauauuuaguuaaugagaacuaaaucugaauuuuagguaaagcuguuugucuuaauuuuucuaaaggaugcccacuagaugucacuaugacaaucgucuugccuauguaugucacugacaauauauguguauuuucugauaaucuuuucugcuugguauuauagguaaacagaaucuggugauuauggguaggaaaaccugguucuccauuccugagaagaaucgaccuuuaaaggacagaauuaauauaguucucaguagagaacucaaguaaguguuauaacaugagcucauuacaagaaaagugaucuguuucccagggcacaaaucaguacauaacaggauaaggcagaaugaacaccugugugugugugugcgugugugugugcgugcacgaguauguaggcagguacgcaugcauguauccaugcaaacaaaccugaauguugcucuucuguguccuuccugagggucuguccaccuuguuuuguugagauggggucucucgcuggggucuguauucaccuauuagucuggguuaacugaccaguaaguaagauccaggaauccugucucugcugauccacagagagaauuaugggugcauaacaccaagccagucaucguuuuugaaccaggugcuggggaucaaacuuggguccucauacuugcacaacagauacuuuacaguguuauccucccagugccuuauaaaugacucacucacuguccaaaccaguugguacugucagaacuuacccaacauacuuaagagacuuagacgcuaucaucugcuuaagccacugaaccacacuaccuacuacaacaauagaaacugaguggccacuuacacuauggggcaacuuaauucuguuccuuuaagugcuugauuuuaucaccuuaagaauuagaaaaaaauauggaaacaguucugcagguuccuuuaaaccauuuuucuauagaccuagcucucaguuauaagauuuauaacugguuucucguuucacaaucuaaaagugccuauguuuuuaguuucagcgaauugaaguggcuaucccauuuuuggaaucaauucuagacacaguaaaauaugaaggacuugcagagacuggucauggucauguacucuauugucucuaguuaguuacaauacccagauacuguguguucuuuguacagugucagaggugaaguaguucaguguauuaaaauggcccaggaaucuucaggagaaagagugucugcaguugguuucugccaagacauuucauuuccuccaaaguaacauuugacuagaugauuccuucucugugacuggaaauguccuaagaaccugaggugguugggcugaagaaauagcucagcaguuuaagaacacuagcugcucuucuagaggaucugaguuggauugccaacacccauguggcagcucacaacuggcucuaacuccaauccuagaugguacagugccuucuucuggcuuccaaggcuccaugcuuucaugcacauggugcacagacacucauguaaguguuauagacaaacacacaaaagguuaaugaaacuaacuuuuuuuuaaaagggacuggaggugguaggguacguaaauaagauuagcuagaagucaaaucugguccuuugaccuugaccaugacuuugaaauuguuguugcuacuagucuuuacuuaauaaaauaacuuccuggaucucaaaggaguuuuaguuuggauuuuuuugaucagcagaugacaacaaucuaagggaaaguuaggacucaggauauugacuauucuuccuuaacuuaauccguagucaucagcaaugaugcaccauguuagaggaccaggcacugcuuguuugaacugcagucaagaaugucacucccacguguuuuauucaggacccacccagagaagcacccagagaagcuauaguuauauaagagcuucauuguaggggguuggcuuucacgaaugggaggugcaguuacaugaauccaaaacuguggagagcacacaucagggagagcaagcuagaacuuuccaggggugcucuggucacucugggaagucugagcucuacccugaaggccuuucggugguuuaaaccaaaguccucauagaugucaccacaucugcaagacaagcaucggaaugagaaguuagagcagcccugggaggaagagaaagcucuccccauagcugcaugcuaagagauucuuauguaggguuccucccacaugccuccuacaauggcauagguuaaaaauuagaagaaaauacaaacauuugcauugguugccucugcugauggggacuaugugaugugccucucaccaucugccuccaucuucaugcugcucccuuucuugguugcuaggauauucuggugaucucucgccuugaaaaaagucugcauucaugggcuauauugcuauuccccagggcuuuuuaauaacauauucuugaauacuacucaaauuuauuuauggccagcuugagcuaaaauaaacauuaacaaaucucagugggggagauguucaguugaaccagcauuucuccucaaaugaugagucuaauuuuuucuuuaugaccccccuaugguguauguaauuggauuuuguuguuuucugugucaacauuauaaucuugacugaagugcuuugguuuggggguuuuguuuugguuuuuauuuucaaguaugcuggagaaguugaaauaucauuuagagauguuauuaggguucauuuuuuuuaauuucaaucucuggguucuccacuugguugucacuuuaccucuguucauagcugggaccaggcaccgccagguccuguaucacaagaacagcuuuacccauggcaaucacuaucgcuuaugcaggcuuuuacuagaacuuggguuuuagccucuaacuccagagggggagauucugaauccucaagguaacccccaaagucacuaaggcauggagaggagagugccugcaagcuuucuaggcagucaaguuguaacuuuaauagaacugacauggggcuaacaaagccugcugacagggcaagaccgugguaauggucgcaugacucggagcacaccagaagucaccuuuuaacccuagaaggauacauugauuuacuuggaggagggcugaaguuuuuaguaggggaggacauaguaccacacacccauaauuccaucacuuaaaaggcuuugccaugaaagcucuuaagauugaugcuaugcugggcuauagaguuagacagucacaaaaaauaacuguguaugugugaagugggggggggggggggcuugguacccaaaaauuaaaaacguuuugaaucagugcuauauuccagaaauuauguuuagagaucucaguugccuccaugauguaacauaucauacacacacacacacacacacacacacacaaacacaguacaaauugucuagcacacugcaaaucaucuuuauaaaagcucuucuaaguuucaugguguaaugauucuuucuaguuaugacauucuccucuucguaaagccuuucccucugauccacauauaucgcccguucagggcuaagcucuggcuccaggcagcuuugggauguaggcagguccugaguggagcuugcugaaccucaacuguauuacccacuaaaugagaucaauaaagccgcucuuaggaugauuuuuucaggauucauuggauucugcauguuaagugucucacucacgaaagguaccuauuaugguuugcauuuucaauguccccagaaaucuguucuaguugauggacuugugggagugggguggggguaauugaaucaugaggacugaaacuaacuuuaucaacuuacugauaacuuuacaacugaaggaauauuaggagcuggugccugacugggggagauggaucauuuagagccuagcuuuggaaggggauccauuccaaaggggugucucauugcucuaccacauguuuccugacgugguuaucucaggacaaaguagccggccaaacuagaucucuccagccuuaagcugauuggcucaaguuucuuaucacagucagaagaaagaacccagcacaguacuuagcagauaccaguccuaaccuuacugccuuguagcuuauagaaaauauuaauauuaggggcuggaggaggagcaugcauaaagguccuggguuugagcccuagcaccauaaaaaugaacaguaaugguauugauuucuucauaguacauaaacuuuuugccuuuuuuuuuuuaagauuuauuuuauuuauuucacguauguggguacacuguugcuguccucagacacaucagaagagggcaucagaucccauuacagaugguugugagccaccaugugguugcugagaauugaacucaggacaucuggaagaguagucagugcucuuaacugcugagccaucucuccagcccaacuuuuugccuucuaacauuaaugggaucacagugaauaaacucaugaucucacuuuuuaccuuaguagaucacuuuuuuuuuuucacuucuugaauacuaagaauuaaaugaaucucucuaccuaaaucaacguguacccucuccuuuagucuaggugacuagagacugcacuacugucuuauuaguauuuugaaccucaccuuaaguuacuuuuuuccuacccucaacuuucucugaguuuucauguguuaaauuacuucacuguagccugcagugaucucuaaggaagcgugcugggucugugcuuuggggcaugguucucccguguugacacucaguggcagagucaggcacuaucauugccccaccacagauuaucaccacguaucuucaccucugcacagcuuccuauucugguuucaugcuuuuuggccucugucucauuaccaucccaucgcaauagguaaaaggacuuuuuaaaccuuuauugccaaccuagaagcugagaacucuuuacagaauaaguggucuuuggguguccuaaaaauaagaccauccuaaugacucaacucuguauaucagaaguuaggaaauauuguauauuucccuacuuggacuauuagaaacuaaguuacuaucuaguagcuacaugggagacugguucuacuaaauggacuaaugaguuacacauuguaaacauuguuucaagauugaacaucuacuuacacaucguaauucuaguuaagaaacagaauaccagccauguccacacaauucuugacacagaauucauauaaccgccccuuuucuuucaaguucacagcaacaauuuaucuuggguucgguugauuuggguugguguuuuaaauaaacuagaguuuauucacauuucaccaggccucccauugcuguucuuuauuauucuaggaucuaauucgguaucaaacagguuguuucucuucaguuucucccaaccuauuacaagacuguuauuuaauuacaauuaauugagguucauuuucuucugaaaacuugccuugagaguuacuaugaccaagaaaauauccuaaaauaaagagccagagugaucuaaagauagaaaagagccguucauuaaaugaagcacuggcuaugauaaccuggauaggucaauuguuauuuaagaccugugcauaagagcaucaaucaacaguuacuugaaagcuggaaaagcccaagguaccaggaagacaugagagccacucugcuuuggagaaaucauggaggaauuguuuuggaaguaagggacuugaguuuguucacucuuuacacaggauaaauuucauacuaauugaguaugcaaagguuacuggaaggcacuacauuuucuacaugaaccuuuuuuuaaauuaggagcauaaaaguuguuuagcugugagugacuuuaaaucagacuccagauccugaagaacaugucaggaaaaaguaguagagaaagaaaauccucuguagaccugggacgcucucuugcucuugggagcucuggguuacacguuaaguucaggacuucgucggugauuucuucuuauucuccuguguguacucggcaucaaacccaggaccucaggcguagcaagcacauuccugucccuguagagagcauauugcucucagcuuuagacuaugucaguuccuuaaucagcauuccagucaccauagaugauuuaugaaccagaucaucuucuccaugacucuuaaaucuuuccucccucuaguuccuguucuguccuugaacaccaccguauccagucuugucccuaaaguuacccugauaaccuuuugugauagcucagcucauuuaacuuacuucgguccccgcuguuuuguuuuguuuuuccacuguaagucuaaauauauuuuugcucuauccuaauucccuuacguaugacaaagagugagaaaaguaaaauagaaaccaagaagagagggagaaugccaccaggaaaaugaauaguccccauuaguccuugauuaaucauuguuacgacuaccaguucaaggcgauuauguaaguaauccuuuuaaagcaccagcuaagaguugacauugaauuaguaauuucuguucuguaucuaaucacuauaaaagccugguuguauaaguuucuucauuuauaaagggaacugcaacuccccucaccaucaaauaugagaucugaaauugaucuagucagcauaauuagugaguuuacuuaacauuuuccuugccgaguauuaguuauauaacugguaacaagcucauuuucaagcacucucucuccuuuccauauuguucaaaauaugacuucuuuuucccacauacauuaacaaucugaaugcugcuucagguguucaaaaucguguggauauucucugucuaauauuuaaucaggucaguauccaaacugacagaacuauucacgaagcaucuacuuagccacuguguggguucugccauuaaacaucugcacagccacuguguggauucugccauuaaacaucugcacagccacuguguggauucugccauuaaacaucugcacagccacuguguggauucugccauuaaacaucugcacagccacuguguggauucugccauuaaacaucugcacagccacuguguggguucugccauuaaacaucugcacagccacuguguggguucugccauuaaacaucugcacagccacuguguggguucugccauuaaacaucugcacagccacuguguggguucugccauuaaacaucugcacagccacuguguggguucugccauuaaacaucugcacagccacuguguggauucugccauuaaacaucugcacagccacuguguggauucuaccauuaaacaucugcacagucaucaugcguacucuuccauuaaacagcugcacagacaacguguggacucugccauuaauuuuacugugcugcuuugucaccgucaccacuuugguugcugcuguuuguccacacauuucaaaauaaaggggagaacgaguccauuucccuauguguuauuaacuagaaucccguguugcucuagcuugugguagguguuaauacagcaagaugcacgugagcugaguguugacaaagauuacccauggaacccuauuaagcuuccagggaguuccuuccuuuccacccugaccaccuccccaccacagcagagacagcuacgguugagguuguuuuccacuacagaaacaguggggugucacauaugguuuuauguuuugauuugcaaguacuauucaggcaugaaauguagaaugcauguuggacacuggccauacauuccaaguacuuugaguugaaagaauuaguuuucauaguuuguacuagcugcugccaauucggauuauuugacuaguguggacagacuuuuacaaaaaccauaagucuuuuuuuuuuugaaccucagagaaccaccacgaggagcucauuuucuugccaaaaguuuggaugaugccuuaagacuuauugaacaaccggaauuggcaaguaaaguagacaugguuuggauagucggaggcaguucuguuuaccagguaaguagaguuauguauaaauagaaagaauuacccuucucuacuugccaccaugcacauggaaacaggacauuguccugacuguaaacuacacaggugccaaagggaaauauuugacacucaugcacaauaaauauuaagguaaauguaagaucuauaauuuauaccagucauacuuauaaauagaaguuacuuauauguuaauguauaagaccuuguauuacauuaugauggugcaucauacuucauguaccuuaggcagauucacccucccacccacucccaccaacuucaaugccuuauuuuuaagucuauuuuuaaacuggcaaauaaucagauaaucugaaacauguauuuguggaguggcuaaauugagauauaucaccuuaaaaucaacucccagcaauuugaagagcacaguaaguaagaccuuguuccuaaccacagucgccaugcagugcaguagagcccagaucuuacacuuccuguguaacuggagucuuguguucuuuagccaagcucuucccacaugcgagucauuuucaauucaaaauacuaguuauuuucaguuuaagaaucagucugauuucuugagcauagugcuuaucuuauaugguauggcuuucagcucccuggagauuuccugggugugcugcugugccuuugccuccaggauaaaugccaugcugagaagagcaugacucugucagcacaggcagacgguggaaacuuuaccucugcgaccucucugcagccucaggguagcaggggauggcaugguuucauaucauaguagaaaauaauagguaaagcagaaaauacuccuuuccugguaucauuugguaccaagugacuuccgguuugcuuguuuguuuggcuauucuucagaaagguuaacauguggaagaaaaaucagucccauuccuuugggguauauauuagcauguauacacagaaaugauucaagaaaggggcauuacagauuccuaaacugauuauaaacugucugugucucacaucccucuaacauugucucauauuaagauacauucuauagacuuaagacuaaaugcacuuauguaauuagcucuacaguaagaaaguggaagccuacagguagcagucucacauguugcagcuuucagccuguccccccaugccagugcgaaaguggaauauaccaaugcucacagcacagcugcuuuugcuauaaguaagaagccuauggcuguccacgucuaaaauguucacuguaugucccuuuauggaaggcucgccccacuuugaaucagagcugcagauguagcuacagcuaguccucgucagcuuuucugguuugggcuauaguggaaacuaguagaauauuuauuugauugcaacagugauaauaaaugauuuaacaugagcuaaaauacugaaaagaaaguguucuauacucauauuuggaaguuaacaacuugaaaucuuauaucugcauguauuuuuuuuccuccuauauauguuugaggaucgauaguuaucuguucuuaagaaucauuuccaguaauaauauaagcuauuucucccaaggccauuuugucuauagagacauucaaauuagcaucguagacugguuagaaaagucguuaccagagcagacugagcgccgucguuaacaacaagaagcaagaugaaugcccugccugcagagaaaugggggcaguuuuagauaaugacagaguaagaaagguuuaccaauggugcuggaaacauggcucugcaguuaagaguucuugcugcacaaucaugaggaccaggauucagaucccagcacccacauaacaagcagagcauccuguaaacuucugcaacucuaagugauuccauagccucuuccagcauggacacacacaggcacauuuacucacacagacacacaaauacguaaauaaguaauuuuaaagaaaugguaugcugaguguucccauggugguuuuaacaaugacaaucucacaaaaggauacuuaaguguacagaugcaaacuucucuuuggauuagcaacuagguaauaaggguuaaacucucacaagagcaaccaaaggaaagcacuggcugcuuuucaaaggacuugaguucaaaucccaacauccacaucagguggcucacaaccaccuccaacuucagcuccuccggccuccacaaauaucaguacucacaaaaacauauaacauauaggcaucauuuuuaaaaauauaagcaaaucuuuuuuucaaaauauuuuauacguaguaagacugaacagcuguaaacacgcauuuaaugccuaguacaaacuuaacuaaaacaaguaccuuccagucucugccuuucagcacagguugaggagagugauaccuuguguuuuguuuuaaaggaagccaugaaucaaccaggccaccucagacucuuugugacaaggaucaugcaggaauuugaaagugacacguuuuucccagaaauugauuuggggaaauauaaacuucucccagaguaaguauacaauuauuaauuagugagaagcacuuuaaggacuaacuacagaaagaaggggaagcaaguaagaacaaagcacaaugacauauggaugaaaauuuacaaggcucagcagaagccauaacugacauacaauaaauuaguaauaaaaagaggaaagagaauuauaaagaagaguaacuuuucagauuugauuugacauagcaauguguuauguagaaagauacuuuuuaaauaauauuuuuauuuauuugaaauuuucauacaauguauuuggaucauauucauccucuccuccaccuucuuccagaucauguucucucucuaagaacaaaaacauaaaaaccauggaguccaguuuguacuggcugaacucccaaacauggggccagcuuggaggauggcugguagacacaguuaguuuugaagaaaacaagcuucuccucacagcacuguccgcuggcuaagggugggcuuuguccccacuccugugcagcucuugugcugucacagucacugagcucucugugcaucuguguccuaucugcaaaacucugcuuccuggaagccacccaccaccucuggcucuacagucuuuuucucccuuuucuguguagaucauugaaccuugaggaaaggagcaugugugcuacagacaucacauuagggcugagaauuccaaagucuuuuuucuccauggugaccaguuguggguuucuguguuaauugucaucgacuacacaaaguaacuucucugaugagaguugagcaucugcggguauaacaauguguuauugagagucauuuuauugcuauguuaauuuaguagaaugagaguaggcuuuccccuagggccccugacuggcuaucuagcuaucuagcuucagguucuuagccuugcugacagugucagggaugggcuggaucucaaggaggaaugguucagaaagaagcagcaguugguuacucccauaacguccgugccaguguugaaccaguguguccugcaggcagcuugcuguuucuguagcucacagaguucaagguaaguaagauugacggguuucucucuuuucuggaagcacauguaucaccuuccagcacugugaauacuacccaaugggagugcacuaaauaaauacuagccaauaggagugcacuaaaugaaugugaauacuacccaaugggagugcacuaaaugaaugugaauacuacccaaugggagugcacuaaaugagugugaauacuacccaaugggagugcacuaaauaaauacuagccaaugggagugcacuaaaugaaugugaauacuacccaaugggagugcacuaaaugaaugugaauacuacccaaugggagugcacuaaaugaauacuacccaaugggagugcacuuaaaugaaugugaauacuacccgaugggagugcacuaaaugagugcagcuagguuucuccauggcauaagaauguaguguccuuuuucacaugauacauguuuguuuaguuuuuuauucaggaacuaaacuacauagaugaguuacagggcuugccaauuucauugucuuuuaaaaaacuccuucagcugguguuagguagcaguuucuuccuaacugaagcacgcuuuccuggaggaaggagaaaagauuaaagacucaggaagcaaacucagcuuaugaggcacaggaagcuccucaagcuuaggaguagcaaggccucccagagguucugagaguaauggcagcugcugaggaggagacugauuagcugccugccugccugccugccugccugccugccugccugccugccucccugccugccgugcacaggguacuaggcaugcagcuuuaguguguugucaccuacuagagugagcuuuucauagcuacccuucagucagucacccauuguuucgggaaauauugaaaacugcaccagcccgugcuaucaccagcuacucucagggcccggcccacccccuguggucagcagucccaagucccaguaacccaguagaggcuuacaauuuauaagucacauuuauaucaguaaauucucgccccgcaaaacauccacacaauuuacucagagccaauugauauugauauaaauugcccaccuagauaagacaaaugguccuguaauuauccaucccuuauaugauauuccuagcuaccuguggcuauuuaaagccaugcagaauauggaucaucauucuccauuuuccuuccuucccuuccguccucucacuuccaucucuaaaaaaucuccgcucgccuuccuuuuccacugcccaaucacaggcuucuucucauauucauauuuaaguuaauuagaaaauucuacaacccauacuccuauaagugacacaaauaaacucacuaguucaccaagcuacacuggggaguugcuccuuuggucuguugccagugcaagaucugaaauagagguuuguuugugucccuacgaagauauaucauaagaacuuuuagaaaucuacuuuaacagacuuggaaaacucaggcuuuaaucauuuuaguggcaucuagcagcugucacuugcucaaaucaggccuggcuuggggacugugcgaacuguugauucugccugcuggugcugcugccugcccuggaagcaaggccuuuaccgugaggugggaggggguggccagugacaugcauggaacagugcugucugcuggguauugugcugggugcagggacccucugaccagaggcaccuacaccuaaggagacaguggagccugagguaagaaugaagcuggucuguuguguaagccagaaggaggucaugccuuagaggauucugaagcagggacauugucugagcuucuguagcaagugcacgggaggggaaccaggggauaucuagauuugggugaaggucucggagucagagguuaaacugggcagcaugguaaacaugcagaagaaaggcuacccuuguuaauccagcaggaagcucccugaacuggaaaccuuggagcauuuuaauuuaaaagugcuucaaacaguuagcuauugcaaguaaaagaaaaaguuaguuauagcaacacuucuggaccaguucuugacacauuuuuccaauagucccaacuguguccaguaauuauccuuugagugugaauuugcuuuuuacacauccccuaaagaagcauaacaauuuggucuagauaaaugaauggucaagcuuuagaauagcagucuugauacucuauagguccacauaaacuuuaaauucauuaauucugaaauaaacagaaguuuuaaaucuaaaguaaacauaaaauuauaagaaaugucagcagcuaaaguccaggcuuugcuuaggcuccugcaaugaugacuuaaacugaaaccacaguuggucugguuuuuuuguuuuuuuuuuuuccccgagacaggguuucucuguguagcccuggcuguccuggaacucacuuuguagaccaggcuggccucgaacucagaaaucugccugccucugccucccaagugcugggauuaaaggcgugcgccaccaccgcccggcugagaauucauaauuuaaauagaagagaaaauauauagggugugguguuuauauaagcauuuuagaaaaagaucagcugggugugguggcgcaugccuuuaaucccagcacuugggaagcagaggcaggcggauuucugaguucgaggccagccuggucuacagagugaguuccaggacagccagggcuacacagagaaacccugucucaaaaaaaaaaaaaaaaauuauaaauucucacauugugugaauauagaucucagcucucccuucucauuucuucauuuuugucccuauucucaauaagaacagacuucugugugaucagcuucauuuaaauaccucucuaaugcuuaccagcuuuuuuaaaaauuggauauuuuauuuauuuacauuucaaauguuaugaccuuucccaguuucucugcaaauucccuaucucguccccgcccccuccuuacccugcuucugggagggugcuccccacccacccacccacuccugccucacugcccuagcauuccucuacacugggcaucaagccaucacaggaccauugaugccagauaaggccccuucgacuccuugagucauuccccuaacuccuccauuggggacccugugcucagucugauguuugucugcaagcaucugcaucugucauggucaggaucuggcagagccucucaggagacagcuguaucaggcucuuaucagcaaguacuucuugguaucaccaauagugucuagguuuggugucugcaugugggauggaucuccaaguggggcagucucuggauggccucccuucagucucuguuccacucucugucccuguauuuccuuuagacgagaacaauuuuggguuaaauuuuggagauggguggguggccccaucccccaacuggaaggccaugccuaaccucuggcuauggucuccacagguucucccuccccuuuguuucaccuaaugucaucucugugggguccugggaggcucuugcuuuccuggaaucuggaacuuucugguugcuacccucaguuccccauccuccauuacuacacgccucuguucaauuuccugacccucuguauaccuccuccaucuccucccauaccugauucugccccucuuuucccccucccccuucucucuuccucccaaguuccugccacccuccauuucccuugauuauuuuguucccccuucuaaguagaacugaagcauccacucuuuggucuuccuuccucuugagcuucauguggucugugaggucuauagaggguauuccacacucuuugguuaauaucuauuuaucagugagugcauacuauguguguucuucugugacuugaguuaccucacucaggauauuuucuagauccagccauuugccugcaaauuuugugaagucauuguuuuuaaauagcugaguaguacuccauuguauaaauguaccacauuuucuguauccauucuucuguugagggacaucuggguuauuucuagccucuagcuauuauaaauauggcugcuaugaacauaguagagcauguauccuuauuacauauuggaacaucuccuggguauaugcccaggagugguauagcugaguccucagguaguacuauguccaauuuucugaggaaccaccagacugauuuccagagugguuguaccaguuugcaauccuaccagcaauggaggaguguuccucuuucuccacauccuccccagcaucugcugucaccugaguuuuugaucuuagccauucugauaggugugagguggaaucucagggucauuuugauuugcauuucccugaugacuaaggaugcugaauauuuaggugcuucucggccauucgaguuuccucaguugagaauucuuuuuagcucuguuccccauuuuuaguaggguuauuugguucucuggagucuaaccuguugaguucuuuguguauauuggauauuagcccucuaucagauugauaaagaucuuuucucaaccuguugguugcuguuuuguccuguugacaguguccuuugccuuacagaagcuuugcaauucuauaaagucccauuugucaauuguugaucuuagagcauaagccauugguguucuguucaggaaauuuuccucuguacccaugguucaaggcuuuuccccacauuagauucaguguaucugguuuuauguggaaguccuucauccacuuagacuuuagcuuuuguacagggaaauaagaguggaucaauuugcauucuucuacauguugacugccaguugaaccagcaccauuuggugaaaaaugcugucuuuuuuuucccccacuggaugguuuuaguuucuuugucaaugaucaaguuaccauauguagccaguugagcagguuucaccugaaaggggggcuggaaauguaggggggggggcgcaccaagagaagggugaagccaagucaagguucuaaucaacgcuacaaguuuaauauuuaacacugcauuuauauggagaaagcccauagaacucauccuguguuuugcaaagcaaggucagugcugcagucuagucuaaguucuugugggaacuugcaauuacaaccaaggcagaugacuccaccuagguugauaagauucauugugacaacugcuuaagggcuguucagccugcucaaggcugggaagaccacagccauagguguguguguucauuucugggucuucauuucuauuccacugaucuaccuaccugucacuguacaaauaccaugcaguuuuuaucacuauugcucuguaguacagcuugaagucagggauggugauucacccagauguucuuuuauuguugacaguaguuuuugcuauccuggguuuuccaaauuugcaaauugcucuuucuaacucugaagaauugaguugaaauuuugauggggauugcauugaaucuguagauugcuuucagcaagauagccauuuuuacuauauuaacccugccaauccaugagcauggaagauccuuccaucuucuguggucuuuuugauuucuuucuucagagacuugauguucuugucaaauagaucuuucacuuguuugguuagagucacaccaagauauuuuauauuguuuaucacuauuguaaaggauguuguuucccuaauuuuuuuucucagccauuuauccuuugaguauaggaaggcuacugauauaaguuaauuuuuuuugauuagauauuuucuucauuuacauuucaaaugcuaucccuuuccuaguuuccucuccaaaaguccccucuacccuuccccccacccugcuccccaacccacccacuccugcuuccuggccuggcauuccccuguacugggacauauaaucuucgcaagaccaagggccucuguguuugaguuaauuuuauauccacccacuguaggagucgccugguggaauuuuggggaucacuuaacuauacuacauaucaucugcaaauagugauauuuugacuucuuccuuuccaauuuguaucccuuugaucuccuuuuguugucuaauguucuagcuagaacuucaaguacuauauggaauagauagggagaaaguggggaggcuugucccugauuuuagugggauugcuucaaguuucuuuccauuuaguuugauguuggcuaaugguuugcuguauuauugcuuuuacugugauuagauaugggccuugaauuccugaucguuucaagacuuuuaacaugaagggauguugaauuuugucaaaugcuuucucagcaucuaaugacaugaucauguggguuuuuucuccuuugaguuuguuuauauaguggauuacauugauagauuucaguauauuaaaccaucccugcaucccugggaugaagccuacuuggucaugauacaugauuguuuugauguguccuuggauucaguuagcgagaauuuuauugaguguuuuugcaucaauauucauaagggaaauuggucugaaguuuucuuucuuugugugguuuugguaucagcguaacuguggcuucauagaacgaaauggcuaguguuccuucuguuucuauuaagaguauugauauuaggucuucuuagaaggucugauagaauucugcacuaaacccaucaggucuugggcuuuuuuugauugggagacuuuuaaugacugcuucuauuucuuuagggguaauaggacuguuuagaugguuuaucugauccugauuuaacuuugguaccugguaucugucuagaaaauuguccauuucauacagauuuuccaauuuuguugaguauagccuuuuguaguaggaucugaugauguuuugaauuuccucaguuucuguucuuaucucuuccuuuucauuucugauuuugucaguuagaauacuguuccugugcucucuaguuagucugucuaaggguuuacuuaucauguuaauuuucucaacagaccagcuccugguuuuauugauucuuuguaaaauucuuuuuguuucuacuugguugauuucaguccucguuugguuauuuccugaugucuacaccucuuggguguauuugcuucuuuuuguucuagguguacuauuguguuucagguguacuauuaagcugcuaguguaugcucucuccaguuuuguuuuggaaguacucagagcuaugaguuuucccccuuagcacugcuuucauugugucccauucguuuggguauguugugccuucguuuucauugaauucuaaaaagucuuuaauuucuuauuuuauuucuucuuuggccauguuaucauugaauagggcauuguucagcuucuguguguauguggguuuucuguuguuuuuguuauaacugaagaccaaacuuagucugugguaaucugguagaaugcaugggauuauuucaaucuucuuguaucuguugaggccugcuuugugaccaauuauauggucaauuuuggagaagguaccaugacguacuaagaagaagauauauucuuuucuuuuaggauuaacuguccuauagauaucuguuaaauccauuugauucauaacuuucuguuaauuucacugugucucuguuuaguuuguguuuccaugaucuguccauugaugagagugggguguugaagucucccacuauuauuguaugagauacaaugugugcuuugagcuuuacuaaaguuucuuuuaugaaugugggugccuugcauuggagcauagauguucagaauugagaguucaucuugauaaauuuuuccuuugaugaguagcuuuuuuuuuuuuuugauaauuuuugguugaaagucaauuuuauucuauauuagauugucuacuccaccuuguuucuugagaccauuugcuuggaaaauuguuuuccagccuuuuacucugagguaguguuugucuuugccucugagguguguuuccuacaugcagaaaaaugcuggguccuguuuacauauccaggcuauauuauucuaugucauuuuauuggggaguugaguccauugauguuaagagauaucaaggaauaaugauuguugcuuccuauuauuuuugcucuuauuuuuauguuuguguggcuaucuucuuuuggguuucuugaaagaagauuacuuucuugcuuuuucuaggguguacuuuccccccuuguguuagaguuuuccaucuauuauccuuuguauggcugaauuuguggaaagauauuguguaauuuucauuuugucauggaauaucuuaguuucuccaucuaugguaauugaguuuugcuggguauaguagccugggcuggcauuuguguucucuuagggucuguaugacaucuacccaggaucuucuagcuuucauagucucugguaagaaguuugguguaauucugauaggucugccuuuauauguuacuugaccuuuuucccuuacugcuuuuauuauuucuuuauuuugugcauuugguguuuuaacuauuaugugacaggaggaguuucuuuucugguccaaucuacuuagaguucaguaggcuucuuguaugaguaugagcaucucuuucuuuagguuagggaaguuuucuucuauaauuuuguugaagauauuuacuggcccuuuaaguugggacucuucacucucuucuauaccuauuaucccuagguuuggucuucucuuuguguccuggauuuccuggauacuuuggguuaggagcuuuuuguauuuuccuugacuauugugacaauguuuucuaugguauuuucugcaccugagauucucucuucuaucgcuuauauucuguuggugauguuugcaucuaugguuccugaucucuuuccuagguuuucuaacuccagaguugucucccuuugugauuucuuuauuguuucuauuuccauuuuuaaguccuggaugguucuguucaauuccuucaccuguuugguuguauuuuccuauaauucuuuaagggauuuuuguguuuccucuuuaagggcuucuaccuguuuaccuguguucuccuguauuucuuguuuuuuuuuaauuaauuaauuuauuuuuuauuuauaugaguacacugcagcuaucuucagacacacaccagaagagcacaucagauuccaauacagaugguugugagccaccauuugguugcugggaauugaacucaguaccuccggaagagcagccaaugcucuaaaccucugagccaucucuucggccccucuccuuuuuugggggcgggggggugguuuuugguuuguuuuuucgagacaggguuucucuguguaucccucgcuguccuggaacucacuuuguagaccaggcuggccuugaacucagaaauccaccugccucugucucccaggugcugggauuaaaggcgugcgccaccaccgcccggcucuguauuucuuaagugaauuauuuauauccuucuuaaagaccucuugcuuuucugguguguuggguaucuaggacuugcuguggugggagaacuggguuugaugaagccaaguagccuugguugcuguugcuuauguucuugcccuugccucucgccaucugguuaucucuggucuuagcuggucuugcuaucucuguugcuugucccuucuguaagccugugugucagcccuccugggagacuaguucucucggggaggaauuuggguacagagagcuguggcacagucaucuccagagcacagaaugcuuaacaguuuuaaucaaaacauuuccaaggugcugacccuugaggauccuuaacaacuuaaaugccacugugguucucugacuuuuaaaaagcaagccaacaccuuugcugacaaagggacacaucaugacauucacuuguggagacuaagcaacuccuuugucuugcuguacuacauucauuccuauacaucaccacaguuuuaguugauuauaaauguaaaauauuuucuggacucucaguucuuuuccauuggucuauggguaucauuguguuacuacuucacggucuuguuuuguuuuguuuuguuuuuuuaugaguacacuguaguugucuuucaggcacaccagaagagggcaucggaucucauuacagaugguugugagccaccaugugguugcugggaauugaacucaagaccuuuggaagagcagacagugcucuuaagugcugagccaucucuccagccccuuguuuugguuuuaacugggucgcauguagcccaggcuggccuggaaccucacuagguagccaagaaugaccaccugcuuccauuucucaggggcuggaacuacaacuacuucacuuggcuuacuacauguaauucuaacuguaaucaggaagcauuaaaccuuucagauuuguucuaucucaagauugcuuuagcuguucuaggucccuuggguuuccauauuaauuuuauauuaguaugccagcuucugauaguaagcaagcugggauucucauagguauuguauccauagagcacucugaagagaacugucucuaaacaguaugaaguucuaaaccuagguagauguuuacucucuucugguaaguaaugcuuuacuguucaguucuugcacugccuugaguauguuuuguuucuuuugaggcuguuuucagaauguucgaacuaguguauaaaacuacaggucacuauaucugauauccuguaacugguacccuguaacucuaaagcuagaauuagcgauuauaaauguuggucccuuccuagcacucguguaaggaaguaaaggugagagugagaacugcccuguuagugucaucuacagcuguauguccuccuuuuagucagaugcuugcuguuucuuucucuugccuguguaucugauccagaaccuccagcagggugacuaggaaauuagacagacgucuugucuugaucaugguccuagugggaaagcacaugacucucacacugaggaagggcccuuugaucucuaguucauuaagugcuuugaucacgaagaacugcuggauuuugccauguuuuuuucuaaaccauuugacacuauuaauacuguauauuacgugauugguuauauuaaacuaauauugcauuuccaaggucaauucuacuugggaauuguaugugauacuuuuuuauauguuaguagagucaguuugcuaccauuuuauuaaggauuuuguauugugucucuaugagacauuuguguaugauguuaucaauguucaguuggucuuagaaucaggauauguuagcuugcagggugaguuaaaaagcacugucuccugcuugcuucaaaaagcuaaggauaguauguguuaguucuuugccaucacaggaguuuguggugagaggacugagacagcacaaagccauugcugugacaugaacauucuaaaugacacuacacaggaacaaacaccuguuucaaugcagcauuugauagccauguguucucugaccugcacuaacaucacagcagccucauuaacauagaguaaaggggagaccuuaagugggucugucuuccuuuaaaaguagaacaagggaagccucuagacaauaagugucuuaggguuucuaccccugugaaaaaaacauauugaccaaaagcaacuuggagaagaaaggguuuauuucaucuuaugcuuccagguacaucauggaaagaagucagagcaggaccuggaaguaggaacagaugcuguuuaccagguuucuccuuguggcuuagucacccugcuuucuuguaugccccaggaccaccugcccaugaguacccacccaccaugggauggcaccacucgugucaauuaaucacacagauaauauaggccaaucugaugggaacguuuucuugauuaugauuccuccuacccagauguccucaucuucuguuguaacaacaguaaguguacucuaugucuagaaggaaguagaaggacucugcccugggcccuugucucagcugcuguacacgagagaacuucucauugcuaaggucagaaugagcuuuagucauucgccauugcccuccaucuuuccaucagccccuauuagguuugcauguguauuuguuuauguguguauuuuauuacauuuuuaaaauaaauuaccaaauccauaccccauuucaucucuucuguuuccuauccuauccuccccacaacuauucccucacuauuucacagcuuuuguuuuguuuuacauggaccuugaguccauguagugcagucagcauguauaugacugugggcucaccuaugugcuacauucagaggccacauccugaagaaaaauuccucccccaguggccauuaguugucgguagcuccugagacuacuuggacuucuuggcuuugucucccaugcuuacaucuuguauggguuugauaacaugcagucaaacucauacguaugacagcuuucucuuguccagaaacuacaacuguuuugcaacuauccauuaaucucuacuaaccccucuuccacaaugaucccugaaccuuggagugaugggguauugcucucgcucucucucucucucucucucucucucucucucuuucucucucucucucucucucucuguguguguguguguguguguguguguguguguguguguguguuuuacauauaggggucaaaagacagccucagguaucaucuuuaagaagcacuguccucuuugagacuggucucuccuugccagauucauucaguaggcugucuagccuauaaaccccaaacagcuccugucucuaccuccacagcauuagacgugcaccccuggcaccacaucugauauuuuuauguggaugaaugguaagcucauuaacacucauuuugauccccauugucuccaaaagcugaauauauuacucuuaguuuauaccgguuuccauucaaacacaguaacuuugauuaacaucauaugacuuacgauguuuuuuucagucacuacucuaaugaaguaaagauaaaagcaaggacugcugugaauggagaaugaauuagaaaauggaugaagcuaagauccaaaguucauauuaaugaaccggugguuuuaccaugcccuggccuuuuuuccuuuaaguccuugccuaugcaacugcuacuucagcagcaccgugccagcccgucccauacagcucuguucucauuaauaucgcuuggaagaaauuuuucuaucucaaacaucaugagaccucaaccaaaccagcaggcucaaaaguuuuauaucagcaguauucuguuuaaugagcucaaaaaaaaaaaaaaaaaaagaugcuaaggcaaacggucuagcuaugcuagcccauuuuauuaucacuaauagaaugccugaggcagacaaacuuuagaaaaaagauauuuaguucacaguucuggagccugaaaggugugugcucugagccucagcauugcugcuggugaagaccucaggcagauggaucccaaugacaagcaucccuggagagagcuuucacucuuggaaucaggaagacagggagaagcaggagucucaaagucccauuaaccuaggucacacuuaaagauccaccagcaucaucaucauacaagaccaggcuuuuaacacaugaugccuuggaagacagacuccuugcaccacagcagagcugcuaguuggcuccaaaccuagggccccugccccucaucagggagcaucauggaguaaauauuagauguacugguguuuccucuucugaucccauuacucuugacucuugaggaucuuggcaaaaucuccaugagacccuguguuucuggugaaaugcccauuuuauuuuaguugcaguuuguuuucuuuuggaaaacuguuucaagaauuguguuugccucugagagcuucaacugaaucaucucuggauuguuuuagucuuuuauuauuucagagcugcuauuuauucugacucuuaaugcuugaagauucuaaauaggaggaagugggugaagccuaugaauagguaguacaccaauuccugugggccuugaacucuagaguccaagcccugggcugggaaaauggcuuaggaguuaauaagauccuaucucaaaaccaaaaaaguuuacaauugugauuguaauuauaaccauuauuuuaaaagaccuaaagauaguagaggaaaaacugauuuaagaagagcucaauuuuaguuuuacagaaaaauugcauuuaaugagguagcuaucgaacauauucggcuggcuauuuaucagauuuuaucauucuuggcuuuugaaagaaccucuuggcacuuuacuuucucugucuuagugauugacaguuuugaugccaaauuuuacacaccaaaaauaugcaaaugugacuuucccugacucauuccaaagagacucagaucauagugaaaacaggccuaguaaaaccaguuucaaaaggcaggagugcuacagaguuaccaccgagaggcuagagagcaguuagcaaauagagcucugacauuguguucaauuuuguaacuaaugucugcuauuucucaucagugcauucuauaucacaagacauuuuacaguuuucugcagcauucguggcaacagugguguaaaguaucaccuaacacuagaagggacuuuaaggaccaugucaguuauaggcuauuccaagaagaagacuggauugcaagccaaguacagauagguacacacaggagagaaaagaugaaaacggcagcucccagccagcucccucuauuguacucugggauggagcugcauucuaggagccauugucaucauugcagggaccugggagagcucccugggagugcuccugggaggcagaguggccagagggucugagcagagaccuauguaagaguuaggggauggagaagucaggugcauugugguucuaacaaagcagucacaaucugccacaugcugccaggcuaggaaagccaugguguguccauaaaucaacagaaaccaagagucugccuggcuccgggcauacaccuucaguccuuagcuacagauaauuuguuuuucuuuucuuagaaaugugauuuuagcuauuacuugcaagguuccuuagaaauugccuaguagcucuugguagaguggaaagauacaagagaaauaggaacuagggcucauuuuuaugaggaaaaauuaugaaugugaaauaaaagagaagauuugagagguugcacuuucuggcuucacauaguuuacuguuuccuucugccaccuguguugugaaugugaccuuagaagugacuugccauguugaagaaagagggaggaaaacuugcuucauaucccacagugcugaugccccugagugagaagucagggaagccacacuguguuuucaguggauguugaauugaaucaugaauuuuuuuucuuuuccagauacccaggcguccucucugagguccaggaggaaaaaggcaucaaguauaaguuugaagucuacgagaagaaagacuaacaggaagaugcuuucaaguucucugcuccccuccuaaagcuaugcauuuuuauaagaccaugggacuuuugcuggcuuuagaucuaugaguaauuauuucuuuagggagggguaguuggaagaauuguuuguuuugugauccuggggauggaaccuaagacccagugcgugcugagcaaaugcuauacugcugagccaccccaacccuagccccuauauaauucuaaacaauauguugucauuucccaguaaucuaacaagguuauaguaaaagugccuuaagaaaugucacuugcuauaaaggucucagugccccucccaugagaccucaaguggcuccccagcauaugcacaggguacuguguguacaagagaccccagugauguagagccccuggagcaugagcagaugugugggcucauaaaaguaggagcuaggcagguaaguccaaagggcagaaacagguuuuaaacagcagagcuggaacucagacuauaaagaaaauuccaucaaaguagagacuggauuauuguaugcacaucacacuugcagcaaagcucugcucacucagacagaaaaucaguaaauggagaacuccauuguguuccauggagacgagagcagguggaagauuauguaagaucugaaacacugaaauugucugcuucucaucuucagugagauuccaaaggauaguacagugacagaacaagaauaggcacucucuacaaaaaaaagaaagaaaaaacuaaguaauagcaagcauaauagcuacuguuaagaacucagagauaaugaauugagaauggauacugcuugaaaugaaaauuuaauaaguuagaaacuaaacuuuauaaaaauaaaaaaaugagcauuaaaauggcuuuccucaucucagcaggguuucagaucaucaggucagagaaaguauuucugccuggccuuguaaauuaguauggucuuuuuuuaucuuuuacuugacaauuuccuacauguuuacgaugugucuuaaucauaccagguccucauccccacucccccacuaccuuuguaucuucuuucucuuuucauaaccuucugaaaccagucauugcuuucuucauguuccugcaugugugcuguccacuggaguacgggcagccugccaguggacacacacacacacacacacacacacacacacacacacacacacagagccaucaguuaccaauagcucuucagcugggugcagucuuaggagccucuccuccauccaagcuagaauaugggucugcagaucaccacagcugcugugagcuugugagugugguguccaugccauguccagaaggcagcauuauauauacauggcccuauuccccaggcuucaggccuucauucuuuccaccacuucuucagugcucccugagccuuagacaagucuacugauagaaauggucuguucagagcugaauaguaaacagucacuuagucucuacacuuugaucagccuugugucuguaagcuggaugcucucuacugaaaaaaaaaaaaaaaaaaacagaacuucuucuccaaccaggguuaagagcacuaauacaggguauaaacacagguauuuagaaagcacucugaaaaccuagccauuuaacaaagcagcaguaguagguuuguccuuagaacccaugacuuccacaccacaggcauuugaccaguuuugcaguacuagacaugaauugucuccuauagagccggccucaaauccaacuaggaagcauugacaggcaugccauuguuguucaguagaaacuguaacaugcagggccuaccaccaacuaaguccauaaaagcuuuucucccuggugaugugcucggcaccuucuggcgcugaaaacuguccagugaaggaggaaguuuccaggcagcuccagauugauucucuauguccugcaaguaaauguguuguaaaugugccuucaacaguaggggcuugucaucuggcuacgacaggcaaccaagagcgauggcaaaagauguguuguuuugggagccuccuuaacuaguuacuuuuaagggugccccacaccuggcacugagaguuucauuuaauaaccuaggucuucauuuaguaagcauuguccaccaguguguaggaugccuccauucaaacuuuuuucuuuaguuauaauuaccugauaaccaugaacaaagagaugaacucaaagaggcagagagucugcugagcuagcccaugaagcaggugagccaguuuguguuauguagcaguuuccucuaaggucaaaaccugucuuagaaggaagcuguuuugacauaagacgguauagaggagcuagaagaagagaauauucuaagggaagcugggaacuuccuuaagcucagcaaauacacaacuuagaagaucuuaaaauugaccagguacacuagacuccucccuccccaagcauagauaagcaaugauugccgaggggcucugagacacgcugagcugucuagaagaccaacugagccuccuggcaaagcagagaccagcagagcugucugaaggaggcuuggaccuaccgaacucccuagaaagagcacuggaaccuguugagcugccuguagguugucuaauacacuccagguuuccugagcugugacucugcuggaacgggcuuuuggugaugcaauuuugauggucuccuuccuuugaacguccauaucugggguuaacagacauuugcuccugucucuccaggagguguguuauacaaugauuuggaucccuggugcucaggcagaggcaaguacaguagcauauguuuguaacccuggcaguggugugguaugggagagacuggcaguguauuugcaagccagacugacccaagaaagaaagaaaaaauuuaauuguuucagcaucuuuuaaauuuggaaaaaagcauaaaugucaaagaaauaauuacuaugucuauaaaauacaauauuugcagcacuugaaaaggauguggcccuaacaggaaaguucuucaggaaaagaaacacacacacaaaaucuaguauuaguaugucuaagaguaauauauauuaaaaauaguugacaauaucagacuuaguguuauuuucuguuugucuucuaugauuaggauuuuuuggaaacuuuuauagagaaauuauuuaaacuauuaagucacagccuuuguuuucaacaggaaaaugaggguauagagcauugagaggaaaaaugauuuuccaaaagucauccaucaagagagagagaccagaccauacaaaagaaaaaagucaauucuauagaacaguugcacaucaaauaaagcaauagcgcuuucuugcaaugaacauaaccugaaagccaccaauauccagaauuuguaggacucagugacucagucagaaaaagaaacaaguuauuuacagaggaaauugaaguggccaaugcagagcugaaccuucuaccagaaaggagagaggcaggggaggaaauuacaugugccagucucaccaucuuuagacuaaaauguugacaucucccagagcuagggaugcuaugcucagcacgcagcaguuucacuguggauaagaccaagagaacaccucauacaugccaaaacgaaagacaaaagcacccuggaaaucuagacacaaggaaauugucgucuggcuauuuuaguaugaguucucuccaauguguauucugaaacaauucagugaaaguggugugugugguaggaugcaccagaaagcacaguugggauaugggaaaacaagaaaccuaguucaaggucauuaagcagauucccauugacaacccgggaaacugagggaggaagaaagcuggaguguguagauccugaucguuguuugcacgauguuccacacugccagcuuguugcucuguguaaaccggacacacuccaacugccaaggucccaagcugcuaacauaaaugcaaagaauacgaaacacuagcaauuccauguuucugcuacuuucuacauaaaaaaaagugcacagcccaguaauuuauuugaaauauaauauccaucagggugaggguaagggugauaaucauagcuuccaccaaagcauuguguauacugaaaaggagacaugauacguuuuuguguuagaaggcgagguuucaggugggcuuugaauuugguuugacugagacucauugaguuugaggugucuuuaggaaaggaagaaagaagggaacaaaaaauaaaaagcaauggaaacaugccuucaaauucugaaaaggaaauuauuuucaacuaauacaucuaugcucacucaaauaaagacagacgugugugggucc

SEQ ID NO: 7154 - RNA, 15765 nt, Mus musculus
ucuucuggccccggggcccggacuggcccgccgcccccaccugcagcgcggcggagcgcgggcgcgucacucccagcggaagcgccagccccgcgucuggcgaggugcgcgccucgccgcucccgcuccagcgcuucguggcccgccugugucugcagggcaggggcgggggcccggugacacggacaggggacugagaucgcagucgccgccgaaucgucgacagucacccagcucggacggagcguccgagcaggagccgaucaggaaggugaaggaccacugccgagccgacagcgcgucccaggucaguccgcccgcugcacuuggggaaacuuugggaugcggugacagcugcgagacugaggcaccgagggucgcgaggccguguggccgcggugcgccccgcgaacaggcaccugccgcacauuugacaccgcagcugccaguguggggacggagacccugcuaccgcggaccacuacgggccaccgagggccagcgggcuucaggggccucccgggagacuccggcucgcccgcgccccgccgcgcgccuccggguucccgcaaguccccagcuccgguuggcggcucgcgcucggaccccgcgggucugcggauuccgccgccuucgggccucgcgacgcgggaggagcggcccggggcccagggcugcggggugggagccccguggcgggagcggcgcgcacucggccaguggagcgcgcgggucgcgggguccggcaggagcgcguggccgcaggugcccguggccgcugggcagcggagguacggagcgcgggcuggggccgcggagccgauugcaaccucgggcugcaggaaccggggucgccggguaggcaguccggucccugcggcucccgggugcgcacauccuuggcaccgggcauccagaccccuucagcggagagcgggcugaggaacggcgccagcccgggcggaggaccagugcugccugcucucuggcacgccaucuccccagcgagggccgagugcuaggcuacgcggggaccacugcccagggccucccggcacaagccuuuuucuugggcagcugccugcccuggcuuggaguggaggcgacgaaaugagcaccccgcccccauccgcgccccagcgcugucgccccagucaccuuccuuugcccuucuccgacagcaccuuggacuugcucucuccugaacuggggaaaaucugaggaaaccaggcacggaccuuggagacacgccgccugcacacucaacagucuggaaauccagccaccuugguaccucgccgcuucccagacacuuuggaggagcagguuugcaauuucuacccccauccucauccccucccccgucucugucucugcugagggagggaaucuucugaagagaagaugggaucuaggcacccauaaccuagccccaggaggagcucaugggagccagccuagcuuuguagcuaugugagggaaacagcacaccuuauaaacuaacuccuucccgugggcaguuccugaauauuucuuagaagacuggagacccaagaaagcugacuuuuccugggcagucagugcaucuuuuauuuggcuccgacucucugcuugcugggaacagacacauuuugcuuaugaccucuggcuggccucauuccaguugcugucuggcuuuggacugcuugcccaucaggacagugauuuugaagagcugacugggaagagaaagcugcaagccucaaguucugguuggcuccugcucaggguuguagucuuccgugggacccgugggcucccuauuccucuggacuguggcagcaacucugcccuucaccucugcaaggaaauuaauuuucaaacaacuuggggaugaugguggaggcaccccugugugagcagaugcagggcuuggaagcaaccaggaaacaaacaggaguaagaaauccuuuuuaaaggcuuacaugauucugggacuaagaaaagauggagaugccauugguguguaaaaccugacaucucccuguuaggucccaccaguccaggggacucacauaagcaggaccuguauugggugaugcauauuuggaaccuaguacuuaaugaauuccuaagcaguaaaugccucccgauuuuuaaacucacaaucaucuacaguaauguagcuauugccuccccucccaccccacccccacuuaggaacaauacacucccaaaccugguaacucuggaagagcccagguuccccaacucauuucacaccagggcaggaacuaggauaagagaaaggacuguucugagcuuuagagucauauacccacuuuauggcuccacagccagacaacuguuuuauaagagagaacacaaaggaaaaucucucuccuguccuaaugaauagaaagcuggggacggugggaggacaaaggcaauaggaggaaucagcuccaagauggcuuuccaagcaugucagacauauagcacgaccaugcuggguaccacacuaaucagguaccccaacugggcccugccgugggauguccaucaucuaacaggcagggagauaccguacuccagacaggcagaaagaaggaaugaccuugggagaguccaaucaccuuuccuacucucuguacaaaauauggauugaagcagaugagcaccgaggggugggccugccugcaaacagacuagguugcugugcgugggauccauuccagacucauuuacaaacucagagucggugaaaugugauaaaccgaacacuguagggauuucuaaacaaggaauuaaaacacucaacuucaaaugggagagaugcaggcaacaaaucguccguguuuaugugccucugaauagcucugauuucuuuugguaggagcugacagcuggcugacagaaaccucauccaaagagagaagagacuaaacccaaguaugaaauuagggaugauguuuucagguaacuuucuauuuccauucagagugggugucuggaagggugaguguagguaugguuugcuccauuugucaacagauauuuuucccccaagggccccugagucuaaggugccauacuuugacuguuuucuaguuuccugguggcagaauagagagcugggaaucccagcuccagccugcaaacucccccucuguccacacuaucugaugcuucuaguaucucugaucuuucugagcaauuuguucauauggccagucuuugggguuuugcccaagaaacugguugucaauuacauagggugggggcagcaucgggaaguccagaugaucugcccauggauuuuucaacccaccucugguuuuugcccugugccugccucacugccacccugcaugcauggugccugggccuacuggggccuauaggucaagggucauauauacuauauacauggcagcauugaucacucugacagcccuccucucccuccaaagcuuauuggaaguugcucauucgauaacaccuuuccucuagcugccuuugucccuggaaguauauaccuuugaguccucccaauaaaaauuuugaguggaagcuuaaccagcagggaacagugauguauucuaacuaaaguuaaagaccuacuuuuaaccagaaaugaggcuggagcaauggcucaacucuuaagaucaccggccucccuuccaaaggacccagguucaauucccaggacccacaaugcuccucacaacuaccuauaucucuuaguucaaggggaucgggugcccuaaucuggcaucugagggcaccaguacagacauacauaugggcaaacauuuauacacauaaaauaacaggcauacauauaguugaugcucauacacauaaaauaaaacauaagaaagaaauaaaauagaaagaaggaucuauacaacuacuuaguaauuagaaucgucuaauaauguagggacccauaaggaaaaucuaggaaauucuuaccagauuccacucaaucugaugaaucauuacuuacagaguaaaaaagucauuuccaauaguccaucuguaauuuaaaguuaguuaguuuguguauaucuguauguugucaugugugugcagguacacauaaauauauauauauauauauuuggcagccagaggaaaaccauguuucauuucucaggcacugucuauuuugugguaugugugcauggugugugugugugcauacauauauuuaugcacauugcucauuugugagcacauguuggcuuacaggucuaugugcaugcgugcgugcgugagugugccucuguguguuuguguguguauguguguguguaugugugugaguguguguguguguguauguguguguguguaugugugugccucuguguguguguaugugugcuuguguguguguauguguguguguguauaugugugugagugugccucuguguguguguauguguguguguuuguguguguaugugugugaguguguguguuugugugugaguguguguguaugugugugagugugccuuuguguguguguguguguuugugugugugugugucugugugucuguguucugucuucacuuuccauauccacccuacguuuauguggaugcugaggaucugacuucugguccucccacuuacacaauaaguccuuuacagacuaagaugucucccuagcuguuaccauuucuuuaaagucucucacuaacugggaacucaccagguaggcugggcuaacuugcugacccagugaggcccaggaucuguguaguucugcuucuugagugugggguuacaggcgugcacucccaugcucauauuucuucuagcaucaguucugggagucaaacucagguccuuaugcucucaaaguaacuuuuuuacuccccaaguccucuucccagcucuguuauuuuaaagggcuuuggguuugggaugcaauagaaagagaagguuaaauucugagauaaaauucuugaaaagaggagugaaccaagcaggagacucaauagaaaaccuuccgucaggugcuaaguucacuuccaugggcacacagcauaccuauuauaagacugucacuccacagaugauggagccaacccuucaggaggccaaggcuugacuagggcauacagcuaacaucuaugaacauuacgauugagcucugggucugucugacucugaaccuauuccaguugaccugugaacuaugugaagggcgcaaugacacugagaaagugucaguaaaaggaggaaagcaaaugggcugacugcauguccacacgcucucagcucuggguucuuagggagcuuccuacgggaggaaagaccguuccaggcaagagaagucuucaucaaacacucuacagagagagaucauauucaacugucagguuugggguuuacagauugaucugacaaggguaaugacccccucagagagggugaaggccuaaagacaggguuggucuaauaaggcagugacuguacgaugaugcucugagagcuuggucauaaccucuggggagggauguaucugacaauccucuucuaaaaacauugaacuuucaacaguaacagauggcccuaugaaauauuacaauucaaguggacuaagaagccauuauagcucaguguggaagcacaugccuaugguuguagauacccuggagacugaggcagaaggauugcuggagcccagguauucaggccagugucagcaaccaacauaauuucaaggcuggggagccagcucacuugguuaaguacuugccauguaaauccaaggaccugaguuuggucuccaguauccacauaaaaggugcacacuuguaaaucucagcacugggaaaggagggucagccagaucccgggcucucuggccagcuaaacuuagccuuaucagagaucccuagguacuuaccuuaaguaacaagguggguagcuccggaaggacacuggaaauugaccucuggcuacacacaggcaugcccccaccccagugaacaugcacugacauccauacacaacaaacagaauuuauuccagugaaaaguaagccuccuagacucuuuuaugcugccaucaucuacaugauagaggaggcagccaguugguacucagcucaaccuccuugauacccugcgguccacaacauccccauuucugaggaauaaagaagaggccacugcccuuucagauaucccagucucuaguuuguugacaguucgcugucuuagagccuccugacucuagccuuggugagagaaaagcuguaagcauaacugcucaggauuccuguuguagaagagggguguguguguguguguguguguguguguguguguguguaaaguaaacuaaagucuuuccaucuuuccacacacuuaaagguucuuagacuuaagaaugagaacaaccaaauaagagucuuaguguaauauugaaagucagagcagggcaggauggcauaggccuugggggcagaggcagucagaucucugugaguuugagacccaacauggucuacauugugaauucuagauauccagggcaacguagugagaccucaucucaaacaaacaaacaaacaaacaagaagucaaaacauuguaacuuguucuuauuaaagugucuauuucucaaacaugacuuuggccuaaggauuuuuuuaaacuuguuuuuuuuuuuuguuuuguuuuuuuuuguuuuuuuuuguuuuuuuuuuuuugugauugcuacugaauccuuucuuggcuuggauacuaagugguuucuguacuugauauuauguuccagugccuccuaauuucuuugcauauuaaaccaauuuguaugugaaaacuggaaagaagugguuucugugguauucucaugcgaacuuucgaaugcuuuccuuccagaguagaccugcaagucgguauccacacugccauccugaucgcugcaucccacaucucagguauguuuugaugguagaauagcucuucuagacuuccaugacagggagagaaaaccaaagcauuugcuuuccuucagugcuuugcugugcuucaggaaugauaguaaaauggaggcgguucaauuuggaguuccaccuugugugggcuuauuuauggcaaugccaauggaacauccaacaagaaauauuaguaaugauaccauaagaacugggcuguguugugaaaggaaugucuugugugcaaccuuugcauauauugaccuuuuuuguauggaggcuccuauaauaacaagaguggugcuguauggaagaaugugugggaauacacuguuuaaagaacaaaugccucuaaauacaacaccccguugagaaauggagcaccauugggacuugagaggccucuggugacccucccagaucacaccguuuucucuccuccaccagcacccacugucccuuuggaugcucgucguaguuguccuccauuuauaauggacuccuaagaaaaagaacauuaacuagacagcaagcagaaagccagaugaugaaggaaggcugauauugccuguaugugaugaaagucucagaaggugagcuggcccaggauuuguaagcacuuauaggaacccuaggcagggucaggaaugaguccugggauuccuuaguguggccucugccuggacguggugcagagcagugacugaguacccaaauggaguggggcuguuuguuuaaccuuucucucccaagcccaccaggacuugccccaggaugucagagccgaguaagugagucagagcagagcuaacaugagcaccacuuggggacagcaaggggguagggggaacacagagaugaguccagacauagcaaguaaagauaagaacugaagccaggcugcuauaugcuuugguccucaggugacagauggaccauggugggugacugcacugagcaugucugugcacauccuggcaggucccuccagcauucucuggggcuggggcaggggugcggggugugccucucuuccagggucuucagcuuccauggugcucuauuuuucuugcuuaccauuugaccucaguagauuccauccuucaguuaauucuugagacuauguuccaguugucgccugaagguuuggcuaaauauagaauuuagccggggggggggggggggucauuucuccuucagaugucuaaaaacacuucugcauugugucucauugcuauuguugauguuccugaaucuauacucauguuugauuccuugguaugugacuuauccccaaacccaagggccuuccucugccaucaagacuguggaaucuucucuucuguggccuggaagugcacacgcccauguuaugggaagugcacaggcacguguuaugggcaugcgcuguuucacucaguucugcuuuggccucuggauuggauaacucuuuguuccccaggccugggacuuccccccacuuuugugauggauggcuucucaugcucccccuuugauauaguugccuugcugacacugagauaaaauauugugaccaagagcaacuugggagaagagagguuuuguuugccuuacacuuccagcucauaaccacugggggagucagggcaggacucccuccugguccuggcucauauagccuagcucuuuuauacaucucaggauuaccugcuuaggaguggugugcuccucggugggcuaggcacuucugcaucuguaacugaggaaaacauuuacccacaggccaaacugaucuaggcaguuccuuagucaagucuuucuucucgugugacucuaggcuguggaguugacagucgguguuaacuuggacacuagucuaccucuuuuucuugcuagaaauagcauuuggaugcuggaguucccggacuggauuucugguugucuucuccccccccacccccaccuccguugggaguuauuuuuguuuugggagaugggggucucucugugaggcugacuuugaauuugugguccuucugcuucuccuuccugaguacugggaucacaggcuggugccaugaagcccguuuuuuucccuuuauuuuucacuguguuugaaaauucucagcacuacugacaucccguuugcuaccgagcuuugcgggccucuuucauguucuuuugagauugcaugcucugugaauauucuucuucacagacucuuucucccaaccgugcuuaggacauuccuugcuccuucggggauacugcguuuuggaagcuuuuaucuuucugucuauuggcucaugacuaaagggcuggacagaaggaccggugagaaggcuggugcacacggguaaugcuugucacaugugagucucauuguagacagcccugguggugugugaaacccugugguauucucuaagacagguaggcuauugaauacagaccugagcagccuucacccgaggugggauacacuugagcucuuuucaaacaaucacuuccuugucuucaguccaaagacccugugucuuagcauuuucagagaacagagccccagguggacccgggguggaagcagguuugucacugguggccuggaguuggagaagccaccccuuagccacacuuccugagcuuucacaggucaguguggcccagggaacugagugaacauggaguugguguacuggcuggggauggagucuccgacucagggaguaugggaggcucucugcugcugucccuggaggucucacgggagcagcaaggcuugccugcucccuagcauccuuugacucuucuuacuguggaagcccaguucuaacgagcccugcuguaaagcauggguguugugcaugggguuagcucuuucucaggcugacuccucugcuuuaagcccuccaggcugcuguuuucuucccuguuuucucucuggcuuugugaguguaugccucuuuaaaaaaaaaucuuucguuuggggaggcuucaggagggagcaaaaugagcuguauuuugcuguauaagcccuaacccuagccaucugcagccauauuuccggaguuugguucugucccuauaaacagagccugucaucauagaucauugcagauuaggcuucacugucucucuucuucuuuugucugucugcaaaagucuuuuucugauguuaauuuaaauauauguaguauuauuaucgugugcguggagauaugcuguggugcacguguggaggccagaggacaacuucccggcauggauuugcucucucccccuuuauguagguucuggggcuugaccugggucaucaggcuugcacagugaccuuuacccaugaagccuucuuauuggcuucuuaauucuguuuguuuguuuguuuguuuguuuguuuguuuugggacuggggacagaacugggaaccuuucacgugcuaggcaagugcucuaccauugaauuaccggccaagccaaaccugcuaaauucuuacacagucuucaaaaagaagcuccugcaucugaccucugaaaaaccucauuuguuccuaaaugacuaaaacugcuuaaauccugugacuccugcuauaaccaguucucuauagcaucuuccaagucucugugagcuccccaggacacggugguaucuucgcagcucugcccagcacuuaucagggacuuacaggugacaucgcugaauucaucucuuugcaugcugacugucuucccccuguuggccuucugaucucuguguacucuuucccucuaguaagggacuagucuguuaaucaccucucccacuucaaacagaagauuuccaucccacaauccuaguccuuuuuauuucuuuauuuuugagccagggucacacuuucuagcucccacccuggcuuuaaacauauucuguggaccagucuggccucgaacucauggugaucuuccugccuccacaccucaaaugccaggauuaccagagagauccagcagcugggagucauaaucuuccauuuaaaaagucagugauuggcccguuuacugagcugugcuggcauugcauagaaauggacagccaccuugguguagaaguguuccuaguucucauuuguacaaugccaaugcauaguaugaacuagggagagcgucuuaugaggucuugguuacaacaaauaauaaaauauguucuaaauaaugaaaagauccagagacuaggagaaacacuaucuuucuaaaauuuauucagauuauaucuacaugaaaugcauaucacguuuauaaaaccuaucugaucucugucuccugcuguaagcacaaaugaaagacagauuuucucuuagcucaauauacagugaugacuauuacccccaucaugaacucuguugaggaagccuaaaccagagauauuuaaauaaauuaaacauguaauuuuagugucaaugguaaagauuaugugauuacaaacccugcauuucuccuuuuaaaguuucuuuuacacuugacuuuaugugucuauguguauguguguguuuugccugcguguacgucucaacacuaccugcauucggguugccugaggagaacacaagcaggcaucagguucccuggaacugguaucacaguuuucagcugggaauugaaucuggacccucuggaagagcagccagugcucuuaaugacugagccaucucuccaguuucuuaaauaauaauagucgucuauacgauuuuuucauuuagguuugugugcaugcacgcgcacguguguggucuacgcauugggugggggaaaugcagggacucguaugcuuuacacuaguacaaucacaccaggagaguagaggaggccuuuuuuauugcuuucugucuuauaccauucagacagggucucucauuaaaccuaaaucaccuuugcaggugggccagccggccagggagacccuggaacccaucugucucucugaucaugguuggguuacaggcccauguggccgcccccgggccucccccagccucucacuagggugcuagagagucaggucuucaugcuugcauagcaagcucucuuaccugcuagcuauuucuucagcccaacuuugcuucuuaauaugaauguuuaaacuguguucuucaagagcagaaaauaagcagaccguugucaaaugugaaaguuaggaaaagacuugcguuccugcuccaaggaagaauuuaaagaaacguuuuaacuuacaauuccauaaagguuacuauuacucugaaauuucuuuuauuuuuguaauuuaugauuuugcugugcuucagcuaauaacauaaucucaucuauguccugaucauacauauuucaaaaauagacaaaaugacaagaugaauacaaguuggacauugagucuaauugucaauuuuuuuuuuuuugauaaccagguauugauuucugacuuuugaagauggaugaaggcucagaaguuucaacggauggaaauuccuugaucaaagcaguacaucagagcaggcuucgccucacuagacuuuugcuagaagguggcgccuacaucaacgaaagcaacgaccguggggaaaccccuuuaaugauugcuuguaagaccaaacaugucgaucaacagagcgucgguagagccaagaugguuaaauaccucuuagagaacagcgcugaccccaacauccaggacaaauccgggaaaagugcccugaugcacgcaugcuuggaaagagccggcccagaggugguuuccuugcuccucaagagcggggccgaucucagcuugcaggaccauucuggcuacucagcucugguuuaugcuauaaaugcggaagacagagauacccugaaaguccuccuuagugcuugccaggcaaagggcaaagagguuaucauuauaaccacagcgaagucgcccucugggaggcacaccacccagcaccaccuaaacaugccucccgcagacauggacgggagccaucccccggccacgccuucggaaauugacaucaaaacagccucguugccacuuuccuauucuucugagacggaccugacacucuuuggcuucaaggauaaggaguugugugggggcagugauaauaccugggacccagacucuccuccgaggaagccugugauagccacuaaugggcccaagcuaucccaggcuccagccuggaucaagaguaccccaucauuaaagcaccaggccagaguggccuccuugcaagaggagcuccaagauaucacuccagaggaagaaauagccuacaaaaccaacgcgcuggcacucucuaagcgguucaucaccaggcaccagagcaucgauguaaaagacacugcacacuugcucagggccuuugaccaggucaacucaaggaaaaugucauaugaugaaauaaauuaccauuccuuguuuccagaaggaagccagacaagcguggagauucccacugaccgggacccagacucuaaucagauuuuugccuccacgcugaagaguauaguucaaaagcgaaacucuggggccaaucacuacagcucugauucgcagcucgcugagggugucaccccuccaaccguagaagauggcaaagcugcaaagaaaaagaucuucgcgccaucuccuuccuugcuuucaggguccaaagaauuaguggagccugcuccuccaggcccccugagcaggaggaaucacgcgguguuggaaaggcgugguuccggggcuuuccccuuagaccacagucuggcgcagagcagacccggcuuucugccgcccuugaaugugaauccucacccucccauuacagacauuggugucaacaacaagaucugcggccugcuuucuuguggccaaaaagcgcuuaugccgacggccccuauuuucccgaaagaauuuaaaaccaaaaagaugcuguuaaggaggcagucccugcagacggaacaaauuaagcaauuaguaaauuuuuaagagaucauuaggaaacacauuauguucaaaucagaaauacauagacuuagagaagaaaucuuaacuauauccuuuuaagucuuagcuagugcaucgcagcuaggcaaaucaaaauauaguguauuuuguauuagguaccgcgagcacagcuuaauacauagcuucugagggaauucuaacaaaaugaaagcuguuuuuuuucucaaaauguccaauauuuaucaacuuucaugugguccacguuuuuucaucuaaccaaaacaucaccaagaaagaaaguuuccuguguuagaaacacuuuuaacauuucagauuggcuucauguucuauuaugaaacaaugcucucaagucaguaauuuuguggacacuuuaugucaacaagguuguaguuuuucauguugccaaaaucaaacaaaacacugacaucaguaaagcgaaaacuacaaaggaagaauaaauggaucccuuuaaaaauguugacucaggcaaguaaaagucuaauuaaacuuugaaagcaugaaaacuagaucgacagagcaagcaguguucacaguggcugcuaacuauguaucagaacggcagcuggggguggggcgggggcggaggagauggcucaugggcccugcaagccgaauggccccuuuggaugcccagaaugcacgugacaguagugcaggcaucuguaaucccagcauucccuguggggcgauggguggagccaggagaaucccuagaaacgcauggcucagauagucugucuacacugcaguuaagaaacccugucucaaacaagggaacaaggaugacugauaccaaaggcuguccucugacaggccgacuccccaugcgaggcagcaaugcgcguaccaaagccuguuguuuuuacgccauacauugcuuucaaacaaacuuaccaaucauguuaucuuauggaauuacuccuguuauuuuugaguauuuucuccauagguuuccaauaucaagguaauauaaaaaguaaaaaggauucacccugauauacauucuucccaaaaaaaacccacccaaaacagaccgggguggggguggggguggggguggggcuggggagcaagaaguuugggaauaacaaaaagagggaauuaaacgcuugcuucauguuaaaaaaaaaaaaagaaacaaugauuaauagauuaguuuaguuuagguaaaauuacaaaauccaaguagaaaccuaaucauaagguguguuacagggucacuacuaagcaauaucuuuauuucugacauguaguuauuagacagucauuauaaagauauauaaagauaacguccuuggugugacaucuggaucaucuaguauuuuagggucuaugaauaacuuguaacaaaauacacauuacuauaagauauuuaaaaagugacaauauuaccuacaugacuucaaaguauaguguucacagaguucuucacucuggcaguucugaagcaaagagcaaccgaugcacuagaaaaccaagggugugaguccaaugacaucaucuccagcuucauuucuuugcccaacagguggcacgaggccuuucuugguaauuugauauaagcauuuugaaauguacauagaaauuauuuaauuauuuguggcuuuuauuuaaaaaacuaaauugcagguuuuuccauuuaauguuuugaagagacucuuaauuacauuagaaauauuuuuuauucagaaauuaaaauuguacugauguuucuaaguagcugaauuccuuucgcaaguuuuaauaucacaaaaaguacuugaccucacaugguaaggugacaguuggaagaauauguaaauagaguaauucauuaucaaggugguaucaauaaagauuuaaaauaucau

SEQ ID NO: 7155 - RNA, 5639 nt, Mus musculus
ucuuuucgccucugcaaucaagcucucccaauaaacgugugcagaaggauccuguugcagcgucguucuugcuggucgaguccggugcgcgcaagaaguggugccgaaaacccgggacaagaaacaucuucaggcacgagcgaagacccccuacuacagggaggauucagaacugcaucgcggggaaggagcgguuaauagagguucccguaaaacagacugcugagaaggauccggcguggauucagaacucuucagcuggggagcgguguuaauaaagguuccugcaaaacagacugcugagaaggauucaacugcauggauucagaacucuucagcugaggaacggugguaccgguaaguguaaagaaauuaauguaaaucucugagaggcaugcucuccuacgaaguagauccauuaauugucgcugggauugugcugcuugcuuguuuucuugccuuaauuuuaugcuauugccuuaauugucaucgcccugggcacgaguguaucugcugggaauaauuucacguagauaaugcuuuaguccaggacgaucauggguaauggccagucuacgcccuuaguagggccagugcaagccuugcuuaaagaaagggguuuaaaaauuucagaaagcacagugagcgguuuuuugagagaaauagacagacuugcuccuugguuugcccccacugggucgcugacgcuaccuaguugggaaaagcugggaaaagauauagcaagagaggaagcagaugggaaagugaaagcagggacaaggccguuauggaaauuaauuaaggcuuguauccaggacaagaaaugugagcuagcuguuaaagaaggacagcgacuuuuacaggagcaacaggaaaguaugucagaaacagagaaauaugaaaaagaaagcgcgcgcagaaagauaaguaaagggagagaaauaaaaggagaaaaggaaaagaaaccaaaauguaaagauacaaaagauagcauaaaaaauaaagaacagaaaguuaagucaauuuacccuccucucgaggacuuugaguuauuagaauugucuagcucagaggauucggaacuaucagaaggagaggagaaaaauuuggaggaggcugcugcaaaguguaaggcagaaagaucugguccaauaggaaggaguaucagugcucccccaccaccuccgccuuauacagauaagaaaacaauuggcuauggccacuccuuuugcacuccuaaagggcugcaaaaaauaugucaggcuuuuccuguuuuucaggaucaugcucaacagcgauauuaugagccaauaucgcauaaacaagugaaagagcuagcagagucaguaaggaccuauggaguuaaugcaucauuuacucagucccaaauugauagauuggcucacaaugccaugacuccuuuugacuggaugagugugguaaaggcaugucuuacgaugggacaguaucuagauuggaagucuauauggcaugaucuguguuugagucaggcccgugcuaaugcuacugcagggcaacaagcauggagcuuugaaaugcuuacaggucaggguauauggacaaacaaucaauuaggauacccagugcaggucuaugaucaaauuaaucaggcagcagugaaagcuuggaaagcauugccuaaucgaggagaaguaucugguaacuugacaaaaauuauucagggaauuaaugagccguucucugaauuuguagcucgcaugauggaagcggcaggauguauauuuggugauucugaggccgcaaugccauuaauugaacaauuaguuuaugagcaauguaccaaagaaugcagaaaugcuaucacaccauggaaagggaaaggaauacaagcauggaugaaagccuguagagaaauaggaggaccucuuucaaaugcagggcuggcugcugcagucuugauggcacaaacaaaagaaauaaccugcuauaauuguggacaaacaggucauuugcaaaagcaguguacaaagaguagaaagaguagguuugaaaagacaguaccagguauuugcccaaaaugugggaaaggaagacauugggcaaaugaauguagaucagucagagauauaaaaggaaggccaauaccucaguuuaaagggcaacagccaaaaaacggagugaggggcccccguccccagggcccccaaauguauggggcauuccagaccacaguguccaugaggccacccagagaccgaggagagccacuccggguucagcaggauuggacaucugugccaccuccagaguaauucuuacaccucaaauggggugccagccuauuucaucagauuuuagaggucccuuaccaaaggauacagugggccuacuguuggguagguccucuucugcuuugaaaggauugguaauacaucccggaguuauagacucagauuaugagggacaaguuaggauuauguguucugcaccccgagguauuguagccauuucuccuggagaucgcauugcucaauugcugauucuuccuaguuugcauaacauguucccuaguggccaggacucgcgaggagauaagggacucgguucuacaggaacuaauguggccuacauaucuuuagauuuggauaaucgucccacuuuacaauuacaaauagaaggaaaaaccuuucaagguauaauggauacaggagcagauaaaagcauuuuaucuaguaagugguggccugcuucuuggccuguuaaucaaucaucacauagcuuacaaggauuaggauaugaggcuaccccaacuauaagugcaaaauccuuacaauggaaagauaaagaaggaaggacagggcuuuuucaaccuuauguacucccuuuaccuguaaacuuaugggggagagacguguuaucagcuaugaacuuuauauugacuaaugauuacucucagaaaagcaaggaaaugaugaaaggaaugggauauauaccuggacuaggucuuggaaaaaauuugcaagguagaauuucaccaguuaaagccacuguaaaggcagacaagaaagggcuggguuuuuucuaggggccacugaggagccuuugcccauuccguggcauacggaggacacggugugggugccucaguggccuuuacccucugagaaauugaaagcagcuaaagaauuaguacaagaacaauuagaccugggacauguggaacccacucaaucacccuggaauacccccauuuuuguuguaaagaaaaagucagguaaauggagauuguuacaugaccuaagagccauuaaugcacaaaugcaaguuauggguccuguacaaagagggcucccccuacucucagcucuaccuaaggauuggagaauuauaguaguagauauuaaggauuguuucuuuucaauuccauuaaauaagaaagauaaaccuagauuugcauucaccuugccuucuauuaaucauauggaaccugauaaaagguaccaauggcggguauuaccccaaggaauggcaaauagcccuaccauaugucaguuauauguaggaaaagcuuuacaaccgguuagggaugguuuccccuccuuaaaaauuugucacuauauggacgacauuguaauuuguggaccugaagaagaaaguauacagcaagcuuauggcuugcuuaaugaaacuuuaaaaaauaaugguuugaguauugcaccagaaaagguacagcagucuaauguuagucauuuucuaggagccacuauuacuuuacaaugugucaccccacaaaagauuaguauuagaaaagaccaucuaaagacacuaaaugauuuucaaaaauuauuaggagauauaaauuggauuagaccuuauuuaaggaucccuacuucggaauuaaaaccuuuauuucaaauuuuagaaggagacucacauauuaccucauugagacaauuaacaccugaggcuucugauguucuuaggaaaguggaaaaggcgauccaaacagcacaguuaacucguauaaaugagcaagaaccuuugugccuaugcauauuacgcaccaucaaucugccaacugcuguguuauggcaaaaugguccuuuaguauggauacacccacauauauccccuaauaagacuauagagcauuaucccaccaugguagcaaauauggcccacaaagggauaaaaacuucaaucacucacuuuggaaaaugccugauagcauaauugucccuuauacugucgcacaaaugcaaauauugugugcuacuauagaugaaugggccauucuuagaugcaguuauucugguuuaauugauaaucauuauccuaaacauccguuauuacauuuuauguuauuacauccaguaauauuuccaaagguaacggcuaauaccccuauaaagggagccauugauauuuauacagauggauccaaaacaggaguuggaaguuauguaaucaaugaaaaggcuguaagguugcaauuuacaccaggagccccucaauugguagaauguuuggugguuuuagaagucuuuaaaagauuuccuaugcccauaaauauugucucugauucuguuuauguaguuaaugcgguucuagcauuagagacugccggaaauuuuaaacaguccaguccuguaucugaaauuuugaugaaaauacaaaauuguauucugaugcgugagcaucccuuuuauauucaacauauuagagcacauacaucauuaccuggaccuaugguuaagggaaaugcaauugcugacucagccaccagagacaugguuuuccuaucacaaaguucuauagaaagugcaaaaaauuuucaucagcuuuaucaugucccugccucuacauuacgacaaaaguuuaagcucacaagaaaagaagcccgagauauuguccuacagugugguaaauguguagaauuuguuaaugcaccuuccguggguguuaauccucgcggauugcgaccccuagauguuuggcaaauggacguaacacauaucccaucuuuugggaaauuacaauauguacauguauccaucgauaccaguucugguguccuucaugccucucccuugacaggggaaaaagcaguucaugucauaucucacugcuuagaggcuugggcugcauggggcaagccccuaguguuaaagacagauaaugguccugcauauacuucuucuaaauuuagccaauuuugcaaacaaaugcaaguaaaacauauuacuggauugcccuauaauccacagggccaaggcauaauugagagagcccaucgcacucugaaacaauauuugcaaaaacagaaagggggaauagaggcuaugacgccaaagauggcucuaucccuuacaauauuuacucuuaauuuuuuaaaauuggaugaugcuggaagaucaucagcugaaaggcacggacaauggccucaaucgcccaaugaaauggucaaauggaaaaauguccuugauaauaaaugguauggcccggauccuaucuuaaucagaucccggggagcuauuuguguuuuuccacagggugaagaaaauccacuuugggucccgacgcgacugacaaggaccgugaaagagcaagaugaaccccaagaugauucuccugcuccugaugauugagaccgggau

SEQ ID NO: 7156 - RNA, 3655 nt, Mus musculus
ccgggugacagaggucagccccggcaagauggcggcccccauggagcucagcugcuggggaggaggcuggggucucccuucgguccacagcgaguccuugguggugcuggugaggccgccucgcgggccagggcgcgggaggacugggcuggcuagccgcgggcuccgcuggagaccggcgggccgcuugcaagcgucaggucccggcggcccggcggcgcuguuccugcaguuggagaagcacacacgcggccccgcaaccucaggcccugccuccugcauccgagguccccaggagcggggagccugcgcguccccgauggcggacgggggaggggcgugggcagccucaggcugccuuugagggugcaucagucagagccgugcugcagaccuugcaagccugcucucagugucuaaaaucucuuauugcaaacucuguuucaggcuuaugccaaguuuucuggcgcgcccuugaaaaucaauauuauagauaacaccuggagagggucaagagguacaguauaagcuuucaaacgccccccucucugcccuuuucaacaguugcaucccuuucugcauuacagccauauagcccaagaguacuuggggcgucuuagcuucuuagaaugaccuuggcuguguguugguuguguuuggucauuucgaguaagaacuaaagguacaagacaaaccuggaaaauuggagagacgaaaauguuuuuuagugcugcccuuuguaaagcccacagaaguuuauacccauacucuuccaugugccaacugguguaguuuuuaaggcauuguaaucuucagaauaaaucacgguguuugcuuguguguaaauuguuuuugauuauaggugauguaccaauuuugacaacugaagacagcauuguuucuaagccugcaaaaauucuaaacuuucuaagaaaacagguggguagcuccuuuagaagaaguagguaguuuucugcauguuacucauuauuauuauuauuauuauuauuauuauuguuauuucagacuggguuacaugcuaaucuaugcugccacugugcagcacagacuggcuuuaaaugcuagaauugugggugugacaauuacaccuggcauccuguaugacuuauuuuuaguucacuauaaggugauuuuaauuuuuggggcaacugggaaugccuggaucuugacaauagagaaacaaagacuugcuuacuggugcugaaaggcaugcauuuuauuuuacugugaucuggaaguuuaaugaaguauauguaauguauuuauugugaauuucuugaaaaggauauaagauucaauuuaguuauucagacuuauucuuguugauaauguuaucacuuuaguccuguuguuacuauacauuucaugcuaagugugacacccgaguucccaucauauggcaacuauuuuauuugaucacuuuuguuguuauuguuugguuugguuugguuuuaugcugagauuugaauacgggaccuuguagucacugguaggcaagcguucuaccacugaguugaauacugaguuuuguauuucuacuuuaaaaaagcacuuaucugauaguuacacgccuuaugaaagcacguaucuaaagugugugaaguguaaauauuuauguaguaagucaugauauuuaaacauaaaaugauuccuauaaacaugacggguauacgugauuugucaguacuuuaagaaaaaaaucuuguaccauuaaaauuugaaccguuucuaaauugagaaguuuccuuuuuuuauggaaaaaaaaacauuuuaaugaacuguauguuuuuuuccuuccuuaugaaaaacaauugcuuuuauucauuaacuuguaccacgugccauacuuugaacaaaggucauugauaagcaugaaagcaauagaauguaguugacaagcuguaagcaacauugggguuuuuuuguguauggugcauuaagaaaguuuucauugguuaguauuccucccucuuaauguuagguuugacauuugugagggagaauaggaguucuaacuuguuuaucucccuuguccuaggaauguccuuugaccucugagagacuguuuuucucuuugauagaaauauaaugcugacugugagcucucagcaaaacaaggggcagacacacuggcuuacaucgcucuccuggaagagaaacuucucccugcuguggugagcaucucugaguaugacagacaguauuucagugacuuaguugaaaauguuguagucuguuuagaaagaacaaaaaggguuguugggggcggggggcgucuuaaaggggagauuucuuguauuagccuugaucuuuuauauuaugacaaagcugaauucuccuagacauuuaccuucccauugaaguggguaguccgcuuuguuuguuugcuuguuuggcuaaugaaacauucuaccacugaguuacaguccaguacaauaauauuguuuuggaaaugaacacuauugauggaagaugagacuuuguuccauguauagaauuggcuauauuguaguucguucauccugagacuguuugcugagcacugacuacgugcuaggccguauccuggguccugagauauagcagugaacacaauucauaaugguuaaaauaaucucauuuuuaccuugagucauuugaucuggaaaauuuaaaugaaguuacuuuauucaaagacaauuaugaaaauaccgucacauugacugggugggguuugucuuggcggagcuucccuauaaugcuuuaucuucuuuggcagcuucacaccuucuggguggagaaugagaacuacuucaccgugacaaagccgugguuugccucucguaucccuuucccucugaguuuaauccugccgggaaggaugucuagaggagcccugaauaggauucucuugacaaggggagaaccuccccucuaccauguccaagaaguggaagcacagguacagccuggauucucccagccggcgcucuguuggaaagggagagguggccuuaccuagaauuucuaccugcaaagcacuuuucauccuuuuuagauauauagagaugccagggagugccuaaaucuccuaucaaaccgauugggaacaucucaguuuuucuuuggugacacgugaguaaauucucuuaaaagucauauagccauaagacacuguuuugauauuucuaccaguguauuuauaaaaaugacuuucagcuuucuuugugcuauuaauuaugaaaacgucaugaaacugcugccacacugaaaacccuacguggaguaacccaagucaguguuccugggccauagccacucauauuuaagucaaacauaagccaucucuuaucccuuaacaacaacaaaaaguugggucagugauucugcugcagaagauaagagcccuucuggccgaggcucuaucucagcagccacagggccccuccuccuacaggguauccaaagcacaugacuguugcccauuguacugaucaugaagccccuggauacacacgugccaccauacccuuccugacgaacacccuggaggaagucaccagcuguuucucagagacagggcugguggugggugguucuggauuuguguugauucuuauuguauaaauauacucugucauuuguaucaugggga

SEQ ID NO: 7157 - RNA, 5117 nt, Mus musculus
auuaacaaacaguccaaugauuugaaauuuuauugagaaaauagcuauuuugagauuauauccaguuucucauuugucagaauacauucuuaacagugaccaucauuuccacuucuggguauuucuacaucagcucuagguaaaauacauucacaguaggcaaggcuaugguauuugcacacuagaacagaugcuuacguuguuucccauccagagacugccuugggagacggagccaauaaacaucauaugcagcucuugucccuuccucuguugaucuuccagaaagcuaaagugaagcuacaaaaccucaguuucacuuaaggaugguuucuauuuuauaaaacaauaagacguaagagaaacccaaaucaucuuuaugcauuuaaaggcuuguauacacccguccgccaucagaucaagacgccagcagcccacagaccaaagaacaagcagccagaauggccuucuccuucuccaaugacucucagaggcugaugcaaacucuggcagggcacuuccagugaucgccaaagaucugggauauguaaacuacaugauuacaggcauugcucuaaucuucgaguggaaaaccgaagcgucaggacuaagguccaagagcuuuuccugugguugguugcucaccauuacuccagcacccaaaccgcacggcaaguugugcuucuaauguacauccaaacccuggagcaucgagccugcgacuguguauauaugcugcagaggcugacaaaacgccauggccucacuggugagcugguuuagacucugggagaaauggagcuuguuuagucgcccuuaccaucaccagagaaacacucaaagcagaaacuuuguaaugagcacagacaacaaauccucaauguucuccuaaggacauuucucagaacacaaaucccauaaaacaucgacuuuuaaaaaauccucaguaaaauaaguuagggaagugguauuaaguggaggugcuuacuggagacaaugagucccccugggggaugaguaugcgccugcgcgcagccuuguucagucuguccucuuugcuaauaaaguaaaacaucucugaagcuagaaaccaaaaacacacauuuacacaucaaaggcucugaaaagccuacagcaagucagcucugcacaauacagcauuuuccaaacuuaguagaacaacauauucugccaaauucccucuuagaaucuacucuugcagaaacuaaauguuuuuuaccuuauaacuucagauuaauaauaacgagggcauaaaaacaacuagccuguuuccccuuugaaagaagcugcuuauucuguuggcacgauccucuaucacaacgcaccuucacuacucacaagcaaucagcuccagcuccccuuccaucacauggugcuguuuaagaauguuaauucuuuuaaguaauccacggacuguuuuucuggaaaaauauuuuuaagccuuuuaaauucccagaguccucauuugcuuuggacacaacagcacugagugccaaacaagcauccuggggucccagcgauugcaacaccaacagcaacuuccacacuaacaaagaaccaaaggcccccuggccuucucaucaugacgggcagcacucucaagcccagugaugcuucaguuaacacacauuagaaacguaaaaucauaagcaucuugauauuuuaauggaaaauccguuuuggugugagguuguuagaaacauucucacaaggcaagggcgaucuuccgggaagcauguuagaaaccugagccccuuuuucuuuaaacucaagagugaaauaaaaaaauuaucaguauauaaucuaguucucauuuggaacugaauacuaagucugcaguguuaaauuuuaagauagagauauguagauagugacgaacuuacucuauuagguuugcuuuuugaaaauccuuuuauuuuggaauaauuauagacucuuaaagcauuacaaaaauggaaggagauauuccauggccccaucauucagcuuccuaaguauauuuaaauauauuuuacuguuaauuauguguaugugugugugggugggguggguacaggaacauuuugaguacaggugcucauggauuccagaagggggcgccagauccccuggagcuagaguuccagaagguuguaaacccccugcuagagguccugggaacugaacccacguccucagcaagagcagugcguucucucaaguacugagccauccauucagcucccacgcauauuuaaauauuuauauucugccuuugagugguuauuguuguggcuguugaaaaacuguugacccuaccaaaaaaaaaaaaucauuuugagcaagcuugguaggugcaugucuugagaugcaguacccaauucaaauaccaccugaacaaagugguuuucuuacaauauuccacaaguuucugccucuguugauguucauuuugcccauuuuuaaacuuugaaaacacuuuaacuuagauuuaacuuaaguaucuuuguucccuguguuacuguauuuaucaguuauaaauuuuuagggauuauaacuggaaauaaaaaugguugcuuccaaaaaguaucagguccucuaguaccccgacauuugcuacugugagccuuuugugggguccccucaugcccuugucugugguuucuucaguguuaggucaccacugugaugacagugcucacugaggguguuuuccugugggaauuagcaaacuaaauuuuuuuucuagcucuguaaaaucaacaaaauuaaaaaugggcauaaucccuguucccaugcuggcugcuaccaccaccucugaaacccauggcucacaguguuuggucagggcuguggaccauuuucuccagcaaacucacgcacauacauccugacagggucaccaaggcccuuuguccagucugaggaacuaccuccuucuaagagcuucucagugugccuggucccugaaguauucuaugcucaguuacagcuuccuccugucccauuuacuuagacaaauagagcugaacucaguacuaacaucuaaguucuuacucagcuaacuaagguucugcagcucagaaaugugguuuugaagcacaugggcuacagaauauaaggcuaaaggcaguucagagcagugugaccauaaaaaaaaaaaaaacaagucacuuuacagacauccucuccacuaaacagaaugagugcuuguuauucuaaaaugauuaggaagaguuuggugcacacacagcacaguaacucccugguugaagucuggagucgucugaacauggccugcugcauucuucuaucauguaagccccugcuccuuccucagcagaacuuaccucagaaucaccuucuaacaucacccacagagugaggucucguucuguugauacgguucuuucucuuaggaacugucagcuuucaagaagaauuguccuacucuuacaugcauuuuacaauuauaaacuacuucaaauacuuuuuggaagguuuaccauuaauacuaguugaaaaugacuaacccugauuaaagcauaagcagauauaugacuaaugugucaaccauccuucuucaauauaaagucaauccuagagacaacgaagccucuugaucauuacauuuaaaacacaauacucagauauacucagauuucagauuguuguaacuuguuuuagaucgcaaaaauacauacacucacaccucccguacacacauacaccacacacacauacacacauacacuuacccuacacacauucacucacacacacaugcucaaacccacacucacuagcacacauucaccccuacaucgcacacucuaugcacacacauacacacacacacacacacacacacacacacaaacacccuuuguuaaagcaucucugugaaacucguugaguacauguccuaaaugcaaaugcacucacagagguggaugggaccgugagggcuaccugugucuuauuuaaagcuucaagaaugaguauuuacagugaccuaagacuuacaucuaccaaaaacagagcaaccuggggcgauguaggucaaaugcagcugagcuccgcucugcucgcaguagccgagucucuagacaacacagccugguuucugcagaacuuggcaacauuuucugagcaccacaguaaucuuguaagacacuaaucccaaacaugguccuauuuuuaaaaucccagaaguaguuuuacaauaacagaagcacguuggccacuaaaaucagcaaguuucuauuauauguaaaacuaccacacaacaaauccuugaacggcucauucacaaccaauaacuguaaaucgucugagaaaccugcuauugacucauuccuuuggauccuucaacucuaauuaaaaaugcacaggaaauaauaguuugucagaaagugugacuacaugauaugcguauuaggaaacaaacugcuuugagucaaauggaucacggagacccgacacacgggagcagaucugagacgcucgccacggcucaucccaaggaggcugaacaguuaggugagcacaauaacaauacaguagacagcuagacuuccaguucuggaguugauauaagagugagacacguaagcaaugguguacuaaauacacaggucuaaggcugccauguucaucucugcuagcuuagagcaaaccuaucagcaaguacuuagucacacuggcuugugugcgugcgugcaugcgcaugugcgcuaucagggguauuauauaaaccaccuuuaacauuugcauauguagcaguaaacugccaaaggagcagauuuaugagagaacaauuaagaagcauauuccucauugcuuuuuaaaauuaaauauaggcuuuucuauugaaauaauuucuauuuuuccugguuccuaaaaucggcaucagacuucuuaaaagaauaaggucucagccaaaaagccacauauuauguacugagacaagucuaagaaaaacuaaguuaauaaauuaacuuaaauacauuaaaaauguacauucacaacagaauugcagcuuuuggucagcaacaccugaaccaaaggcaaagaucugccaagguuaaggcaggauuuuuauauacaguaccauu

SEQ ID NO: 7158 - RNA, 4138 nt, Mus musculus
uaaguaagaagaguuuauugagauucgucuccaugaggaaugcuaaugggaugcuugggaaagccagauggaaggaaaauaggaagggccgagaccaggccaauaagaggcaggagucaggcuccuggucagauaggaagcagauggagugggugguccacaaaaccuagcuagguuugggggucccugugggaacaaagagcacagaugccagggucacauguggguccuggugagagaagggagccuuccugacuggggaacacgggaggaccaggagggcaacccagaauagggaaggagugaaaaugaauuucagcuuuccuucuggcuuaaggcuggcuacugagcaauucuggccugggcuuucuuacugcacugauaucuggauuuuaacuuuuuaaacuuuauuuuauauucaccccacauuugagguggaugugaguacugacuucuauauuuuacauuuacuuguucuaauaauuaauauuaauuuuauuuauuacuauaauauauaauuacugguauuguucaccauagguuaucagaugaggaugaggagggcaagaccaagcaggaguguaucgucucugacccuuccuuuuccaugguggcaguucaacgugaagacagugggauaaccugggagaccaacucaagcagaucuuccacuccuugggcuucaggagaaagucagaccucgggaauauguaguuuggaagggucagcucugacuucuccuccaggaaguguuuccuuuauuauggaugaaguuaaaaggacacggaaaagaacucagaaguccaagcguggcucaccgucacugcgucggaaaggcagcaaaaaaaggaauucucuggaaucacaagauguucugacaaaccaagaagaugguccuucaauuucagaaagcccugugcucaauauugagaaugaaaagucaucuauuggcacuuaugauaaaacaagaaggaagaagacugcaucaaauacgccucccaucacuggggcuaucuacaaagagcacaaaccauuaguguugaagccagucuacauaggaacgguacaauacaaaauaaagauguucaauucaguuaaagaagaguuaauuccucuacaauuuuaugggacguugccaaaagguuauguaauuaaggaaauacauuacaggagaggaaaagauucaucuauuagucuagagccggauuugagcaauggugguucuaauauaguuccccaaaggaaauuagcccagagcccagaagaagacaaaguaagagagcuugcuccacccuggagaggugcccucuccaaaggguccaggaccucauuguuuagucacgaagagcaaaagaaaacguaugccgauuccaauuuaaauguuccaucuucaacagaacacgcauuucccuccagugccagaaaugauacagcugaucaagaagaaaaucucagccuuccacaaaugaugccacaacagccagcugaugaaucaaagacccacagaauggagccaccaagcauuccagcaaccaugguccuugaaagagcaaaggaagaacuggaacagaaugcacaaggaaaggaaaguucagaggaugaugcuucagucuugacaggcucagccgaugaugugcaacaggaaggcuugguuucugucaaccauuccaugccaugggaggcagagaaggagucuuuagagacaggaccaccaagaccagcgccagccauccaagaaaaguuugagccagacauggaagggcuagagccgauuucaacagaaaaaacagaacaagcgucugaauacgugaccucaucugagcccauaguccacagagaggaggagcaugcgccugagcccauaguccacagagaggaggagcaugcgccugagcccauaguccacagagaggaggagcaugcgccugagcccauaguccacagagaggaggagcaugcgccugaauccauaguccacagagaggaggagcaugcgccugaguccauaguucaaagagaggaggagcaugcgccugagccugaguccauaguccacagagaggaggagcaugcgccugggccugugcccauaguccacagagaggaggagcaugugccugagcuugaguccauaguccacagaggggaggagcaugcgccugagcccauaguccacagagaugaggggcaugcaccggagcccauaguccacagagaggaggagcaugugccugagcccauaguccacagagaugaggggcaugcaccugagcccauaguucacagagaggaggagcaugugccugagccugaguccauaguccacagagaggaggagcaugcgccugaacccaugguucuuagaaaggcacaacuagagaggggaguggaaacuucuacgccaaucacggauaccacugaacccgaagauucuagucuagaagaagagaucauagaacuugauuacccggaaaguccuuuagcuucuaaggagacuuccccaucgccuuuguccccugaaguagagcacagaaaagagcccauucuaccaacacagaugacauucacaccugaacguaucacuuuguccgaggaagaaagagaagaaaacgagucuguuucuaccgauucugcuuuuguaucugaguauucaguccuacaggauuugaaccauacaccagagaagcuggaaguagaggcaguuucuguaucugaugugaaaucuagcaaugaaccugcagucuuuucagaggacgacgaggaacgugagucuuauuccccagcuaugaccucuguaucugagcagucucuuucuccauccaccacugagaagacaucugccauccaguccccacucuuuucaacaguuucaccaguccugucuggagaugaggccucagagagcgugugucacucaccagaaucugaaucugcggcugaguauucuguuccagcacaugcgcaagaguugcuguugaaaacaggugaccacaagcucccauuaaagucccaacguguuucugagcccaucauucaggcagaagaugagaaagaagauauugggcuacuucccccagcagcacugagccaggcaguucuaucggaagaugagagucuaggaaguggaaguuucgcaucagauucaaagcugccauuuaaacccucgguuucacaaaaugcaacacgggaauccccccaaaaaacaauagaugacaugccccaauucaaaccaagaggccuuucugauccugcaacccuguuagaagaagaaaaggaagccauuggaguugggcuaucuucauccaaugaggucucugcaguggaaugcgcucuccccccacaaaccacugagcugcuuucugaaagccaugccccaccucccugggccaucucauccgaacaagugguccaaucagaagaagggagcagagaccagcagcggggcucauucucuuccacaccagagcuuggccacacaucuccucugcuucuaaagggugccuccucacccacaggucuaucagagcaagggcaggaagaggacaauauugggccccuuuccccugauucugcauuugcgucagaauucucauucucacccuauccgacucaggaacuagagaagagagagcuggggcgggauucuccacugugcuuaacgucccccucugagcagacuguucugucugaugaggacacggaagaggcugaccucuuuucuccggauucagcaucacaggugucaaucccaccauaccgaaucgcagaaacagagcaaaacaaggucgagccagacgaauuacuaccuaggaggucugcuccagacuaucccuacuucucagaggcagaugaagaagaggcgggguccucaguggucacgccugugccugagcauucugagccaucgcaggagcgggaggagucuuccccuuguaggccuguguucgaagaucugagccugcuaccuucggcagauaagaccggccaagcagaaacuaugucagauguuccaacaauuucaaccucugugucugaauaucucauccuggcacagcaggagaaaacucaggcaucuuuggagccugaggcugaagauuugguaccaccaccaaccaguggaugggagaagagagaugca

SEQ ID NO: 7159 - RNA, 2180 nt, Mus musculus
uucauauuugacccacgugccuuuuuaaaaagugugugugcacguuauguggaggucagaggacagcuuuugugauugguucucuccuuccacacugagcuguggagauuuagacguagccugucaagcuugcaugacaagcacuuuuaccuccugagccaucucaccagccaguccacaugccuuuuacacauuccuucuauagauauugagcaccagcuauggcccaggcucgguuuugaaauagaaacuacagaaaaaaggccauaguugaguacaagacagagcuauuuauacuguaagugcugugguaaaagaggacucugguagcaaacaucccagagaagguugggaagaguuuccaaaggaggugaacccuccuuaauucuugccgaagggacaagagcuagucaauuguaggaguaaaagaaugacugagagugcaucguaugcaaaggcucagacaggaaaacacuggggccauuuuagagugggccagugcagaggacugggacauggggaagggcaugacaaagaggggcagaggcacauuagaacauuguuguuuauauacaagguuugaacgaggcauugcucacucugcgguacuggagagauggugaggggauuuuguuguaaagaaguaaugcaaaauagcauuuauaaaaccaggaaguuaugggaaugacaguaauccugcugagagucuggcccuggagaugguauaaaauaugcagugaugggucugaagagugucuagggggugaaaugaguaggcuguccuaacuuguccaggugcugugggagaauacaaggugacugcugggcaucuuaaaccauggggugaguugaacaagaaggaaaagcuugaaggcagagaccagaagcauggauucaugucuguugcucuuucgugcaagauugggcgugacuggaguaaaugaguuucagugugaaugaauuuaguguguaugaaaaauacccaagugaaacugagucuaggugugaaacuuaggggggagaugggagcugaaauuagcuacuuaggagucgacacuguggcagcacuugggagccucaugacagggagaacccaaagugaaggugagaauuaaggccaggugcagcuugaagaagaguagacagagggguggcuuggccugcauggugggccucuagaagccaugaguggaguuccagaaagccauauuucacaugaaaauaaagccacaacucaacucaggucucagggugaugcuuuaaaauguguuccauugagauccuuuauuuguuuuaaauauauuuuagguuuaaaggaauuaaaaaccaacaaacugaaauguacuaucuuagaauacugagauccacuacauauaacauggaaaaauauugaaaucuggguuaacuaauuuuuaaggcaaauugguaggauugcugcugauuucuguaggaaucaggacuuucucaguguagcacagaaauggcaccugaggugauaugugucuccuugagauucauuuuaacauuuauaacaacagccuuauugucuuuaauggugagcugaucagauucuccauaccauuguuugucacuguauuggacuucauguuguuaugucaggcugggggggggggggggggagggggcggguucaaaggcuacagccagaagaagggagccacugccuuccuguggcucuccugccucauguggucaaguucuuggggcuaaagucuguagucuuucaugaaaguuacgucuuucaguuugugaauuugauaguaaauucaugacuaggaccaggucaacaauguacauuugcauugcuucagaagguucaugacucuguuauccuaaguguuccucuuucuuaugaacucagaagcauaacuacuuauaaauuacucucucauaggaauaaucucaaaugguagcaacaaaaaauauucuuuguacuugguuuuagucugcugugguauuugauuuuuuuucuaguuugaguuacauuuauaauuaguuugaaauauuugaguagacauuauuugucacuugagcaacaaauugagcauguuugacauuacagaaaggaaaaagaagccaccaguauucaguuugcugaaaauaucauauaaguuuuuuaagucaacuugggaauugucaaauaaacaauaacuuuaaag

SEQ ID NO: 7160 - RNA, 69714 nt, Mus musculus
ugccgccgccgcgucagcagcgugccgcacgugcccguguuuacgucccucguggagccgcagacgucacagccgaauggcaacauuguggcgacgcugagacuagcgcuuuaggagucugcuuucugguucugguucuggcuggcugggcgcuguuggccgggggcagaggggcggcggggagguaggccccggcgggcgagcggcggacgcgcgccucagcacgcagccccgcggcuccgcgcaggccgguccggcggcccagggcccugcgcugcggcagcgagcggcuuguaaacagauccggccgcacgugaccaugugaacuaccugcuccgggccgcguauugucucuucugagagccgcaccacaaaggagccggugggugagcggccggcgcgcuaagauggcugcaggcgccccgcaagggugagcugggggcgcggccaccgcggagacucggccgggcgggcgaccccccucgccgggcaccggagcuaccaugucguucgcgcuggaggagacacucgaguccgacuggguggcggugcggccccacguauucgacgagcgcgagaagcacaaguuuguguucauuguggccuggaacgagaucgaaggcaaguuugcuauaaccugucacaaccggacggcccagagacagaggagcgguucccgggaacaggcggggacgcccgcgucugaugggagucgcgguccgggcagccccgcggccaggggucggucagaggccgcugccucugcuacagcagcgcuccggagucccgggccacggaaaagccaggccugggccgagggcggcucuccgcgcagcgcgcgcagccugaagggggauccuccucggggucccgcgggcagaggaccggagaguccucuccguagccccgcgcgggcuaaggccagcccgcuccgcagaagcgccgaaucccgagaugcgaccgccagugccacgccagccccgccggcgcccccggugcccccggugucgucggugcggguggugagugccuccggggcggucuccgaggagaucgagguccuggaaauggugagggaggacgaggcgccacagccgcucccggacucggagcagccgccgucugccgcggagcuggagucuccggccgaagaaugcagcugggccgggcuuuucuccuuccaggaucugcgagccgugcaucagcagcugugcucgguaaacucccagcuggagccgugucugccgguguuccccgaagagccgucaggcauguggacggugcuguuugggggcgcccccgagaugaccgagcaggagaucgacgcucuauguuaccaacuccagguauaccugggccacggccuggacacguguggcuggaagauccuuucucagguucuuuucaccgagacggaugauccggaggaguauuacgaaagccucagcgagcugcggcagaagggcuaugaagaggugcuucagcgggccaggaggcgcauccaggaggugagugcggaguccgagcagcgguccuaguuuucacgucucacugccaaguguuggagccuggguuuggggucugcgaagugucuucuuuucuagccgcgggaaaaggaagaacaggagggcuccugaucggcuuucuuuacuuaucucagcgauggaucuuugggaaguuuugaguuuuuuuaccccuccaaaaaguacccaguuuacuaaaaauacagguagagauaaaagcauuuagaaaaacagguauucuguaaucuuaaacuaaaugaauguuacucucccccuaaaguagcuugcccagacauuagcucuucuuucagggugucauguuuauguacugaaaauuguugucuuaccgaucaaaguugaucugcuuuuguuugccuugugugcucuggcaacauagguaaguaugaaauuuuacuuuucagcguuuugcggugcucaaaguguaccacugaacuacacccagcccuaaauuuauuuuuuaaaaaguguguugacuugaccaaaugagaauugacauaaguaagauuuuagacuaugaagucuuuacagauggcucaaguuucacuccuguuuuagggagaagguaggucaagggcaggaaugcuuugagcuuuuauauguagugugaacacuuuaacauacuucuugagucuuuaaauaacaggaaauaaaggcuauacguagugagcucuucaguguguguuuauagucaugccucuucuguagaaauguacuaaaaaguguaauuuaauaaggugacuucuaaugggcaauauacaauuuuucaaagcaauuuguuuuaaugucacaguauuuugugcuugaacuugggauggagagaagcucuguuucauggaguuuuuauuccugaauugcugucauuuguauguauauuuaacugauauuaggccaggaaccuggaauguucuuaguuucuuacuagaauauuugguguuugacuuugcuagacuauuauuucucacuuacaccauacacuaugcauacauuuacaacuuccucuaucaagacucuucacucuagcucacaucuuuaaucccagcacucgggcauguggaucuuuguguguucaaggccagccuggugugaauagggaguuccaggacagccagaagcaccuagucacaagcugucuugaaggacuacacuucucuggguuacuggaugguaggcaucauguggagcuuccuagaguucaggaaccuguuuucauuucucccuuuacuagcucacuuccuggagacuuugauaaucuuuuuggaaagaggugacaaauaagacauucuuucuaguguucauauuacccugcauuucucuuaagcuuuuugaaguaguguuuuauuaaccaauggugugugugcuccuuucucagacuggaaaugauagcuaguguuuuccaaacuagaaacucuuuaucucuaauuuuaaaaugugugcuuuaaccuuauuugauacauaauaaaaggugguuaucuuuuauuaaaaaugagcuuccaaaaaguuaauuuucuaggacucaguuuugaggguuaguuuuuuucuaaaacacauuuucuuaguuaaaaauguauuaacuagauguuuuauucucuuugagguguuuuuuaaaaugaaauuuaaaaauuaaauuaaggucucauucuguagccagaguggcuuggaaacuaauagguagcauaaguuggccccaaacuccagauucuacugcucagccucuuuagugcuaguauuagaggugggagccaccacauaccuauuuuauucuguuuagcagaggaaaaaaaaacccgaaacaauuuuuaaagagucuuuugucuugggaaacaaauguuuauuauaaauuuaacaauaaauacauaaucuuucaguucuuuaugaaguugacuugaaugguauuuugagaauagcucucaaugauaacacacguuugucuauaauaccuacccugaauuauacuggaagauggaguucaguguggagauuagugucuuccaugaacaugaggauggaaguguaucaagaaccuuucuuucuaaguaacuauguagguugugaauguguucuacugccuacauucuucucuguauuagugguuugcuuuuuuguguccggcaggguauguggggugguuugcacuaugcuaaguaagugaucugccagugaacuacaauaccccaucccuuggcaguaacauugguuggugaaacaggacucuguaagccuugaacagcccaggguucccuugaguacaacaucuuacuagcacugaaaggauagacgcacacuguagcuacuuuuuuuuuuaaggguaaaaucuauuuuauagcaauuauaugucacuuguauuaguucuguugaguuuauuuuuccuacuugguuuuguguuaucuuucagucaacauagcuuguggaauuggacaaaauuauaucugguaaaucagauucaauaaugauacuuuuaaaauguauuucuuguuuauauuuuucuuucuucaauuuccuugaaucuuauuugcccucauaguaugauuuuuuuccuagcuauaaauuccauauuuguuucuguucuagaucagugacuuaagagagguuuuaucuacaguuaggguauucaaacaaaaggucuuuuacauaggcaaauccucuacacugagcuacaguucuagcccucccauuaaaaaaaaaguguagauuaacauuguaacauaucaaggccuugacaggguugaauuccccugccacuuguucagagcagucaacauaacuaaggcauguccuuuuaauguaaaguagguaaauacaguuuuuauaaacugauagauguauauucuucaaggaagaugcuuucagaaacgagaugcagcccagacuguccucagauuuaugauccucuucccuuagccuccugacugggauaucccgacucucgacuuguuacacuuuuacacagcaaaaaggcuuaggggcucgaagaguggcuucugaguguuugccggacaucugacgcccuggucucaaucuccagcacaguagccuucccuaguaucccacacuguagaugcagcacuugagagugggcgucaggaaggaggaucacaaguucaaggucauccaaguuaaaaccauugagagcagaaagugcugucaaagaggcacaguguacguacgacuuagcaggguuuggagucagaacagccuggauuuugauuaggacucauuacagucuaggaugagagcagagaaguaaccgaaggaugcuuuacaaauuaggacuguaugaaaucaguaauuagcuagcauuuuacaaagguagcuuccaauaaguauggcuuuuuuucuuucauguaaucaagauguuguaguuugucguuccaucuuuugaggauuguaacuuguguuuauuagcaccaguuagguaauugagcucuaaauauuccugguggaagccagcuugaugcuaggcaguacuccaccauugaguuuuaacucuaagugacugucugccuauauauauauuuuuuuguuguuguuuuuuuugagacaggguuucucuguguagcccuggcuguccuggaacucacucuguagaccaggcuggccuugaacucagaaauccaccugccucugccucccgagugcugggauuaaagguguacaccaaccacugcccggccugucugccaagguugaggcuuaaagugggcauagcuuuggcuagagugacauucaguugcagacuaggcuuguccugccaaccuugugcuuuuucugccauaacuugcuacuuguuugguuucuuuuucuuacuugcuuuuuccuuuucuugaccaaaaaaaaaaaaaaaaucauuagaaaagggucuugguuaguccagccuguccuugaauuccugaugcuccugccucuacuuuucuaugcuacgauuauccugguucuucagccuucccaaugcugugauucuuuacaguuccucauguuguggugacccccaaccauaaaauuaauuucaaugcuacuucagcuuuaauuuugcuacuucagcuuuaauuuugcuacuguuaaugaaugguaauguaaguaaauaaccuguguuuucugauggucuuuaggggacaccuguaaaagagggccuugacccccaggucaagguucuuuuuacuuuuguagcauuuuguaacauacaguaccaacuucuggaaacacuauagggucauacaaauugagauaggggauucugacauggccucacucaugugcuggcuggauggaaggguuuauuuugucuuacagugugagguugcuguuaaucaugguggugaagccauggcaacaugaaaaagcugguaacauugcuccucugugguuagcagaaaggcgaaugcugauacucagcucacuuguuuguuuguuuguuuguuuguuuuuuccagccaggguuucucuguguagcccuggcuguccuggaacucacucaguagaccaggcuggccucgaacucagaauuccgccugccucugccccccaagugcugggaucaaaggcgugcgucaccaugcccgacucagcucacuuuuuauacuguccaggauguccagcccauggaaugguaccauccauguguaggguagggcuuccuaccucaguuaccucaccuagaagcucccuuacaauggccagggguucguuuaugugauuauucuaaauucuaucaaaucuacagucaggacucaucaucauauuacuuaaaguuuuuggaaaaccuugauuugcacaugucaucuagcucuggcugucuuggaguucuauguguagacgcugaggcuggccucugagucacaaguucugcuugccucugccucccaagugcuaauaaagauguuuaucaccaaaccuggcuuuuuuauguauaagauuuacuuauagaauuauuauuauuauuauuuuuuuuuuugguuuuucgagacaggguuucucucugucuggaacucacuuuguagaccagguuggccucgaagucagaaauccgccugccucugccccccccccccccccgccucccccgaguacugggauuaaaggcaugcgccaccacgcucagcuauggaauuacuuuuauagugagucaugguggcuuauaccuguaauuccagauuuugggacgaugaggcaagaaggacuuucuguugacuuuaugccagguccuuccucagacacacucucauucauucucucucucucucucucucucucucucucucucucucucucucucuguguguguguguguguguguguguguguguguguguguguaagauucuuuguguuuacucaaucuaaagcuacaggaggaacacucaguguguaauuuuucuuccuguucuaucuuuucgagucagguaucaccauauauauauagcucuggcuggcuuggaacuguguagagcagccuggccucauccucuugugcauaccucuccugggucggggguacaggacuaaaggauuccuucaccacaccuggcuagauuuuccucaaguucuguuuuauauuguucuggucaggaguaaguugguuuagaugugggcauauuucacuuuaaaaaauuuucacagauauauacuauuugaaaggaagaaaaaaaaaugccuucucagaaaguaucucuucauauuacuuauuagccuccaaaguggaaguagagaauauggcauagugugcugcugccuaaaaucuacuugucuucugccacuuuuaaucccauuuaaaacaacugagucauagcuuuuaauuuaaucuuuacuuuccccuccauaauugcacuuaaaauauuuuauuuucuauacuaguguuucuugguggaucugaaagugggaagaaagauguuaacuucucauuuuguuuuuaguuuagaaauccuccuuauuguuuauauuaagugcacuuuugguacuagggaacuaaauuaaaaaguaacaaaggcguaaaagagaaaauguauagauuaacuucccaagcaguuucaaaccuugaaaguuucaagggaaucauaagucauuguauuaaaaggaaauuauguugauauugaagcugcuuuguaaacaguuuguuauacuugggcucccuggaguuccuuagauuugacuguuuuucuugagccguuuuucuucuguauuaagcuuuguggagccugaagcugcucuucuuaaggauauuuuauuugucuuggugaaaauugccugacauagaauagauaaaggaacaccucuuaacuguauugagugucagugugcuuagaauuuauagauuagaguugggaggaaucugaaaguauguuuuguuuuuuaaauuuuguuugacugcaccauuuucuaguugccccacucaacuuacuauuuuuucauugaauuucauguuuuuacucucuauaaacucaaaagagaacaacuuggccgaguacaugccacaugguaguuaagaacaugaguuagucugggagcuguugguaaguuuuucuuggacuaaacuuuugagaaguuaccgaguuucuguacuucugguucuucauuucugaagagauguaaaauugagccuauuucaggucauuagugagcuauaccugcccuaugccuaguguguagaaacucagaguaaauaaaaacuaccaucauuccaaucauugucuucuuucuccugugguacuguauaguagcuggcugcuggauuccucugaaauccaaaccuauuucuacuaaaaaccagauuggcaauuacagccauguuagugaugacggaagcuggucccacaaagguaaaauauucccaaauggauacagugucaaaauaaaaauagcagguugaucuuagcuuugugcaucaucagaaacuccuccaggacucccaagacauguuaccacuacaaaugaaucuaauuguuuugguugacuuuauaggauauugugguccuuuugguacagcugguuauaauuuugauucuccccacccauaccccagaguucuguacucugcuucuaacuggugucucuuuuuuuguuaaguuuuugagacaguuuuacuguauuguccaggcugacugucuuaguuaacguuauauugcugugaagagacaccaugaccagggcaacuuuuaugaaggaaagaauuuaguugggguggcugguuacaauuucagagcauggugcuggagagguagcugaucagcaggucuacagagugaguuccaggacagccagagcuacacagagaaacccugucuuggggugugguggggagaaaaaagaaagaaaaacaauaacagaaacccaguguagccccuuaagcuucacuacauauuauacucuguguuaggguuucacugcugugaaccggcaccaugaccaagacaacucauguaagaacauuuaauuggggcuggcuuacagauucagguucaguccauuaucaagguggaagcauggcaacgcccaggcaggcauggugcaggaggagcugagaggucuacaacuucaccuggaggcugcuaggaaaauaccaacuuccagguaccuaggagaaggguauuaaauaaagcccaagccccaguggcacaccuccuccaacaaggccacacuuccuaauagugucacucccugggccaagcauaugcaaacuaucacauucuggauugcauguagaauacaucacaauucauaauagcaucaaauuuacaguuaugaaguagcaacaaaaaaauguaugguuggagucaccacuacaugaggaacuguauuaaaggauggcuguguuaggaagggugacaaccaacguauuauacucaucuguucauuauuucuaguuuuuccuccuuucuacuuuuuaagugcuggcuguuuuggucaguauuuuaauacuuacucuuucaaaauguugugauuuuuuuuuuuuuuaaauuguacuuccauaucuuuaguuauggguagucaugggauuguugagucaagaguucaacugcuccugaaaauauuaucuuugugggaguccguuucauaguguccuuauauaaauguagguacuauggcacuguauaccuaagcuacaugcuguggucuuucuuaugugccuuuauagaguaugacuugucugauaguugagaacagccucuuguaaaagcuaggguguucuuucucuaugcucccagaaauaagacucagauucaaaauauauuuacaaauaacuuggccauguaacuaggcucuucucugacuuaaaauaaccuauuuauuuuaauucacauucugcuaugugcaugauuaccagugcucagguaccaugccucuguucucauaagauccuccugggugaauccugccuggaagucucccagaauccuuucugccucuuggaugucccaccuccuauuuccugccuuuaggccaucaaauuuaucaucgacaggugccacauccauacagacacaagacauucucucuguagccugcaacugacuuccuccuaccuuuacuuuauuaauauguuuuucgaaagaguuggcuuuuacuuaauuuagaugcaggaucucauauagccaggagguagcuugacuuugcagccgguggugaccuugaacuucugcugguccccuugugucuauggugcugauaguguagaccugccacuccacgcacagcccggcuauauuauuuaguuuucauuuauaugugugugugugugugugugugugcgugcgcguggugcgcaugcauguggaggucagacuugggugucuuccucaguugcucuccaccuuuugacguaggaucucugacuguucagcugugguuaauguuugaguuucaggaauuugucuuugccuccccagcuuggggaucccaggugcauaccacuguacacaagcuuuucaucuggcuuuuuauaugguguuagguaucugaacucacgaagcauuuuacugacugagccauuuucccagcaugccuggguuuuauucuuaugaagagauauuuuauaaaucaauuuuuugaaagguuuuauuccaaccaggguuuuauucuuuuuuuuuuuaauuuauuuuauuuauaugaguacacuguagcugucuucagacacaccagaagagggcauuggaucccauuacagaugguugugagccaccaugugguugcugggaauugaacucaggaccucuggaagaacacagugcucuuaaccgcugagccaucucuccagccccaggguuuuauucuuaagaaauauuuuacaugucaauuucuuagaaaggauuuauuccuauuugugaaggaguggaagauuuaugugguauaagucaguuucauacaguguccuucuauaaauguagguacuguggcacuguauaccuaagcuacaugcuguggucuauugauucuaaguuacaugccugcauaacauauuacuguguggaaugcaguaagcaguuguaagacaaugaacauuuguguauccaaacagaagaggcacugugaaagccugugucccugugagcgguauugaugaaugggccuugcaggauuagaaguugugugugagucagugaugaguaggaagacuuagggcauguuggcccugggacuguggcagaauccacaugggacacacugugggaccgugggcuguuacugucugugcuagcuuguuaucauagugauagugugucucaugcauguauaguuagaugauccuaacacucuuuucugaagaaaagugaguggcaccuuuuuuuuuuuggcuguaguuuuuaaggaacccuugaaaaguguuuuucacaauaauuauguuuguagggcacuaaauaauaguuuaguacauuuauauguuacauugauuuaaucaggcuaucaucucacacauuuaguucuuuuaaaucuuuguuauuuuggacuauaugaacaguaguuacuaaugaccuaagccuguaaucccaccugcuuagggcugaaauagaguggccaaguucaaccccugcuugagcuacaggaguucaaguaacuuuauggcagaacaaaaaguguguauguauguguggggguggggagacagauaugaugguucucuguuaaucccagcacucuugagggaguggcaggaucugucuacauaguaucagguuagucagagauacagugagaccuugucuaaaauagugggaaaaggagcuaugugucucauuuggcagaauauuugucucccauccagaaaguccucaguuuagaagccuagcauuugggaaguagagacaggauuggaagaaguucaaggucauguuuggauacuuaguucaaggugagccugagcuguaugguacaaggaaaagaagggugggaaauacagguaauggaguguuugccuagguuguguaaacagggccguacauucuauccucaguaacacaugugcgcgcgcgcgcgcgcacacacacacacacacacacacuuguuuuacuuauuaggcuuagggguuuuuuuguuuguuuguuuuuugguuuuuuuuuuuuuuuugagacaggguuuuauuuuuguuuuuguuuuuuucuuuguuuguuuguuuguuuguuuuuuugagacaggguuucucuguauagucuuggcuguccuggaacucacucuguagaccaggcuggccucaaacucagaaaucugcuucccucugccucccaagugcugggauuaaaggcgugcaccaccaccgcccggcaggcuuaguuguuauaugcaaugcuuaguaaaucuuuacuucauguuuuuauguuugcaaaauaauucccuaaaagugcagaagagcuuugucaagaguuuaaaacaaaaaagaaacaaaaaaacccuuuguauauauuauguguauauguguucagccugcauguaugucuguacuccauguccgugcaaugccuguggaggccagaagagaauauuaaauaccuuaggacuggaguuagagacauagauaguuuugaacuguggcuggugcuagggguccuugggauaauugacagugcucuccagcaaucucugucagaucuugaaguagaaauaauacagaacuuuacuuuccauguccuugcuucuucauauacccuucugucacugcuugugcugugcugauuggucuugggcccuuggcagauacuuugcagggaugcuuuacaucuggguacaucugcauucuuagugucucagauugcucucagauggucaagcaugcaucauccucguguagagacuucuucucacauuuuacgugugcuguucuucucuaacagccucaguccuaaccaccugucaucauuucuuucuacuucuguguuacuuauggauccuguacacuucacaguucauaaccagggcauguccaaaguacaguuuguucauucucugaacuuuuucaggauagugauugucucucuccccuuucuuuuggcaacccuuccccaugcggugacacaccccuaugccaguccauauuaaauucccuuuucauggauuacaggagacaauuuaaagucgguugaguaaaugguaaucuuaaguacauuucauuuauuuuaauauuauuuucacauuacuuagauuaaaauagaauaacugaaauuaauaaguuaucauugcucuuaaaguaaucugguguuggaaaauaugcaacuuuauagcaaagucagauuaauaaauuaguauuguuaggugagauacccugcaagacaugcugcaagaguauuaaguucaguugcugcauaguugaguacugcucuguuggagaauaagaggcauguuggaaauacuagauaaguauuuuaauauuugaaaacauuucuaccccaguugcacacaucugugaaacuuauaaacuaauaagcauauagucauuugauguuuuuauuuuggcagaauauaguaucuacagcuguuggaagccuaacucaagccacuuuaguaucugagguuuuguaaccuugaauuauuguacaccacuugagugacuuccugggaaugacugggaagagcguuguuuagagaugucgcuuccauucuuuuuuuuuuuuuuuuaauuauuuugcuguuugugaaacuuguuuaaucauuguaaauaaaguguuucauuuucaaguagaauuaaagauaagguucauguauguacuuuuucuugcaaggauuuauugccuuuuaaagguaaaaaaaagaaaagcuuaugauuaaaaauuuaggucccccccccauccuuccuguuuucauuguuuuugaucuguagccuacaacaugcuuugcgaguggugagccacauugaaggggggcacucugaccucaaguuagaacacugcugggaucugaggagagcucaaugauaaacuaaucaaucauguccgcuguaggagauacugcuuucaucaccucagugucacauggguuguuaaauagagacaaaucuauaccugacuuugccacuuuggaaaagucaggacacaggaagaagagaggcauguaucauuuuuagacuauuaugccucaucccuugggaaagguguacauaguuuuggauauuguggugaagagaugauuuaguuaacccuccccccuucccugcuuuuuguaaguuagaauuccuuugguaagugaagaaggaaugucuacaaaaccuuauuuacgaccuauacaguggauguaguaguguauaucuguaauucuggaacccaaaaaauugaaacaggaggaguugaguucaaggucagucugggcuacauaguagaacccuggcuuagcaagaagccauccccugcccccuacccucccacauacauauuuguuugauggcugauuuuuuaaaaauaugacuauaaaacccaucuucauuucccauucuucagucuguucaguuccuucucuuggaggcaaccucauaggagucucuucuuucagauaguuacccagaucuuagaaccuuaucuauccuacuucauauauucuuucucccauaacaagcuauaguuucuuaguaacuauacaauacucuauugaguagauuuugauuuauagauuaaaacaguuuuaagacaaggucucauagcuuagguugaccucaaacuccauaaguaagaugaccuggaacugcucuccugacucuaccuccuggguauuaaagguuccuggcaugugcagccacaccuacuuuauguggugcuggcgacgcuugcaugcuaagcaagugcucaucuuuucugugucuauuuguugaaauauuuacaaguaaaguuuaucuguaagguacaauuguuuucuguagggaugugccuguuuaggacccccccccccccccgcaggcccuuugugucuguguugccggaaggagcacaaagcaaagccagcacaaucaaaggaacacaugcagugacuuauuuuuauuaaaaaugauguguaugugucaucccaaacuggaauagugagcauugagcuaacuggcuugguuaugguggcuucccaucuuuuaucacugaucuagguaugaugacugucucaucccacuggugagaguuggacuucacagaauuggcuaacugcaaaggggaagagagaaaggagguucaggaauuaugggccuuugucacacuaacuaucugcauuuucuucuuuuuuugguuuuuugagacaggguuuuuauguguagccauggcuguccuggaaauaacucuguagaccaggcuggccuugagcucagaaauccgcccaccucugccucccaagugcugggauuaaaggugugcgucaccacugcccggcuaacauuuuaaaagugguuaugacucuuacaaauacuauguucugagauuccauucucucuauuuuuuaaacacccaggguuucuaacagcccugacuguccuggaccucacuagguagaccaggcuggccuugagcucacagaucagccugcugccucccaagugcugggauuaagggaguguacuaccacaccuaacccuguuccauuguucuuuaguuauuuuuguggugccgguagucaaacuuugugcuuuugugcagguguuuagacagcauguauaugucuguacacaacuuauuugccugguacuuguagaggccagaagaaggugucccuaguguccuggaacuggaguuagagaugguugugagugacccugugcugcugggaacugaagcucugcaagauucuggauuuuugagccacgguuaaauuucuuuccaugauaaucauuuaaagcaaaugccgaccaaaaacagaaaacccuacccuguuuuuucuccuuuuugauuuuauuaauaccuacugacccagcugaacucuguuuuucuuuucucacuaccguugaaugcuaccuagaauuuuggggggccagggugguaaaauguuuuuuucuuucuaaugaaaugacaguuccauguuuaugguaagucuucaaccuaccuaauucaaccauaggggucccuggcuuuuguccuuugguuggguguaaguaucugcaucugacucuuaguucuuguugggccucucagagggcagccaugcuaggcuccauccauagcaucaguaauagugccaggccuuggagccucccuuucagauggaucccaaguugggccugucauuggaccuucuuucccucaaucucuucuccguuuucgucccugaaguucuuuuagacaggaacaauuuugggucaguuuuuaacugugagauggcaaccucaucccucuacuugaugcccugucuuccugcgggagauggacucuacaaguucccucuccccacuguugggcauuucauccaaggucccucccuuugaguccugagugucucuuacgaaagucucugguacauucuagacacacccccuccugacacccccccuugccuguuuccauucuuucugcuagcccucagggcuucacuccugaucccccuccccgcaauaccugaucauguuccuccuuuccccucucuguccccucucccacucagguccuucccucccucuguggcucccugacccccauugcuuucuucucccucccaagugggauugaggcauccucacuuuggcccuucagcuuguugaccuuuuugauuguauccugaguauucugaacuuuuuugacuaauuuagaguacacaccauguaugcccuuuuggguuugaguuaccucacucaagaugauauuuucuacuuccaaccauuugccugcaaaauucaugauauccuaguucuuuaauagcugaauaguauuccauuguguaacugaaccacauuuucuguauccauucuuccacuguaggucaucugggugauuucuagcuucuggcuauccacuaugaguauagucgaacacgugacccuguagcaugccugucucagugcucucacaacaaaauaaauuuuuuuaaaagauguauuuauuuauuugacauaugugaguacacuugcugucuugagacacaccagaagagggcaucggauccccauuacagaugguugugagccaccaugugguuccugggaauugaacucaggaccucugggagagcagucagugcucuuaaaugcagagccaucucuccagcccuacaguguuuccauucuucauggucagaguuacuacaacaggaggaacuaacuguauuaaaggaguugcaguauuaggguugagaacuuaaaacauuuacuguccuuuacugucaguauuuuucauaagccuguuagauuguuucaauuagucuuucugauagugugaggacuaccucgaacauuuguaaccccuacaagacuuuucuguaauacaccaacuuuagcuuaucccccacuaguuuauaaauaaaugagacucaggcaaugguuauuuuacuuggcuuugacaauuacuggggguaaccgcuagucuauauuucuaacugcuggccuggcugccuccucagugguguacccaaauacuugcuguuuauucuggccacaugcucauggcucaucuccccucauggcagcuucuuccucucuucucauucuuccuccuucuccaccuggucucucgucucuccacucacucaggcaacauaaaaccuaccuaucucuaaucccuccacuaauugguuguagucaauuuuauuuaaccaaaguuuuaaaucaagaaucaagguuugcacaacaaaagcuuauacaugugagaaccuucuccuagaguacagaauuuagaguacauuccaguacaaagcaacagaucggaucucagcacuuacuccaccguuuugaagcauugccuuccaucugugaucucucugcuccuacgaaagcauugcuguuuguuccaggcucagcaaaccugagaaaccuaauagucagaaaccuaguugucauccuuaguucuccucuuccuucuccucuucccuccuucuugauacaggguucucuauguagucaggguggcuccaaacacagauaucugcuuucuuuugccuggugagugcugggauuaaaagguauguaccauaccaccuggcuaaaaauacuguuauuuguuccugucuuuagucuuaguauacaucagaaacugaguugucagaaaucuaguaguccauccuuaaugcuaauacauuaaaguccagucuaucaccaaauucuauuguuuuauaagauguguaugugugcccagcgugguggcgcuugccuuuaaucccagcacuugggaggcagaggcaggcggauuucugaggccagccuggucuacaaagugaguuccaggacggccaggacuauacagaggaacccugucucgaaaaaaaccaaaaaaaaaaaagaaaaagaaaaagaaaaagauguguguguuuuuucugcauguuugugcaccucuuuugugccugaugcccuuggagaccagaagagggcaccagauccuuuggaacugguuacaaaugguucugagcugccauggggugaugagaauagaggcagcuagcuaucucuccaguuccaaauuuauauuuaaaauuuguaucuaaauaaauuucuaacagucaccaacaacuucauugacaguacaaggagccugugaacuaaccugucucuuccuagucuuguaacucuggaccaucauggccggcuaguacuucuuggaucucuuagugugcucccccauccucuccaguuuacuaauuuuauguaaaccuuccagucuuuuaaugcggcuugccaacuguguacuuuugauguaaucccacuccucuuuguguauguucacacaaagguuaagauuguuguuagagguguuuguuuguuuguuuuuuauuguucuuguuguuuguaugacuggguagcccaagcuagccuggaacucacucuguagccaugaugcccuugaauuacaucuuaguacauaaugcuuuccaagugcuaggauugugggugugauauuacaccaaggcuaagaucuguguguguggaaauaauuccuugcugauucuuugaaaccugggauauuugaaaggaacagcuugcuuccuuuugugcaaagaaucccuuauggccuuccuggugcaugaaucugcaaguuuauuugcaagugaugaaccucuuucacaggguguucacauugcaauuuuacauuuucugaguuugauuaauguauuucuccaguagacuucaaacaaguucauugaaggaagaaauggcauccauaugucauauaaggggcauuuuugucccauacaaucugagaagucuguugcaauguagugugguugaaauguuuguuggacaaagcaaucagguauucugaguaugcuaugaauagucaacacuagucuuuuucuuuuucuuuuuuuguuggagacuugcgucuauuuuucauucuauugaauucacaccuuccaauuguauauaacaauucugaguccugcagcaagaauaccagaacucuucuucagcuguuuguguagcuguagcacuuuagaauaauuucaugcugccuauauagaucuuuacccccaaaaccaucuuuuuuaaauguguuuuugcuguuugcuguccagaaccugauguagaucaggaccaguaaaggauaaauccucuuuaacuaaugauguuaguauuuaugucuucucuuuguuaaccuuucauuaacucuuguuaacaguuuuauuuucuucuuccuuuuuuuuuuuuuuuuuuuuuuuuuuuugagacagguuuucucuguguagcccuggcuguccuggaauucacuuuguagaccaggcuggccucgaacucagaaauccgccugccucugccccccaagugcugggauuaaaggcgugugccaccaccacuggccuaauaguuuuauuauuuucauagaaucgccuuaaaucuuaaauaaaaggcgauuucuauuaaaucacuuaaauaaaagugauuucuauuuuauugauaucauuaguuuuaaaacuaccuuuuaaauuuuagacaaggucucucugucauucuagcuggcuuggaacucugaagaguaggcugucaacagacucuuccuguuacugugccuggcaguuugacuuuuaaauguuuagguagggaguguguguguguguguguguguguguguguuuuggaguaggggagggguucucuccuuuuggcaauucccugagguuacaugcccuacccacugagcaauuucaugaccccucuuuuuuguuuucauuucuucugcuuacuguagguuuaauuugaucuuuuccuguguguguuuuaaaacgauuuauuuguuuguuuguuuauuuauuuuacuuuuugguuuuucgagaaaggguuucucuguguagcccuggcuguccuggaacucacucuguagaccaggcuggccucgaacucagaaauccgccugccucugccccccaagugcugggauuaaaggugugcgacaccacuccuggcgauuuauuuauuuuaaguacacuguugcugacacaccagaagagggcaucagauccuauuauagaugguugugagccaaugagugguuccugggaauuaaauucaugaccacuggaagagccguuggugcucuuaacugcugagccaucuccagaccuucuuuuuuuauuuuuauauaauuuaaaauauuuguuuccaauguuacauauuuccccccuuaaguauugcuuuucuguaugucuaaaagucugauguuguauuuucacuuacugguuuuuuuuuuuuaagauuuuaauuucaauuaugagaauucacuuaugccaguguguaaguauguacaugugagugcacuugccuaaggagcucagaaguugguuaccccucaaggugggguucugggcaauugugccauccaacauggguacugggaaaugaauuuggguucugugcaagaguaauaugcugaaccacuucucuaaacuuccccagcaugauuuuuuuuuuaaagacuuuuucuuuaacucaugccuuauuuagaauuaacuugguuuauaucuaaguauuuacaagaucugguaguccuucugcuaaugauuucuaauuuaauuuuauuagaguuugagagcauaucugauaagcuuucuaaucuuaaauuugucauguuuguaugacacagaugucugccuuguuggaugugugagcuugagaaugccgaauguguucugcugcaguuaccagcgugguugguagauagauagaugugguuauauccagcugauagauguaccguugguucauguuuucuuauuggguccuggagucuccucuuuaacaguagauuccaugucucucuccugcaggcugcauuugucuugaauuuuggugcuccauuugcacaugcacacauauuaaggauguuuuuucauuauuuaauguucuuuuguauuugauaacuuccuuugcacugaagucuacgucaggcaauuaauuuagcuaauccuauuuucuuuucuccgauuaaguauauaguauuaauuauagucauguagaauuuguuuuguuaauuuuacuaucuaucuugucuuuuauugaaucugguuaggaucauuucuucuuacauuuugucuuuuagugugucuugugacuuuguauuaagagccuaggcauaaucugaguggaaaagaugauguuaauagguguuuagugugcaguuuuauguuuagcugacuagaauaguuguucucaaccugugaguugcgaccccuuugugguuaaaugacccuuucacaggggucacauaucagauagccugcauaucagauauuuauaauuuauaacaauagcaaaauuacauuuaugaaauagcaacuaaaauaguuuuaugguuggggggucaccucaaaaggaggaacuguauuaaaggaucccagcauuaggaagguggcuuaggaauuaagacuguuauucuagguaucagguuaaaauuuugucugauagucguugagugucccuagagagcuuguuaagauguaguauccuuuugucaguugguucuuccuuguuaucauaggagccucuguuaguaugguggcaagguacuagaagaaguguggggaaguauucuauggaacacugaggugucagucuuacaggcugugacuuuggguuuucaucuugucaagugcuucucaguguuuaaccuuauccccccucauccugugacagaaggcaagggggguuaugaguuggaucuguaucucuucuuuuagguaaguacaguucugguaaaccccaguaguuuagguucugguaaaauaguuacuauuguuaagaacagaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagucacaaauaauauaaaauaucucggcgugacucuaacuaaggaaguaaaagaucuauaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaagucuucucaaggauaaaagaaccucugguggaaucaccaugccugaccuaaagcuuuacuacagggcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauauggguacaggggaaaaauuccugaacagaacagcaauggcuugcucuguaagaucgagaauugacaaaugggaccuaaugaaacuccaaaguuucugcaaggcaaaagacaccaucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaaugcucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauauuacuaccggaggauccagcaauaccucuccugggcauauauccagaagaugccccaacugguaagaaggacacaugcuccacuauguucauagcagccuuauuuauaauagccagaagcuggaaggaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaagauacccaagauauaagauacaauuuccuaaacacaugaaacucaagaaaaaugaagacugaagugugaacacuaugccccuccuuagaagcuuggaaggaguuacagagacaaaguuuggagcugagauaaaaggauggaccauguagacacuagcauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaaaaaaaaaagaacagaaugucacagaaagugacaugaaauucugggcccucaugcaucagauagauccagaauggcuacuuagucuucuagaagcagaaggaauuuuucggaauuuuugcccgagaacuguugugauuugaauaugcugggcuuagggaguggcacuauuaggaggugugaccuuguuggagaaugugugucacugugggggugggcaaugugaccuuccuaaccacgagucucuuaggggccuucagauagauauaaaacucuuaguuacucccguacaaugucugccuggacaucuugaugauaauggacugaaccuaugaaccuguaagccagcccaaauuaaaugccguccuuguaagaguugcguuggucauggugucuauucacaguaaaaccuuaacuaagacaagaaucauucucauccagaaaguaacgcaaaaaaguuaggauagggccuuguucuuccucugugguacuaggucauugaacccggcugagacuugggauaugucaagacaaguauugcaccacugaacuacauuccugguccagggugucuagcaccaggacucucaaauuugucuacagugagauggcaacaguucaccaauucaguuuagguuuucccacccuguucuugguucccagaaaaugagcuugcuugcccuucagcccuccuugcccccucucuccuuccucuuuuccuccuuucuuuuuccauauuuauuuauauuuuuguucuuucugagagaagaggugcccaggcuggucuugaaauucuaggcccaggcagugagugacccuacuugucuuuggagcagguggggaugugugugcuugaacacagcaauccaguucuccucacacugacuuuuucuguucuugguuucuucagaaaguuauagcucucuguacuugcccaucagacaaaaugucaaggguagcagccugucucaugacuguaaauuuuccccuuguuuuuuuuuuuuuuuuuucccaguucauuuuuuuccccauuuuuuauuagguauuuagcucauuuacauuuccaaugcuauaccaaaagucccccauacccacccagccccacucccccuuuuuggaauuuuccccuuguuuaacagugaaaaguauguaguauaauuuucauauauaaugagaaugcaaccaauuaaaauguuucaauuuagcauguagaguuugaaccauugucaugcauacaauaaauuaucaguuuaaaauauugucuacauuucuugugauucuuuuaguauaucucuaagcauguucuuuauuuuucagauuuaaaaaaguuacuuuuuaaaaucuuaugugugggcguuuuccugaauguauggcgguacacugugugugccugggggcccuggaagccagaagaaguguagaccccccugucaacuggaguuaguuguucagccaccaugugggugcugugaaucaaaccugggcccuuuagaagguacaaacgugcugagccauaucuuuauagucucuuauagauuuugagaauuuucaaguucuuauaauuucauugugguaaaacaaacaaaaaacgaaaagcaauacucacuauacuaguucuguucaguuuuuaagaguuuuuugauagcucugucuucaugcuugggagguaguaguggguuuucgugugugucugugugugucugucgcauacugguacugguagguaguuuuugagauaggaucuuauauagcugcgguugcuuucccacucaguaaauggaugaggaugucacgaaacuucucuacagcgucuacucaacuaccugagaaugacacuacccccagcugacugggcccucaugcaucaaauaguaaucaagaaaaugccccauagaaaugcccauaggcuagcccgacggcagucugcaguugagauuccuucuucccagauggguauagguuugugucagcaaucaaccagcacaaugauagaguauucuuugguuuuguuucauuauaugauugaagaacauuuacuagaugucaauuuaaaggcaggcagguaguaguucuuucccucuagugaauuagguugugaccuuguacauugagacacuugaaguauagaaaggagugaugacauacaaauuguguguuuacuuccuugauucuggcucaaaagcaaguacaguauuuauuaugaguuacuguauuuaguuuucuuagcauugaaucuuucuuguucacagcucuuggacaagcacaagacuauagaaagcaugguagagcuuuuggacuuguaucagauggaggaugaagccuacagcagccuugcagaggccacaacugaacucuaccaguauuuacuucagccauuccgagacaugcgagaacuggccaugcuacgaagacagcagaucaagguauuuugcuuuucuuuuuuuaagccuaaacuguagccacucugcuuaguaguucagaggcuugcuagccacacauuuuaauuaaaaaaguuuuucuuuuuuuuuuuaaauaaugcaaacagauucuuggucuuuccuuuucaaaguccuuguuaggauccucaguugccauagucuuaaacuuuugaaaaauacugaauucucaguuauuuauaaauacgcacuuucauuaaaaaggugucagaaaccuaagacuggauauuagaauuuacuuaacuuguagaaaugaacuguagacauuuugagacucuaaccugaaaggcaggaaagaacuagaugucaugguugucccaccaguuuggacuguugcaguguugcaccuuugcaauucaggauugacgaguuaagauucuauuaaucaacacggugaguauugaguauccacuugagaaaagcuguagacugucacugucacuccauuuuucuuaggaaccagugggaggaggaacauuuauuuacaugaguaacuuccuuuaagggaaaaaugauauuucccuauacuugcuguuccaagcuguuaccucucacaccauucaaccucuacuguuuuauucuuugggauucuuaagaaugcuuauuguauauauauauuguguauauauauuguauacaggcguauuuccuaguaauucacugcacccaguucuugaguucauagugugucagaugacuaugguaaguggaacuauuacacacauuacacaaugggaucauuuaugucuuugucuguagcuugaaauagucaucaguguagauuggugucauuccaaagacaaaguuuuaaaauuauauuuauuuauauauuaaguuagaaaauacacacauuuuuuaaaaaguaaguauaauuguuuggcaaaguauuuguuauaagcacaacuaaaaucaguugcuuauuaggauuacauaguaucuuguagauaugauacauuuuaguuucacugaagaucauugucuuaggguuucuuuugcugugauaaaguaccaugaccaaaagcaaccugggcaggagaaggcuuuuccagcuuacaauuccucaucauagucuaucacugaagucaagauagaacucaaacugggcaggaaucuggaggaaggaccugaugcagaggccauagagagguucuguuacugacuuguuccccauggcuugcucagccugcuuucuuauagaacccccaggaccacuagccuaaggggcagcacuguuuacagugagcugugugcccccuaccccccaacuccuaguccuaucaucaaucaaagaggccuacccacaggacaaucuaguagggggcauuucucaauugagcuuccuucuaaaaugacucugguuuuguaugaaguugauaucaaacuaaccagcacaauaauugagaauugggacuuaaauagaagauuauagucaagcuagcuauagcaguaaaauuucaaaaguuuuaacauuuuuuuuuacaaugguuaaauuaaaccuaggauuuauauuuuagccccuuuaauacuauaauuccuggaacuauuuuaucuuaauuuauaaagauaaauuauugccuaaaauagagguagaaacacguuucacucugacccauugguaugauguguauuguguguagggauaauuaccaguuuacaagucucgaaguaggaaaaguagcaauauguauauuuaacuacuguguucuuacggaugcugaaauuuauucuacuuuuauguuuuuguauguauagguaacagauuuauauucaguugauagcauuauaaaagcauuucuaaccgguagucuacagugguuuugguuaguccuuaguacugcuguuagcacgucucuaaaaggauugccuugugugggcacugcuaaaccuugggcaggcuuacugaugucucugggaggacugacucugcucugcacccuuuacaagacaucaggggugaaacugaagcuuggcuuguggaacauuuuaugacauuaagcauuucuuagaguagcgucuaaaauaacucuugaagcuucucaccaaaguuguuagaaaaaaaccgugguagaguguaugcucagcauuacagaacaaacaaguuucaaaaagauggauuaaauuaaaaaggaaaaagauugagaauaagaaaggaaacaggcaaaacuuagacaaaaaccugugaaaccaaacuuugguuacaugaaaaacauauuucaguauagguuagaaacuuagucuaaauuuauuuuuaagucagcaaacauagauugugugugugucaguguguguccuuuuucuuuuuugagacagggucucuguuuaugucuccuauuugccccgaagcucgcuauguagaccugacccugagccucucccaguuugcauuuccaucuucucacuccuuuucgucaggguuggucuggaaggcuccccagaaguaaaccaauacagcagucaaauaauagauacacuggaaaaaguuaaguaaaacguaguauucuuagaaaggucguguuaaaaauucaaaggaaucuuaaagguguuauuaggaaaaauaugcaaguuuaauggaauuuugguguauaaucagcaugaaagcugugaguuauagcuuugggugucuaacuggaagguggagcauauuaauagauuggaagauguaauaauguuuauaguaugucaguauguuggucuguuuucugauacugaaacaaaaugucuaaggcagggucuuuucagucccaaggaaagguaaguuaguagucuuugcauggugucagcuccggggagagcaucaguaugacaguguuagguggaggcagcauuggaggugcaagugugaggagaugauggugcagucagucaggcccugagcugaaggaagagucuuuuaccaggcacacccucuucaagagcuuuaccaaacuuccauuacccaccacucugggaacaaguuuguaacagaugaaccuuuugggcuaaggagacaugguuaaacuaugguagugaggucucaauugguauauugaauaaaaucacuuuuaacagugucuuuacaauuuauauuuauuaaguuaauacuuaauaaaacuauuugucauguguuuuauauucuacaaacuguagaagggcaaaauugaacuaguuaacuuaaauaauuagucagauuuuggugagaacaacuuaggaucugcuguuagguuuuuuaaaaaggguauuauauauuguuaaguauauuuucccguguuguaucgaucucuugaacuuagucuuaaaagaaauuuuguguccuuuaaccaaaaucuucccuaugccccaagucccucccuucuacaugaguuaguacauucuacuccuuaguacaggcugaguggcauuuuuauaugugucuuugugugugucugguuaguaccauucuacuccuuaguacaggcugaguggcauuuuuauaugugucuuugugcaugucugugcuggcucuguccauucgucauguggaugagcacgcacauucaucccaucuuuucacuauugugaauaaugcugaguuaauauuggacacacauaucucagcauacugauggcaaguccuuugugcaugcaucuagauguagcuuggaagacuauguggucuguuucuacuugucugaggagcuaccauaauaguuaacaccaauguguucccacagcaguguacaaaaccucuuucuuuacuuccuuuccaguauuuguaaccuuuugucuuugcgaagauccaguuaaauagaugauaccucauugugggucugacuuacuuuccccaaugauuagggauauagaacaauuuucauaugccaauuagccauauguccuguuuccuuagguucuuugccagguuguuguuguuuuuuaaauuggcaucuccuauuuggauacuaaucuuuuaugagauauauggcagggaaucaaauccagggucuuuugauguuacucauacuuuguuucuggcuugcauccucagcuuucucacugagcaaucuggccuugagcuuuggauccgccuuguuggcauccugaguagcaaggauggcacgugccuccugguuuacaguuauauauuucagucuuggcugguguauuacgaagcucugauugggcuggagagauggguugaugauuaagaauacuuacugcuuuuccagaggaucuuaauuuugguucccagcacccauaguggguggcuuauaaccaaccaucuuuaacuccaacuccaaaggaucuaaugcccucuucuggccuccacugucacuuuagcacacacacauaacacacacacacacacacacacacacacacacagaaaaacacauacauauaaauaaacacauaaggcuuuuuaaaaaaguucuugauaauugcuuaucauugaacaaacauucccauugccuaaaaaguuacauuguauuuacaguaucaauaaguauauucacaaaucuguguuggcauuuguuucacugaggaacccgaaguuagguucucccaauaucuuaaugcacagagauaucauaauaguuucuuacaaaaugcaguauccuagcaaugaaguacuuaaggaguuucaugccagacaauuuguauuuauaaauuuguuuuacccugcugacuaccaaaacugacacauaccuuuuuccauguuaaaacaggcucuguuuucucucuagccuugaaauuccaaacagagcugucauuguuuuuagcacauaacccagcugagcagggcugcgguaacaucuucaaguuucccaaguuaggaaaagauguuacgagaggauuguugcuuagugccuugaguacaauaaaauauaauaaaaugauuagccaagcuuucuagcaauuggcugcuaaguucaaaugucuacagagcagcggaggaaacguggugcauaaagcauguuuauauuguuugugaaggcggaggcagacacauaacuaauccaacagcauucagaugauggagguauuguucugcuuuuaaccuccucccacagaagccauagcacagaauuccaguuuucuagauguucauccccuccuuuugucuguugcucagagguacaacguguauucguguagauagaaauaauuugucuuaauguucugagcuaggagcuuugaguuuguauauucuagguuguguuuauuaaauucuauuccauaguaaaaucuguugcaguuugaccagaauauuaagcuagaaaaucaacagugagcauuccaauagaaagauuuguuaacuagguacuaguuaacuaguagggcagguacuuaaggcaagagaguaagcuaccuuaaaggaagcagcuauaaaaagagcccccacaaagggaagggacuggauuuacugaguuaaacacagagaagacuccauggagcuuaauaugcugcuucuuguauuggccuugauggcccacuuagauccagcccucuaaggauagggcacuuaguauucugguauuggcauguuuugguggagaagauagaguugcaacaugaggcuggaguugaaaaagcuggagacuugauuuugucauugaggaagcaacuguuaguucugguguauaggagcaagccugggaggaugccucacugcaguaaggcagagucaaagguacacagauagaagaaagaaggacaccuccaaccuucccauugacaggaucugaaaagcauuugcagacaccaaaacuagcacuagaagguaggaggaggagaugagggaggcugagacaggaaggccucucucuguaccugggauuucaggcaugccacaccaugaucauuuaaauguauuguugauucaauaagguauuugcaaaagauuuuguaauaaauaaugaaacuaugucucuuaacuuugugaaaaaaaucuguuugaaccaccacgcccaguagaaacuuguuuguuuguuuguuugaaagugcuagggauugaacgcaguucuaggcaagagugcugccacugacuuauaucacuggcccuuggaaaaugcaguuauugaacagggagaaaauaucugguagaaaauuugucacccaaagaugacaucaguaguauauuuuauauacuuuuauuucuuugguacucuauuguguaauugaaauuuauuuuaucuaugguuuugaucuguauccaccuacuguuauagcauauuuuuauauuuagagaaacucaauaaacauucauauugaaaagacuugaauuuuaugacugguuauacacagcuuucucauuacaugucugguauucauuucccccuuuaguucaaaaagcucuugguguaaauagcucuggcugucucguguguguguguguguguguguguguguguguguguguguguguguguguguguucguuccuuagaugaccuuauuuacccucaugguuuuauuaaugcuuccuuuguguuacugaugcccagguuuauaucucuggccccgaccuuuacaaaauuaauuccaacauauauaaaacuaaauccuagguccuuaauuuuuaaaguuccauucucccucaaaguaaggguguuaaauuucaguugguuaagguguuaauucuguuucuugcauugcuuagagaauauggcuuguuuuauuuuuacuuuuggaauccauuauuagauuucagugauuugauaccugauguuuuuuuuuauuauuauguuaagaugugccauggaugaguuacauuuaucugcuuuccauuguuuucuaguuuuucuuuguugcuuauuuauuuaaaugugcaaagguguuuuuccugcauguuuaucuguauuccaugugugugcuuggcacccacagaagccagaagaaggugucagauccccugggacuggaguuacagauaguugugaauuacaugguauugggaauugaaucugggucuccuagaagagcagccgguccucuuaaccguugagccaucucucuaaaaccccccccccccuuuuugagacaggguuucucuaugaaacuguagcuuuccugaaccuuacccuguagaccagacuggucucugccuccugacugcugggauuaaaggcauacaccaacacuccaacuccugguuuuuaauccuuaacaguguuauuaacauuccuuccacuugugccucauccuuccaaggacugggguaccagacaugggccacuauaaucugcuuaaauguaucuguuuaaaucaaucuuuuguguaugauaaagcaggauuauguauauagauauaugguucauuuguuuucagcuuuguuguuugugacuuuuauaauacauagguaguuuauuuuuaucuaaaaagaauaaagugcuuauuugggauaugccagaccuuaguuccuuuaaaaaaacaaaaaacauaaaacaaagggaacagaaauuuaaaagagaauaacuauuguaagugaggaaauaaauuacucauugucuuugguuuuacaagacaggguuucucgguguagcccugacuguccugcaacucacucuguagaccagacugccucugcugggauuaaaggcgcgugccaccaugccuggcaauuacucauugucuuaacacucagaaaugaccaaaugcuguguauuuauuuagcgggguagggauggggaugggugggaaugggaagauugacaaagguagaaagggaagaauggaggacagauuccuauguuagaagucuucaguacuguuguucaguuuaaaaucacuaacuucucuucuagagcagguugcaaguaguguucuuuauuuuagcacuaagccugacuauggcacauuacacccauaaaauguuugaggaaugaguaaaagauuuccccucuuuucucugaagauuuccauggagaaugauuauuugggcccucgaagaauugagagucuacagaaagaagaugcugacuggcagcggaaagcucacauggcuguuuugucuauucaggaucucaccgucaaauauuuugaaauaacagcaaaagcucagaaagguaagcuuuaagacucaggcauuuucaaagaugaguaguuaaguuuuuuaugauuagaacaaagcgucuguguaugccauacccauucuuuaagucaauagcaaaagcuagagagagcuguugugggguagccaccaagaagacugcuuggguuuauuaccccgcuggauugcacuggguguuugaaaucugagccuuucuuaggaugaacuuuuaagcagaaaacuauguucuggguucacauacuucaguuaacaauuuuagucugccagaagcagaacuacagaagcaaaaagcaaggccaguacguuuagagacuuucccagagcuauggcuuuugauggauuaggucuuuguuuuuccuuugucaggugguacugucuaugugcugaguuuuauggccuggaugccagucaguuuugauaaggucuggggccuacuaaggucugaagccccauuaaaaauacagaaacaggcacaguaaggucauuuaaucuuggauaaagccaauggauggagaaacacgauugaaacaauuucccauguguaugcaaacaagugaacuuuuuacagaacuaaaccucagacuugacuuuaaaauguaucuuaguuaaaauagacuguucccccuguaguacacucuucuuuauugaucuuacaguugcuuuacuauuugaauacaauuuuaaaagauggcuaggaaauuuaaaauggcagaaauaauuuugauauaaaauagacaguggggauauuuucuuugagacccuaaauuaaggaccaaggagaugcuagguggaaaacuucagcuccucuuguuguugucacaguacauguuuacaaagauucuuccucuguuuagacuaacagugaauccaaacgugucuuccugugucucucuucauuugcagccuuucccuaacaggauuuugcuuuguauuuauugaagagcaaagaaacaugauaugagaaagaaauaaaggauucuauucuacaaaaauuuacaagaggucuuuuacugacccaagauaguacucaaaacugcaaacauguucuuuaaccucuauguucuuuaacauguugguuccaacaucuaugguggaccuuugguuucuuuaguauuucuuuuaaccuguuguugccuacuuucaguaaauacauuauucuggauggggggaauggcaguguauauaguuuuaagaucaaagcuaugcauuuagcuuauuauacaauaugacuacaucaaaaauucaagguauaguaauggugguuucauuguuuucuuaaggccaaguuagacugagcacacuguagggaaacagauugaacacagucuaaaaugagcuuaaggcauguuauuuaauaugauuucagguauuugaaagcaagcguuauuuucagaaaaaagcuauucccucagagccacuaagaacagcagugacuauagcagcaaagcuuagaccaagaaaagggagcagaacuacuuuuuuuuggguuuggguuuggugguguuguuguuuugguuuuuucgagacaggguuucucuguguagcccuggcuguccuggaacucacuuuguagaccaggcuggccucgaacucagaaauccgccugccucugccucccaagugcugggauuaaaggcgugcgccaccacgccugacuuagaauuucuuuuuuuaauuuuuuaauuuauuuuuuugaacuuuuaagucauuuacuugacuagauagcuacaguucaguuacuauucuaaaagauauaacugguuagcuuccaaaauugcuuuuaaauaaaguacuugaauuguggcaauaaacaaaacauaagauacugcaguuuauaaaauaacacauaagaaauuucaacucuuauucuuugaguuauaaaaaucaagguuuggcuaaguuaugaacauguuucccauguaauuauuugcauaacucuaguaaugcucaguggcauaagaucagguucuuuuaaaaaaaaaaucacuaaaaacauaaaaagccccuauauuacccguagaauauauucauuuacauuuacauuccaggauuugcuauaucaguuauaauuuuaaaggucauauccaaaggagaaagcaacccaucuauagacuggcauuauuuauuuauuuuuuggcuugugaaauguccuuaauuuguugauguagcaaacaaauuucaacucugcaugcaaaugacagaagaaaucugcucagcaauuagcuuuagaguuucaauucauauaggcaacaugcuauaugugaaaaaauuacugacugaacuacagguauuaaauacugaaaaaaauuaaguuaauuuuuaacaauuaauuuuauuaauauuaauuuuaauaauuaauaaaauuaauuuauuuuauuuaauaauuuaggaaguuuguagccaucagcaguuccauugcuauuucaggugcaauugggaauucaggaauuucaguggagcuguuaguauagugaaccuuguagguaaaguacaugcacaguuuugauagcacaugugaggggaucucuguaaaauugaccucguugguuucauucucguuaaaccgaccgggaccacucaacauggccuuuauuguuccugauauuaaugcauguucucuuuuuacaauaaauucagggccaucagaagguauuaauuuuacauacauagcaucagggccuucauagcuaccauagguuuucuccucuccauccauuauguucuuguaaaauucuauuugagcccagaggagcuuucguauuucuuagccagucccacagcuaccgcagcuguaaucccacauaccgccacagccccuaucccaagagcagaacuucuaaggaagcaaauuccuuauuugucagaacaggaacaugugauuuuugaagacuguaagucaagaaauaccaauauuuguaaaguaagcaccagaagugguuuaauagauggcuguauuugagcaucaguguaggaauggggaagguaagcauaaggaauugacuuacaguuacuuuaagauguaugugacuuauuaaugaaguuauuuauuuuuuaaagaaagaaguucggggauuagagagauggcacagcaguuaugagcacugacugcucuuccaaagaacacagaucaauucccagcacccaccuaggggcucacaacugucuguuaacuccaguuacagggaaccugaugcucuuuucugguguccaugggcaccaagcacacauggcaugcacagacacaaauuuaggcaaaauaccugcacauauaaauagaacuaaaauaaacgauuucugaaaaauuuaaagcaaagcuuauacuaaauucuauauuguaaaagacaaauacuacagaauuaaucaccuuugaaaauacagugagauuaucccauguugcuagucuaaucuccagcuucugucauuuguuaaagugggauuggcauacguaucuggauuucaggaggcaccacugccagugcuccuaucugugauaugcuuuuucaaaaaaagaguuuacuuuagucauuuguaugcauaugucugugugguuguauggaugugacugcagaugcgcauggaggcccaagguauugcuucuggagcuggcauuuuucucucugagcuguccaauauguaugcugcuaauugaccucggguccccuggaagaguuugggagcucauaauugcugagccaucucuccauuucugcguuuuaaaauuggaacauauuagcugucuaucaacaugagcauuugauucauccagucaguccuauuaucacaagcuaagaagcucuuucuucugggaaagaagagggcugugcugccucugagggcuugcugguuccaucugcacuggcacauggcauuagcuccuccggcaucuggucaucacaaaguuuccuaaauguuguuucugaaacuacucuaccuccugagugcugggauuaaaggcauauaccacuauucaagauaacagaauguauauuagacugugcauuaaagacauuaaguuuaucauuugggggagucagugaauauuuugaauauauagggauuagauagauuucagcuaacauauacauauaucucuuuuugcgcauguguguucaauauguucacgcccccucccauuccuaaauguuauuuuuguugauuauuucuuuuuuguuguuuuuuaagacagggucucucuauguaaccuuggcuguccuguaacuaacucaauauguagccuaucauauccagccucaauuuucuuuuauuuuacaauuuauacauauuuuuaauuuauguguguguguauguauguauguaugugagucugugaguuuaugugcaccacauuuuuacagaauccugcagaagccagaagaagugcaucuaauucucuggaagugguuuuaacaggugcuuguguggaugcugccagguccuuugcaggagcagcagacaugcuucccuccucagccaucuccccagggcguggugaagcuuguuucuuugcuuuguuugagacagugucuuacuauguagcucuggcuguucaagaauucacaauguagaccaaacuggccucaaacuugaagauuuacuugccucucagugcugggauuaaaggcauacaccacuacaugauaacagagaaagcacuaugagauagagacauugaguguaauugauugugaaagccagugaaaucgaaaacuuuauaguucuucagugucuaguaguuuugugccuuaauauuucuacuaaauuacuauuaacagcuguguaugaucggaugcgagcagaucagaagaaauuuggcaaagcaucgugggcagcagcugcugagcgaauggaaaaacuccaguaugcaguuucuaaagagacuuugcagaugaugagagcuaaagaaauuugucuggaacagaagaaacaugcacuaaaagaagagguaacaaaagcuaucauuaagaauguugaaaacguaaaacauuacgauuugcauaaauaagauucuugauuuugagaaacauuuaauauuuuuauaacaccauuuugauaauauugucagugaauauuaugugcuuugugcguguguguguaccugugugcauguuuguguguuaguauacacguguguucagauguagaugcauguguuuguguaugcaugaagccuuguguaucauuccucaguugaugaccacuuugaggaaagagcuuucauugcccuaggauuugucaauuaagcuggguuggccaacucaggcauccaguuucugugucuaucgccuaugacaccauacuuagcauguuuuaguuucuuucugaugcugugauaaaauauagaccaauagcuaagaggaggaaagggccucuuugguuuacuuccaggucacaguucaucacugaggaacauccaggcagggguuugaagcagaaacuuguuugcuggcuucuucucuuaacuggcuucagcuccuguucagcuaguuugcuuaaacuacccaggaccaccugcucagggaauaguucugcccacagugugcuaaggccuccagcaucuguuaccagucauuacagcccuugauggauauucacagaccaacaugauaaaaugacaguuacucaacugagauucuuuacgaguuguucugggcugugucagguugacaguugauaauuaggacacauggcucucuucuugucuuaguuacuuuuuauagcugugcuacgacaucaugaccaaggcaugguucucaaggcguagggucugugaccauuauaacagggagcauaguuguagccaagcaugacacuggagcaguugcauuucaguuugaaaaggagcacaaggcagagagccaacuggcgauagugacugucuugaaacuucacaacccauucccagugauauaaguccuccaccaaagccucccaucccuaccaacuggggccagacacucaaacuugagccuguggggccauucauuaucaggggccuauucuccuuuaaacuaccaggcuuuguaccccauuuuuaaaccauuucuaugagauaauguuugugauugcacccacuuaaagauugccaccuguaaagaucuggacacaugguagcuuuuuauuuaacagggaguagcauacaccaagguacaaaaaaggccaaugaauuuucaaugcuuauugaaauaaaaguuucucucuguuuuuguuuuuuuuucuuuuuguuuuuugagauaugauuucucugugcuacucugacuaccuuggagcuugcucuaucaagccgcuggccuugaacucaucaucuuccugccucugccuccugaguacugggcuuaaaggagugcacauccaugcuuaagcccagaagaaagacauguuucuugugguuuccuuauaccuucucugcaucuccaugcugugcccaagcuugagacuaguguacacagacaugugaucugaucaagcccacagaucauuuucacauauauuugucaaauuucacuaugaucuuugaccauaucuuauucauguuuuuucaaaauacagccuuuuuaaaaggcugcgucugggauugagaugguucagugggcuaaagacacuugccuuuuuuauuagggaguguaauuccauuguggaacuuuugcauagaaugcacaugauauccagcacuaaaacaauaaugaaaagucaauagaauaaagccacuuagucacauaauauaauaaucuagcuaucgccagccagugugugcagagaacugcauaauaaagcaauaaaacccugaguuuuaggcauucaguuccacugacaauguaugacuuuuagaauuucgaaaacaauguuguauauuuacuuuuaagaagugucuguccaaauaucuagcugauuuuuuuucuaauaacuuuuuucuuuuaaagaauuuuguucuggauucagguccguuacccaguauaggccugcuuuucucccccucucuugguuagucauuuugacuuuaacauacugaacauggagcuauguguaguggagcaugcuucucauaccuucaauguggagacugaaaagucagggcuugaguucauccucagcuacacaaguccagacucccgugagugugugagaaaguccagcucaccauggcccaccuccuaccagguugaaaguggauuugucaagcucuaaugucugcguuuaauaguacaggcuaaaauuuuauuauauauauaugugaaugaauauuuugccuguauguaugcauguauaccauauagaugcuaggugcccauggaggggagacaucugauuaccugaaacugguguuaugcgugguugucuaccgugugaguaacaaguccucuuaccugcagagccaucuuuccaggccccccauuuuguguggaauguauugcuuuaucagggcuagaggcggauggaucaaugguuaagaagacugaccggaugcuuuucuagaccacguccagugcagcuaacaaccuacuguaauuccauuucuagaagggcccagcagccuugugucuuccuuuaguacuaccugcuuguggcacuuagacauaaaugcaagugaacaacuuuuacacauaacgauuauauuaaugcaucuauuuuggcuuggguauacugagauguucuacaaugacaguuacuaauuuaaaaaaauguaauauagugucucacuguauaguccaggauguccuuguacuuccuuaggcuucucugcuuguuugaaauaagggcucauagauuacccuagaaagcaguucuuuuuacccuuauguuuucuuauucgaguagguaaaauuggaccuugucugggccaauuuacacuuuguauucaaucucugaaggauuucagccccauccuauuuuucccugaggcauuucuacugcacucucccuuuauugagcugguuccuuuuuuuuuuuuaaucuggauuuuccuuuaagucagccgguuuguuugugaaguagacuuuaccuucaucucauuucuuaguguugacaugaucugucugauccugagcuguucuggcaauacagggugccaaaggcaaagaccccugaccccuaacauuagaaaguacagcuuuuuauaaauagaccuccagcguagagaaggaagaggcugaggucuagaguuugugagucugugucgucaacauccaugauuguaacagugugcuuuuaugugucugcauuaugugucugaauucuucagagcauuuaaaacaauugucagucauucuugccaaguuuauguuuguaguauguauaauauagguauugugcuuuauauguauuuaacugugauguacugucagcuuuaauagcuauaauuuaaggcgucuugcauuacucaugagaaaaagaacacauguaaaauauuaaacccauuccaagcaaaugcuuugcccuugaagucuuuguuuguaacauaguccuaccccaugauuuuagauuaagagaggcuuguuuuuguuuguuuguuuugaaacaaggucuugauaguccuggcaggccugaaauuuaccuuguacaacagaggcuggcuuccugcgugcuggagauuuguucuuaaaacaaugucaguauugcauuuucaggugggaagagacaggaccagguaacccagcccuaaccuuugugucgucugggaagacacugagguagugggaaguuaacugcuggaagggaaagucauuggagcucaaacagagcacuguuuuuauuuauuauaaaaagaaaauucuugauaauaaaauuaaaagguuaaaauugugaauuaauauaauugguaaugcuuuucaugaagauaaugaugaacuugaaauacauacauuuuccaaauuaacucuuagguauugauaaucccaugagcauuugaauuuuguucaaauuuaagcugugguggcuugaaugagacugguccccauuuggaccccauuuggaugcuaaucaucaagaagcaauacugcuugagaaggauuaggucuuagcuauaagcuguccugaaggaaacgcuuucuuuuauaagaguggccuuggucacaguggcucgucacagcaguagaacguugacuaagacaaagauuaagcacuguuucuuuugauuugauuuugauuuaaacuucggguauuuucuuuauaguuauuaauugaaguagaagauacuuaagcuaagauacuauuaagggacuaguuauagaagcacaguaacaguuaucagagugcuuguccucugguuagcagagaaugcacaacaacacuucagaaaggagcccaucuucauguaaaaagcuugacagcauuuucucuuucacaacagaaaauuuaagcuaauggucuuuuuugauuucugaguauauauauucuaaacguguguguguguguguguauugaagccaauucauuuauuucuuuccgccuuugccuaaaagcauguaggcaaguucaaaauaaguuuauauuucccuauuugaguuuuacuuuaguacauggaauauugaacacuaucguaugaguauuuaagcucuugguacugucccucagaacaucucacaaugaagguaguaagcacauuuuuaugugaacagaacaacucugugggucucagaucugcaagcuuacuccuuacuucuagagaaaauggugcugucuaguuucuaggugucaugaucccacgacuuggcauaugugagccaucuaacauaaugccugcuuuugaauugagaagaggaauauugacauuuguguuagggugauaagacauugguccccuaaaugugaacaagcuaugauggagacauugaaaguuuguuuugugguagguuauauuaaagguuuuuuuuuuuuuuuuuuuuacuguuuuaugacuguguuuuuauuuuucccuuaugcguaagaggugcccuucucuucuuugguucuaugcauauuuucuaaacguauagaugucucucccugccacuuacauaguggaagcuaaaccuagacuggacuguuguacaagcaggccagcacuuucauagcugagcuguucccaguuccuuuacaguuuagucuaagauaaugucagacugaccuuggacaaauucuuuagcaggcuagccuugaauugaucuaacagauucaccuccugagucgagaguuucaagccugugccuaguucuccaggcacauagccuuaaauggucuucucuccauuaucaguuccacacccagcucaggaaucugauuucauuuuuacuuauuucauucacucauuuguucauuuguuuuguuuuguucuuuucuguggccugcugguccuggaagucacucuguagacuaggcuaaccucgaacugauuccccucccucugccuccugggcgugcgguuaaaggagugugcugccagugccuggcucucauuucuuuccuaaagcaguuaauaauguuauuuccacugcagaugcaaagcuuacagggugguacagaagcuauagcucgauuggaucagcuggaaucugacuacuaugaucugcaacuucaguuguaugaaguacaguuugaaaucuugaagugugaagaguuguuauuaacugcacagcuggagagcaucaagagacuuauaucagguauggugugcauuuaaccacagaaguccacaaaagauagagggugaggagggagugcacguggaucccagcugugcugcuccuagaggaacccuuaaacucaacaguuugggcuacacauggcguuuguaguuuguaguguaccugcuuuguuaaaggauuuucaucuagaaucagaauuugcaguuuugccugugugcuaugugggagagugaggacuguauuuauugaacacuuacuuuguaccagacacugcuaagcauuugcuuaauuuagucugaggucuauuuccuuacccuuuaaucaugacuuagugaagaaucucauucuuuaaccaccacuucuauaacagaaaagagagaugaagugguguacuacgacacuuacgaaagcauggaggccaugcuggagaaggaagagauggcagcgucugugcacgcccagagggaagagcuacagaaacugcagcagaaggcacgccagcuggaagcaagaaggggccgugucucagccaagaaagccuaccucagaaauaaaaaaguauugaaaucuuguuuuuguucauuacuuuauccuugauccaugucuaauaauucaaauuaugauuaguacuaugauuuggccauuuuuacuuccauucuuaaaaggaaaucucuauuaccuauucucagccccuuacauuaaauauauuucucuuagaggugccgucuuacauacaucugaauggcugcacucuagcuauucagaggguuacuugcuaauggacaugguuucugcaucccugcaggagagguuucccugauggagagaugucaguagcauagccuuacauaaugagguugggguguuacagagugaacugacacacagcugucaggguuagacagaucucacguggucaguccugaccgucgcucuagucugguaaaggagagaggagcaaguccucauuagcucccgugcuucuaaguaaaacaagucucauagacuuugcugugguccuccuaaguuuuauauauuuuauauuuuucuaggaaauuugcauugcaaaacaccaugagaaguuccagcagcguuuucagagugaagaugaauauagagcccaucauacaauacaaauaguaaguagggcuucuagggccuugggacagaaucuuacuuguguguacuugacaccaucuguaaccuucgggcuucccaccugugugcuuuguuccuagaaauaacaacucugagauuuccaagugaauaccugccucggccaguugccuggcucuguucucugacuagcccauaacuuaauuauccugugugccacgugacuggucacuuuaucgguuuuaggcggccaucuccucagaguuccccuuuugcuccugacucuguucucagaaauccucucucuauaugagaacauccacuuuuccuauuuccugcuaagcuaauggagcaaagacauuuuauugacaggggaugcuucuauagggauucucucugcacuugugucugaaagggguaacuauugauugagaauuauguccacugugaaugauuauguuugaaugagugaaugagagaucaguuuuaggcaaaauaaaauuauacauaugagaguuccaaugugcccuucccagccgcaccuccagcuuucuauuacuauuacaguuguacauguguuacaguuaguagcggucaguguuggcacauuguuccuguugauuacauugaaguucuugccugguauugugagaucaggugcaaaaugacaugaaucugugacuauaggaucagauuaauuuuacugcccuauguauguuuggaauauacacauguugcauauucagguugacuuacuucaccuaauagugcagauugaauguuuggauuguuggauacuaagguaagauuauauuguuuuaagaaacugucaggcugucuacaaaguaaaugugcuagugugcacuuacccaacauuaaaugagagcucuauauuguuaaacccuauucagcuuuuuguuguuuucagaaugacugacagcuguuguaauagguagaguaguaucucagucguuuuaguucucauucucaaguaacugcugcugagcaugguuuucugucaucaucagauuccuugcucaggguuuuuacuuuuugacuggacuucauacagagcguacagagcaugcccuuaaagucacuauauagagaaccucccccccucccaggugugcacccacucuggcuuuuguugaguuuuaaaagaguucuuuaucagaugucuuuuacuguauuuucccuaguacacgguuaucccuaaguguccucugcagagauuuuacuuugagcaaaccugaguuccuaguugcuguguuucaugcuaugaugugucucaugcuauguuguaugucuuagucaggguuucuauuccugcacaaacaucaugaccaagaagcaaguuggggaggaaaggguuuauucggcuuacacuuccauacugcuguucaucaccaaggaagucaggacuggaacucaagcaggucagaaagcaggagccgaugcagaggccauggaggaauguucuuuacuggcuugccuccccuggcuugcucagccugcucucuuauagaacccaagacuaccagcccagagauggucccacccacaaggggccuuucccccuugaucacuaauugagaaaaugccuuagaguuguaucucauggaggcauuuccucaacugaagcuccuuucucugugauaaccccagcugugucaaguugacacaaaacuagccaguacauuguaucucuuauuuaaacacuguaaggcuuuugugcuuuacauuuuacacuuagcccuacaaccuguuuugaguuaaguugucuggaaagucuaagguguuuacauccccuuuuggcaugcucaugucuguuugccucagcaccacuuguuggacaaauugcuuauguuccauggcauugccuuuguccuuuagucaaaggucagguaaccuugucucuaagggucuguuuagagguuguuuuauuaacccuaggcuuuuccuugcagucugccuaaaguuuagaauaccacaagauaauuugcaauugagacucuugauaaaauugagaagaagcaauuuuauugaauuuuacuguuuacaaacauggacuaauuuuccuauuuauuagaauuuuauauuuccuucuuuuuaaaagauuuuacuuuauuuuuauauauaugaugaguacacaguagcuguuuucagacacaacagaagagggcaucagaucucauuauaggugguggugagccaccaugugguuacugggaacucaggaccucuugaagagcagucagugcucuuaacugcugagccaucucuccagcccagaauuuuauauuuucuagugguauauuucauuuucuuuauuucauuuucuugucuuacuacauuagcuaggaccucuagcugggacaccuuggccuuuuccaguuagcagaaagcuuugucuucuuacuauuggguaugaugucauguuugucacgcugagaaauuacugcuguccuacauucccaaguggcuguguguaacuaacuaguuuacauuaugugagcuacauuaggaauuuccuccuuucccauuaugguacuauaucauauuuacauacagugaguucugauagcaguggguuuugauauauuaaucaacacauguagcuuauaaauaauugaguaccaaaaaugcuaggauggcuauauuuuucugcacuugcuuauuuuaaagcuucuuuucuuccuuuggcaucacccuaaagaucaguaaacuuuaguucauuuuuaguuccuuaagcuaauuuggcacaauuuagcuaaagcugucccuuauuaucauaauuaaacaggauauuagucacuuauccuuaaauuauaugacugucuuucucuuagcuagaaauagcaaauuaauuauugcccuuucauuucuaagucugugggucagaaagugcuguguagaguuagacaaggaaucgaacugguaaugauggugccccauucucauuuguaccuggguucuuagcuuaguuacugacauucuauucuuaaauuuguccacaaagaauuuucuaaggacaaagaaagaaauaaaaacaggaaucucagagauaaauguuaucuuaaaauuugaccaaaccucagaauuagauagaacaugugaugugauggagggaaacagaaacaagguaagucauuguaaaacauacacagucagggaaaggagagucggcuucaggcguggccauucgaguuaccucaaauucacacgcaaacuacgcaguccuccccgauggcauaaugcuguaaguuugcauuguuuguguuggaggacaucauucagcguuguccuggccugcauucagcugcacgcucaugugcauggcucauaaaucucagguugugcaugcuuagaaucuucaauugauuacaauugguaaaugccucucaaagccucuuuugaaacuuacguuaucuuuguuggaauuucuugggugauaauagcauuuaaaauauaacuccuaauacauuaaccguauuguuaaguuuuccauagaaaccacauaaguuaaaagugcagcuccgggccaggugugguggugcacgccuauaaucccagcacuugagaggcagaggcaggcgaauuucugaguucaaggccagccuggucuacaaagugaguuccaggacagccagggcuacacagagaaacccugucucgaagugcagcuccgaggggaguuuaacaucuaauacucacucuaaaauccugaagagaaugugguuugcuugcugacuagcacuaccccuaacaaguuccuaaauaagaaaaguauggucagaaagcaaauuguguuuucccauuagaaacauccuucacagauaaggugguacacaacucuaauccuagcauuuugcaaauaaaagcagggagaucaccgaaaaauugagaccagcauggauuacauagaaacauucugucuuuuuuuuuucaaaaggagcucuggcaaaguuuuauuaaaggaaaacuuucuuguuuacuucucaccagucuguucuggcaugcuucuaauaauaucagaaucaccugggucaaugauagccagugugcacacucuguaguauuuuccacacgcugugcccaguucaauauuauugccacgguaguaauggaccccaguuuuagccaacauggcauagaacucuauuucagauuuccucaaaucugggcagcuguuggcaaggauaaccaacuuggcuuugccuugucugaccaucuucagagucugcuuguagcucagcacguauuucccacuguucauaacaaguuggagccuagaguugaucgacuccagagacuuuuucgucuucuuugcggccaccaucuuccugccuuaggugugggacaacccccaaccaacaccagccgccaagauggccggggagcgagaaaggacauucugucuuaaaagcaaaacaacaaaaacauacuuacaaugggcaugggguauaugucuguaaucuggaagcugagacagaggauucuaaguuugaggacagauuuggcuuuagacacggcaaucucaaaaauaucaaaagaucacaccaggcugggauauaggucagugccuugguuaacuccuaucagaggagcuuguuccugugguaaguggauauuaacagagacacaguuggacagugugcagagacugcggacuacucuguccuaaacagguugucuucacaccccugcccucaaggcucaggaaucuauguguagggcagagaagauaaaaagacccuaagaaccagaggugguaucuguuuccaaggagacugucuuccagauacaacaagacugauacacuuaauaacacagcacugacuaagaagcugccugcaauuacuucccacggucaaagaaaaauucaguuuucuccaguggaguccuacuggguauauaacauacucccugugcucugacugugccauauccaaucccuguccuuagauuuucucacuacacuacauuauugggcuggcaagggcucaguggguggauuaaggugcuugccauauaugucugugacccgaguuggugccuaagauggaaguggaaggaaagaauugauucuaaaaguugcccucuggagacuaaagagaggucucagugguuaaaaaacacuggcuucucuuccagaggaccugaguuuaauucccagcaccaauggcagcucacggguaucaguaacucuugauccaggggauccaacacccuuauauagucauauauauauagucagaacaccaguguacauaaaauaaaaauagaugaauuuuaaaaaguuguucaccugucccgagagucuuucaccucccaggucucugguacauucuagagggucuccgcaccuccuaccuccagaggaugucuguuucuauucuuucugcuggucuucagggcuucagcucuguuccccccacccaauaccugaucauauuuccuuuucuacuccuguccccucuccuacccccucccccuucuugugauuccuuucuucucccucccaagugggauuaaggcauccucucuugggcccuuuggcuuguugaccuucuugauuuuauccuggauauuuguacuuuuuuuggcuaauauccacuuugcuauuauguggacuuuaaagcauguuuucucuuugguuuuuuguuuuuguuuuugccuggagaccuugaagaugguguagugagucuguaucugagaccuaggaagagaggccuggcuuuuguaucuaguaauaauugacucagcuaacauaagagaaagaaaagccgguguuguguuuauuauuagucauuuagaauuccuuguccugugcuguagucauggaaccaacacuuacccagaggauaugucccacuaccaccaagacuuauaaacuguaucuagccucucugaaaacauuuccacccauuaggaaacaggauggccauucagaccuucuugaagauguucccuaauuacguaugaauucguuaccugcccuucaaccuaauaguuaguaaaauacuacuucauccauucaucuuccugccaagagcuucccuuuacacacuaucugcugcauaguuaagaauuuuauucauacauucauucauaaggauaguaucuaccauuccuucuugucacauauccaaguugucuuaaucucauuagauuugucuguuccauucucuaauccaaaccucuuuuucuccugcauucccaauuuaaaggguagcauccuaccuccuaccuccaucauuggugaaauuagaaaacugauacucuuucccccccccccccagcauauugaugcucuaccuccaccuagaaauccccacucuauuagccaaucauagugcaugcugaguucaaggccaaccugaauuucauugugagaacuuuuaucaaaaaaaacaaaaacaaaaacaaaaaaaacccaagguuucuuuuagcacgagcuaaaagaaaaaggaugccagcuccacccuucucuugaugugugaugcaguauguaguuggcucauaaaucagugaccaagaagaacuuggauuuguucuuaaagggccuuucuuaccgguuugguacauggaaacuauuuuaacaaauuacaucacuuuuucuagugugugaccuugaaugguuuucuuauguaagcauguuuuacccccuuuguauuuugugccuauguuugaucacacaucagauguugaaauauguccuaagcguuuuucucacuacuacuccuaagauuaauuaugccucgugguauuggcgcucaggagucagaggcaggcguuuacguuuauuaugagcaguuuuaauuuagcgacuugacaagcaguguuugucucaaccaguugaaaaccuuuauuguguauauugugaugugugaucauuauagaagaauaaaacaacccaaaguaaagcuacaaguuaaaaaaugaauuccaaaauuguuacuccuucuagcaagaggucuuaaucacaacucugacagaacuacuagaauuguauagauuccuuuacaggacaguugggaagcauugagcacuguuuagauaaaugcuggcaauauggaaacuuccucauaguucccgucucuguugagugugcuacagauuucgauguaaaaauaucagauuccucccucccucucaguugagauucagcuguagaucuggacaagugcacggcuucugcucaguucuugauuucuaaguauauuuguucccuuuggaaugcauggcauggguuuucucuuuaggaacuguuuuaggacaguguucugauaauuucuuaaauucuuguuuggagaaugucuugcuucccuuguacaaaaagaacagguuagccaggugaugcaugcacuccagaggcaggcagaucucugaguuugaggccagccuggucuacacagugaguuccaggacagccagggcuacacagagaagcccugacucaggacugaagaagaacaacaacaacagcaacaacaagacagguuggguguccaguaaucauuaccucuccaacacaauuuggagauacugccccuauauuuuauaguaaugaugugauagugaguacgucugagacccaccacucauuggauguuauuuucuguuaauauuuacauuugccuuuuuuuuggugaaucuauuagaugaccuauuuaagaaauaccauguuuucacauggaaauuuucaguucauguugucuuguaaacuguucuuuuccauuuuguggugguugucacuguuuuguguugcuagagauagaacuuagcggcuuguguaugccagggaaaugccgugcuucagggcugugucauagugcgugcgauaccuucagguucuguuucagacguacuugcagcuuucaaggcacagucauccaucacuagcccugugugcuuuccuuucuuacugucuuggaaugggacaaggauaaccugucuuguauucacuggguuaucuccgcccuaacaugcccauucuugagguccaaaugauuuccuggguuguaagucgggaucuuuucuaucguuggcugcucugucuguugacaaggugucacugucuucagacugacucagaaugaacgcccgccuuccugcuaucauggccuccaagugcuguguuuacucuggauacagguucuuucugaggugguuuuuuuuuuuccuuuguaaauauuauuacuaaauuauauuauccagauaucuucacaccuauccucacaccuuauuuuacuuuuuuuaaagguagaauagaguucacaacaaucccucuguauuuguuucucaaguauuauaaauguguaucacugggccuuggcuauguguacacgugcgcaugcuugcauacauacaugugggagcauccucgaaugcuagagcucaauuucuguugucuuucuuagucucuuuccauuuuaguugucuguguaggggucucauugccccaguggcuacacuggcuggcagccgcuccaggagucugccuguugguaccuccuucuacacauggcuucucacucuuugcaguaagcacuuugcugauuaauccaucuuuguuccuuuccuuuccuuuucuuuuugcuuguuuguuuugagacaccacagggucuuuuuuagcgacagcuguccugcaacuuacuauguagaccaggcuggccuugaauccagagaccucuccugacucugccucuugagcacugagaucaaagguuugugccaccacucccaauccaccucuuacguuuuuaaggaaacaaagaucuuuugauuguggcuuugauaucaucauccaagcacauggagcaagaacugcuauugucagggcugaaguugagccaugaggugaaagggugagagaaaagagcuuaauuccuaggugaaauuagucuugagaggcagcuccaguuuggcuuugucucugguuuuaaauaugacugcuuccugaguuugugugucagccuugagcaggucaugguagucucucucacuccgugcugaaguggggaggauaacauuagaaaagugauaacacuuggucauacucaggguuucucuuucugcacaaaacaucaugaccaagaagcaaguuggggaggaaaggguuuauucagcuccuccauacugcuguucaucaccaaaggaagucaggacuggaacucaagcaagucaggaagcaggagcugaugcagaggccguggagggauguuccuuacuggcuugccuccccuggcuugcucagccugcuuucuuauagaacucaagacuaccagcccagagauggucccacccacaaggggaccuucccccuugaucacuauuugagaaaaugccuuacaguuggaucucauggaggcauuuccucaccugaagcuccuuucucugugauaacuccagcggugucauguugguacacaaaaccagccaguacacacuuugccuaccuagaaagucuucauuuguuuaacuaaaauaucugacaaaugagauuuuguuauguaacucuuagguaauucaacaguaaggagaaaguuacaaacaucaguguuaauagcaugccuacuacaggguguaguauuacucacaugauucaugaacaauauuggaagcauauuuuucuaacugcugguugauacacuguguaacauuaaauuaacaugguuccccuccuuucaaagaaaagggauuuaaguugaaggcggcagaggcaggcagaucucugaguuugaagccagccauguccuauagaguucugggacagccagagcuacacagagaaucccuaucuugaaaacaaaaacagacaaacgaaaaauuauugaugugguaguugcugauuuuauuugaaaagucacuuauauuugaguuggcugaaugugaagccagaaauaauucugacaaaauuuguuguagccuaaaccccugagacaaagcaguguucaguuuacuuuaucugaccaccgugaacuuauuggaaguauagagguuugcauugucaaagauuuuguucaguggaucaucuuaacuaauuugacauguuagggagaaaucuucuccuuucccuuucucuuguuaauaauuaaaauaaauugggcaccguauaaugcaauuacuuucuucuuuaccagaagagagacaaauugcaugaugaagaggaaagaaaaagugccuggguuagccaagagagacagaggacacuggauagacuucgaacauuuaagcagguaauagaaaugugcuaauguuugauuuacauugcucuucagagagagccauaggacucugauuguagggguucuguuuagaguguauucccagcuggagcaguuaaauuggcuaagucagcaguaauauucuuugcccuuggagcaccaccuccugaguauauaaagaguaaagauagugucaagaaagccuggaaucuuuugaauuaaaaaaaaaaaaauuguuaauguuaacaguacaaaaacacuuuauuucacuccuauaagaaaauuaucagguauuuucuuaaaaggugcccuagaagucccuccccccuuacuuaagcauuugaaaauaguuucuuaguauguacguuggguuuuauguacuguuucuuccacugaagauuaaagucacuuggcuaguuuucuuguuugugagauaaggucuuucuauguagcacuggcuagacuggaauguauauagaucaggcugcccucagacucugugugcugggacuaaacaaaaggcccugcccauguuguuuuuaagcaguuggcuuaauuagguaagagaauaagagggaacaagucuuagcauauuugauaguagauaauaaaggagcuggggauaauuguuucaaaggaauugacaggcacagguauccuaguuuguuuucuuguuuguuuuuucccuguuuugaauaaaagcaguaaagagcuaaaugaauaacauucuguuaaagaaauaacuaagcgacugggcgugguggcgcacgccucuaaucccagcacucaggaggcagaggcagguggauuucugaguucgaggccagccuggucuacagagugaguuccaggacagccaggacuauacagagaaacccugucucgaaaaaccaaaaaaaaaaaaagaaaaaagaaauuaagcauuuguugucaaguuaguuucauacaauaacucacucaguaacuguuauuuuagagguaccccgggcaagucauccuuaagucgaccagauuacgaguggcgcauucaagaagaaaaagcacagcaagcccugugcccugugaggagcagugucacucucugccaacagugcugcaggggcaggagaagacagaggugggaggaggaggaagccagcuugggccuucacagacagcagaaccccagagccuuguccaacuugaagacacuucaucagaacaacuugaauccaccucauuaccuccucgugcugucgucagcucugaacugccuccuccacagucagcuccacuguugacuaguauugaccccaaaccguguucuguuacuauagauccucucccacccccucuuccuccaacaccucccccucccccacccccacccccaccuccacccccaccccugccuguugcaaaggacaauggggccuccaccacugcagagacacuggagaaagaugcacuuaggacggagggcaaugagaggagcaucccaaagucggccagugcccccgcagcacaccucuuugauagcagccagcuggucagcgcacggaaaaagcucagaaagacuguggaagggcugcagaggaggagaggugagugcacaggaccuuucugguucugcuguaaagggaagcacagggaaggagcuuugcauugaauuauguguugcaaagcuuaaaauacaguuuaugaacauuauuugauagucauguuucuaagauagccucugaagugacauuugauuaaguaguacuuuuuguucuccguaagaaaaggccaucuauuugguuuguguugaagacuuaagagugaucuucauauaaaaagacaaagaacagguaguuauaugugcaacucaucagauacacaauaugcauuaguaaagcuauuucuaaacacauuucccuugccuuugagggacuuuguguuugcauaggggcaaauauaacagagcaucuugcauauuacauauugaucugagaauauucuguaaaaucuuucauaacaaucugaauagaaccucacaugugaacuaacuguaaaaaugcacugacagugacccaacauuaaauugugggggggggguuggaugagggguaggugugugugggagugcuuguguguaugggggggguuggaugagggguaggugugugugggagugcuuguguguguggggggggguuggaugagggguaggugugugugggagugcuugugugugggggggguuggaugagggguaggugugugugggagugcuuguguguggggaauguguaugagugugugaguuaugagagaguguguguaugugugagguguaugggaguacauggggugauuugugggagucggggggaugggaguguguagggggagaugugugggagugggggacggaugagggucagucgacuuuuaagauuguuuucaguucuugucugccuuacuuauugagaguuugccugugaaccuggagcuuaccguuucagauugacugccuagccaauaacccugccccagccuaucagccucugccauguccuugcaucucccaggagcugggguuauagcacugugugcacaacucuguccagcuuuuauauggauucugggguuucugaacuuggggacagcaaggaccuuacccacugaggcaucuuccaauauuaaauuuaaaaaacaauaagagaaagaaauauguaaucaaucauugucuuacuuuggauugguuuguggguacaaagaggucucacaugucaagaccuguccuagucaccgugcauuggaggucacacagauugacuuuuaagagcaauaauucuuacugauuguuuuauuuuguuuuccaaagugaguucacccauggaugaaguguuagcauccuugaagcgugguagcuuucaucugaaaaagguugaacagcggacucugccuccuuuuccugaugaagaugauaguaauaauauuuuggcgcagauaaggaaagggguaaaguugaagaagguucagaaggaaguuuugagagaauccuucacacuucugccugauaccgacccuuugacacggaguauccacgaagcucuaagaagaaucaaagaagcguccccagagucagaggaugaggaagaggcuuugccgugcacagacugggagaacuagcagguacaugagccuuacuuagccuuuagcagccggcuuuaacggcuuugacuucgcuggugagcuccagcauuuguuguggagucuguaccaugugcgucguguauggcuucauuguagagcauggauaauagaugugugaauuccaauuuuuaacucaaaaauauucaguucagugucuguuuuuuaaaucuugccccuuuauacaacagucccccuugcaacuaaucauguguauuucuaguguauuacuguugcaguuguuuucucuccucuauuugccuuuuaaguuagggcuucuguauccaggcuagucuggaacuccuugugauuuucuugccaucaugguaugcauuacauaguauggcuggcaaaguauuuuauuucucuuuuucaguguguguguguguguguguguguguguguguugguggguaguauauauucaguacccugagagaccagaaaagcccauuggguccuuagagauacaguuacaggcaguugugagcccucugacauauagucuagguaucuuuuucaggucuucuugcaggguuucaagagcacugaaucauuaagccauuucuccaacucuggaaagcaccuuuaaaagacuucuagcuguguguuuuuucuaucuugcucguuaaaaauaucuacaguguaguuauauuccaaguaaagagauauagucuuauuuuuaacuugaccagaaaagccuuuuuaacugaauuacuuaaguuaggcuuacugaauuuugauccuuucuuagcugcccauaagggaguuuucucagucuagaaaauuacuaaguugucugguuauauagcuuucuaaauauugaaaacuauucagccauucuucauugucuauaauaaacauuauagcuacauugauaaauaaguuauaaacaacuugaauccuguguacaguauaauuguuuacacacaugcauuguaauucuugcaaucugcugcuugcuugcgcaccccugcaggguaccccccuccccaccaaaugggaucucaucuuguagcuuuagcuggucuggccacuagauauauagaucaggcuagucuuugccucccuucucaucugccuuggucuuugugaguugugacauuaaagguuauuagcacaaauuacacuacauuaaaagaauagugauuauggcauaugucauaaguuaguuacauaguuaaaggauugaggacuuugaggacagcguuuauuauguauccaaacuccaucucaaaacaaaaacagacaagcaaaccccaaagagagagggagcacucuuucuagaggggauauagacaagacagcuuuuuuuuuuuuuuacccugggugugguggcacacaccuuuaaucucaggcauuuagagacagaggaagcaucccugaguucaguccagcauggucuacauagucaucuccaggacagcaaagacuacagacagaucuugucucauggggcuuggggggaaagcuucauuuuuaaaauaaauuuuagcagggauguauacagggucaucuuaggaugagaggguguguaccgugguccuugacuauguaggagucuaugaacuagccuuaggcacuuguuaaguguggauuccugucucugacuccaaaucuaaguggauuuuuaauguauaugcaagugcacauggauuucuaaaacuuggugcaauaaaauaugaaguauucaaacaaagcauuacuccuaaaaggauuguuaccuguuacuuuaggaccuagaggugcauucggaaaacaccuuucccugcaccgugccccucaagcucacacacaggcuaacaucacacucucuccggcaugugguugagcauugccuuccccccguguuucccuuuauugcuguugugugcagaggcccugauuucaacuguuuugcucacauauguguauauuauacuguacuuuauaaaaaagacuggcauuuauuuucuuaagaaacauagaggaguauacagaccucaguguuucucauuaguguguugauauucagaggcucggguugucuuccuagagucucuuccauaguagauauucauguaucaccucccucuuuauuguucuugcuccugcuaugucuccuguggcuucucuugcugcuuacacguguaucucagccagucaccacugcucgcucgcuauccuuaguucuuuugcuacggcagcuucugccagcauuuccaugcuugucuucucccaucucaccaggucuuggcugacacguaaggcagggccucagcaucuguauauuucagcugaggugauuuacaugucuggccaugagugucaggacacugugugagggacugcaaggggcugguaguucuuaaaguauugaaacaaucagcagaugugugaucuauacaccuuugaaaguuuuagaguuccuuuugaaagaugaauguugcucugccucauccuacuguaaggcuucccagagauagccauggcuaacaguguccugaaguagcuucaugagacagaauuauaauuuaugacaagguucugauuugucucauguagggucuuucucaaauuucaucuuuuuuuaaaaagauuuauuuauuauuauauguaaguacauuguaguacauucagacacaccagaagauggcaucaaaucucauuaccgauggugugagccaccaugugguugcugggauuugaacuuaggaccuuuggaagagcagucagugcucuuacccgcuaagccaucucuccagcccuuucucaaacuucuaaguauaacugugaaaagaaaauggggcacauauaucauucuaagaaagcugcagaaaagggaacacaagaaauuuauccuaauaauguuuaucugacaggggcuacaacaauaccuuucaguaugcaggugacauaacauuuugaauaguuaccccucugcacuuagccuuuuagauuuaaggccccaaaacccagguuuugauucagaugcuguuuuuauguuguaauuccugcuagcacaucucagugaaguauccuaucaaaacaaaaauauacuuauuggaaaaauaugagccuuauagucuaaaauugguuagcuucugagucacacaagcuauguuucagauacucagugcccauguauaacuucagaaacauguuucuuguugguguauauuuaaagaaugguuuuuaucuaaacuuccucuaauaggccaguugauaaaaccuaucugccuguauugaaguuuaaagacacccauuuaauggguguuacuuuccuaagaggagcagaaacaaaagggaauccaacacucucaauagugaccaacauuaugaacuaaccaguaccccggagcucuugacucuagcugcauauguaucaaaagauggccuagucggccaucacugaaaagagaggcccauuggacacgcaaacuuuauaugccccaguacaggggaacgccagggccaaaaagggggaguggguggguaggggaguggggguggguggguaugggguacuuuugguauagcauuggaaauguaaaggagcuaaauaccuaauaaaaaauggaaaaaaaaaauagugaccaaaaucuauaugaaaugacuuuuauucuuacuacuuuaagaauacaaacaucauggggcuggagagguggcucaacuguuaagaucaucgccugcuuucccagaggcccuguauauaauucacaguaccgacauggcagcucaguagguaacuucagucacaggggaucugacauccucuuguggccuccacaggcacugaaugcacaugguaccuagacauacucaggcaaacacucauacacauaaaauaacaucuaacuuaaaaauuauaaacauuuuauuuaaaggaaacccuauaccauuaccacauaggugacuauuaaaacaagugugcauugaagguauuuccaagagugggagggaacugacuuauguccuacaggcauuuuguucuaauauuguaucauuuuguuugcaaacaggugacuuaagagagaagaaaaauacccauggaugaagacuggcucugguuccuuuggggaaaaaaucuaagcucuuggucccacaauuggauuccauuauguccugaguauauugacaaagugguuugaaaaaggaagcacaaacgggagguuacuacuguccagucccucucauugauagugcaauguucccgacugcagagagaacaagccuccuggagacggcuguuccuuccccaccccuccuccccaucugcccaaucauaaucucauaguggccagucccauugcuaugaauuggaagaacacuggguuggcagaggucugcuguacgagcuacuuugggauucaucuuucagugaacugagaagaucugugcugaagcacagccgcuuccaugucagcuuguagagacagagagacaugcuacagaagacauugaucaagguaguuauggucaggaauuaaaaaaaaaccaugaaaugcacuuaaaauuuccacauuauucaucuccagagaaguucaguaucugagaagccaguggagauauaccuaucaaugugugcaccagaacacgacacauuuaacaaggcauauuuuuaagaggccacagucuuacauuuuguaagaauuugaaguuaaaauuuccaugcuuuuaaaauagcguuucauaauucugaauuuagaauaguuugaauuuuaugugcauccuguuuaugagaagcaaugcuuuguaauuugauaauguuauuuuuagucuuuuuguuugaacuacugcuugauuacuauaacucaagacuuuccuauugagaaucaaaaaagcaggauucaacaguggggauucaaauuacaagccgugcacccgguuacguuuuuauuguuaugcuccguggugaggagcauguauucaguaaagguccagaaggcagcugggcccgaagccuccagcuggcauuuuagugguuuuguuuuuuguuuuuuuauucuguguauagaacuuuaggagaacguuuguugcugucacuaaaucuuuaaacucacauguguagauccaaugcugaccuggcuguaucuuaaaggguccauuuaugaacggggccggcagggauugucauugguuugauuaugugaacaugcaugagggcagauaugcuggacccaguuuacaguacauuguagugugugcuuuauauggaggaauugaaauaccaaaaagaacuucauuuguagaaaguucuuucccggcguugcccagaaucuucccagaagcgaaagccucucaaugcccgccauaguuuuccuccaggaacauggcuuccuggucacuuuuaagagauguguuucuuuaauuaugaaaaagauucuuguaacggguuauagaaaaccaaauuuuugcacuuaaaacauucauguuuauugaugagacugggagcucauguagcaauuacuuuauauauugguuuuaguccaagcauaauucacacaucuuguccgcaacaauuaaaagagcucugauauauaagccucauucuaagaugaucuguguguccuuuauacccccaguaaagcaccaaaauguguuuaacccaaagagucauuggcuagauaaagaaauauuugaaaagcuucaaaacuuacaaauguucuaaaaaucagccaucguuuauaaacuuguaauauuuacagaucuauccaucgaugcauuauauauucagguucuuugcuuacuuacuucugaggccaggcccugcuguguagcccuggcuggccuaggauuugcugugcaggccaggcacucugcagcagucugcuucucucugccucucuuacagguaugcaccaagaugccugcgucccugguuguuuuugguuuuuguuuuuuuuuaagauucauuuuaaaaauuacuuuaaauuauguaaacuauguacagaggcucuggcuugguuacuaggaaccaaacuugggucuuuugaaggagcagugugugcucuuaaucucugagcaaucucuccagucccuuuuuuuaaacuauaggaaaauaugaaauauaauuuaucaaaagccauuguguuguacucuguuuagcaccacgugccugggcuuuguaaguggggaugaacugggacaaugagcagcucucagcacauccugacaauccaagauuacagccuggagugagccuucagccuguuuucaaguaaaugauucucucccaacaugccagcuucucugccucgggagucuuguuuuuguacuggagcauggcucaguaguaaagugcaacaccuuauguuccaucucuagcauuggcuucuuaauccucaagaaaagauuuuuacuucacaaaaucacacacauuggaguuacucauaauaauauaauuuaaaauaacuaguauacauguguucaucaaaucaccaggugagcccucauuaauuuaaagugguuuuagggccccaggaaaaugacaauaagcaugaugugguuuuucucccuuacuuuccuagacacagaaguuuugcuuaauuuuagaugcagucaucagaccauaagugauaagcucuggccuucagaguucauucaugugucuaguugucauggcagucagucaauguuuccaguucccaguguaguuagccuuccacggugcccaguauccacagacacugcuugucuuugcuguucccaaguguuuuauacugaagaugggaaagcaggaguuaacuagaugcuuaaucuaguguuauuauucauacuugaaugucaaauuucaaauauguccccgauacaaccaaaauaauguauaguagccgaugugcuauguauagaaaagauaucucuagguuaaagguccuaguugguuuuuaguaguaagaaauugcuggcgaaugaggauuuuagggucuaagcaaugacccuaguuaaagagugcuuuauauagggauaugaaguucaugagacagcauaaaaacaaucauuccuuaguugcucaucaugcacuuaaaacuuucuucccccuccccauuccugagacaggguuucuccauguggcccuagcugcucuggaacucccucuauagaucaggcuggccucaaacucagggauuugccugccucugccucccgagugcugggacuaaggcaugugcgacuacaccuguugcaaaauccauuuuuuaaaagauacugguguaguauagugaacacuuuguggacucuacagugugugugaacguucagaggguucucauuuguauaaauaugaaugucgaacaauccuuggugccacaguaaguccuagaaugugguaaguugcacgguguacugcagacaccacacacuaagaauuagaauucaguaggauauagaaugacagcauccacauggcaugggggcacgcacauugauacaguugcauucucuagacucccugagacuucuuuauggaauccacucacagaauauguuuguauuuauuuaaaccaauauuuugaguccagccuuguaauacacucaucaacagacaucaaucugcacagugacuuugggucuuuagugggccugucagggaguuuugagcuuucuuacauuuuaccaguaaaauaaguauagauccugaccaacugcaggacauuucagacuauugcuuaagaugcaagcacuugacagggaaagcggagaccuuuaauuuuuccucaucuuugcacugaauauaaaugauuauauaaagcuaaaugugcauauugaacauuuuauuugugcuugguguugccagugaccaucaagacuuuagauggaagagggugagaaagcagaagcaccuuacugcugagcacacuguguucaggccucacgacugcagucgugaggccugaacuuuauguuagagcauguuaaaauccugccuaauugcuuggaaauaggaggcgaugguauuuuuagccuauuuauguaauguaacuuaaaagguuuucccagaaaaugaguuuauauuguuaucuaaacuaucccauguguaaacagaagcuuuuaaagguaggaggcaguccugaugcagagagagacaaugagagagacaguccacuaaauguucccugaguuauguuaaagauguucuuauuuuaaauuuuuuguuuuguccacaguaaauauacaauguggcauuuauaugacuuaauggauugagcuccaaguuuauaaauguacccucucuucaaagcaaauuuuuuggggccacuguaaggugcauauagagaaauuaccucugaggaugacaugcuaaaguguucaugagagcugcuucacuuccacccucagagaaucacuuguuuugagagcaaggggaaguuucuuuuuuuuuuuuuuuuguagauucacuuauaguuaacaguggcccaauuuaggguauuggaaaugaguagggaagacaaugaaauguuuaaaaacuaaaggcauggguguuagaguugaguuuuaacaggagaaaacauuuuuucuugcauguuguauaguuaacugucaagggguguaaugcggcauuuuagguuucuccaugcaaauuccuuugucuuuccuaugaagucuuugcaguuaccgguggcauuucccuuuccugugguuuccccuuauuuugugugauguaacaaggguugcauccuauagcaguuucuuacaauguuuucgacacaguccccacugccuuguugaaucucucucuguacuguaugcacugccaagugugagaccauaauauguaguuuaaugagaaacggaaggaugcaggucaguuugcaugaguaaagcccacuggggcuacauaaacugacacuuuugucauuuuacccaguuguggguaaaugaagacuacaauggcagacugacucaccauuacuugcuuugugcaauguuauaaaggcaaaacacuaugcacuaugcuuggcuuuacagauggcauucccaccaugacauuaaguggauuguccacagcauacuauaaaugccaucucuugcaaauuuauauacguaaauaugcucaauuaacacuuaaguauuacaaguauaaggaaacuacuaagcaggcauuuauagcaauacuaugaaaucuccaaucacuguuuugacugucgccuucuccuuagugcagccuuucugcaucguaguugcugcuuuuuuacauuucacacuccugacuucagaguuaaguacuugcucauccaguguugcacucaccuuucuuauuguacaugcaauguaacaacacacaguuuuggugcuuaacaauauuccuuuuuuucuuuaauaaaggauauuuauuugaauuaac

SEQ ID NO: 7161 - RNA, 501 nt, Mus musculus
uuacauagaaacauucugucuuuuuuuuuucaaaaggagcucuggcaaaguuuuauuaaaggaaaacuuucuuguuuacuucucaccagucuguucuggcaugcuucuaauaauaucagaaucaccugggucaaugauagccagugugcacacucuguaguauuuuccacacgcugugcccaguucaauauuauugccacgguaguaauggaccccaguuuuagccaacauggcauagaacucuauuucagauuuccucaaaucugggcagcuguuggcaaggauaaccaacuuggcuuugccuugucugaccaucuucagagucugcuuguagcucagcacguauuucccacuguucauaacaaguuggagccuagaguugaucgacuccagagacuuuuucgucuucuuugcggccaccaucuuccugccuuaggugugggacaacccccaaccaacaccagccgccaagauggccggggagcgagaaaggacauucug

SEQ ID NO: 7162 - RNA, 8576 nt, Mus musculus
ucuuaugaaacuacaguugcacuuauuaaaauaagccaaaggcauucaccauuugaaccuucaaaaugucacaggcuuucaaucccagcuacugaagaggcuaagagacaugaaaaucaacaguucaaaggcugccuggugguuuaguaaacccuaucucaaaaaccuuuaaauagaauacaagcaggcuggaggugugccugaguggaagggcuuuugcccagcguggacaagaugcuggcuucaaucccaagcaaugcaaacaaaacaaaacaaaacaaaacaaaacaaaacaucccagcauacuugauuuuagaucugaaaauaccagaguuauaugugucaugugacaccugaaugggcauguucuauuucaaguaauugccuauuuucuucuuuuauguuuaguaucucccuacuccaauccacuauuccucuuacccaccccuacauacauaggccaagagaaaggcugagggaggccagggcucucauucuacugguuaagcagucuucuguccaucaaaucaaauauuaugaguguggguuuguuugguagaagaaaaagcccaaaccagccaucuuucaguccauuccacauaccagcucucccaaaaauaacagaaaccagauaauucuucaagcuaagaggccagcaguucucagcacaucccacuaaagcugaaucaacauccagcuugcugucugguccacaguucagauacugagccaccacaguaggacaaccacugaagcuagguuuguucaucccaacaaauaucuacuuauguggaaucaguagaaagaccacaacacccaauacucaaagaagcaugagggcagucucugagaaauacagcaccuuguggugacaagauugucaccaacucugcuggcccucagugcuuccucuuaaaacuaucuugacaagaaaguuguaucaaacaaagcagugguggcacaugcuuuuaauccuggcacucgggaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagagguagguggauuucugaguuugaggccagccuggucuacagagugaguuccaggacagccagggcuacacagagaaacccugucucaaaaaaaccaaaaaaagaaaaagaaaaagaaauaaaagaaauaaaugaaaugguaccaaacagaagucacagcuucucaaggaaggcugucaucugugucccccacccccuccccuccccacccuuuucccuagagcuauccaggaccauggugucacuuccccuccaugaugucacucuccauggccacuuuucuaacaccagaaagccucugcuguguuucuguuauauuuauucucaggaaugugggaacaucgaaggauggcccaagggcacaccagaaaggcuuucccaggauggcuggggcaugcucauuagaagucuguuuaaugagggcuggcacagucagcgaggggcaaaugugaacucagcaguuauuacugugugucaaugggauucaguccuugcuaaaacagcuuuccaggagaaaaggcuaauuuuagcucaugcuuucagaggguuuguucuuugugugcuugccccuauguggcuagacaggccauccugguggcaagagugugugacaaaggagauaauucacuuccuggugcacaagaagcagaaagagacuacaaguucagagcacagccuucaaaggcagguccccacaaccuacuccccucaggaggccccuccaucuaaaguuuccacuacuuccccagauagugccacuuuuuaucaaucuuguggucacaaucuguacacugagaagccauguuuggcucccuguccuggagaagucaaacugaaagagaggaauaaguaaaaaguguauguggcagggguguggcggggaggggugggggagauuccuucaauguggccacauugggaaagggacaagaaagccagucacucccuccacuccaucuuuagguucccaaaguuacauuagaguuuaaacagggggccagaggcaagcauaacuaagcauuccuggucaagguguggccccgcccaccacugacucauccaucauuggcuggguuucccgcuuacccugcaggguggucuggcaaguuguuagaacugcguggaaucucuucucugggagacacaguuucccucuggcuagcaccaggcuucagccuuuucuuucccaacaugagcucccuaaggggaauuccagcuucucaggguccgucguaguuuaaacgucugauagucagauuaagggacauagguguuucauuagaauacacucauuucugucaggcuaauugcaacaccuccauuacacaaacccacgagggacauuucagauucaaacuagaaugccagagggaagaguuggaaugagguaguggcgugauagggguuuagccuugauccuuggagaagaguguaggcccaugcuucccagaaaagcagcagucugucgcacagcguggucugcguagauaggauggggaggggcaauaucgguacuuuccugggaaguaagguuaugaguauguguaauguuucuguauuuugagcagguuagccauaaaucuuggcagcugccuggaggaggaggaugggauggagaaagaaaaaaggaugugcaguucgaguuaagccaacauggcgaucagccagauggcguguaagcagaguggaagcuuuuuuuuuuuuuuuuuuuuuuuuuuuuuuuuuuuuuuugguuuuugguuuuugguuuuucgagacaggguuucucuguauagcccuggcuguccuggaacucacuuuguagaccaggcuguccuggaacucagaaaucugccugccucugccucccgagugcugggauuaaaggcgugcaccaccacgccuggcaagaggaagcuuuaaagaaaggaaaaauguccgaagaaccagaaagaagcuccaggaagcucagagacagcacuagaccaccgggggcucugggggggaaaguauauuauguaauuaaagggguaaguguuccuccuaucgcuuuauagcuuaaggugaaccugccuccccagggucgguccuuugggcaggucauuggcuggccuaacuggauuauuaacccuuaagggacaacggagcaccuugucuuccccgggggccagauuccauucuagcaggcagcaguuuuucucuuaaugggccuuccuggcauugugaaagaauacaacuugacuuaaaaaaaaaaaaaaaaaaaaaaaaacgacgaagacgacgacaacaacaccaccacuuagaaacugcaccccacaaugaccaacuuaucagcuuuuccaugucagcugccaaacagagguucuuuagucgaccuaauaaguauugucagaaaaugugguaggcaaauaugcaguagagaaaugcucucugcaacagauuuuggaguuuaugcccuccaagagaaagaaaacaucuaccacugccccacaugaacagaacaaaacaaaccaaccagccaaacaacaacaacaacaaaacaaguauccacaaaacaucauuaacaucugagguauuuaaaagaacugaaaggaaccacaguaggagccucuuucccccaagacugugcaagguuucucaggagagcccaagcccaggacauggggguuccugaagacuuaaaaacugcuucuuaacacauaaucacauucaacuacgaucgccuuucagguguucgagagcucuugagcgcugaucaaagucauccacaaauguaaaauuaccaccuagagagcucaggcuauaguuauaggauuuagggaaagaagaagucugaauuauauuuggaaccaaugguuauuucucaguaagcaucucaauguuuugaaaacucuaaguucuguuucccauaacucuguggacgaggcugucaugagaaacuguuucugccuaaagugauggagaucauacaaacaucugauuccucugcuggcuuucugauuauuggacagagaaguucauaugacauugguguuaaggugguugcuugagauuccugcuuccagcugggcuguuggguagggagcaucuccuaggagauggaggcauugaaaagcucauaggacagggccgugagcucacuugauccaucauggcaagacugccuuuggucugggacaugcucuuugaauauuuuaaaaccaaacugaggagaagaucacaaagauuagugucucugguuugcgauuuuaggagucagacaucuucuaucccaaacucugacuuaguuuucuauaaugguaaugaauagauuuuucucugccaacaaaaugagccaauucaagccgaauugagaggaaggggggcaggucuacuuuggggcucuaggauggguucacuagucccaaggaaggaggccagggaaaucaccaugaagagagcccaaaauguuuggauuauauagggaagagccucuggggagggggaagccuagcgccuggucuggaaaguucagggcaauaugccagccgcaucguguaacaggucaggacugagagaugcugggagaacucggaugucgagcaucuuaggcacuugucugcuuagaaacccaacaauaacaccuucacaguuccaauaaaauagcuggcaggcaauaaaacagccguucaucuaucaauagauacaauuucuucugugugguuugaaguguucuuguuagcaguguaauuuacuguucagaagucuggacugcacagacuccacggaucaaaucccaaccucaucacucacgaguuguguccuugaacuucaucugugugcuuugguuuuccacaucuaaagaggaaauagcaacaacagcaacagcuacaauauacaauugguguaauugaguuaaaacacaagccauugaggcuaguguuuggcacacugcaaaugccaugagagaguuccuucccaaacuagguagcccuugccuguuaucccagcacuugagaggcugaggcaggaggaucaaaaauuccaggauagcuuggauuaugaagugagaucacaucucagaaaaaaaauuaauuagguauccaauucuuuaaaguguuugaagaaaacgagaguaaccacuauuaaggcugggaauaugacuuagugcaaagggcugaccgggcaggcaugagggccuggguugccuccugcaaaaccaaaagccucauuguuugugcaacuucaauugcuguggccugaaagaguaagcacccccacccccacccuggcaagguuucuaacuuauuauuaaagccagcauuagaaagagugugguggcacaugccuuuaagcccagcacugaagaagcagagguagaggggcagaggggcagaggggcagaggggcagaggggcagaggggcagaggcacagaggcagagggagagaggcagaggcagagagacagagaggcagaagcagguggaucucugaguucauagccagccugucaggucuaugagcaaguucuaggcagcaagggcuacaugaagaaacccuguuucaaaaauaaaugaauaauaaauaaauaaauaaauaaauaaauaccaaaaaagcaaacaaaagaaagagaaagaaaagaaugaaugaaacuccacauuucagauuuuuuaaauguuuuuuuuuccgaaaaaugauagauucaacuauuuugauggaguggcauguguguacauguauauguguuuauguguacaugugugugcauggggggaugacuguacuuauguggugagugugugugugccugccugugagugugcgugagugugugugagugugugugugugugugucacugcugggcauccaacccaggccuucacgcacgcuagacaagugcucuacuccugagccacuuccaaucuccucuugcuucacaugggacuaaggcagaaauugugucagauuuuuuuccaagccaauaaaguaagaaaccuaggugagauuuccagcuaagccagcuugagaaaauaagguguuuccuaucgccugugucaccuuccagcccugucuagugucccugguccuuuuccugcagugucaguuguugguugggcccugggaaauccccuacuaauaauagcuccuuugcccuuccugaauggagauagcacuugcuggggaagaugaaugucugcuuuuguuauuuacaagugugcacgcgcacaucugcucaccagugcacacacauaugcacaccuccuugaguuuucacagccauucuuuucucuucccuccgcucccccccccccccaauaacaacuuggugcagcucuuuagaagucuggucaucugaacagaucacucagguuagaggcugaguccuacggacaggcaaccccguuaaugcagagccccucuggggacguuuccucuucugguucugugugcuuuaccgcaggcuuguuaagcuguuucugcugaagggugggccucagagcuuuuaggguccuguguacccagagagcgguaccaacccggugcucauggagaagcuaaguguggggcugagagaaacugcucaccugcccuggcucugugagaagacacccagucaugccuggagacagauguggcccugccuauagcaugcaccgcacucacagccccagcagagccacugugacucugaaggcacccuugugccagcaagaggaaagacaagccugguaugcgugggacaaccagauagauuugguuuugauaggaagcuugauuguccaggaucuccucuaaguuguagaucuagggagggcgucaugaucucauugugccagagacugauaccaaucucaggucuccaaaggccaggaaaguucuaguccugggcagcuucccagcucuggcccuugucacauggucccccuguagagccagcccuggaaucugugcuguucagcagccaggagcgacuccaaucgaaggaccuccugccccagccggaagugaugugcaggagugagccugaauuccucacuucauggguguguaaucaaagagcccuggagggcccagaacagacaugcagguacucugacacaggacagggcccagggguggggaguuucuaguucacaaagaaccagauggggccugcucaugugaccagaaggaguaagccuaaguaagaaaagaaugcauuucucaucacaaggaaaggaggaagcccugggguucaaaccagcgcagaaacggaaaccaccacccccaccagcagcagcagcaccuaccacaccuaccacuaccaucugucccaggaagaggccaaucccucccucccucccucccugaguauucacugucagacuagguucccccuccucuuuauacaccucucggcauuauggggcuccacgccagccacccauuuuccauacagccaguucuuaggugacaggucuugcugcagcccaaaagcucauacccuggcccugucaaugcuugacuuuugugacuuccuaccccaauuccaccucagaaugccuuucugaccccuguaaggcuuuacauacccuucacucaucccauagguguaaggcagccauugucacccuugcuuuacaaaggaggaaaccgaggcacaggcaggagacaggcuagugauuggcagccuccaaggucaacacugaguccacacuaguacaacugucaggagguggagccagccagggcaggaacucugcacagucuuccuuugaagcagguuucccccucucagcagggcagcaaguauugcggaucuuacagaaauguuuacugaucugagacuccaggcccuuccucucugacagugggaaggaagaugaggaaggagcuuauggaagcaggaggcccagcaggcugcucucccuggacugauccuauagagcgcucugugcugcucuagaguuagcuuggaaaagguaucucaguugggaacauguuuacccugaaagcaggaugaccugaguucaauucccagaacucccuaagaauucgaggcacagcugggccaugguggugcacgccuuuaaucccagcacucgggaggcagaggcaggcgaauuucugaguucgaggccagccuggucuacagagugaguuucaggacagucagggcuacacagagaaacccugucucgauuaaaccaaaaaaaaaaaaaaaaaaaaaaaaauucgaggcacgcggugcauguguguaauuccagcucagggaggcagagacaggaggaucccagggccuaaccuaaccuaauuggugagccccaggugauugagaaacugcaaauuaacacugugcaugaugacagaacaaucguagacucaccuuucacagcuacugaaguaucagguauuggaagccacuccugagaggugcuugcgaugcuuugaaccugacaugccccuugcaagcaugcauuugaaugcuugguuccuggcucuuggcacug

SEQ ID NO: 7163 - RNA, 3090 nt, Mus musculus
ucuuaauaguuaguuuauucagauuucugcuuuuucaaguuuauaacuuaugcaaaauaaaguuugcaugcugucuuagucaggguuucuauuccugcacaaagaucaugaccaagaacaagauggggaggaaaggguuuauucagccaacacuucauguugcuguucaucaccaaaguaagucaugaccagaacuuaagcaggucaggaagcaggaguggaugcagaggccauggagggauguucuuuacuggcuuguuuccccuggcuugcucagccugcucucuuaaagaaccaagacuaccagcccccagauggucccacccacaaggggccuuucccccuugaucacuaacugagaaaaugccuuacagcuggaucucauggaggcauuuccucaacugaagcucccuucucugggauaaccccagcugugucaaguugacacacaaaaccagccaguacaccgcgaucaucaaaucauuuuguuacuacuucauaacugaaauuugcuacuguuaugaaucauauuuguaaauaucugauaagcaacaccugcaggacuugugacccacagguugagaacagcugcuguauggggcauuuucuuaaguagugauugauguaggccuaauuuuuuguggguggugccaugccuggcugguggucuuacguuccauaagaaagcaggcagagcaagcaauggggagcaagccaguaagcagcacuccuccauggccucuguaucagcuccugccuccagcuuccugugugaguucuuguccugacuuccuucaaugauggacagugauauggaagcauaagucaaauaaaucagcccuuuccuucccaccuugcuuuggucaugguguuccaucgaagccauagaaacuaagacacacagagagaaaauuuuauguuuuucuaaggaacacaggcuuuauaucuuauauaaaauauucgaggaaggaggaagaaaauaaguacucaguaauguuucuugagaaucauacagccuugauaccccacaccaucgaaggacaagguaaacaaaauaaaccaagacuuccccaacaacuuuccaaaguauaggucaacuguuuacaugagucuguaugaaaacaaaacaaccaaugaaaauaaagcagcuuguuuaaagaaugaaacuugagaaugggcccuuuucaaguggggugugcuggugcguggcuauagucacaacauuggaaaguuaaggcaggaggauugcaaguucgaagccaggcaggacuacagagugagacccugucucuaaaaacaaaauaaacccuuuccauaagaaaaugaacuauuguggguggguaggggagcaggacggggggggggggccucuggggggguauagggaacuuucgggauagcauuugaaauguaaauaaagaaaauaucugggcuggugagauggcucagugguuaagagugcugacugcucuuccaaaggucccaaguucaaaucccagcaaccaugugguggcucacaaccauccguaacgaaaucugaugcccucuuuuggagugucugaagacagcuacaguguacuuacauauaauaaauaaauaaaucuuaaaaaaaagaaaauaccuaauaaaauaauaauaaaaagaaaaugaacuauucaagauaaauuggauuaacauguccaugugaaaaaaaaacucacaugaaagauaaucauauucauuaucaacaugaauauaaaaauuaauuagaacacaaaaaucuauaucacauuaugacaaaauuaugagaaugugaggaaaucccucucauacguaaaugguaggagagcaauuuagaauaucuaguaaaagcguuuacauuccaaaauaaaaacaauuauauacucagguauauuuuguacugaggauguguucacauugucauuacuugacaaaauaagcaaagccuagugucuucccguaguaaaugaauuuauccaugcacaccacuuaguauagugucugggguauaagcuaagcaucauauaacaccuuguuauguaucaucaccaucgaucagucagucguaggagagauucuacaaaucuaucaauaucaucaacacugggaagaaacauauuugcgaugcucgaacacugucuggauagguguauugaaaagcuaauuaaccgccaacguuuggucaguuuggaggcugauugcuccucucucuccuagcacuaaggaggagcguguuuuccgagagacaacgcaaucuuucagucaagucgagaaaucuuggugggaccuugguguuugccuggugcuacccuuggguuuuggugauuugcugcagggcugcagguauucaguccuuucuggaccgcauguguagggaaagaggaacgaaggaacgguagucaccagggaggcuggugaggguccucuuggaaagcugcccgggacagaaggguugcaguucugcagccagaaaccaucccaucuugcugcuuagguguuguuggaaagccacuugcccaagaguggaagcaggcggcgcucggaggagagcgcacuccagcuucuggcccaggcuuagcucgcggcagcugacugcgggcaggacgcaagccucgaacuucaaguaagaaccucgggccccaggaaaaacuuaggcaaagcuugcaggcggaugaucgccuccgcgcagauccugaaagccuccuccgaaggaggagcuuucacgucuagaacgucaggccacucuggcugugagaggggcggaagccagccucgagggcugagagcuuguggccgcugaagccaaguucuuccgaccugugcaccgcguuucaggagccaucggggagcgaucaguggacagcagaagagaagcaacgaacccuggaggaucugagaucuccuccaccaaaacgcauccaagggccucauauccaguucuuuacgugcccacgacucuccggcugacccggugcaaaaccccagcuuccuguuaagggucccgaguguagcuucccggcagccccuaacacccggagcgcgacaaucuagcgcaccgggagcggcaggcgcgggcccgcacggacacag

SEQ ID NO: 7164 - RNA, 8272 nt, Mus musculus
gugaccgaaguguggucgggguggcugccaggcagaggccgggaggagggcgcgagcacgaccugggcgagcagggggccgaggcggcgggcagcacgggguucggggagccgggcucggggagggaagucgggaggcgaccucgccggggcucggggaggaccggggacaccggggagggggaggggcugggagcccggcgcgcgcggccgggggucugggggaggggacaggggcaggggcggcgcccgggcgcagcgggcggcgcgcggcggcauuaggugaagcucauggagacugugugcucgagcgccuugcggcgcagggaggcgaugcucgugccccgccacacgucgcugcuguccggagagcugcagagcuggggcgagccggagacguugcuggggccggggagggaggcgggcaccaugccggggaaggcgggcugguagaggugcgacugcagccccgcgccguuggagcccgccaggcuguuggacaagcccauggaguugggcgguggcccggccgccaggcugcacugggacagcgacugcgccauggccugcuggcggccgagcgcgggcggcagcggcagcugggacacgccaggcauggcggccgccgcccagcgggugucguuggcguggaaagagcacaggcugucgcccauggcggcggccgcggcggcggcagccgacgggaacuggggcagccccggcgugggcagcagcgugccuggcgcgcggaacacguugguggucuucuugcgcuucuuccacuuggcgcggcgauucuggaaccagaccugcagcgggcggggugaggggaagggagacaagacuccacgagguuagcgagcaggguccgagcuugagguccccaagccuugcuucacaccgucacccagucccagacugaaaugaugcuccgagcucgacaccccccccccccacgcccggcgcgagcucgaggcucuccgccgccgcggagccacgcacguccccuuagccuccaccgagcggagacuccgggcgcucucgugucgcggugcccucuggagcggaacacaccgagcaaacagcacugcauagaccaccguuugcagcguucaccguccugugcacucuggcauagucugugcaaugcacagagguaguaguggucgucaagcaggcaugugucaaggcucgacccacagguguacaaaugaagacaaacaugaguacccaugugacuuaauggcaugucucauagcacugauggaguauagaauuuucagaaacacuggaaauuuggggauugaugaaaggccacgaaugacauaaacaguuucaaaaucgaaagacaaaggaagcuccuaacaucacgguugacagagcagagagguuaauauagugacccguguggcaaagugagccacugagcuucgguguuauuugguugccaccuugauuucugauuucucccucagugcuuggagcaacugccacaaugcuccuccccaucucucucccaaaacgcucugagggcgccuuucucugccccaagccauucggggugugcuggagcucucugacugaaccccugggccuuacgccuuccaguaacuuacuucagauucgugguaacauguccucugauaccuguaagcugaacauaccccaacacaccucucguuuuauaaacuaaagcaaauuuccuaaacaaugcgaaggaaaggaggucagcuuuaagagucacgcuggucaggaugcaaaucuaaauuugcugggacaauggacugguuuuuuuuuccccccagggagaacugucuauuaaaauauacaucaaacaagcccuccuggcuuuuguuuccugauuauggcccaggaauuucagagccuaccaggcaaaugugccuacaaaugucaaaaucacugucacugagcaaaauuuccucuuagagguacuagacaaccaaccuauccaaccuugauaauuucuccucaccaucuauuugcauuuuaucuuuaaggggcuggggcuuccucagagaguuuaguuagcagacuuuucauucaaaaucuaguuagcgggaugacuacugaaacgaaauauaaaauggugccaggcacagaucagauguugacuaguuuccucuuagaauuuggccaacacacacacccuacucuccaaaucccccccccacgugauuuaucugguaauccaaucuauguaguagaugauuugcaagcugaagugucgaggguauggauauaccugccuucauucuugguaaaucaagaauuuauagcggugcaagcaagcauacacuuugcuuaccagugugaauaguuuugcagucuacaauccucucugagucugccuugccuuccuaucuuaccuagggcuucuuccagcacuuuaucuuucucuaguuuguacaccauuucccacauugcugcuuaacccuauauugaugcuggguaagcuuccuuagcgcaagcucuagagcuguggugcggggacuaaugaggcuucagggcccgaugaugaugauugcagcuggauggagcuguuagcagccuuuggccuuggguggacagugaagagaccuaaggucccaaagacccuuugcagcaccuagcugacacuagugugggaaguugggcaagaggacacccuugacugaaacuugcugugucugaaacuugcagccuccuaggaacauuuugaaagggagagucaggaccaauuccuaccacuccccagagcgagugaauccuaaauggucaguguuuugaagaugguaaauuggacaaaggcuuggagaaagaagcaacagagaaaaaaacaaaaacaaaaacaaaaaacacugcucagcagaguuucaagagcaaacaguacugcagaauccagaaagaaccacuguuaaaggacaaaauauuagaggaauaaucgaaaaaucaugcucaauuauguuugaggguuaguagucaaaugauggcuacaaaauuuuuaauguuucaugguuuacugagauucaagggggaaaaaucugcauggaaucugaacaccucaauuccaagcuaugaugcauauguuuuuuaaaaugugaauguuuccacuuggaaacuagagcaugucggguuaagaugcagacagaaccuaagggagaguuuuggaaugcacugaugacaacuccaggaaauccauuaaccacagccaaagacccaacuuugcacucaguuugaaaugcagcucuccucagaaaaaugcuuaauacaacagugagaaucuaauggagguuggaaucuaaaaauccacuuucaugauaucugcuguuacaguaauauagacauacuguaaauguauuuuaaaauauauagcccguuuaauuccccagcuauaaauggcucaggaauagaaaaagagggggagaaagaaagaaugcccccccacacacacacacuugaagcaaaugcuuuaugaagaccucauuggaauccagcaaaugauuaauguguagauaugggaggaaaucuggggagcuguauuaaagccuagaucucagguucauuucgaucagccagccgugaacucugggccgaauucauuacacuuuaauagugcugggagaggaagaaaaugcaauuucucauuccauuagaaaacucgaaaauacucucagcuuguccccccuauuaagauguggcaggugacagggccauucuaggggacacggucaauggaauuacagcacauuauuuuuguucauauaaaauauugaaaggcaagccugacugugcagaaguuauuucacugauuugguuuuuauguaaauaaaauauugaaaguuaauuaauccgugcuagagacuaaugauuaugcuuauuauauugcauuugaucgcguaauuugcaugauucucgcauugcugcuuaauaagccauuccagguuauaaauaauucugaaauugguuucuaauaauggcaugcuauaaaaggaaugguuuuauuacacuagccagaaaaggggaacaguaccauacaggaaguggccuccaugugaaaagaggugcuuuaguaaacacuucaaaaugugauauaguccagauaaaggcaaaaaaauaaauauacuggauaauucagucuaaaauuaaaaaguaucuuuaaaaacaugcaagcacaauaaguuaaauguuuagaucauuuuuaaucagugcaguggcccacauacuggaaagaauguguggcaaucuguuaacuauaaagaaaacuaugaagcacucaucauauaagaauguaaaccaauuacuauuuaauuugaauuuggucaaggagcaaugguacagugaauugugaaguaaauacauuucccauaaauuauuuucgcauuacguuacauaauguuaaucauuuugaaauguuaauuaagaagguuauguugaucugauuacuuuuuaaacuaugaaacauuauuuuuaaaaaauauugaaauugcuguucuauuaaauuguuuuuaucaguagacucaagcuauuaucuucgguugaacauuaugcuagaacaauuaacauacuuugucucuuucuucuugcauauucuuuuguguacuuuuugaacauaacuaccacacaguuuauauuuuauuucauuuauaacuuuuucuauuaaaagaaucacugccauuaaccuuuggaagaccuaauaaaguuuaauagaccucauuuucuuuuuuaauaaaaucagccauccaauuauauuuuauuugugauucuaaguucuauuuuaauuugaacuaauuaccaauaugucuagguuaagauacagcacugcacucuuuuauacaaaaauuaauagcaaagauuucucuugagagcaaaaaguaaauuugugaacuuugauucuucgauauugagcuuacaaucaaguauuauuguuggauuguauauuuccaugacaguuugaacccacacuuaaaaaguguaaggugaagauuuaaagaacauuuaauaugcccgaacaauguaauuaguacucuucauauguguaaugucuuugccccauuguuuaagcuuuucagaguucacuaacaaauacccagauuuauauuuaauaaaaauauuaaucguugugaauauuuaucuauuaauuugaccauuuuaagucucugggauauucauuucuuauuagaacaaagguauguauucccguuuagaugaacuacaaaaugccgaauggaaauaaauccugauuuccugaccaaucaaauguaaaagaacuguaguucuuaaaguuaauuuccaaaaucagguagcacuggcuuaacaaauuauuuaacuuagcacccaggauucuagaaggaaagggaaaaaagguccaaaguagagagaaaaauauuuucagcaccguggauagcucucggcaagcgcaaagcuucuucaaggcgccugucaaugaaauaguacauauugccagucuuuguaaaagaaacaagaaagaaaauugggguuuauuaaucuuauauuuucucucccaauuuucaaaagagauacaggugaaauuuucuagauuucauauaauuacaauuuagaaagugguuggauaaaauaugggcacaauaacaaauuccuccauuacaauuuaagcuuucuggccugaaaaguuccuucuuugggucaaauauccacaacagacagugcucauuuccugcuuuccuccuuaagggaaaucuuaauuauuuuauuaaaauucaagacccaaauuucauaggugguguaguauuuucggccagucccugcgcguaaaucacccaaggcaaaaaaagccuuugaaaacaacaaagcugaggguguuuugccuguaagacgaaagaaggugauauuuuaagagaauaaaaccacaccuggaaguuugaguacuccaccccgcuuuuuaaagacaccaacugcacugugguuccucuuccuuguuuccuguauuauuaugaaaugccccccauuuauccaaaugcauaauagaaacucauuacgggguaaugaaacacuugucaauagagcuggagcaaggugcgcgcugggcuuagcuucuggggagacgagaagguucccaucuuuguuggaagaaguuggacuugggccccgcagccccauaacaccgggcugcuuuugaggaguuuugagaugagggauggggcuacaauggaggaaguccaugggggccugugaucauccuagccaauauuuggacagaguaugguauccuccgacccaggaacguagaaacaacaagcgcgcagcucgggaucccagcagagcacaauaccuacuccgugcucuaauccuccccuucccuccuugccuuccuccccugagcccaagcccgccuuaccugcacccgcgacucggucagcccgauacgcagcgcuagcuccucacgcaugaagaugucgggguagugagucuuggcgaagcuccucuccaauucguugagcugugcuggggugaagcguguccgguggcgcuucuguuucuguuggcccugcuguuggccggcuuggcugggguuggggccgcccuggggccccggcugcuugucugggucuuuggcgcucaccgccagcgaagcagggguagagcccacgguggugauguccucgcccggcagcagaguggcuccuucgaccggguccgaguugggugccagguccccuggaugacccccagggucagagccccccacacccagccuacacuucaccgccucccgguggcccagaagcucggcggcaucuuucauaccugaggagggaaagggaucucgaucaguacuguccuggcgacgugaggagccggugacuucccugagagguucugcuucagccccauccaccgcucccucugcgcccacgcuugccccgaggcggaaacugccugguccucagcccgguuucccaggaauuggacagcuagguugaaauagcaucuccuggccuccuucucuccacagcccgcucuggugcuucacagcuccggccuucgugucucccacaaaacaaaacaaaaaacaaaacaaaaacaaaaacaaaaaaaccacucccaggccugacaaugaaacacacccgaguccuuucacuaacuguaacccuggugucccaggaaaccuugagaaaauucuuagucggguggugcgggagaaaaagaaaucaagagagagccuuuggaggcugcuccuccugagcaaaggcgcuaaaugaacucuggccaauucccucugacuuucggaagaugaauaugucuccaagccuuccaccucucaaaauaagcccaaaucagcuccgccucccccucaaaucagagaaaguguuugggaaacggagucacauccaucacuaaagcuccccaagccugaagcccagaacuugguaacccagauagcuucaaagaaauuuaaguaaacucuauagccauaacagugaaucaaacuuuagagaauucaacuuuucucucccgagaaauaaacggcucgucccuccccgucacugguaacaccgagucccuuguagaaggcagggaugcccgagaggaugaguugggcuuuucuucucaaccagcacacuuagcaaauccaccuucauacagcggcuucuccuucacaaaggagaagauuuuuuuuuaaaaaaagaaaacaaauuuaagcacacuuagaggagaaggugaugauagaaaggaagaaggggaaaaagggaugaaagaaauuccaaaucaaagcaaacaagaguggaaaaagagagaaacaccuccaaacaaauuaucgcgggcuagaacuccuuccaaaaauaauaauauuaauaaugaaggggagagagaaagaaaaaaauaagaaaaacaaaaaggugucagcauccccaacuccguuuuguuuuggaaucuacauauuccauagauuuuuuuuaagacgauguuaaaucaaauuaaacuuuaauacagcacaauuacuuuuaaagaaauuaguccauuuagggcgcauuaagguaaaauaaggaacaaauugacaauuuccugccccggcuucuccuggcugcccgggugagaggcgcucacucaccuagccuggcguccaggaggucggcgugagacagcaucgcgcaccgcuccagggcgaaagcuguucccccccaaauuuuagcggcuuuaaguuauuuaaaauagauauaagcuauaagcuauacgauauagauauauauagaucaccuaaaugaaagaaaauucgguuugugguuaaaaag

SEQ ID NO: 7165 - RNA, 3563 nt, Mus musculus
agugccugucacacaaacccgaggaccacaguucagguccccagcacacacaaaaaaacccucagaaggucaaggguaggcuuagauuuuucaaaagguucuuaaaugaauuagcaucuguucuagcccaccauccacuagaguuggugggaaggaaagguuaauagagcaaaggaagaugugggccuauuuagaaauauuucuuuggagcaaauccaaucugcauuguuaggauaucagcuguucaguuuaguugaaucagcagcagcagcuugguccucuggcaaacaccauucaggaaucagcaacagcaggucauccagaagaaaccacaaggcucugccaaucguucugacuccacgaaagccacaagaagcagccagugcccgaaucugcagaagugacaagaagacuccugaacaccaccagaaguuuuuugauguguuucucucuaugaagucuguagugugaaauuauuaaaaaaaaaaaaaacaauaaaaccaauccacgcuauuguuggcuaggcauuggcacuggucucucucugguccuagcuugguacaaagccuggaacugagacugcauguuucuccuagccaaagccucucccacaagugcugucuaugccucuccagaacuccgagaccacucuccacuccaaaauuuccguggcuagcuggugugugugugugugugugugugugugugugugugugugugugugugugugcacucucaccaacccacacuccacugugguuaucuuuccccuggagcucaguucuugcccaaucuuccuguuccauagccuggccaaauuacaccccagcuauguucuuccccucuggcacaccugagaggcugagaaauggaaaacaccagacaaucuuaguuuagaauaaacagacaacacaccugcugggugcagaaucuacuguccuaaacucaucaacuacuguaucacacagugaaauuugauucagcuguuaaaaaaaaauuggaguuguaaaguuuccaggaaaguggguggaucuggaaaauguuauagcaagugcugugacccagacucagaaacacaagugcuguguguucuccuucaugcguacggauccaaggcuuuaacguuugauccauggggcugcgagcauuagugugggcuaugaagcuggaaagggaacacaacggagaaaagaaguggggggugggggacagaacacacggagcacaaaagcagaaaggcugcugggugggguagguaaggaugaucaacagaaacaaauuuuguuugaaaauaccauauugcaaccuaauacuuuuugugcugguuuccaaaaacaacaacaacaacaacaaaccaaaaaccaaaaauguuagcacugagccugacgcagagggaauaauucaacugauuguuaguugcuauaaauaguaauaucaacuuauuaauauuugaucagcauauugaagcugauauaaauauaguaauaugaccguggaucucaaaauucauguuaauuuuuaaucuauacauuauaguuaacauauuaauguagccuuaauaauucauaauguuacauaagacaucaaauauuaauauguauuuucccaaacaauuuuauuacaauauuacauuuaaaaaaucucaccagcuaaaugucacuagugauuuuuuucuucauggucucuuuucucaaaccagguuugcaucugcuggcgaugauggaauuauaguuguguggaaugcccagguaaguaccaauuaaauguggacuauaaugaaaacauggcacugugguugaaaacucacucacuacuacugugugguacucaguaugcuggcuuauuauuaucaugugggauugguuaauauguugggaagguugguuagagauauucguuuacaacagggacuaguauuucauaauauuuuaagugugugcaugugugcgugugugcauguguaugucuguagagacuaaaagaguucugggcccuaggaacuggaguuaugggaauagugagucuccuaacauggguccucugcaagagcagcagauacucuuaaccaccgugcaucucuccagccucagagaguuuuggguggucagcuacuaugcagugacaucagaaaagaauuguuaguuuuuguaagaugguacaguuuuucauucaaccuuguaugauagcauaauaaaauuuucucucauguuugacuuuagucuguguaacuguguaaugggaggucugucuuucaaguguauuuaaagguugcuggaguuuccuggggcgucuccuggugguuuuaguugugcagguugcucuguuuuuauuuuucccuccuugcuccuucauccuggguguuugaucucacuguugguccucauuuuccuguggucuugcuuagauucagucauccuuuaacacuaaaguguccacaaguggcuccaguccuccucaaccucacacugggugcucacgugcccaugugaaauguuugcauagacucuccucacauccucccuugugcuuaaacuuaucuguaucauauacaucauacuuuacacaaugcaaacguugcagggaaugacgaagucuuuucauguucaguacaguucauucucuuucaauugguugauugguuggcuggcuggcugguugguugguugguugagacagucuggcccagguuggcccugaaccuuuguucucucugcuucagcauauugaagaccaggauaaaccaccauacauaugaaaaaacacuguaauuuuggucuaagauugguugaaucuggccagucaucauggcacaugccuauaauccuagaggcaaggucagguggaucaagagauccaggcuagccuuagcuucauaauaaauuugaggcaagcuugaacuauauugcuauuuccaaauaaacaaaaaaaugaaaucaguugaauccaucuucuauaagugguggaugcagaaggccagcuguacuguuaacacauucaugaaauccugcagacuuggaaagauugaaauucauauauauaguguguuucuaccugggaggugagggagagacugaaggaggacgacauggagugagugggacuaggcgcuggguuaagugugccugcagagcauggcgcugucauuuccacugcacccagagcugcaagagccuagacauguguacaugcaucugcuuucugucuacagaguaaacugcugcuacuguugccgagcugacaugauuccuaaaaaccauaggaaagguuauucaaaucaaugaugaaaauauccuaaaauagcauacugacuaaaaaauagccaaaauuacucacagcuguuuuuaacauuuauuuagauuauauuuauuugauuguuaaaaaauguuuaaauuucaaacacauaauuuuaaauggcauauguuuauuuucuacauaagcuauucucauuguuacuuaagagucuucauguuggaaagguuuguugacauuccuaccuguguuucagacaggagaaaaacuucuggaacucagaggacacacucagaagauaacggcugucauug

SEQ ID NO: 7166 - RNA, 4417 nt, Mus musculus
gagcugugucaucacuagcccuaaugucucauucugugugauuccacagcuccugccaaggcacuggccuggaggaacuuagucccuuuuccugugaucuucuuuuacuuuuguaagaucacaucuauacuccuggacagccuaugccacuaacugacauuugcagcaaaggucaaacugccgauagcccgugcaauggaggcaguagacgacacaagucaagagcaguugcuguuguagcccuggcggcaggcaugcucacguguuuuuguuuguucucuuuuguuguuguuuguaacuauugucacuuaaaacaacgcauaugcagcagugagcauggccuauuuuuuuuuuaagcucuuaaccucucagugugugucuucugacuauucugcaugacagaauggcaagcacaggacaccuucaugugcagccaccgucagggcgucucuaggaccagcaccagagcaguugagcugugaggugaauguguugcuuuuccucagggaguguuaauacgucacugucagggugcauggacaucuggguauccuacgugauacagggugucuggacucuugaagcugaaaggugagauccacuguggugauuugaauacgcuuggcccagggaguggcacuaguaggagguauagccucauuggaggauaagaugcuccuccucgcugccuggaagccagucuaugccaccagccuucagaugaagacauagaacucccagauccuccugucccaugccugccuggaugcugccacuccuugauaaugaacugaaccccugaaccuguaggccagccccaauugaauauuguucuuauaagaguugccuuggacauggugucucuucacagcagcuaacuaagacauccacauucccugauaaugucuggaacucgucacaugcuucauuugcaaccugauuuucaggccacacuggcauugucacuacaugauugugagagaaaggaccccugaggacuuaacagggggaccuucucccagugucaggaacgaggagugagcaucaaguccuccccaugugggucccaggaaacccauuaaugacuucuggcucagcucaaauaucuccugauguucugagagugaugugguccauacccucauucuuguuacuccaucugccccuccccacuucccaucucugacacagacaagcucagaacugccuggcugacuuuucugcaguucagaggcuccuuccuugccagccaugcuauauacagcaucagcuauucuucagucugccucaguuacacaucccagccagguagcagauuacccacuauguguuacuuacaguugcuugcuaucugucuucugugauacauauagacaccagucuuuaaaguuucuucuugaaauaggacucuacuucaaaagauaccugacaguuuacugucuucuacaguuuuaucuuuuuauccuguuuuuuacauuuuuaaauccuucaaaaauagaauucuaauaucauucuguaaagccccuuucuccuuugucuagggaaaaaaaaaucugaauucccauagcaucuaacacagauauauccuuagggguacuuuuuuuuuuuuuuuacuaguuuuuguauguguauguauaugugcaugcaugcauguauauaugugaguguugcguguggccuaugugcacaugugccuuugggugcuugugugcaaagggugaaggaugucagguguccugccuaugauuauuugccucguuccuuugagacaagguccuucuggaccuagaguggggcuggacccuguugaaccccaacagcccagucucugacccugcacagugcugaggucaaaggugcucacauggccacgcccugauucuuaacaggggugcuaagauuugaacuuaagugcucauguuuauauagcaaguguccuuacccauagaaccaucucucuagauauccaccucuuugaaccaagguaugggcuuaccugugucuauaacuaucucugaguaaagcgggugacccaugagcaggaugugccucccauaaugcaccagagagacagucaugucguaguaaauacacaguuuccuaauuauuagggaaguccaggauccaucaguuacagaauucccgcuagcccaggaggguuuugcucagugacuagcauacuggccugucucuugagagaaccacacaucuccagugauggcuaaggguggccuuccagagaaguucccuaccugugagacccacagaguucuguggccuaaggccuguuccuagaaggggaggggcacuucccacaugguaacacaccugagcaaaguacuccucggagauccuuccagcccauucaaugcacagguccaagggccggcacggguuggccacgucggcacacuuaaucaucaugcguuugaugaggauuugguucucaggaaaguucuucccgguaggguugcauucacaaucacugcccucacucugggaaaaaaaaccaaaaaacaacaaacaaaaccgaucagaucagggcuggggaaacucacagaggcuaacucaccggacacacagguuagucugggacuuagcaaugggaacugucugauuucuauauccauaaauaacauguuagcaucgucuuuaagaaccaucaauauuguaucgaauucaaaaggccaaaaguccccaucacccacugaccugguguagcagcuacaggcaguguuuguucugagcaguuuaggagaucaccuuaaaagggacugucucccacucucucucccucuccccgacuccucagaaauguaugaaaacacagcuuucaguuauuuuaauccaucaaaugucaagaaauugugacuuuucaauuccgucuucauuuguuuuuacuugguuuccucucgcugccuacccaccccccuucgucagccauguauacauccacgugugcuucuuggcuggcucucauugagagauaauuagugugaagugugaagcauggauauuugggccaaaaugcaagaggauguguguucggcagucucugaagacaugguuaugcagugcuauguaccuacugggggaaugccaguggcccagggcauggaaccaggucuguauguaugcauucacaccaauuucacagagccuggagaacuauccucuccaagaggcaccauggguuuguaugaagccguuaauuagcucuccagagcugggccaagcugaaagacagccugacguguagugggauuuuguugugagguugguccucuuuauuggacuccugagggaagacaguucuagacgcuguuuucccaacacccuaagaagguauuguuuacugcagaccaugugucgggcaguaaaucucaaacagaauuggagguaugaagagaugacugucucaauuccaaacucagucauucuguguaguuuuaugcucaaaacgucaagauacuuauuuguuccucucuaccucugccaggaggaaaccccuggcuugugugauggcauccgugggagauggggaucaacacggaugagcuggcaaucuuccucucccuagguuggucaugugauggguucuauagccagcguccuuacugaucaucaaguuaccuucagaacauuuauucuaccuuuuacaggacuggaaacuuaugccuuucaggagcuauggaacacacuuaugguuuccgaggagacagccaauuucauguuaguaaagggugaacauucugucuuauuucuaaagcccagagucguaaggcgcauaagugagguucaugguaaacuucucucuuuuuaaaauuuuuauuuaaaaaaaacauuuuguauauuuugaacauauucuucuuauuuucuucagguccuccauacuucccuacagauuuucaauguuauuuugucucuuuuuauuguauuuuuuauuggggggggaacaugaugcauuuauaaaaaaagaaaaaaagcuuacauuuuuguuuuuuuagucacacaguuagcuuuaauuaucaauuugacaauaucaugggcucuuccaggaagggagucuuaguugagggauugcccagaucagaucagccuauguaggcccaucucugugggauugucuugaguguuaauuguugugggaagaucaaccuauugauggcagcauccccagacaacugguuuugaucuauaaggaaaguggcuaagcgcgaacuggugaacguguccgugagcuuccuuccucccuccauggugucugccauacuuccuuggcugggagugaguucccggucagaauuagugcugcaugaaguagcagcauuucugccuucagacuccuggucuugaggucuugcuuaacuccccuccaggaaacacugacugagaacaaauaaaccuuuucuucccc

SEQ ID NO: 7167 - RNA, 13546 nt, Mus musculus
guuuuuuuuuuuuuuaaaguucaugcauuauuuauuuauaaagcauucauauaacaaggucauuuuuuuaaagccacaaauacaggcaguauauaaaguaagccuggagccauguacuccugcaauggccccuuguuucagaucuuccucaaacagaugagaagacguuaauuccauuauuggacaaauuagugaacaaaacugauaacagugaacaaaacugauaauaaauauuccaaugaucuguuuuuauaaaauacuaacugguagguuaaagcagacaggggacuaucugguggggagggaaacggcaaaggggggggaggggaagggcccugcuucacgggaaggacuaugaucgaggaugagggaaaacugacacuacaguaaugcuuuaucaugaaaaugucuuaaguucacaugauguaguuaacaauuaaguuagaaaaaaaccuaagcaguauuuguaguuggcccaaguuaaaaaaccaaaaaaccaaaaauuuuauuuacauuuuuaagagccucaucuucuuuuucuugacuaauaaacacacaaaauuacaacaaaguaauaaaggaacugaaaaucccaauaaaccaauaggcaaauucaucauaaacugaccaaaaaaagaggcucaaaacacugcuguugguuuuucuuugccaacauuacaguggugcccuggcaagcagaagcaggcucagcuccaugguucugugucugcagucaucacuaagguuuguagagccucacccccacccccacccccacccucacccccaucgugucugagcucccaggguuacugacgcuaagggaccugcacauugaucaagauccccaauaguucugaugaaauggugugagaauguaacuccagccaucugaauccuauuguccagcaaggccacuguuagccgguuaggaugccgccaggagccucauucacuccucauucacuccucucucaagucuguaaagucaaucaacuggacugaagcucuaccagggccucagguccugaacaaggccgagacgaacuccagauggaaaaggaagcauuucagagagucuuagccuucuugccagguguaguuuuuguuugguugguuuuuuuugcaagucacugacccuccaucuucucuucacuuucacaaaacaagcuccucucaguucguuucaguuucugauacugaugcuuuucaucagaguggaagacuguucucaugcaaaggaggaggcuucuggcaauccuggggagagcugcaugcuugugauuggugcagagacaggcagcuuggauaggaaaugacagccccaugcauguuggugcaucccuaccacgcacucacacacgggugcacacacacacacacacacacacacacacacacacacacaccaucaucaucaucaucaucaagcaggcuugacauccucagguacagcucaguaggagguuuuaacacugguugagcuugaagaguaggagccggacuuccuggagaacuuguuggagcugagcgagauuugcaugcgauucacagugcggacacuucggcagaggagcgcguuucuggcgugaucccugaaaucuuuugagacaaaguaauagacaaaggggucuaugcagcuguugagggucgacaggcagagggcgacaagguagagggcguagacguggcucugccucuggguuuugauuaggaaauaaugcacuacgagcagaagguugcuaggagcaaagcagaugaaguacauggccagcacggugaugaugagucggauagcccucugccuuuucuucucugaguguucauccauagcagaagagcggagcgucuugaucaugagcacguaggcagaugcaguaaggagggccgggaacaggaagacuccaauggccagugagaggaaguaauugaacaugucccccaccaauaccuccucaggcagcacaucgugacagguggugauguucaaugcuggaauguagauggucugcuucaugacauacaaagggauggugaccagaaaaaucaggagccagauugccaaggagacgccaacggcgauguuugccuucuuccuggggugucccaugggguucacgaucacccaguaccucugcacgcugaggcaggucaugaagaggauggagcaauacauguuaccauagaaaaagccaaugagcaccuugcacagggccuccccguagacccaguuguugccauguaggugguaggagaucuucagggggaaccagaugacagagaggaggucggccaaggccagguuggccauguaaaucacggcgggguguuucuucuucguucggaaaaggaagauccagagggccaugccauuacugggcaaaccaaucacaaacacaauaauguagacgaccggaagaaagaccguggucagcuucccggugaggauggacgcagagaacucaucgauggaaaagccugguucuaccggaaccccuuucccagugauuggaggcuggguuucuaaucugccaauaagacuucuuccuuuacuguuguugcguccuguacaaagaaagcggagcagaaucauuacugagauaaaugguccaacaguaaggcugcuguguuuuaaauggaacauuucagaugaacacagacagaugucauuagaguauugcagacaauauucucuuucagugaccgaccguccuacacagggcaguuggugacgguugaagucuaauucuugugugugcuggcaaguauuuuaccacugagcuacaucuucgccccgacaaugguauuucauuaacagugagaguuuuggguuccguauaggacagcgacuucuagaaaucuuaagacugacaggguuucauuuuauuuucuuuaaguagcuauacucauuaguucuuuuauuugaucacacaaccaccagcagucuuugauuggucaguuaguaaagacagauagauggaugauagauagauagauagauagauagauagauagauagauagauagauagauagauagauagaucagucuaggauugugugguaacucuucccgagucuuuggugaguaaggcagccuugucuugccaucagcugucuugguucucauuuucuauccuacucuggccuuaagccaagauucaaccuagccgucaaccacacccugccccaggggccagccuagggagauuccagaaccaggaggcauucccuuguccgcccacaagaaauacuauaauggguaggcauuccccaccucucugcuggcuucauaaacauccucccacugagcucaguuggcaggcaagccuuuuagcaucaggaccaaaugugcucugacuuuugagcguguaacagcaagcuuuaacuuaggaugcuuccuucauaccaugaauugaacauucuaaaccacaaauaacccugggcgugguagguugugccuauagucucagcuauuuggaaagcugaggugaauggacuguuuucacuuaaggaaucugagaccagccugggugacauagugagauuccauccaaagcaaagcgaaacagaacaacccuaccaagcagugacgggcaagcccagucuucauccugccccauccuguauucccucacugaccugaaggaggaagggugaacgcuaaggaauuuaacuuuaaugaugagacugaggccuccaccgucuggaaacaccugaacauuguucacguugacaaggaagacaguauaccucuccugacuuucucuaauauauugugugcucaguuaucugauccgcuucugguuccagacucagguucuacaggaccguucgcuucuguaggcuucaccacguugcgcugacacagggguaaugggaggagcacuggagguuacagagaucagcaguucccuuuccacccacuguagaaaaauaaagaugcucccuacccaaaaaagaagguguucaaguccuaauccccaguagacaagggucuuugcaacccuaagguacgaucuuaacaacacuauccagguuauccagucaggcccucgguccaaugacaauggucuuuuaacaagacauagggaagcuggggacagaaaaggagaaaacagcagaguaaacaacaugauggacaaugggaacaaaggcuggcacugugccaaggggcaccaaagauggcagcacccaaccggaugcuggagaugggcagauucucuuuccccaccacuuucauuccugaccccucaccucagaacccagagaguagcaucuguuguuuuauagcucugcucaucacaguggccuuaggaaaauaaaagcauuugacguaaacauauauauuguuucuauuucuucuauaacuguccaaaaaaaaaagcacuuuuuaaaaauuaaaaugggggcagagagcuggagagaugguucagcgguuaagagcacugguucuuucagagguccuuaguucaauucccaacaaccgcaugguggcucgugaccaucuguaaugggaucugaugcucuuucuggucugcagauguauaugcaacagagcacucauauauuaaauaagauuaaaagaaaaaauuaaaacaagggcuggagagagggcucaucgguuaagaggacuagcugcucuuccagagguccugaauucaauucucagcaacaacaugguggcucacagccaucuauaauaaguucugauguccucuucuggcauacaggugccaugcagauagacuacucauucauaaaauacauaaaucacuuaacaauuuuaaaacaaagccagguguagcggcauaugccuuuaguaugggacuuuggaggcagaggcaaauagaccucuaugauuuugaggccagcuugauagaauuauagaauuccaggccagccagggcuauauagagcucccaucucuaguuaauuaauuaaaaaauuaaaacaaauauuccuaaggagauggggaauguagcucaauugguagaguguuugccuauuguguaccagacacuguaaccccaagacucaggagguagaggcaggauaauuguaaauccaagggugccugcagcuacauagugaguuugaggccagccugggauacaugucucaagaaagauuauuccugaauauuacaauguucuucagauacugaauuagguaacuccaugaagaauauguucugcacgguaacccaguacuuaguacauagauccauaauggaauauugcacaaaauacccuucuauacagaaugcauguugguucucuggaguguuuuuuuaagccagaaccaggacugacuaacauugaagcagcucaaggaaacaguaaugauguguuugcagacucaacagcugcaaggaaaccuauauaggauuaaaggugucuuuaacccagccccuggcccagcccugacauaccucuggauuacaaugcucagcuacccacaucccuggaagaagugaggggggauccaaagccaccgcuccacuacgcauuucuacaggacguuggacuggaacaccgaaugccagaggccgcacauagaaccacaacaaauuacaggaccaugggugccaucauagagauuagcacugacucacugugggucugaaacuacggucugcacuauacgcaaggcaccuguaccacaaucaccacaaagcggagaaggcagcucaugcuauuuugccucauuuuauagaugaagaagcuaaggcacaaaucaguaacuaaguguggguccuaagguuaaacaguuguuaugugggaaaaauuaguucauuaccagaagccaugguuuugcucgcuaucccucaucacaccuaacugguacuacauguuagaccgcacagagaucugcccaaccugcauggauucuacacauacauuuccucaagcaaaauaucuaaaauuguaaauuuaacacacuaaaaguuacuuucuucaauuagccccuccuucaaaaauuaacacagucaccuguaucaaugucaacauguccugccagcccuuuagagggauuuaaaauaaaaaggcuuuguaaauccuccacagcugcccagaggacccgugagcagugggccagugcucuggggaccccacucaucugcaaaggcauccaggccugaaacagcccgcugcauguauuggugguuaguuuucuguuccuaugacacaauauuaugagcaaggcaauuuucagaaggaaaauguuauuugggccuacaguuccggagcgcucagggugugucaugguggggagaccaggccacaagcugcaggcauggcagcaggaacuagaagaucggaacucacaccuucaaacgcaaguacaaagcagagggaaaaucaaaagugguggagacacuuaaccucaaagccugccccagcaacaccacaccuuccagacagggccacucacuagagagcagguauucaaauauucgagccuauuggggauuggggggugcgcucucauucaaagcacccugaacuucuguggucaguggccugaggcuugagaguucucgcaaggaaaauccauuuucuucuguucccaaagaaaguuacauaauguucuguaacuacuaaggccacacaaaauaagagaugauuagacacucugaagaaaucuugcuggaacagacucugaccucauugugaucacaguacaucugcgcagauguaacagagauaaaaagugagcagccagggguggcaagauggcucaucgaguaaaggugcuugguuccaagcuggcauaccugacucugaaccccagaacgcacgugguugagagaaacaagucccacaccacaagcuuaucuccccauguacacaaugguauguucaaacacacacacacacacauacacacacacagaugggggaggggggcugcaauuuaaaaagugguuuagacacaacauacauauuccucacaguugugguggacaaaaaucggggaaggggggggggcuguaauuuaaaaagugguuuaggcgugauggugcacgccuuuaaucccagcacucgggaggcagaggcagguggauuucugaguucgaggccagccuggucuacaaagugaguuccaggacagccagggcuaaacagagagacccugucucaaaaaaaaaagugguuuagacacaacauacacauucuucacaguugugguggacaaaaauggggggagggggagccacagcacggcuaggaucuggugugagcgcccucucucucucccaaacugccagcuucgccugcauccucacaagccuuagguuucuuguugcuaggauucagcacauaacuaagggaggaaguguuuccuuaggcucaaagcacgaaugccacacagacagucacacucugaaggagaggggugguagacaugcaugcugaugcucaguuugcccucuccuuguacgcaggcugggaccagccuauggaaagggugggugcccagccacacucagaauaggaauucccuccucaauuagaacuguucuggcagggcacgaauccuagcacaugggaggccgagggagugagucucugagaucgagaucagccuggucuacagagugagcuccaggacagccagggcuauacagaaaaacccugucuggggaaaaaaaccaaccaaccaaccaaccaaccaaccaaacaaacaaacagaacauuagaaaaaacuguucugaaaacgcuucauggauaugcccacaggaauguuuuugugaugauuccaauccagucaagucgacagcgaagaucaaccacgauccccaagaaaaagguaaauauauucaugaaacaacuuguaccuuagcacucaaagcagcguuauuccuaauagcccuaaauggaaacaacucaaaaguccaucaacagaagaacaaauaaacaaaacgagaaguguccacaaugagauggcaccuagcaaugacaagaaagaucaaguacugaagccagacaugguagccuaugcuugccgcagaccuuggcugagguaugggaauugcuuaagccuaggaauuugauagucugccccagcagaacuagaacccaucucaaaacuaaacaggcugggauauagcucagcuucuacaugccuggagggcuucuaccagaagccggaagucugaucacuagcacccuauaaaacuggguaugguaagcccacacuaaucacagcacuccaugaggacgggagcuucaacgccuccguucacaacauggcuaacuugagugugaguucaaggccaucaugagccauaugagacucagagacucaaccaaacaugcaaccaaagcaacaaaacaugcaaccaaacaugcugggcgugauaguccaugauugguguucaaaaaaaaaaaaaaaaaaguaaggaaggaaggaaauagguuguugaugcaugcugcaacauggguaagucuugaaaacaaacaaacaaaccauuaaauaagaagccagucacagcagcccauacauuaugugaaucuaaucaaauaucuagaacaggcaaguccauagguagaaaguugacuaucaguggccagggcugguuaugggaaggcuguuaugcaacaacaaaggggauuccugugggucaucaaaaugcguucaaauugaccacugggauggucacaauucuguaaguauaccgaaaggcacuggacucucuuuaaaugggcuaacuguguguuaugaaaauuauuuggcaucgagacccuaauaaagcuauuaaaaguaacacagaaagacaggcugaggguagagaugaaacacaucuacccaagaauuacugaucacugcuguugugguggguaccaaaacuaauguauaagaaugauaaagagaaagaaguaacuaggaacaacauuccaacuaaagaaguauggcucggguuaaaacuuuaaaaaaggaagaggaagaaagacuaggaggaggaggaggcgucauucuucgauuccccaagcccugugcagauauaccacuguaaagguuggggcugcaccucagugguaaagugcuugcccagcauggauggacaaggcuugauuuccaggcugccuccccaagccccucacaaaauagaguugggaaucccagcuuuaaacucaacacugaagagucugggacaggagaucaugaguuccaggcaagucugggcuauucagcaagaucuugaauacagaacacaaacaacacgcaaacgguagcagccauucacauuaaaccacucugugucccaguucaaagguccuugaggcucuguccuuucuguauugcauaccaaacugcugguaucccugaugcuaguuguaaaccaggcucaguguuucaaaacugagcggagacuaugggugacuacgaacuggggacacaccagaguaccuggcucugagugcaucuuauuuguagggcuacaaucaacaguuccugucaggcauacaaaaacauacacccacucauguucguggccacacccagcccccacgacugccaaacaggaaacgggccuguguaucagccugcuucuaaguuacuauaccccuaguccuaagauuagacacucaccuuccuacaggaaauauacagccaacuguaaacaagaaaccaauaaaauaauacgcugucaucugcuucauaagacucuaauguacauuauucaaaaaaccugaaaucuaggguccucucaauauaaaauguaaaauuagggcugccucaaaauaaaauguaaaauuagggcugaggcucuagcucaguggcaaagugacugguuaauacacagaggcccuagguuuagugccuaauaccugggccacaccuggugugugugugugugugugugugugugugugugugugugugugugugugugugcauguuaguguguauaugccaucuuuuaaagcuguuaaaauuguguuacugaccuuuacauguuaaaucccauacuuguacaaggcuuuccucucuccaagcuauaaaaaguguguuuccuugaagcagaacaucgggagaagagcaaaccuugcucucucugucuuagguuuucggccacucauaaugcaagcugacacaaucuuuuuaaaaguugaaucacuguuuaaccaugguacaaaauaaucaucuccauaucaaaacuauuucaguaacuuacaagagcuauaacaccccuacaaaacaugcacagaagccugucuccugacuguauauagauuuauuguugaaaugcaaguaaguccuaggacagcaggaugguccuucugugguuuaagggacaccaguuggugguaggcuuggucucaguguuuuggcccuuucccagaguucuucgcuaccaacucuugggagcaccagauggagagaaaaaaagguuucaguugcuauuaacaacuauuaauauucaaccuauccauccuuuccuagguacacuuuuagcgaacuuugcaaacucuuuuucuuuuucccaaggggaacuguuuuccucaacauuuguccagauaguaaaaccauaagaaagucaaauacagacuucaugaggccugagggaucacgguuaaucaguaacaggaggaaggcagaggcaccaagcaucaaccucaagucccaucuccacguucacuagaguucuuuuauacuacgagaccucggaaagauccugugugccuguucacaaaacauuaauuuaacaagacgaagccagguuugccggugcuggucuauaaccauagcuacucgggaugaggaaguagaaccccagguucaaggccaaccuggguuaccuaguggacucgaggaaaguuugcgcaauuuaaggagacuuugccucaaaauaaaauguaaaauuagggcugaggcucuagcucaguggcaaagugacugguuaauacacagaggcccuagguuuagugccuaauaccugggccacaccuggugugugugugugugugugugcauguuaguguguauaugccaucuuuuaaagcuguuaaaauuguguuacugaccuuuacauguuaaaucccauacuuguacaaggcuuucuaauuuagaaauguguauuuuauguauuccucauguacaaaagcaugggaaagauauaaaucaaaauguuagcaagugguuauuuuaaguaccaauguuuaggaugauuccguuaaauuucuccuuucccuguuuucucuucucagugaccacauauuaauguuauaauuuaaaaaaagaaaauguuaucgggagcuggaaagaugccucagcauuguacccucguggacucacaacugucuguaacucuaguucaaggggauccaacacccucacccagauaugaaugcaggcaaaaacaccagugcacauaauuuuucuaaaauuacauuuuaaaauguugucuagguaugguagugcauuccuguaaucccaucauucaggagaacagacaaaaguguugcaaguucaaggccaguguggucaacauagacaauuucagagcaaccagggauacacaaugagacuaauucaaaggaagaaaaggaagacuacaacaaaaaaacaaacacacacccaagaagauccagucuuaaaacugaaauggacugacugugugacuaggaaaauagcaacgguccagcacuugcccagccugugcaaagcccuagguuggaugcccagcauggcaagaaaucaagaaacaaaauauggagauggaagagggggaggggagcaggagagggagacaguaguagugauugugucugugggaaacugacuuaaacgucacauucgcaauucagugccccuccccccagcugggacccuuuccgagaaacaauuuuuuggggguggagaaaaccaagcucaaucugcuguuuaacaggccaaggagcacgcagaaagaccagaccuaagcggcaugagcaaagaaggcaagcaaggugccccguguccuaaccaaaauuaauuuaauuacaauggggggggggggacggacccaauaccucccgguaucuaaagucucuguuacuagacuaacucuuuaggaaaguuaccggcaauggagcauaauuaugcagagagaaaagccaaguugggauauuaaguagcucggguuaacaaguaacccaauuuuuuuguuguuguuguuaaaaucaaguucaccacguacgcuaggaaccucuaccucccaaucuccucacucugaaaacagaggaagccgacuaaucaggguaugcuuccuauacuagguaaaucacgaaaguaaucaccuccaaccacuuuuuuuuuaaguuugcacacacuuuguuccugaguuuuuaaauuucuaacuuuaaaugacaggcaaacggagagggguuggacgcucuucuacaacuuaacgacaaaguaaaagugagaaauagccuuuaagacuacagcaaguuuagaacggaaacgccaggccggguuuugcaauagcgcuaucacugguagcaaacacccccccaccccacccuacagccuacagaggucuccguggcuucuagaagggccaguucgagcucaccaggagcugcaacgcccaagccggcagcgggccagaggagcaccgccccgaaccgcuuuccugcaguucgguuccuugggcauggcagccucagagagagaccuggguggcugccaguguucgcucccggcggcgggaaggucucgaaaucucuaggcuggagauuucaccugguaaggguccgaaagggccccuucuaccaccacgugacauucaaaccgccugagucccgugcccagcgcauccacugcgaugccagguaccguagccccgagugggucuugaacacugugguucaacccgcaaagaaaggguucagugagugggugggugcgaguguaaaacucgaggugggaacuucccagggcacgggcucccacucacuccacccauacgugagccaucaaacugcuauaauccgggggucuaguaagacccuauaggacguaguucgcaggguccgcgaaaaccaauuacugacucaguguuuguaaaggaacgaccgcagggaggggaggcugaguccugcgggcgcuccuuccuuaucuccccgaaccacgucgacgaguagagauuggaagugcccagaccaggauuguuucuagcgcgucuuugguggcacuuaggugucccggcugauugguccugguuagggacccccaucaaagcuacagagaguguccagggggugugcccgccuuccccgauucccccaccagcccagagcguuccuucgccgcucgagcucacccggugcaagguucucgguccggcugcaggagaccgaggccgccagaagggugauaccucccagcagccacgccaggcugagacuucgcauccccggacguggggcgggcgggcaauccgccaccagugguucgaaacucggagcccuacucugagcacagggucccuucccuuaacacgagcuucacugagccuuccuggggcgggaccuguuucagugaaaccg

SEQ ID NO: 7168 - RNA, 13546 nt, Mus musculus
cgguuucacugaaacaggucccgccccaggaaggcucagugaagcucguguuaagggaagggacccugugcucagaguagggcuccgaguuucgaaccacugguggcggauugcccgcccgccccacguccggggaugcgaagucucagccuggcguggcugcugggagguaucacccuucuggcggccucggucuccugcagccggaccgagaaccuugcaccgggugagcucgagcggcgaaggaacgcucugggcuggugggggaaucggggaaggcgggcacacccccuggacacucucuguagcuuugaugggggucccuaaccaggaccaaucagccgggacaccuaagugccaccaaagacgcgcuagaaacaauccuggucugggcacuuccaaucucuacucgucgacgugguucggggagauaaggaaggagcgcccgcaggacucagccuccccucccugcggucguuccuuuacaaacacugagucaguaauugguuuucgcggacccugcgaacuacguccuauagggucuuacuagacccccggauuauagcaguuugauggcucacguauggguggagugagugggagcccgugcccugggaaguucccaccucgaguuuuacacucgcacccacccacucacugaacccuuucuuugcggguugaaccacaguguucaagacccacucggggcuacgguaccuggcaucgcaguggaugcgcugggcacgggacucaggcgguuugaaugucacguggugguagaaggggcccuuucggacccuuaccaggugaaaucuccagccuagagauuucgagaccuucccgccgccgggagcgaacacuggcagccacccaggucucucucugaggcugccaugcccaaggaaccgaacugcaggaaagcgguucggggcggugcuccucuggcccgcugccggcuugggcguugcagcuccuggugagcucgaacuggcccuucuagaagccacggagaccucuguaggcuguagggugggguggggggguguuugcuaccagugauagcgcuauugcaaaacccggccuggcguuuccguucuaaacuugcuguagucuuaaaggcuauuucucacuuuuacuuugucguuaaguuguagaagagcguccaaccccucuccguuugccugucauuuaaaguuagaaauuuaaaaacucaggaacaaagugugugcaaacuuaaaaaaaaagugguuggaggugauuacuuucgugauuuaccuaguauaggaagcauacccugauuagucggcuuccucuguuuucagagugaggagauugggagguagagguuccuagcguacguggugaacuugauuuuaacaacaacaacaaaaaaauuggguuacuuguuaacccgagcuacuuaauaucccaacuuggcuuuucucucugcauaauuaugcuccauugccgguaacuuuccuaaagaguuagucuaguaacagagacuuuagauaccgggagguauuggguccguccccccccccccauuguaauuaaauuaauuuugguuaggacacggggcaccuugcuugccuucuuugcucaugccgcuuaggucuggucuuucugcgugcuccuuggccuguuaaacagcagauugagcuugguuuucuccacccccaaaaaauuguuucucggaaagggucccagcuggggggaggggcacugaauugcgaaugugacguuuaagucaguuucccacagacacaaucacuacuacugucucccucuccugcuccccucccccucuuccaucuccauauuuuguuucuugauuucuugccaugcugggcauccaaccuagggcuuugcacaggcugggcaagugcuggaccguugcuauuuuccuagucacacagucaguccauuucaguuuuaagacuggaucuucuuggguguguguuuguuuuuuuguuguagucuuccuuuucuuccuuugaauuagucucauuguguaucccugguugcucugaaauugucuauguugaccacacuggccuugaacuugcaacacuuuugucuguucuccugaaugaugggauuacaggaaugcacuaccauaccuagacaacauuuuaaaauguaauuuuagaaaaauuaugugcacugguguuuuugccugcauucauaucugggugaggguguuggauccccuugaacuagaguuacagacaguugugaguccacgaggguacaaugcugaggcaucuuuccagcucccgauaacauuuucuuuuuuuaaauuauaacauuaauauguggucacugagaagagaaaacagggaaaggagaaauuuaacggaaucauccuaaacauugguacuuaaaauaaccacuugcuaacauuuugauuuauaucuuucccaugcuuuuguacaugaggaauacauaaaauacacauuucuaaauuagaaagccuuguacaaguaugggauuuaacauguaaaggucaguaacacaauuuuaacagcuuuaaaagauggcauauacacacuaacaugcacacacacacacacacacaccagguguggcccagguauuaggcacuaaaccuagggccucuguguauuaaccagucacuuugccacugagcuagagccucagcccuaauuuuacauuuuauuuugaggcaaagucuccuuaaauugcgcaaacuuuccucgaguccacuagguaacccagguuggccuugaaccugggguucuacuuccucaucccgaguagcuaugguuauagaccagcaccggcaaaccuggcuucgucuuguuaaauuaauguuuugugaacaggcacacaggaucuuuccgaggucucguaguauaaaagaacucuagugaacguggagaugggacuugagguugaugcuuggugccucugccuuccuccuguuacugauuaaccgugaucccucaggccucaugaagucuguauuugacuuucuuaugguuuuacuaucuggacaaauguugaggaaaacaguuccccuugggaaaaagaaaaagaguuugcaaaguucgcuaaaaguguaccuaggaaaggauggauagguugaauauuaauaguuguuaauagcaacugaaaccuuuuuuucucuccaucuggugcucccaagaguugguagcgaagaacucugggaaagggccaaaacacugagaccaagccuaccaccaacuggugucccuuaaaccacagaaggaccauccugcuguccuaggacuuacuugcauuucaacaauaaaucuauauacagucaggagacaggcuucugugcauguuuuguagggguguuauagcucuuguaaguuacugaaauaguuuugauauggagaugauuauuuuguaccaugguuaaacagugauucaacuuuuaaaaagauugugucagcuugcauuaugaguggccgaaaaccuaagacagagagagcaagguuugcucuucucccgauguucugcuucaaggaaacacacuuuuuauagcuuggagagaggaaagccuuguacaaguaugggauuuaacauguaaaggucaguaacacaauuuuaacagcuuuaaaagauggcauauacacacuaacaugcacacacacacacacacacacacacacacacacacacacacacacacacacaccagguguggcccagguauuaggcacuaaaccuagggccucuguguauuaaccagucacuuugccacugagcuagagccucagcccuaauuuuacauuuuauuuugaggcagcccuaauuuuacauuuuauauugagaggacccuagauuucagguuuuuugaauaauguacauuagagucuuaugaagcagaugacagcguauuauuuuauugguuucuuguuuacaguuggcuguauauuuccuguaggaaggugagugucuaaucuuaggacuagggguauaguaacuuagaagcaggcugauacacaggcccguuuccuguuuggcagucgugggggcuggguguggccacgaacaugaguggguguauguuuuuguaugccugacaggaacuguugauuguagcccuacaaauaagaugcacucagagccagguacucugguguguccccaguucguagucacccauagucuccgcucaguuuugaaacacugagccugguuuacaacuagcaucagggauaccagcaguuugguaugcaauacagaaaggacagagccucaaggaccuuugaacugggacacagagugguuuaaugugaauggcugcuaccguuugcguguuguuuguguucuguauucaagaucuugcugaauagcccagacuugccuggaacucaugaucuccugucccagacucuucaguguugaguuuaaagcugggauucccaacucuauuuugugaggggcuuggggaggcagccuggaaaucaagccuuguccauccaugcugggcaagcacuuuaccacugaggugcagccccaaccuuuacagugguauaucugcacagggcuuggggaaucgaagaaugacgccuccuccuccuccuagucuuucuuccucuuccuuuuuuaaaguuuuaacccgagccauacuucuuuaguuggaauguuguuccuaguuacuucuuucucuuuaucauucuuauacauuaguuuugguacccaccacaacagcagugaucaguaauucuuggguagauguguuucaucucuacccucagccugucuuucuguguuacuuuuaauagcuuuauuagggucucgaugccaaauaauuuucauaacacacaguuagcccauuuaaagagaguccagugccuuucgguauacuuacagaauugugaccaucccaguggucaauuugaacgcauuuugaugacccacaggaauccccuuuguuguugcauaacagccuucccauaaccagcccuggccacugauagucaacuuucuaccuauggacuugccuguucuagauauuugauuagauucacauaauguaugggcugcugugacuggcuucuuauuuaaugguuuguuuguuuguuuucaagacuuacccauguugcagcaugcaucaacaaccuauuuccuuccuuccuuacuuuuuuuuuuuuuuuuuugaacaccaaucauggacuaucacgcccagcauguuugguugcauguuuuguugcuuugguugcauguuugguugagucucugagucucauauggcucaugauggccuugaacucacacucaaguuagccauguugugaacggaggcguugaagcucccguccucauggagugcugugauuagugugggcuuaccauacccaguuuuauagggugcuagugaucagacuuccggcuucugguagaagcccuccaggcauguagaagcugagcuauaucccagccuguuuaguuuugagauggguucuaguucugcuggggcagacuaucaaauuccuaggcuuaagcaauucccauaccucagccaaggucugcggcaagcauaggcuaccaugucuggcuucaguacuugaucuuucuugucauugcuaggugccaucucauuguggacacuucucguuuuguuuauuuguucuucuguugauggacuuuugaguuguuuccauuuagggcuauuaggaauaacgcugcuuugagugcuaagguacaaguuguuucaugaauauauuuaccuuuuucuuggggaucgugguugaucuucgcugucgacuugacuggauuggaaucaucacaaaaacauuccugugggcauauccaugaagcguuuucagaacaguuuuuucuaauguucuguuuguuuguuugguugguugguugguugguugguugguuuuuuuccccagacaggguuuuucuguauagcccuggcuguccuggagcucacucuguagaccaggcugaucucgaucucagagacucacucccucggccucccaugugcuaggauucgugcccugccagaacaguucuaauugaggagggaauuccuauucugaguguggcugggcacccacccuuuccauaggcuggucccagccugcguacaaggagagggcaaacugagcaucagcaugcaugucuaccaccccucuccuucagagugugacugucuguguggcauucgugcuuugagccuaaggaaacacuuccucccuuaguuaugugcugaauccuagcaacaagaaaccuaaggcuugugaggaugcaggcgaagcuggcaguuugggagagagagagggcgcucacaccagauccuagccgugcuguggcucccccuccccccauuuuuguccaccacaacugugaagaauguguauguugugucuaaaccacuuuuuuuuuugagacagggucucucuguuuagcccuggcuguccuggaacucacuuuguagaccaggcuggccucgaacucagaaauccaccugccucugccucccgagugcugggauuaaaggcgugcaccaucacgccuaaaccacuuuuuaaauuacagccccccccccuuccccgauuuuuguccaccacaacugugaggaauauguauguugugucuaaaccacuuuuuaaauugcagccccccucccccaucuguguguguguauguguguguguguguguuugaacauaccauuguguacauggggagauaagcuuguggugugggacuuguuucucucaaccacgugcguucugggguucagagucagguaugccagcuuggaaccaagcaccuuuacucgaugagccaucuugccaccccuggcugcucacuuuuuaucucuguuacaucugcgcagauguacugugaucacaaugaggucagagucuguuccagcaagauuucuucagagugucuaaucaucucuuauuuuguguggccuuaguaguuacagaacauuauguaacuuucuuugggaacagaagaaaauggauuuuccuugcgagaacucucaagccucaggccacugaccacagaaguucagggugcuuugaaugagagcgcaccccccaauccccaauaggcucgaauauuugaauaccugcucucuagugaguggcccugucuggaaggugugguguugcuggggcaggcuuugagguuaagugucuccaccacuuuugauuuucccucugcuuuguacuugcguuugaaggugugaguuccgaucuucuaguuccugcugccaugccugcagcuuguggccuggucuccccaccaugacacacccugagcgcuccggaacuguaggcccaaauaacauuuuccuucugaaaauugccuugcucauaauauugugucauaggaacagaaaacuaaccaccaauacaugcagcgggcuguuucaggccuggaugccuuugcagaugagugggguccccagagcacuggcccacugcucacggguccucugggcagcuguggaggauuuacaaagccuuuuuauuuuaaaucccucuaaagggcuggcaggacauguugacauugauacaggugacuguguuaauuuuugaaggaggggcuaauugaagaaaguaacuuuuaguguguuaaauuuacaauuuuagauauuuugcuugaggaaauguauguguagaauccaugcagguugggcagaucucugugcggucuaacauguaguaccaguuaggugugaugagggauagcgagcaaaaccauggcuucugguaaugaacuaauuuuucccacauaacaacuguuuaaccuuaggacccacacuuaguuacugauuugugccuuagcuucuucaucuauaaaaugaggcaaaauagcaugagcugccuucuccgcuuuguggugauugugguacaggugccuugcguauagugcagaccguaguuucagacccacagugagucagugcuaaucucuaugauggcacccaugguccuguaauuuguugugguucuaugugcggccucuggcauucgguguuccaguccaacguccuguagaaaugcguaguggagcgguggcuuuggauccccccucacuucuuccagggauguggguagcugagcauuguaauccagagguaugucagggcugggccaggggcuggguuaaagacaccuuuaauccuauauagguuuccuugcagcuguugagucugcaaacacaucauuacuguuuccuugagcugcuucaauguuagucaguccugguucuggcuuaaaaaaacacuccagagaaccaacaugcauucuguauagaaggguauuuugugcaauauuccauuauggaucuauguacuaaguacuggguuaccgugcagaacauauucuucauggaguuaccuaauucaguaucugaagaacauuguaauauucaggaauaaucuuucuugagacauguaucccaggcuggccucaaacucacuauguagcugcaggcacccuuggauuuacaauuauccugccucuaccuccugagucuugggguuacagugucugguacacaauaggcaaacacucuaccaauugagcuacauuccccaucuccuuaggaauauuuguuuuaauuuuuuaauuaauuaacuagagaugggagcucuauauagcccuggcuggccuggaauucuauaauucuaucaagcuggccucaaaaucauagaggucuauuugccucugccuccaaagucccauacuaaaggcauaugccgcuacaccuggcuuuguuuuaaaauuguuaagugauuuauguauuuuaugaaugaguagucuaucugcauggcaccuguaugccagaagaggacaucagaacuuauuauagauggcugugagccaccauguuguugcugagaauugaauucaggaccucuggaagagcagcuaguccucuuaaccgaugagcccucucuccagcccuuguuuuaauuuuuucuuuuaaucuuauuuaauauaugagugcucuguugcauauacaucugcagaccagaaagagcaucagaucccauuacagauggucacgagccaccaugcgguuguugggaauugaacuaaggaccucugaaagaaccagugcucuuaaccgcugaaccaucucuccagcucucugcccccauuuuaauuuuuaaaaagugcuuuuuuuuuuggacaguuauagaagaaauagaaacaauauauauguuuacgucaaaugcuuuuauuuuccuaaggccacugugaugagcagagcuauaaaacaacagaugcuacucucuggguucugaggugaggggucaggaaugaaagugguggggaaagagaaucugcccaucuccagcauccgguugggugcugccaucuuuggugccccuuggcacagugccagccuuuguucccauuguccaucauguuguuuacucugcuguuuucuccuuuucuguccccagcuucccuaugucuuguuaaaagaccauugucauuggaccgagggccugacuggauaaccuggauaguguuguuaagaucguaccuuaggguugcaaagacccuugucuacuggggauuaggacuugaacaccuucuuuuuuggguagggagcaucuuuauuuuucuacaguggguggaaagggaacugcugaucucuguaaccuccagugcuccucccauuaccccugugucagcgcaacguggugaagccuacagaagcgaacgguccuguagaaccugagucuggaaccagaagcggaucagauaacugagcacacaauauauuagagaaagucaggagagguauacugucuuccuugucaacgugaacaauguucagguguuuccagacgguggaggccucagucucaucauuaaaguuaaauuccuuagcguucacccuuccuccuucaggucagugagggaauacaggauggggcaggaugaagacugggcuugcccgucacugcuugguaggguuguucuguuucgcuuugcuuuggauggaaucucacuaugucacccaggcuggucucagauuccuuaagugaaaacaguccauucaccucagcuuuccaaauagcugagacuauaggcacaaccuaccacgcccaggguuauuugugguuuagaauguucaauucaugguaugaaggaagcauccuaaguuaaagcuugcuguuacacgcucaaaagucagagcacauuugguccugaugcuaaaaggcuugccugccaacugagcucagugggaggauguuuaugaagccagcagagagguggggaaugccuacccauuauaguauuucuugugggcggacaagggaaugccuccugguucuggaaucucccuaggcuggccccuggggcagggugugguugacggcuagguugaaucuuggcuuaaggccagaguaggauagaaaaugagaaccaagacagcugauggcaagacaaggcugccuuacucaccaaagacucgggaagaguuaccacacaauccuagacugaucuaucuaucuaucuaucuaucuaucuaucuaucuaucuaucuaucuaucuaucuaucuaucauccaucuaucugucuuuacuaacugaccaaucaaagacugcuggugguugugugaucaaauaaaagaacuaaugaguauagcuacuuaaagaaaauaaaaugaaacccugucagucuuaagauuucuagaagucgcuguccuauacggaacccaaaacucucacuguuaaugaaauaccauugucggggcgaagauguagcucagugguaaaauacuugccagcacacacaagaauuagacuucaaccgucaccaacugcccuguguaggacggucggucacugaaagagaauauugucugcaauacucuaaugacaucugucuguguucaucugaaauguuccauuuaaaacacagcagccuuacuguuggaccauuuaucucaguaaugauucugcuccgcuuucuuuguacaggacgcaacaacaguaaaggaagaagucuuauuggcagauuagaaacccagccuccaaucacugggaaagggguuccgguagaaccaggcuuuuccaucgaugaguucucugcguccauccucaccgggaagcugaccacggucuuucuuccggucgucuacauuauuguguuugugauugguuugcccaguaauggcauggcccucuggaucuuccuuuuccgaacgaagaagaaacaccccgccgugauuuacauggccaaccuggccuuggccgaccuccucucugucaucugguucccccugaagaucuccuaccaccuacauggcaacaacugggucuacggggaggcccugugcaaggugcucauuggcuuuuucuaugguaacauguauugcuccauccucuucaugaccugccucagcgugcagagguacugggugaucgugaaccccaugggacaccccaggaagaaggcaaacaucgccguuggcgucuccuuggcaaucuggcuccugauuuuucuggucaccaucccuuuguaugucaugaagcagaccaucuacauuccagcauugaacaucaccaccugucacgaugugcugccugaggagguauuggugggggacauguucaauuacuuccucucacuggccauuggagucuuccuguucccggcccuccuuacugcaucugccuacgugcucaugaucaagacgcuccgcucuucugcuauggaugaacacucagagaagaaaaggcagagggcuauccgacucaucaucaccgugcuggccauguacuucaucugcuuugcuccuagcaaccuucugcucguagugcauuauuuccuaaucaaaacccagaggcagagccacgucuacgcccucuaccuugucgcccucugccugucgacccucaacagcugcauagaccccuuugucuauuacuuugucucaaaagauuucagggaucacgccagaaacgcgcuccucugccgaaguguccgcacugugaaucgcaugcaaaucucgcucagcuccaacaaguucuccaggaaguccggcuccuacucuucaagcucaaccaguguuaaaaccuccuacugagcuguaccugaggaugucaagccugcuugaugaugaugaugaugauggugugugugugugugugugugugugugugugugugugugugcacccgugugugagugcgugguagggaugcaccaacaugcauggggcugucauuuccuauccaagcugccugucucugcaccaaucacaagcaugcagcucuccccaggauugccagaagccuccuccuuugcaugagaacagucuuccacucugaugaaaagcaucaguaucagaaacugaaacgaacugagaggagcuuguuuugugaaagugaagagaagauggagggucagugacuugcaaaaaaaaccaaccaaacaaaaacuacaccuggcaagaaggcuaagacucucugaaaugcuuccuuuuccaucuggaguucgucucggccuuguucaggaccugaggcccugguagagcuucaguccaguugauugacuuuacagacuugagagaggagugaaugaggagugaaugaggcuccuggcggcauccuaaccggcuaacaguggccuugcuggacaauaggauucagauggcuggaguuacauucucacaccauuucaucagaacuauuggggaucuugaucaaugugcaggucccuuagcgucaguaacccugggagcucagacacgaugggggugagggugggggugggggugggggugaggcucuacaaaccuuagugaugacugcagacacagaaccauggagcugagccugcuucugcuugccagggcaccacuguaauguuggcaaagaaaaaccaacagcaguguuuugagccucuuuuuuuggucaguuuaugaugaauuugccuauugguuuauugggauuuucaguuccuuuauuacuuuguuguaauuuuguguguuuauuagucaagaaaaagaagaugaggcucuuaaaaauguaaauaaaauuuuugguuuuuugguuuuuuaacuugggccaacuacaaauacugcuuagguuuuuuucuaacuuaauuguuaacuacaucaugugaacuuaagacauuuucaugauaaagcauuacuguagugucaguuuucccucauccucgaucauaguccuucccgugaagcagggcccuuccccuccccccccuuugccguuucccuccccaccagauaguccccugucugcuuuaaccuaccaguuaguauuuuauaaaaacagaucauuggaauauuuauuaucaguuuuguucacuguuaucaguuuuguucacuaauuuguccaauaauggaauuaacgucuucucaucuguuugaggaagaucugaaacaaggggccauugcaggaguacauggcuccaggcuuacuuuauauacugccuguauuuguggcuuuaaaaaaaugaccuuguuauaugaaugcuuuauaaauaaauaaugcaugaacuuuaaaaaaaaaaaaaac

SEQ ID NO: 7169 - RNA, 16712 nt, Mus musculus
auuccagacaccaagcaugguuuuaguuuauuaauauauuuuuuuuuaaaaaagagggugaacacaaaacaaugacguaaaaggucacaagcgcggugauaacaguuacauuaagucacagacagaacacgggacagggagucaguaauugagaucagccaacaccggaaccaaguuaaccauacaaccauaggacuuucguggaagcgacucuacaguauuuggaaauacuuuguucucuuaaauaaacaaccuuucuacucuuauuugcuuaaaaugccaacauauuuuuucaucagaaaaaggauauguuuuaaauuaauuuucaaauuauuuugucaaagguaugaagauuuuauaugcuuguuagucacuguggcauuaaaaaugcuuuacaaauaaucucaauaacucaagaaaaauacagaauaaauuucaaucaaugaaauuuccuuucauuacuauuauuuuuaaccaaacugaccuauauauuucuuaaaauuggacuuaaguaaaacuuuuuguguuugcuuguuucuuaaaaaaaaaauuguuuaagaucugccugccucugccucccaaguucugggauuaaagguguauaccauaaugccuggcugauuugaguaauuuuugaaaaaacauuuguaaauaaauaguguguaauuuuguaggcugaagggcauauguauuaaaaauauacaucuuauacuguguuuuuauccuaaucuauagcuacuggaagcagaaacucagauaugcaaagcaguuuagcugauaggccuugcuuaugugaaauacacuuggucacauccagcugaagacaaguucuaugugcaucauagcugaccacaugccagcucucugcguugccugaguaaggacaggacucgguuauucuccuauagucagucuauggcccacuauccaacagugugaccagggcaugugggugugucugucugugcaagggccagccuugcaggacagcuacuggauguaaacacaccuuucuccucucgucagucuuucauaguuacugccucccaagauggcauaccuuaccuugccaauuucuaaaagacacagucagcucacagcuaaugagaauccuagcaggauggggugggccuggugcuucccauccaucucugcucucugggaggcauagccgaaggggugugauguaccuggugcucagaggccuccaugcagauggcugugucuaggcuuggcugcuuuguaagguuuauuacaguccuggugagucuuaugcucagucuugguccauguauucaguaaguaaauugcaaguuaaaaaaaaaaugcuacccauaucaaaacggguuuuccaacagccuugauaauucuuaaaacuacgguauguucaagaugaaaaguauuagagcuuccccuacacagguaauacugucucauccuuccaucacuaaccauuauuaucaaauaauuugaaaaaaaauauaggcaaaagcuguguuaagucuaaacuacggacuccuccccuaucauuaggaucuccagcugcccagugcuaacacccaccaacucagacuuuguuuauuaagucagagaaucagauuauuuccauaguaacggccagggaauaaacaaaaaugugucaaagugcagauucccuccugcaugacaaaugagugugugcauaccaucuauauauuaaagucaccuagauauauaagaagugacauccaguuacuaucauagcacuagcaacacuggacaccuuuauuuccguucccgucaccuugcugguaauuauccaaucuagacucuugauagcagaaguauucgugcauaucggauauugguuguuuuuuagguuucgaaguaaauacaguucuuugcagggacuaaugggauuccccgcuguuggcuuuccaaccuuuucucauggaaccuuccagcaacccuuucccuaagcuaauagcuuuuuguauaugcuguuauucaggugacuagagcagguauccauuuuacucggcaucagcuggccggugcuguugcaacuguugggaucagagcuuucuuugcagcacaagaugcuguagaggugccucuggcacucggaggaggcguaguaguaaaucaacggaucgaugcagcagcucacgcugcucacacagacgcagaggagguaagcaaaguaggcugccucuguaccaggacugucggagaggaaaagguagugcacaaucaggaggacguuggugggcccaaagcagacgaugaagaugcagaacaccgcggcagacaggaacaaagcccgcgacuucuugcuccgguuggcaaccgcggaggagcucaggcaccggaugauggacguguagcagaccguggaaacgaucaacggcacaagaaagaagauggcggagaaggccgagaaguaguacgaguaaaagccuugcaucagguucucacugaggacgucguggcagguggugauguugagucccggaacucggguggucugcuccuugaggagaaggggcaccacccccaugauggccaucacccaaaugaccacgcaagugaaguuggcucggcccagagugcgccaggacagggacuggaucggauacaccaccgccaggaaccggucaaugcuuaugaccgucaugagcaugauggaggcguacauguucccguaaaacgcugcgguggcgaagcggcacauuccagacccgaacugccaaucagugccggagaaguaguagcugaucuugaaggggagcaccgacacgaagagcacgucggccauggccaggugcagcauguacaccacggccggcuucuugaccuucauccucaagacgaacacugcgauggccaggacguucagaggaaggcugacaaugaacacaaucguguacacggagggcaugaagagcgucagccaggggcuggucagauauccggaggcguccucggagaugaagggaggaggcggcgugugaggagggaggcuuauauuuaaguagacugcccuacccuccagcaggacgcuuucauuuuucuccuccuccuccucaucccccagggggaccaguucaaauguauuuucacugggauuccuuagaaagaaugagcggggguucaccguagcaucuguccucucugauucugaaagaagaaaauugagaccgugagugaugaaaaaaaaaaaaaaagggugggcuuuuguuuguguucuguaauuucccccaggagcagauggcuagguucagauccugcacagacggacuaaggacuugguuagcgaauacgcuccuagcuuggaauauugcacaacauuuugcuuggauacgauacuccuauuacucugucgcuccgcaggacaaagaggucuuuccagagaucuaccucgcaaaccucaccuaccuugaaagauccaacgaugcuaugcuuuacguuguauuuaucuuaauuugugugguaggagaaagcaggcauaccacaggguggaggggagcugguccucuucuucucccacguggaccccggggauugaacgcuggcuguccggcuuguugauaagugucuuuuugcccugagccaccuugccaucccucaagccaugcuuucucucugguuguaccccaccgucuguauguacagcucgccuccagcuucuaugacuucucuuuccuucccuagcuggcuugagccaucccgagaaacccaucucucccaaagggaaaacccacauagaaagcagagaggaaauucuacaggccacaccauagggggccauucagagucagagccaaggcucccccaaauugaugaccaaaguaguuuuccuguaucuucaguuugcuuacaaaguaggaugccauugaugccuuaccuaccuaggugcagaggcccucaauuaccuccucacacggccuggaagccccgauccccuccgucagcaucuugccuccuugccccucuagcaucagaugugcuuggucacuuacaccaggccaugaccuuauucuagaaugcucuaugucucaaggugcaugccuagcgaacugggcucucuggaguaucaaccagaugucuaaauacgggcucaguuaccuacacccucuucugucaaaauuauccacuugagauauuagucagaggaaagucaacggcaccagucagacagcaggcuucugggagcaaagagcuuugcuaaaauccuacauuugcugggugggugcugggaagcugaggagggcaaacaggaaccacaaagagcaccaggucccugacgcugggggugcgugugacaaacgcuggauauccucucucuuucucuuucucucucucucucucucucucucucucucucucucucucucucucucucucucucucucagagaugcugcuggaguuaaaccuuggaaacugcacaagugcgguggguuuucagaucuggguuuuguucucuuuuguggucuugaaaaagcacacuuucaaagaggcucugagaucuguaaugcccgcaaggcugaguucugcuucugcacagcuaaggagcaucucgcagagacaauccucuuagaauaaaacuuuaggcugcucuucugugguucccuguuacuccccacuaauggcugaagguccuuagggucacaggacaguagaaggcacagguaggacaagaugguagauguucccccaucccagugauuuuuuuaguuugagauccaaagccauugucugugguaccuugggacacguuccugugcucuguccacgucccggcacacagagaagauccuuggaaucuccaggcuaagauuaucuuuuguaugcugaugagcugacuggugguucaaggccucuagauagcuucggaaucaggccuggucacaggaaagccugaagcaugacuggcaggagggcaggggagcgccugcuccuguuugcacauccugccgguguaucucuccugccuggcuguucauuagcaucuuccguaguaucauuucugauaagcgggaagccuaggagaugcuuuucgcuggguuccuugagcuaggaaucaugggaucugagcagaagucacgggaaccccuaacacacagccugcuugaguucuggaggucgaggcuugggcaacuuauguuugagacagagucuuaugggguugagcccuuaaacucagagcucugauucuauguuccgguagauggugucagauuugaaaugaaaugaaaagacgcauggagaaucugcccgaggacggacaguaugguaugagaggaaagagccugaucccucagggcucacaguacuuagaggggugcugcccagacaguagggaacacacucuguugcacugucauaagagaggauggggacagcggguaggaaacugacaggcaguuucagggacaaggcaccgcaucauuuguccuuggccagagcuggaaauguucuugguucuauggacaaguuuuguccuugcugcaggucacggaugcacgaaguguuuggggccccugcccugcucuggacuccaguuauccuucucucuuuacacagaugccuagaagcugcagaugugacugaagcugcagaccaaggcaucaccaaccgcuuugaagagcuuugggacugaguucugaguuuucaagguggaaauggguuuuaucuguuauaaucucggugugaucuauuagucucuggaucuuuggaucuuuugguuugguuuuuuuuuuuuuuuuuuuuuuuuuuuuuuuuuuuuuuucgggacaggguuucucuguguagcucuggcuguccuggaaaaaaacucuguagaaauccaccugccucugccucccaagugcugggauuaaaggugugcaccaccacugucuggcacuagucucuggaucuuguauacucaagugcugucucuucuuuacaucugcucuguacucgaaggcccugccaaggucuaacagguucuaucuggguucccuuaucaccuuccaagagcugcaggucauuaugaguggagauccuaagaccuuguaagaccuaauucuagcccauuuccuaaaugaucuuaaaucuugagcgggggagaucagguaguuagagaggaauuagucaccuuggaagccacuuauaauggacccccucucuuauaaucuauuuuggaccccaccuccuuuuuccuggcuaacacuagaaagggaaucaucccaauugccccacccccacaccaagauuuaaaacacccuauaaaaaggcgcaggugucagggcuuucuuaaagcccaauaagggaaagcuacgcuuccuggaauuugaguucugccucuggcccugagcggagacgacaccaugaucugcuccuaaaaugaggucaccugccacugucucccccuugaagaguuaacccauggggcugucaguaaccaggcaggccagggcaccacuucccaggaaagcugcaagucuugcuaaggagaugggcggaauaacuaucccucaauguggugaugcacuuaccuucccuaaaagcccuccccgaugcagccauuuacagaguucgugagugaugcaggcacggagagcuucuaccacucagaguuccacuaugcagugguacugacauuuacagaacugcuaugaaggaggaggggcuuuacagcuccagcagcaucaccagcauugcucaaaccugccugcuuuucugaguuugaacucaaauuguaaccaccucucccccagaacagugggaggggggggacccaaaaaacaaaaaguccacgaaugcuuucccuggcacucugucuguucucagucuccaacguuuacugcauucccuaaaccacugcaaaucaguacacaguuggaggucacaguacauagcugguuggucacaaguuccauagucacugggaaagaauuucaggaaggaggaaaaagucuuaggaaagaaaacccaaauuccagugcaaaaccugcucuaggcuuuuuuuuuuuuuuuuuuuuuuuugagacaggguuauacuuuguaaccuugguugccuuggaacuugcugugcagacuaggcuggcccuaaaagucauagaaguccaccugccucuaccuuccgagggccgggacuaaaggcauaugccgccacacccagccucugcuggaggguuugggcaacacuugagucaugcacauuacauacaaucucugcuaaagauaaacaaaaaaaccaaaaucuccaagccccccccaccaccagcgcaccaagugcucugaaggcugacagcagaaggauggagaguccaaggccauccuggauuauauaguggacccugucuuuaaaacagaugccuuucaucucagcacucacaaggcagaggagagccgaucucucaguucaaggccagccugguuaacagagcuauuuucaggucagccagggcugcacagagaaaaccugucucaaaaaaccaaaacaaacaacacccugugcuucugcucaggacagcagccaaaugaacagacugcuaaugcaaaacgccaauaaucaauacucugaaggaaugugccagaguccagagucuucauagcccaauguccagaauacaaccucaaaugauucaguagaaugagaauuaagagacugagauucuagcucagugauagaacauuugccuagcauguagcccacgguuuaauccccugcaccaauaauaaauaauaacaaaaaauaacggggcggcugggcacaauggcagguacaugcaaugucagcacuugagagacugaaccaagagaacugaaaaacugaggcaaaccugggcugccauguaggucauccuggcuacaaagugagaccuuguuucaaaaauaccaacuggggaggggcacaaugaacuaaaagaacugggaguuuuauuagcucugcucaaaucuuuuagacaaaaguaagcucuggggcuggagugacagcucagccauuaagaggcuguacuuccagaggaucagaguucaagucuuacaccuggaaggagguucacacucaucuuaucuccaguuucaggugacccaccguccucuucuggccuccacagauacuggacaugugguacacagacauacaugcaagccaaguacccauacacauagaauaaaaacaaaaugaaaucucugggcacccccuuuccacuuaucucacaucuagaaauacuaacugcaacuggacuaacgacucaagcuuaacaccccaaacugcaguuuugguaaggaaacccagaagagaaagcucauagaucugacccaaaggcacaggcagccaaagcugauagauggaaugaaaucaauauaaaagcacuguacagcaaaggagccaucuuccgugagagauaccuuacagaugggagacaacacuacagaucacacguccuaccugauaaggauuuccuguccaaacaucuacggaacaaaggacucacuauggagaaaacaaauuguugguuuguuuguuuguuuguuuguuuguuuguuuuuuaaaaaagggccugcggugguggcgcacgccuuuaauuccagcucuugggaggcagaggcaggcgaauuucugaguucgaggccagccuggucuacaaagugaguuccaggacagccagggcuauacagagaaacccugucucgaaaaaacaaaaacaaaaagaaaaaaaggacagaaacuaacuagacauuuagauaauacaaauacuaauagauaauacaaaaaaaugccuaaaugguauguaauaaacugcuuagcauuacuaaucgucauggaauugccauuuaaaaccaccgugagcgaucacuuuacuucacuaggaugacuaccaugaagaaugaaagauuaccaaugcuggcaaggguguagagaagccaggacccuggacaccagcaagagcuggaagcacagccauuauggaagacggccagggacuucagaaaacaaaacccagaauuauccccacgaucccgccgucccaccagugaguauggacacaaaggaacuucucugaugcucaguuccgugagccugacugguugggggcuucuggggaugcacagcggagaauuaagugcuuaccagcauggccugacacacacauaggaacuuccaugauacugggaacagggacacgacuugaagucacuuaucuagcuuagcagacggaauguugucacguggucugaaaacaacacucccugggcuuugccaauacuguuugcugucaugccuguaucagcacguccucugucaguagcccagaaacauuauaccucagggaacacaugguauuuacagucuggaacggagaagaauguauaaucccucaacuaaauaucacugccuaaggcggguacccuuucuucccacuuuagauuugauaugcuagaaacuaaagaaauuaaaaaaaaaagcuagaaaaaaguauucuuaaguguauaugaacgucacugaaacacugaguccaggcaagguggcuagauacguccaacauacucaagaccguaugcugggacuugcgucugcuuuuccuacaguccaaguaugacucagacgucaaggggaaaguguuugucagcuggccgagagcucuucagagucaccuugcuuguugagcaacagucacagcaaggcaaaguuaaauucugucuuacagagaacucagcacagcucccaaguacauucguacauuucuugcuaaguuuuacuuaaggaagggucucucuaaagcgguuuugagacaaugacuuuugcaucccagguaggcccugaacuugcuaauguagcugagguuggccuugaacucgcaaucgguccugucuucacucuugagugcugggauuacaggcauuuaccagcaugccgggcuucaguuuugauauugaauauagcauauugcuaacuagcuuaaauacagacuaaccuggagaccugaaauuagugucaggugauggcucuuuugucuuugcugagaucuggcuggaugcagggcgcggggguggggugggguggagggaugggauaggguggggaggggauggggacuaagauaccuuucacugugccggggccuugacugugacucaguguucugcuccagugcucacccuucuggggaauuagcuaacuugaagucucaggaucuugcccacauucccacagugagcaagucagccauggccugcauuucacaggccaaauggaaugacgacuaugaggaggaggacacuggagaagcauggcagacuccaggaagacaagugaaacccugcagccuuucuagaauguuccagucccuccaacucaaacaaacaucauuuacccaaggcaggagccagcaugcuccccacccccagccucauaaugccuucuuucggaucuggggaaagagcugcacagcacagccuuggauaccuccaaguguuguuagcaucaggucaauaccccguggguucuaguuggccaaagaagagcacuuuguucauagaauacaugaugauuggaggugguccagugugucuguguguggagagucucaucaaacuguagccaagcagccaagccgguggguacagacgucaggaagccuucaagauagacaacuaaauagcaaguaaaagggguggagccgugacguuccugggcuugguccccaggacugaagaguaaggaguaguuauagaugaaagacuggaugggcggcacagagaccaagcgcagcguuggaguucuucccuccugguuugcauauaauguuaacgggcauuuaugagacaaucagggaacuuagacacuuugcauagaaugacgugaagaaacuguucacuacuuucuucugaugauauugcauuuauggggaaaaaaaaguucuuaccucuagaacuguauguauauuuaagguuauguauuuaaugcaugcaugcauacauacauaguuaguuaguuaguuaguuaguuaguuaguuaguuaguuaguuaguuuuuugaggcaggguuucucuguguagcuuuggcuauccuagaacucacucuguagacaucaaacucagagauccaucugccccugccucucaagugcugggauuaaaggcgugggccacuaccucuugccuuauaacuuauauuuucauuuaauuaaauaguguauuuaaggagagcauguuuggaggcucagcagggagcacugauacucaaauaccagcccucguucuuccaguaaggucaugagcacagagcgggaggggggcgcccacuccccuaccccacacccagccauccagaucugccagauccaccuuggugauagucagacugacggauuccccucagccagaucaccgucacagagaugaugucugggauuggcuuuaaaauucgcuugcgggggacagcaagggucuugcuaaaagaagccaggugaugggucauggacaaauacgugcaaagcaaaacaaguaauucaugauaccuucuugucacuagaaauuuacuuuuaauuaugugugugcaugcauguguguucucugcaugugcaugaaugagcaggugcccuucuagagcuacuugugagccagcugacaggaguacugagaaucaaacauggguccucugcaaaagcacaacaucuacugagcacuacauacuacugagccauugcucuagccccaaauguaaacauuguuguuucuggguuuuguuuguuuguuuguuuuuucuuguguuuagugcagaagaaggggaaguucuugaguauucucaugaauauggcuuuauguuuagagaaaucaucuaguaucaacaucuuauuuauuuauuuagagaccucucacuauguagccuuggcuauccuugaacuugcuauguagaccagacugucuuugaacucagagagaucugucugccucugccuccagagaacugggauuaaagguguaugucaccauggcuggaauauauuagcauuuuuguuuguuuguuuuuuucaagacaggguuucucuguauagcccuggcuguccuggaacucacuuuguagaccagguuggccucgaacucagaaauccaccugccucugucuccugaaugcugggauuaaaggugugcaccaccacgccuggcauguauuaacauuuuaaaaguuugggggaauauguaaaaauuaguauguaggggaaaaaaauccaggaaaccuucauauguguugaacauccacuaaauaccagacaugucccuugcuuuuuaccuuauaacuuuauuuuauaaaugauaauuucgaggcacagagagguuaaguaacuuauucaagaucacacagcuagucuguggaagagcaaggauuugaaccuagauaggcaugaaggcuuaauauccucuuaccacaaugaaucaucugugcucuauuuucacuuuuguuuuuaugcuuauuuugggggucaaaccugccuguuacuuggaaauucugggguuuacuggcuuuggcuagauacaaaccccugugcacaacucagcccuccuaggcauacauaggaaguggacaagcacccacagagaugagugaaaaaccuucugcauguguacauaaguguguacgcauauaaucaugugugugcauguagaagcuggaggagagcagcaagagucuugcccauugcucugagccuugcugcauugaggcaggcucuaucacugaacacgaagcucuccauuuugucuaggcaggcuaacuggccagagagcuuucaagaucugcccacuucugucauccagugcuggggcugggugcuugugauucaacucagagccuccugcuugcacaccaaguccucuuaccuacgcagcgccuggacccucaguagggaaccuacucagccucuggggacccuccaaugcaaccuuuaauaggauguucuggauggggccuaccuaagaacagcagaacaaaucaguaaggcagaguucaaggcagaauguccuggaggcugcugccucucuggcacacccuggagcuuucagacaggccaggaggagcugcaggcaggccugcuacaggaaguuauuguagcguucccaaagcacagggauaugcacacuagucuguaagacucuugcccggaggcaggagacagauguggcguuaggaugcucaugggccuccgugaaagccacugugaccccuguggucuguucucugcccugagucaccauccccaagguuccuguccccagaaagccaccgucuaugcucuaaucaacagcaagacaucaaagaccaacucaggaucagugugucccaggguccacaguccaucccagacuucagcugucccgcuaccccagccuuucugcagucagugagccugaacugaaauaacggacccuaaacaagauagagauucauaaaugacacuucugagaaagcacagcucuucuggcuaggccuugaguuugcuccuuaggacgaaucacugucccagcuaugcuagguuaaaauuccagcagagauugagcaauggcuaugaaauccaauuguagggguugccacaaguuuuuaaaaucuuuuuacuuauuuguaauuauguguauugugugugugcgugugcgugugcuuugugugugcgcgcacauguaugugucuuaggggugguaugugcacaugcgugcgguugcucacaggggccugaggugucuagccgccuugaggcuggagucacaugggugucauggauguuauuaugcauauuucaacugugccacaaaguaaaauguauuucucacuuauggcuggcuagcaaaacagacagacagacagaaacaaaacaaaacagaaaccauguuucuguaauacucuaaaauccaauuugcaacuugucacaaacuuuaaauauauauucuauagugucuuuuccuaaagcuguacagaauugcuuguugccaugugcaacucauagaugaguuuaagacggcaaaguuaccuuugaaagccaauaacacacacaagguuacaggggauuugcaggauauaaggaugcagggauaaacccuuuaccucaaaacuccggcaucguagugccuacuuguaucucuagaaccugagaggcugaggcaggaggauuugaguuuaacgccagccugugcugcacagcaaaucuuguuucaaaaaacaaacaggacuggagagauggcucagagagaacacuuguuacaacaaaagcccgagggacuaaguucccaucgcagcacccauguaugacuguuauccuaguaugugugugugugugugugugcucgcacacuagcacuggaacuuacugacacaggcuugcacauaaccccuccuccagccaugaacuuguuaacucuacuggguuuaguagagaacuacagcaaggcaggacguggggagcagugaauccuggaaaaacaccuggcuuauagggaaagccauuuauucugucaguucuagcaagaggaaguaaaaaacugaauaaaagagaguuacuaaggaacaaaagagaugugagcuccaaacgaagagaguagcaacaucagacacccagguuucuggugaaccccauuauuuugcgguccuuuugcuuagaacccagcuaagcuccaguucaccagggcagcaggaaccgaagaggcccgggguggggaggaaggugaaugggaggaagauuuuuggaaaagaagcaaguccugggcuuuaaaaagagcaaguucacaugacagacccaggcaggagcagcuagggcgggagguuccuacagaguagcgguucacgguucacgguuaagaggacaugcgaaguugagaaaagccggcuggucuggagugacaugggagaagaacccagagcgggcaacauucuugaggagcgauuagagacugggugaagugaggaauaugucaggggaaguagagcaaggcuggggcccgucuuguacagggaccucuugcuucuugccaagggacugggcuuggccuagagauaaggauggccgucucugaaaucccaaggcacuuggccacaguuacccacagccauucucucuuuaugcagcgguaaggagaagcagauuuguuuuuggcugaguuugugaguucacuuauugucuguacccaauguagggggaccacuccuauaacucccccccccccucaaggcaggccacucaaucucucugggccuuauuuuuagaaucagagaaaggggauaaaugucuccuuaucauaccuaugaucugugcuggccacaucucauagucuauauuuuaaaaggccugucccaaaauaaaagcgaggaaguaaccuaaaguuaugugagcucgcaccuccauguacacuuuggaucguccucccccucacggcugcugaugauuaaggucuaaggucggcuacccaaacacaggcaggcugguuagcugcugcucggcgugggggcccucuguggggcucugaguuuucccaugagcaccacucaagcucacacugaagaaagacagacaacaggaaacaccccacucuuugucaccuccuaauccuuacaugugggagcaccgaagugcacauucuuucagagauaacaaaaacugaagaaaacccacuagauuuucuucagcgugaaaggaacggcuaaaggugucccuacuaagaaagucgaaacaauugggaacuuuacaggcuacgccucugcuuuggagaaaagagaaaauauuugacgaaauaagucgaccaaacuaauuuauuuggucaaacuggcagauauuuaaaaauacacuguaaguaacgaauguccuugcggcagaugagaaauuccauugaaaaaaacuaagacuagauaauuucuaggugcgccugauucugaagaggggucccuuuucuccaugcagagaaacagguuuccgauaacaaagaccuacuccacucccugcaaccagaaaccuucaucaccuccuggguaccaggccaagcugggggcuguccggucuuuauugugugacugugaauuuuuucuuucacaucgcuuuucccuccuuguaaaucaaacgagaaaacgaguuuccaucaaagcaaaaacuugaggagagugguuccacugcacaccgaaagcccagaaucacaagacccuuucuuucugaagguggucuuguaaaacaggccacacaaugacaauuaaagcgacuguggagaccguuccgcggacccucgggccccucuccggauccaacacccgguggcccgcggacugcacccuccaaaaccgaguccaaaagagcaucggccgugcggggaguggggaggauauggugcgccccacauggaugugacuaggggaaccucuagaucucggcccaaaugacuguuuggcuccugggggaaacugaggcaggguugcagccaggagcacccccucacggagcuggcgcaaccuaaaacuucugauagcuucccccaugcucacccacccgcagcucuuaccuggcuggcucauagggacgcgggaagacagcaagggaccgcacaggcugaggccgagggcgacgaucagcaagcgccggggccccauugucccaaggcugcccgcgcggcccggcgcccgccgucgccuacuucuuucugaguagcucggucggagccugcgggugacuagaggcgacugcgcggccccugggugaguauuug

SEQ ID NO: 7170 - RNA, 16712 nt, Mus musculus
caaauacucacccaggggccgcgcagucgccucuagucacccgcaggcuccgaccgagcuacucagaaagaaguaggcgacggcgggcgccgggccgcgcgggcagccuugggacaauggggccccggcgcuugcugaucgucgcccucggccucagccugugcggucccuugcugucuucccgcgucccuaugagccagccagguaagagcugcgggugggugagcaugggggaagcuaucagaaguuuuagguugcgccagcuccgugagggggugcuccuggcugcaacccugccucaguuucccccaggagccaaacagucauuugggccgagaucuagagguuccccuagucacauccauguggggcgcaccauauccuccccacuccccgcacggccgaugcucuuuuggacucgguuuuggagggugcaguccgcgggccaccggguguuggauccggagaggggcccgaggguccgcggaacggucuccacagucgcuuuaauugucauuguguggccuguuuuacaagaccaccuucagaaagaaagggucuugugauucugggcuuucggugugcaguggaaccacucuccucaaguuuuugcuuugauggaaacucguuuucucguuugauuuacaaggagggaaaagcgaugugaaagaaaaaauucacagucacacaauaaagaccggacagcccccagcuuggccugguacccaggaggugaugaagguuucugguugcagggaguggaguaggucuuuguuaucggaaaccuguuucucugcauggagaaaagggaccccucuucagaaucaggcgcaccuagaaauuaucuagucuuaguuuuuuucaauggaauuucucaucugccgcaaggacauucguuacuuacaguguauuuuuaaauaucugccaguuugaccaaauaaauuaguuuggucgacuuauuucgucaaauauuuucucuuuucuccaaagcagaggcguagccuguaaaguucccaauuguuucgacuuucuuaguagggacaccuuuagccguuccuuucacgcugaagaaaaucuaguggguuuucuucaguuuuuguuaucucugaaagaaugugcacuucggugcucccacauguaaggauuaggaggugacaaagagugggguguuuccuguugucugucuuucuucagugugagcuugaguggugcucaugggaaaacucagagccccacagagggcccccacgccgagcagcagcuaaccagccugccuguguuuggguagccgaccuuagaccuuaaucaucagcagccgugagggggaggacgauccaaaguguacauggaggugcgagcucacauaacuuuagguuacuuccucgcuuuuauuuugggacaggccuuuuaaaauauagacuaugagauguggccagcacagaucauagguaugauaaggagacauuuauccccuuucucugauucuaaaaauaaggcccagagagauugaguggccugccuugagggggggggggaguuauaggaguggucccccuacauuggguacagacaauaagugaacucacaaacucagccaaaaacaaaucugcuucuccuuaccgcugcauaaagagagaauggcuguggguaacuguggccaagugccuugggauuucagagacggccauccuuaucucuaggccaagcccagucccuuggcaagaagcaagaggucccuguacaagacgggccccagccuugcucuacuuccccugacauauuccucacuucacccagucucuaaucgcuccucaagaauguugcccgcucuggguucuucucccaugucacuccagaccagccggcuuuucucaacuucgcauguccucuuaaccgugaaccgugaaccgcuacucuguaggaaccucccgcccuagcugcuccugccugggucugucaugugaacuugcucuuuuuaaagcccaggacuugcuucuuuuccaaaaaucuuccucccauucaccuuccuccccaccccgggccucuucgguuccugcugcccuggugaacuggagcuuagcuggguucuaagcaaaaggaccgcaaaauaaugggguucaccagaaaccugggugucugauguugcuacucucuucguuuggagcucacaucucuuuuguuccuuaguaacucucuuuuauucaguuuuuuacuuccucuugcuagaacugacagaauaaauggcuuucccuauaagccagguguuuuuccaggauucacugcuccccacguccugccuugcuguaguucucuacuaaacccaguagaguuaacaaguucauggcuggaggagggguuaugugcaagccugugucaguaaguuccagugcuagugugcgagcacacacacacacacacacauacuaggauaacagucauacaugggugcugcgaugggaacuuagucccucgggcuuuuguuguaacaaguguucucucugagccaucucuccaguccuguuuguuuuuugaaacaagauuugcugugcagcacaggcuggcguuaaacucaaauccuccugccucagccucucagguucuagagauacaaguaggcacuacgaugccggaguuuugagguaaaggguuuaucccugcauccuuauauccugcaaauccccuguaaccuuguguguguuauuggcuuucaaagguaacuuugccgucuuaaacucaucuaugaguugcacauggcaacaagcaauucuguacagcuuuaggaaaagacacuauagaauauauauuuaaaguuugugacaaguugcaaauuggauuuuagaguauuacagaaacaugguuucuguuuuguuuuguuucugucugucugucuguuuugcuagccagccauaagugagaaauacauuuuacuuuguggcacaguugaaauaugcauaauaacauccaugacacccaugugacuccagccucaaggcggcuagacaccucaggccccugugagcaaccgcacgcaugugcacauaccaccccuaagacacauacaugugcgcgcacacacaaagcacacgcacacgcacacacacaauacacauaauuacaaauaaguaaaaagauuuuaaaaacuuguggcaaccccuacaauuggauuucauagccauugcucaaucucugcuggaauuuuaaccuagcauagcugggacagugauucguccuaaggagcaaacucaaggccuagccagaagagcugugcuuucucagaagugucauuuaugaaucucuaucuuguuuaggguccguuauuucaguucaggcucacugacugcagaaaggcugggguagcgggacagcugaagucugggauggacuguggacccugggacacacugauccugaguuggucuuugaugucuugcuguugauuagagcauagacgguggcuuucuggggacaggaaccuuggggauggugacucagggcagagaacagaccacaggggucacaguggcuuucacggaggcccaugagcauccuaacgccacaucugucuccugccuccgggcaagagucuuacagacuagugugcauaucccugugcuuugggaacgcuacaauaacuuccuguagcaggccugccugcagcuccuccuggccugucugaaagcuccagggugugccagagaggcagcagccuccaggacauucugccuugaacucugccuuacugauuuguucugcuguucuuagguaggccccauccagaacauccuauuaaagguugcauuggaggguccccagaggcugaguagguucccuacugaggguccaggcgcugcguagguaagaggacuuggugugcaagcaggaggcucugaguugaaucacaagcacccagccccagcacuggaugacagaagugggcagaucuugaaagcucucuggccaguuagccugccuagacaaaauggagagcuucguguucagugauagagccugccucaaugcagcaaggcucagagcaaugggcaagacucuugcugcucuccuccagcuucuacaugcacacacaugauuauaugcguacacacuuauguacacaugcagaagguuuuucacucaucucugugggugcuuguccacuuccuauguaugccuaggagggcugaguugugcacagggguuuguaucuagccaaagccaguaaaccccagaauuuccaaguaacaggcagguuugacccccaaaauaagcauaaaaacaaaagugaaaauagagcacagaugauucauugugguaagaggauauuaagccuucaugccuaucuagguucaaauccuugcucuuccacagacuagcugugugaucuugaauaaguuacuuaaccucucugugccucgaaauuaucauuuauaaaauaaaguuauaagguaaaaagcaagggacaugucugguauuuaguggauguucaacacauaugaagguuuccuggauuuuuuuccccuacauacuaauuuuuacauauucccccaaacuuuuaaaauguuaauacaugccaggcgugguggugcacaccuuuaaucccagcauucaggagacagaggcagguggauuucugaguucgaggccaaccuggucuacaaagugaguuccaggacagccagggcuauacagagaaacccugucuugaaaaaaacaaacaaacaaaaaugcuaauauauuccagccauggugacauacaccuuuaaucccaguucucuggaggcagaggcagacagaucucucugaguucaaagacagucuggucuacauagcaaguucaaggauagccaaggcuacauagugagaggucucuaaauaaauaaauaagauguugauacuagaugauuucucuaaacauaaagccauauucaugagaauacucaagaacuuccccuucuucugcacuaaacacaagaaaaaacaaacaaacaaacaaaacccagaaacaacaauguuuacauuuggggcuagagcaauggcucaguaguauguagugcucaguagauguugugcuuuugcagaggacccauguuugauucucaguacuccugucagcuggcucacaaguagcucuagaagggcaccugcucauucaugcacaugcagagaacacacaugcaugcacacacauaauuaaaaguaaauuucuagugacaagaagguaucaugaauuacuuguuuugcuuugcacguauuuguccaugacccaucaccuggcuucuuuuagcaagacccuugcugucccccgcaagcgaauuuuaaagccaaucccagacaucaucucugugacggugaucuggcugaggggaauccgucagucugacuaucaccaagguggaucuggcagaucuggauggcugggugugggguaggggagugggcgccccccucccgcucugugcucaugaccuuacuggaagaacgagggcugguauuugaguaucagugcucccugcugagccuccaaacaugcucuccuuaaauacacuauuuaauuaaaugaaaauauaaguuauaaggcaagagguaguggcccacgccuuuaaucccagcacuugagaggcaggggcagauggaucucugaguuugaugucuacagagugaguucuaggauagccaaagcuacacagagaaacccugccucaaaaaacuaacuaacuaacuaacuaacuaacuaacuaacuaacuaacuaacuauguauguaugcaugcaugcauuaaauacauaaccuuaaauauacauacaguucuagagguaagaacuuuuuuuuccccauaaaugcaauaucaucagaagaaaguagugaacaguuucuucacgucauucuaugcaaagugucuaaguucccugauugucucauaaaugcccguuaacauuauaugcaaaccaggagggaagaacuccaacgcugcgcuuggucucugugccgcccauccagucuuucaucuauaacuacuccuuacucuucaguccuggggaccaagcccaggaacgucacggcuccaccccuuuuacuugcuauuuaguugucuaucuugaaggcuuccugacgucuguacccaccggcuuggcugcuuggcuacaguuugaugagacucuccacacacagacacacuggaccaccuccaaucaucauguauucuaugaacaaagugcucuucuuuggccaacuagaacccacgggguauugaccugaugcuaacaacacuuggagguauccaaggcugugcugugcagcucuuuccccagauccgaaagaaggcauuaugaggcuggggguggggagcaugcuggcuccugccuuggguaaaugauguuuguuugaguuggagggacuggaacauucuagaaaggcugcaggguuucacuugucuuccuggagucugccaugcuucuccaguguccuccuccucauagucgucauuccauuuggccugugaaaugcaggccauggcugacuugcucacugugggaaugugggcaagauccugagacuucaaguuagcuaauuccccagaagggugagcacuggagcagaacacugagucacagucaaggccccggcacagugaaagguaucuuaguccccauccccuccccacccuaucccaucccuccaccccaccccacccccgcgcccugcauccagccagaucucagcaaagacaaaagagccaucaccugacacuaauuucaggucuccagguuagucuguauuuaagcuaguuagcaauaugcuauauucaauaucaaaacugaagcccggcaugcugguaaaugccuguaaucccagcacucaagagugaagacaggaccgauugcgaguucaaggccaaccucagcuacauuagcaaguucagggccuaccugggaugcaaaagucauugucucaaaaccgcuuuagagagacccuuccuuaaguaaaacuuagcaagaaauguacgaauguacuugggagcugugcugaguucucuguaagacagaauuuaacuuugccuugcugugacuguugcucaacaagcaaggugacucugaagagcucucggccagcugacaaacacuuuccccuugacgucugagucauacuuggacuguaggaaaagcagacgcaagucccagcauacggucuugaguauguuggacguaucuagccaccuugccuggacucaguguuucagugacguucauauacacuuaagaauacuuuuuucuagcuuuuuuuuuuaauuucuuuaguuucuagcauaucaaaucuaaagugggaagaaaggguacccgccuuaggcagugauauuuaguugagggauuauacauucuucuccguuccagacuguaaauaccauguguucccugagguauaauguuucugggcuacugacagaggacgugcugauacaggcaugacagcaaacaguauuggcaaagcccagggaguguuguuuucagaccacgugacaacauuccgucugcuaagcuagauaagugacuucaagucgugucccuguucccaguaucauggaaguuccuaugugugugucaggccaugcugguaagcacuuaauucuccgcugugcauccccagaagcccccaaccagucaggcucacggaacugagcaucagagaaguuccuuuguguccauacucacuggugggacggcgggaucguggggauaauucuggguuuuguuuucugaagucccuggccgucuuccauaauggcugugcuuccagcucuugcugguguccaggguccuggcuucucuacacccuugccagcauugguaaucuuucauucuucaugguagucauccuagugaaguaaagugaucgcucacggugguuuuaaauggcaauuccaugacgauuaguaaugcuaagcaguuuauuacauaccauuuaggcauuuuuuuguauuaucuauuaguauuuguauuaucuaaaugucuaguuaguuucuguccuuuuuuucuuuuuguuuuuguuuuuucgagacaggguuucucuguauagcccuggcuguccuggaacucacuuuguagaccaggcuggccucgaacucagaaauucgccugccucugccucccaagagcuggaauuaaaggcgugcgccaccaccgcaggcccuuuuuuaaaaaacaaacaaacaaacaaacaaacaaacaaaccaacaauuuguuuucuccauagugaguccuuuguuccguagauguuuggacaggaaauccuuaucagguaggacgugugaucuguaguguugucucccaucuguaagguaucucucacggaagauggcuccuuugcuguacagugcuuuuauauugauuucauuccaucuaucagcuuuggcugccugugccuuugggucagaucuaugagcuuucucuucuggguuuccuuaccaaaacugcaguuugggguguuaagcuugagucguuaguccaguugcaguuaguauuucuagaugugagauaaguggaaagggggugcccagagauuucauuuuguuuuuauucuauguguauggguacuuggcuugcauguaugucuguguaccacauguccaguaucuguggaggccagaagaggacggugggucaccugaaacuggagauaagaugagugugaaccuccuuccagguguaagacuugaacucugauccucuggaaguacagccucuuaauggcugagcugucacuccagccccagagcuuacuuuugucuaaaagauuugagcagagcuaauaaaacucccaguucuuuuaguucauugugccccuccccaguugguauuuuugaaacaaggucucacuuuguagccaggaugaccuacauggcagcccagguuugccucaguuuuucaguucucuugguucagucucucaagugcugacauugcauguaccugccauugugcccagccgccccguuauuuuuuguuauuauuuauuauuggugcaggggauuaaaccgugggcuacaugcuaggcaaauguucuaucacugagcuagaaucucagucucuuaauucucauucuacugaaucauuugagguuguauucuggacauugggcuaugaagacucuggacucuggcacauuccuucagaguauugauuauuggcguuuugcauuagcagucuguucauuuggcugcuguccugagcagaagcacaggguguuguuuguuuugguuuuuugagacagguuuucucugugcagcccuggcugaccugaaaauagcucuguuaaccaggcuggccuugaacugagagaucggcucuccucugccuugugagugcugagaugaaaggcaucuguuuuaaagacaggguccacuauauaauccaggauggccuuggacucuccauccuucugcugucagccuucagagcacuuggugcgcuggugguggggggggcuuggagauuuugguuuuuuuguuuaucuuuagcagagauuguauguaaugugcaugacucaaguguugcccaaacccuccagcagaggcuggguguggcggcauaugccuuuagucccggcccucggaagguagaggcagguggacuucuaugacuuuuagggccagccuagucugcacagcaaguuccaaggcaaccaagguuacaaaguauaacccugucucaaaaaaaaaaaaaaaaaaaaaaaagccuagagcagguuuugcacuggaauuuggguuuucuuuccuaagacuuuuuccuccuuccugaaauucuuucccagugacuauggaacuugugaccaaccagcuauguacugugaccuccaacuguguacugauuugcagugguuuagggaaugcaguaaacguuggagacugagaacagacagagugccagggaaagcauucguggacuuuuuguuuuuuggguccccccccucccacuguucugggggagaggugguuacaauuugaguucaaacucagaaaagcaggcagguuugagcaaugcuggugaugcugcuggagcuguaaagccccuccuccuucauagcaguucuguaaaugucaguaccacugcauaguggaacucugagugguagaagcucuccgugccugcaucacucacgaacucuguaaauggcugcaucggggagggcuuuuagggaagguaagugcaucaccacauugagggauaguuauuccgcccaucuccuuagcaagacuugcagcuuuccugggaaguggugcccuggccugccugguuacugacagccccauggguuaacucuucaagggggagacaguggcaggugaccucauuuuaggagcagaucauggugucgucuccgcucagggccagaggcagaacucaaauuccaggaagcguagcuuucccuuauugggcuuuaagaaagcccugacaccugcgccuuuuuauaggguguuuuaaaucuugguguggggguggggcaauugggaugauucccuuucuaguguuagccaggaaaaaggaggugggguccaaaauagauuauaagagaggggguccauuauaaguggcuuccaaggugacuaauuccucucuaacuaccugaucucccccgcucaagauuuaagaucauuuaggaaaugggcuagaauuaggucuuacaaggucuuaggaucuccacucauaaugaccugcagcucuuggaaggugauaagggaacccagauagaaccuguuagaccuuggcagggccuucgaguacagagcagauguaaagaagagacagcacuugaguauacaagauccagagacuagugccagacagugguggugcacaccuuuaaucccagcacuugggaggcagaggcagguggauuucuacagaguuuuuuuccaggacagccagagcuacacagagaaacccugucccgaaaaaaaaaaaaaaaaaaaaaaaaaaaaaaaaaaaaaaaccaaaccaaaagauccaaagauccagagacuaauagaucacaccgagauuauaacagauaaaacccauuuccaccuugaaaacucagaacucagucccaaagcucuucaaagcgguuggugaugccuuggucugcagcuucagucacaucugcagcuucuaggcaucuguguaaagagagaaggauaacuggaguccagagcagggcaggggccccaaacacuucgugcauccgugaccugcagcaaggacaaaacuuguccauagaaccaagaacauuuccagcucuggccaaggacaaaugaugcggugccuugucccugaaacugccugucaguuuccuacccgcuguccccauccucucuuaugacagugcaacagaguguguucccuacugucugggcagcaccccucuaaguacugugagcccugagggaucaggcucuuuccucucauaccauacuguccguccucgggcagauucuccaugcgucuuuucauuucauuucaaaucugacaccaucuaccggaacauagaaucagagcucugaguuuaagggcucaaccccauaagacucugucucaaacauaaguugcccaagccucgaccuccagaacucaagcaggcuguguguuagggguucccgugacuucugcucagaucccaugauuccuagcucaaggaacccagcgaaaagcaucuccuaggcuucccgcuuaucagaaaugauacuacggaagaugcuaaugaacagccaggcaggagagauacaccggcaggaugugcaaacaggagcaggcgcuccccugcccuccugccagucaugcuucaggcuuuccugugaccaggccugauuccgaagcuaucuagaggccuugaaccaccagucagcucaucagcauacaaaagauaaucuuagccuggagauuccaaggaucuucucugugugccgggacguggacagagcacaggaacgugucccaagguaccacagacaauggcuuuggaucucaaacuaaaaaaaucacugggaugggggaacaucuaccaucuuguccuaccugugccuucuacuguccugugacccuaaggaccuucagccauuaguggggaguaacagggaaccacagaagagcagccuaaaguuuuauucuaagaggauugucucugcgagaugcuccuuagcugugcagaagcagaacucagccuugcgggcauuacagaucucagagccucuuugaaagugugcuuuuucaagaccacaaaagagaacaaaacccagaucugaaaacccaccgcacuugugcaguuuccaagguuuaacuccagcagcaucucugagagagagagagagagagagagagagagagagagagagagagagagagagagagagagaaagagaaagagagaggauauccagcguuugucacacgcacccccagcgucagggaccuggugcucuuugugguuccuguuugcccuccucagcuucccagcacccacccagcaaauguaggauuuuagcaaagcucuuugcucccagaagccugcugucugacuggugccguugacuuuccucugacuaauaucucaaguggauaauuuugacagaagaggguguagguaacugagcccguauuuagacaucugguugauacuccagagagcccaguucgcuaggcaugcaccuugagacauagagcauucuagaauaaggucauggccugguguaagugaccaagcacaucugaugcuagaggggcaaggaggcaagaugcugacggaggggaucggggcuuccaggccgugugaggagguaauugagggccucugcaccuagguagguaaggcaucaauggcauccuacuuuguaagcaaacugaagauacaggaaaacuacuuuggucaucaauuugggggagccuuggcucugacucugaauggcccccuaugguguggccuguagaauuuccucucugcuuucuauguggguuuucccuuugggagagauggguuucucgggauggcucaagccagcuagggaaggaaagagaagucauagaagcuggaggcgagcuguacauacagacggugggguacaaccagagagaaagcauggcuugagggauggcaagguggcucagggcaaaaagacacuuaucaacaagccggacagccagcguucaauccccgggguccacgugggagaagaagaggaccagcuccccuccacccugugguaugccugcuuucuccuaccacacaaauuaagauaaauacaacguaaagcauagcaucguuggaucuuucaagguaggugagguuugcgagguagaucucuggaaagaccucuuuguccugcggagcgacagaguaauaggaguaucguauccaagcaaaauguugugcaauauuccaagcuaggagcguauucgcuaaccaaguccuuaguccgucugugcaggaucugaaccuagccaucugcuccugggggaaauuacagaacacaaacaaaagcccacccuuuuuuuuuuuuuuucaucacucacggucucaauuuucuucuuucagaaucagagaggacagaugcuacggugaacccccgcucauucuuucuaaggaaucccagugaaaauacauuugaacuggucccccugggggaugaggaggaggaggagaaaaaugaaagcguccugcuggaggguagggcagucuacuuaaauauaagccucccuccucacacgccgccuccucccuucaucuccgaggacgccuccggauaucugaccagccccuggcugacgcucuucaugcccuccguguacacgauuguguucauugucagccuuccucugaacguccuggccaucgcaguguucgucuugaggaugaaggucaagaagccggccgugguguacaugcugcaccuggccauggccgacgugcucuucgugucggugcuccccuucaagaucagcuacuacuucuccggcacugauuggcaguucgggucuggaaugugccgcuucgccaccgcagcguuuuacgggaacauguacgccuccaucaugcucaugacggucauaagcauugaccgguuccuggcggugguguauccgauccagucccuguccuggcgcacucugggccgagccaacuucacuugcguggucauuugggugauggccaucauggggguggugccccuucuccucaaggagcagaccacccgaguuccgggacucaacaucaccaccugccacgacguccucagugagaaccugaugcaaggcuuuuacucguacuacuucucggccuucuccgccaucuucuuucuugugccguugaucguuuccacggucugcuacacguccaucauccggugccugagcuccuccgcgguugccaaccggagcaagaagucgcgggcuuuguuccugucugccgcgguguucugcaucuucaucgucugcuuugggcccaccaacguccuccugauugugcacuaccuuuuccucuccgacaguccugguacagaggcagccuacuuugcuuaccuccucugcgucugugugagcagcgugagcugcugcaucgauccguugauuuacuacuacgccuccuccgagugccagaggcaccucuacagcaucuugugcugcaaagaaagcucugaucccaacaguugcaacagcaccggccagcugaugccgaguaaaauggauaccugcucuagucaccugaauaacagcauauacaaaaagcuauuagcuuagggaaaggguugcuggaagguuccaugagaaaagguuggaaagccaacagcggggaaucccauuagucccugcaaagaacuguauuuacuucgaaaccuaaaaaacaaccaauauccgauaugcacgaauacuucugcuaucaagagucuagauuggauaauuaccagcaaggugacgggaacggaaauaaagguguccaguguugcuagugcuaugauaguaacuggaugucacuucuuauauaucuaggugacuuuaauauauagaugguaugcacacacucauuugucaugcaggagggaaucugcacuuugacacauuuuuguuuauucccuggccguuacuauggaaauaaucugauucucugacuuaauaaacaaagucugaguugguggguguuagcacugggcagcuggagauccuaaugauaggggaggaguccguaguuuagacuuaacacagcuuuugccuauauuuuuuuucaaauuauuugauaauaaugguuagugauggaaggaugagacaguauuaccuguguaggggaagcucuaauacuuuucaucuugaacauaccguaguuuuaagaauuaucaaggcuguuggaaaacccguuuugauauggguagcauuuuuuuuuuaacuugcaauuuacuuacugaauacauggaccaagacugagcauaagacucaccaggacuguaauaaaccuuacaaagcagccaagccuagacacagccaucugcauggaggccucugagcaccagguacaucacaccccuucggcuaugccucccagagagcagagauggaugggaagcaccaggcccaccccauccugcuaggauucucauuagcugugagcugacugugucuuuuagaaauuggcaagguaagguaugccaucuugggaggcaguaacuaugaaagacugacgagaggagaaagguguguuuacauccaguagcuguccugcaaggcuggcccuugcacagacagacacacccacaugcccuggucacacuguuggauagugggccauagacugacuauaggagaauaaccgaguccuguccuuacucaggcaacgcagagagcuggcauguggucagcuaugaugcacauagaacuugucuucagcuggaugugaccaaguguauuucacauaagcaaggccuaucagcuaaacugcuuugcauaucugaguuucugcuuccaguagcuauagauuaggauaaaaacacaguauaagauguauauuuuuaauacauaugcccuucagccuacaaaauuacacacuauuuauuuacaaauguuuuuucaaaaauuacucaaaucagccaggcauuaugguauacaccuuuaaucccagaacuugggaggcagaggcaggcagaucuuaaacaauuuuuuuuuuaagaaacaagcaaacacaaaaaguuuuacuuaaguccaauuuuaagaaauauauaggucaguuugguuaaaaauaauaguaaugaaaggaaauuucauugauugaaauuuauucuguauuuuucuugaguuauugagauuauuuguaaagcauuuuuaaugccacagugacuaacaagcauauaaaaucuucauaccuuugacaaaauaauuugaaaauuaauuuaaaacauauccuuuuucugaugaaaaaauauguuggcauuuuaagcaaauaagaguagaaagguuguuuauuuaagagaacaaaguauuuccaaauacuguagagucgcuuccacgaaaguccuaugguuguaugguuaacuugguuccgguguuggcugaucucaauuacugacucccugucccguguucugucugugacuuaauguaacuguuaucaccgcgcuugugaccuuuuacgucauuguuuuguguucacccucuuuuuuaaaaaaaaauauauuaauaaacuaaaaccaugcuuggugucuggaau

SEQ ID NO: 7171 - RNA, 2630 nt, Mus musculus
ucagauuugaggcaagcuuuauuaaauacuagccaggaugauggacacuguccaggugcaggcccgggauuuccagugaauggcaccaaauuacuucagucagcuacguauaaaggcaaaccccauaaggaacguacuuccugccuucauccagcuggggccaagcacacauccugauguacuggagcacaucccgugcuaccaaccuuguuuauagaagaacaacauguggguuguuaucuuacgugaacagcagcccccaacauuucgggaagguaucuguccuugggcaaguggggcuuacaaguuagaggcauguuuguuagauagaucucucaggacagugauuuauuuugucacacagagaggaguagcuuagugcacacuggcauuugauguucgcuccuggauauucuucucuauguuuggaaugguucuuaaaaugaugccuugugcuuuuacuuucggucuuuuuuuuuccccccacuuuguuuuguccuauugugguuuguuuuuucguugucuauuuguuuucuagugagagagagagaaagggcguugguuuggguuccagggaagauaaagaucagggaggagcugcagagaagaagccaugauccaaauguggcauauuaaaaaaauaucuauuuucagucaaacauuaaauuaugaauaacaaaaaauuaagcauuuugugacugucuuuaaaauagaacuuaugccauaguuucuugauuuagcauauuuuacucauguguuucauuuccucaguaagacaaaucuauaugguuucaaaacaaaaccccauugcaauaaaugacagugauguggcaauagaaauaugcagacacacauaucuuuguagggaggugcuuuuuguugguugaaguuguggcauauacccuccaaacucaacuauuccuuaaggggcaggugggcccaccccugauaaucaacuucuccauuugagguauugguuagugagucuucaauguccucuuaggauguuacaagagauuuucucuuuucucucacuaugugguggaagauggaucauguggcuggucuauuuauugucuaagcagaacuuagcacacagucacacagccccuuucauugcaaagccuucucggggaauuuuuauagcuaaccagcugcuaauucucaguggcugcuuagggguuaaugccacaucuggaucuagucagccuggggccauuugagaaagucaaaggugcaccaaggcacaucccagcauggaaggccugcagcacccaagacugccuuuugucaggcauaaauacaagugucaccucacacuggcucuggagaccaagucagucauccugguccaccccaccuuuuuuuucaacuacuuccucuggauugcagaugccauuccuacaaacauuuucaguuauuuuuguucaaaacuuccagccuguuaacauuccucaggauccuuccuuaguggcuggugggucacuaagccccaggggcaugcccuugugagugcacuguccuaucugaaccacuaccagugccacgacaggucugcucugaauucugacuguuguacaaauagauggacagcucccaagagccaaaccuguguucuuuuugcucuuuccaauuuguuuuauuuugcuccuucucugaaucccuauaccaaaucuuuucauuggcauucuucuuugagccuuugugucaccuuagcugcuguuucuguuucuauuguauccuuugauuagaaaaaaaaaaguugguuccuucaguagccuccuuugcuuuuauuuuccauaacaauaaacaaaaugagucaccuccaaggaucugacacagaaguggggaaaccaucacaguugaaagccuacugaucuuccauggagagacuuuccaaagcuagaauuuccauccuggagauauucuagguugguuuaucuguuuguuuguuuuuuauuuaauauucguuuauuuuauuuauaugaguacacuguugcugucuucagacacaccacaagagggcaucagaucccauuacagaugguugugagucaucaugugguugcugggaauugaacucaggaccucuggaagagcagucagugcucuuaacugcugagccaucucuacagcccugguuuuucuguuuugagauagagugucacaguguagcccagguuggcuucaaauucuaacaauccucuugcauccaccuuccaaacacugggauuaggugugugagccaccaagcccuauuuugccuacagauuuucaaagacuaaaaacuaugagcuuucaugaacuuggaauuugaauuucauacaucacauaguaggcccucaauaaagguuuuauaaucacaguaaaaauguccaugggucuuagcgagugacaauaucaacaagaaguaucuuucuagagggagugucugccuacaggaagugucugccuauggcuuauaaagauuaucauuugauguccagucaguaaaaccagcaagcuugagaagucuguuuucauuuuugcucagauuucuucauuuuaggcauguuagaagaacguuagaguuuuuauucuaccgcuuccuacauucuauauuuugugagaauuuaacaugaaguacacca

SEQ ID NO: 7172 - RNA, 3564 nt, Mus musculus
cugucagucacacggccaucuuuauuugaauauaauggagcaaaaaaugcucuuuuauuaaucugauguacauuaaauaccuuugcagcuguuacaugaaugauaguuaucuggcauauaaauguauacacacuuccacaugugauagaucuacgcugcacacgagccaucccacacagagcaugcccugucacaaggauacacauggccgucucgggacuuuuagugaagaugcacuuggcccaacauuuuggcaaucagaaaugagacacaaaggagcauaccagaaagaugaguucacagcagggucagcagaacuugauggagacuccagaaagcugacaugggaguuacugagggucacacaugcagcacagauauacacuacaacagggggacuggaccacacagugggacagcagacagagcacuaaauauagaaaagagaaagaauacaacgccuaacacccauauacccaaaccaaggacaggaccgaguugccaaaagccgggugggguuauaguccgagguggaagcggaccucuucuagggcuuuccuucagcuagacccugaucaggagcacauggucuguucaauguauuccagggucaggcagagacuauaaaaccacauuugggaaagugcgugaaauagcuaacuuacugcaauucucccugaaggaacaacacccagaggccaauggguucucuggauggcuggucuuagucugaaccaauuaggaauguggagagaagccuuugaguauugacaugagcgcaugcuaaaucuuuccuucccauggacuuaugaguaaugucaugcugacucacaagcccaaggggacauucaacuccaccuggccuggaucaguacguugggaggccccaccuccuuccccaacaaacccaggacccuguguaugcuacggaagcaugcuacugcugaguuaugggaaguuagacagucuucauggcuucagagagugguacauuggcgaauguuuaccaauaccuggggugcuauagggguaggaggagucugaccuggaguauuugucacuuuccaugcuguaauuguuacagcuguggaugagcucagcauaaugucacugacccugucauugggacaccauuauuacaguacuuccaaaauagagauguaauaggcauaucauacuuuccucaagggcaugacuaauaaaaaaauguagaaaauaaguaggaagugaugaguuuugaauacauauugcuuuaaaauauagcugauuuaauugcaaugacggcuacauuucuugacugccuuucaaaaauuucugaaacguaagccacuggcucuaagauugugguugagccuguucccagccauggcuggcuuuagaugacaccaucccuucuggucuggauggucaguccucagagcaccagggcgcugcucagggacaggaucuccuuggugucagggaagguauuuggcuugguguaaaagcuucucugaguuugaaccaaagccugaaagcuguugucucuucuuaguucucgauuuucuuagcucuaggggccaugcaaauaugguaggacaggccaaggaugggcaaugguuguaguuuaagcaccuggccuucaguucuguguagguauuuacacagacaaggagugccagagacuauauacccucucucugugucuugcuuccuuggaggauccagaaccccaaagauccuuugcagcuucaaaacacuuggcaacaacccugcagcccauuucaaacuagaaccuguaaacucccuggccuccuggugucagaaccuguuuucugggugacuuaucgcagaggcaagagaaggaaaaagucugcaagacagugugacggggucacaaaucucuaccaucagaaaggaaacacccccaggaggguuggcuuagaggcuggucucuggcaugcugaggcccugaaaagagagcuucuagcaugcccagagaggacacacuuacugccuagcuccccauaaagaacagcucuggagaaacaaacuucuccagagaggcaccugcucucuuugcugcugucucuucuuugaucaauaucuuagugcaauuuccuguugagaccauuuaaagaaacauagacaugaauguauguguguguguguguguguguguguguguguguguguguguguguuuucaaguacuguuuaauacacccuagaagcaguucauucucuuucagguaacccccagucaugcauaguucuuguacuaccuguuuguuguagauuauaacuugcuuaacacuuggaaaaauaagacauugauagagaccuaauacaagauauacgacugucuugucugugacucccugcucuguguucucaaagaaacacuacaaaggguuaaauaucuguauacagcccagagucucaacaccuagcacacuggaggccaagccuuagaugauauuaacccaaaaagcaugugaaagaagaacagauguacucuacccaacucucuccucuacccagcuccaccgguuuaaucagugagcuaacagacacacagacuguguaccccguggcucgaaaugcugggcuuauuaaacugcaucuggguguugagaaaaguauagggaagcccuggcgaucgaucgaugguuugugugugguuggugagagacuguugacaggggaaugggacagucaagagugaaagcgacagaacaggacguggagagcugccagcuuccugaaacagggaaagggcaugcacuauggcuaagagauccugacaacuuccuuuggucagaugacaagagaaauuucaccuaaaauagacacuucgcucagcagaaugcaaacgugaagaaacacaucgguuacuucagggcacuccacuguguagauguguguuuguugucucagcaugccuauuuugggggugagggggugagggguaggaguaguugguaacuauguuuggcacaauaugggauuuaagggaaaccugauauagagccacuaggccccaaacaauaugguaauugucuacaguuccaggugaaggucaaaucuaggcauccugguuucagagccuuuuguacaugaacacguaaggcauccugaggaagaacuagggaaaagccuuuuugauagaagguagacacaaauuggagaauaucauauucuauugugguuggcagagaguguucccacggaaugcucuggaaacaauccuagaguuuagaaugucucccagguaugcuaaucucauugcuggaacguuaucaauggaacacuggacucccccuugguugucacaccccuuccuccccauugaucucuuaagauauucugaaauugagugaacuuuuggugcaaacuugagcucugauuggaugagauuugcagaugagggcccaucuaccaauuuauguguaaccauugagaagcacuagauccauuuaaggcagcauuucgagaaaauagugaaguagauggauaggggacucuaggauacagccauguguggucuacuuccaagugucugucuuuuaacugcaguguguc

SEQ ID NO: 7173 - RNA, 3564 nt, Mus musculus
gacacacugcaguuaaaagacagacacuuggaaguagaccacacauggcuguauccuagaguccccuauccaucuacuucacuauuuucucgaaaugcugccuuaaauggaucuagugcuucucaaugguuacacauaaauugguagaugggcccucaucugcaaaucucauccaaucagagcucaaguuugcaccaaaaguucacucaauuucagaauaucuuaagagaucaauggggaggaaggggugugacaaccaagggggaguccaguguuccauugauaacguuccagcaaugagauuagcauaccugggagacauucuaaacucuaggauuguuuccagagcauuccgugggaacacucucugccaaccacaauagaauaugauauucuccaauuugugucuaccuucuaucaaaaaggcuuuucccuaguucuuccucaggaugccuuacguguucauguacaaaaggcucugaaaccaggaugccuagauuugaccuucaccuggaacuguagacaauuaccauauuguuuggggccuaguggcucuauaucagguuucccuuaaaucccauauugugccaaacauaguuaccaacuacuccuaccccucacccccucacccccaaaauaggcaugcugagacaacaaacacacaucuacacaguggagugcccugaaguaaccgauguguuucuucacguuugcauucugcugagcgaagugucuauuuuaggugaaauuucucuugucaucugaccaaaggaaguugucaggaucucuuagccauagugcaugcccuuucccuguuucaggaagcuggcagcucuccacguccuguucugucgcuuucacucuugacugucccauuccccugucaacagucucucaccaaccacacacaaaccaucgaucgaucgccagggcuucccuauacuuuucucaacacccagaugcaguuuaauaagcccagcauuucgagccacgggguacacagucugugugucuguuagcucacugauuaaaccgguggagcuggguagaggagagaguuggguagaguacaucuguucuucuuucacaugcuuuuuggguuaauaucaucuaaggcuuggccuccagugugcuagguguugagacucugggcuguauacagauauuuaacccuuuguaguguuucuuugagaacacagagcagggagucacagacaagacagucguauaucuuguauuaggucucuaucaaugucuuauuuuuccaaguguuaagcaaguuauaaucuacaacaaacagguaguacaagaacuaugcaugacuggggguuaccugaaagagaaugaacugcuucuaggguguauuaaacaguacuugaaaacacacacacacacacacacacacacacacacacacacacacacauacauucaugucuauguuucuuuaaauggucucaacaggaaauugcacuaagauauugaucaaagaagagacagcagcaaagagagcaggugccucucuggagaaguuuguuucuccagagcuguucuuuauggggagcuaggcaguaaguguguccucucugggcaugcuagaagcucucuuuucagggccucagcaugccagagaccagccucuaagccaacccuccuggggguguuuccuuucugaugguagagauuugugaccccgucacacugucuugcagacuuuuuccuucucuugccucugcgauaagucacccagaaaacagguucugacaccaggaggccagggaguuuacagguucuaguuugaaaugggcugcaggguuguugccaaguguuuugaagcugcaaaggaucuuugggguucuggauccuccaaggaagcaagacacagagagaggguauauagucucuggcacuccuugucuguguaaauaccuacacagaacugaaggccaggugcuuaaacuacaaccauugcccauccuuggccuguccuaccauauuugcauggccccuagagcuaagaaaaucgagaacuaagaagagacaacagcuuucaggcuuugguucaaacucagagaagcuuuuacaccaagccaaauaccuucccugacaccaaggagauccugucccugagcagcgcccuggugcucugaggacugaccauccagaccagaagggauggugucaucuaaagccagccauggcugggaacaggcucaaccacaaucuuagagccaguggcuuacguuucagaaauuuuugaaaggcagucaagaaauguagccgucauugcaauuaaaucagcuauauuuuaaagcaauauguauucaaaacucaucacuuccuacuuauuuucuacauuuuuuuauuagucaugcccuugaggaaaguaugauaugccuauuacaucucuauuuuggaaguacuguaauaauggugucccaaugacagggucagugacauuaugcugagcucauccacagcuguaacaauuacagcauggaaagugacaaauacuccaggucagacuccuccuaccccuauagcaccccagguauugguaaacauucgccaauguaccacucucugaagccaugaagacugucuaacuucccauaacucagcaguagcaugcuuccguagcauacacaggguccuggguuuguuggggaaggagguggggccucccaacguacugauccaggccagguggaguugaauguccccuugggcuugugagucagcaugacauuacucauaaguccaugggaaggaaagauuuagcaugcgcucaugucaauacucaaaggcuucucuccacauuccuaauugguucagacuaagaccagccauccagagaacccauuggccucuggguguuguuccuucagggagaauugcaguaaguuagcuauuucacgcacuuucccaaaugugguuuuauagucucugccugacccuggaauacauugaacagaccaugugcuccugaucagggucuagcugaaggaaagcccuagaagagguccgcuuccaccucggacuauaaccccacccggcuuuuggcaacucgguccuguccuugguuuggguauauggguguuaggcguuguauucuuucucuuuucuauauuuagugcucugucugcugucccacugugugguccagucccccuguuguaguguauaucugugcugcaugugugacccucaguaacucccaugucagcuuucuggagucuccaucaaguucugcugacccugcugugaacucaucuuucugguaugcuccuuugugucucauuucugauugccaaaauguugggccaagugcaucuucacuaaaagucccgagacggccauguguauccuugugacagggcaugcucugugugggauggcucgugugcagcguagaucuaucacauguggaaguguguauacauuuauaugccagauaacuaucauucauguaacagcugcaaagguauuuaauguacaucagauuaauaaaagagcauuuuuugcuccauuauauucaaauaaagauggccgugugacugacag

SEQ ID NO: 7174 - RNA, 648 nt, Mus musculus
cagcacuucuucagacaccacggguugcccaacccagauuccuacaccccagacagcugcggccuuggguuccaaguuaccagaugcaccuugccucccgaacuagaucacggauuuaauacaagcuuuccaagguccuccgccaaagcugacaggauccaggaauuggggggcuagcgguaaggacagucccaagcaccuccuaucccaucccuggccaggcacucauuccaagacgaccuuucggccccgcaccccagcacauuccgcagcccccgccccgggacagucggugccuccaguccagccccaccccaggucccgagcggcucccccucgccucgcggcaggugagucccggcagcggauccacgguccccgcggggcagcucaccuugcugaggaccccgcagcgcuccacaggcggcccggacuccgucuccggauccuccuccgagcccgacgaguuccagcucugguuauccgacauggagacgcgacagccgagcaggagaccggcccccgcuccgcgagcugcgccagugcaggcgccuagucccuggggugaagggucgggggauggcaccgccaagagagcccgcuccggggagugagggaacaggaagagggacgaagcgcgcccgccgc

SEQ ID NO: 7175 - RNA, 3917 nt, Mus musculus
uccaucuccuuacuguuggacauuuuggcuaaggucaucuccguugaguccugggagccucucacaucccagguuucugggacuuuacauacauucaaaacacacacacacccggaccccacccucuacccccugcagcugcauauuucuauucauucuucuggcccucugggcuucucccuggucuaccccccccauaccugauccugcuccccuuuccccuucucccacccaaaucacuuccucccucugccucccaugacuaugcuguucccccuucucagugggauugaagcauccucacuugggccuuccuucuuggguguucuguacuuuuugucuaauaucugcuuaucaguuaguacauaccaugcauguccucuuggaucuggguuuccucacucagcaugauauuuucucguuccauccguuugcuugcaaaauucaugauguccuuguuuuuaguaucugaauaguaguaguccauuauguucaugagccacuaccagagaacuccuacagcugauaagcaacuucagcaaaguggcuggcuauaaaauuaccucaaacaaauuaguaaccuuuauacaaaugauaaacaggcugagaaagaaaguaggaaacaacacccuucacaauaggcacaaauaauauacaaugaaacucuagccaagcaaaugaaagaucuguaugacaagaacuucaagucccugaagaaagaaaucauagagaccucagaagauggaaagaucucccaugcuuauggaucaguaggauuaacaguaaaaauggccaucuuaccaaaagcaaucuacauauucaauacaauccccaucaaaauuccaauacaguucaucacaaacacggaaagagcaauucucaauuuuauauagaaaaacaaaaaacccaggauaccaaaaacaauucucaacaauuaaaaaacuucugggaaaaucaccaucccugaccucaagcuguacuacagagcaauagugauaaaaaccacaagacagagacaggcaaguagaucaauggaauagaauugaagacccagaaauaaacccacacaccuguggacacuugauauuugacaaagaagccaaaaccauugggagguggggguuaucuucaacaaauggugcuggucuaauugguggucuacauguagaagaaugcaaauugaucccuuuuuuaucuccuuguacaaagcucaaacccaaguggaucgaccucaacauaaaaccagauacacugaaucuaagggaaauuuuccuuaacagaacaccaauggcucagacucuaaggucaacaauugauaaaugggaccucauaagacugaaaauuuucuguaagguaaaggacacugucaguaggacaaagcacaaccuacagauugggaaaagaucuuuacuaauucaacaucuaauagaaggcuaauauccaaaauauacaaagaacucagaaaguuagacuucuaaaaacaaaauaaccaaauuaaccaaauugggguauagagccaaacagaauucucaaccgaggauucucuaauggcugagaagcacauaaagaaauguuuaacauccuuagucaucagggaaaugaaaaucaacaugacccugacauuccaccauacacuaaucagauggcuaagaugaaaaacuaaagugacagcuagcacaugcuggcaaggaugaggagaaagaagaauacuccuucauuguuaaugggauuacaaacugauacaaccacucaaucuggcaguuucucagaaaauuggaaauaguucuaccugaagacccagcuauaccacuccugggcauauacccaaaagacacuccaccauaccacaaggacaugugcuccacuauguucauagcagcuuuauucaccauauccagaagcuggaaacagcucagauaucccucaacugaagaauggauacagaaaaggaaacauuuuuaaagcaaauauaacaaauaacagauaacuuauaacaaauccauuaagaacuauuagaacucuaaguaaucaagcaaguuuguaaaggguaaaaccaguauauaaaauaucaguuauacuuguacuugauaugagcaaucugaaagucguguguaugugugugugcgcaaaugcucauguguucauguuggguauguguguguucagguacaugagcagacuuccccuaaagccagaaguggguauuggaucacacggaucuagacuuagagguauuguggguagaaagaacugaaugaacucugagccucuggaagaacaggaaguucucuuaacugucaagccaucuuucuagcucuguuuauuacuuuugagacaaagucuuacuguauagucuuguaagauagcccagacuggccuuguguucagcgaucccaccauuuuagccuccugaagguuagaauucuaggcauaagcuacuaugcccagcacucagauaaaucuuaaaaaaugaauuaaguagaacuuuguuacacuguuuuuauguuuguucugugaaaugugugagaacuauauugcagagacagaaaauaggucaguaauuacucagauucaaagauuuggggaagauguagagcaguuucuaguagacuugagagcuguuggaaaauuugacuuugcugcugcugauuauacaacucugaauauacuaaaaucuuuaauuuuaugagugaauuucuugguaugggaaguuuaucuuuauaaagccguauuuuguuuuguuuuguuuaaaaaaaaacaaaacaggcaacuaaauaugacuggagauaaagcucgguggcagagaacuugccuugcaaagcuccaaagcaauaugcagccaaagaaauuaauugaauuauauuuuccaguacuuaagugaauuccugcacucuuuugcuugggcuuuguaauuuaaaauuccuaguuaauauguaugugugucaggaguuaacuucuucucauugcugagugauauuuuuuugguaugaauacgcuacaguuugucuauccguugaugaacaaucgaggaguuuuaaguuuggguauuagaaauaaaguuauguaagcacucguacacaggccuucuuaugggcgucuguuucauuucucugaguuuaaaugucugugcauauuuuuuaggaauuauaugguaggugguuuuuuaacuuuuaaagaugugcaaguucccucuugugguuuuaauuugcauuucuuuaagaacuaagcaucuucugugcuugcuuugcugccugucuucuuuguugaaauguauucacaucuuuuguucuccacccuugguuuuuuucccaguguugaggcuucagacccauagcuguguuccugaagcugcauuuuauuacuagcucccagucuuugugggcuacuuggugcuuaauugcuuauuuacucaaucuauaguauuuuuagguuacuugauauguuacagauauagguccaugaucaauauaggccauucauuucacccuauuuguggcuuaucuucuuaaugaugucuucaaguuugaaauuuugauaaaauacuuuauaauucuguccuuuccagacugcacccuuacugucaugacuacaugcaagucucuuaagucacagugccauuauuuuucuuguaaauguucuaucaggaugauuacauauuagcuauaaaauauguucuuaggauucuuuuuaagaucucuccuuuaauccauuugcuaaccauguauuagaauguaaacaugaucuacuauuuugaaguucaugcugcuuuuuuaaauucuacaguucauuauguuauaguuuuaaaauucuagacuuuguaaaauguaauguaucuagcuuugacaugucagaguguugucagcauugcucuuccuuccacuugacuuacuaggugcagcucagcaagaaguucagga

SEQ ID NO: 7176 - RNA, 23103 nt, Mus musculus
ggacgauccuuccuuauuggcggcccgcuggcggccuggagcgugcguaagcgcaguuccuuccgcccggggcuccguuggcuggagacggcagcugggccggcuuggccuccauugagauccggaggugagcuggcggacgcuggggaccggcgggacagcgggucucgcgcuccgccugggcucacgaggcggcugcgaaccgaggggaccgcgaggacacguccuugaggcccggcggcagggcggcggccagggaacccgugggccgggugggccugagggccagugcagcgacggggcguccguggguucaguccggagggcgcugugcugacccggcggucacggucauccguguacgagugccuggcagaggggacagcgggagcccuagagaacaaggguucacgcccaggcgcugccuugcggcaggacccgucuuuaaagugauggagauguaggcugcaaauugacccgauccgcguggguacggcagguugugcucuuccuagugggcccggaggaggaugcgaggucuguacaggcacagcuagcccuccgaagucggucucucgaccuuuauguuauagucuuucuccuaaggggcguagucucauugauacugaugucaauuuaccuuaugcaccuauuggaauuauuugguuugaaugaagaaaauggccuuagagguucgcaaguaaaacaguagacuucugagguugggcgaaguuaauagucuuucaucgaaagcggacagauggaaaucuuuccucucuugagguuguaucuuuucgggcuaaggccuguaaaggcacaggaaacgucuguuacuggcucuuuacuuacaaagucguuguguacaauuaaagcaucacacgaaguagggaauacauuuuguuugguuacuugugauuuauuuguauuuuauuuaucguagggcaaaagucuuggaucuacauugggcugcguuuugugggcuuacuuggucguagugccuuucuagaacuugaccaggcaagauaaagggugugcuugcucacacugcuauauuuuugucuaauuuguagacugugagcuauauucugggaucaguuucugaauccuuaaaucuaucuugaaauugugcuuuuuuuuuuuuuuuuaaguucuuaaaauaguaguucuuuaugguuccacuuaauacuuuggucagagaacuugaccaugaagaggagauggacuuagaaacugguaauguaugguaaaguuggguacagaacuuguuuucugugcaaggugaugauggcccccuuugauggauggguagguuaagaaugcugaguguucauccuguugggauuagacguggcuacaguguaggauuagggggucuuacccucaaagggacaaccugcacauaucaguguagauauuuucuaaucaaagaguggguuguguacuaccggaagaaugaauggacuggaagaaucucagagaagccugucucuuggcagugguuggugguucuauuccuagauagaauuagaauuuaagucuggugaguuuaaauuuucagccauuugaggagucugugaaauguuugcuguauacuguauuuggauaaguaggcaaguucuuuuauugcagcgcagcagaaaagggaccuuccgagcuuucauaaacugcuacaccggugucacuuugccuagucacagagaaaugggaggugcuccugagagacaaguuuauaauuacgguuacuuuugacauaccuuuguaacacugcucaguuuguaguuccagguaggugugguucucugugcuugguuggauuguggaacaggauuuuguguaauuuuuuccccucagauuauuuaauaauaauaaaaaaagacaauguacgugcagggaagaguggcaagauugccaggccccgggaaccgagcagggugggaggucuggugugccugggguaguguggguaugggguuacuaguuggucaucacauuggggcuccucaugauagcaauuuacauuuuucucagcggaaucacuuuuaauagugaugaauaaaauugacucguuaaggaagacuauugaagcuuuguggugaaggguggaggacuggaagugcuuuagauuuacauuugaaacuaauuuaccuucugaaaccuugaagccagucuuuuccaacaguuugcuuuaguuucugauuuuaagagauucugugagagaggccaguggacaugugguuucucaugagaauccuagacagguuuaaaguguuuguucuuuaaacccaggcccuccauaaaaguacugugugguuguccuuucuuggguauuuguguacauuagugcaagaugccggagaggaaagugguaaaacucauuaugcaguacugaaaaaaagauaaauacugaugccuuccacaucuuaugccauacuaguuguucuuuccaaaauuaagacccacaggaagaaauauagugagaauguugugaaugauuucaugacgcaugaguuuacaugguacuuacccguguucccugccuuaccugucaacuacuuuuauguugcuuucuauuuuuuaguuaauuaaaacuguuaucagcaacauugauuuuuaugauugaauuaauguguugcucugacuaucuugaaaaccaguuauauuggcguguagccugguauauugaaauauagaggaaaaauggaauguuggaaucagagaugauguuggcuaauuggcuucauucuuaaaagccaagcccccacccuucuuaccccccacccucgcccuagcuaccacccuucuuaccucccacccuugccccagcucccaccguucuuacccccacccucgccccaguacuuuuuugccuccuuuaauuugguggugguggucccuuuuuuuuuguuuuguuuuguuuuuuuccagacaggguuucucuguguagcccagacuggcuuugagcucagagaucugacugccucugccucccuugucaccacugccuggcuaguuggugucaucagucaauaagucacuuuccuaguagaugugugagaucuauuugaauucuugcugacaaucagugggcuguuaguugguuucuugucaucauuuguauucuauuguguguguuugugugcacugguguguacuguggccugagcguggcggucagagcucagucugcaguguuagaagcagugaggcuuagaugcaagugcauuauccacaggcccaucucccggggucuaguuuuugugacugauuguuauggguaauaguuuucauuuugcucuauaguuuuaccaugagaaauaucucuguaggccaucagacuauaagauuacauuucaaauaggaaugucaaacuuguuaauuagccaucagaugugggaaggguggcagucauuucauuagcucagaucuugcuauuuauucuguugaauccucuugucagacaagaagucguaguuuuggggguuuuuugaacagagggcccugcaaugagcuguaucuucacuccuugggggucuuucuguaugauacauacauguuucauuuuacccagcaucuacuucuacugacuuuccagucuuggcuggcuguaaaaguuuaggagccuucuacaucuaacacauuuaaaugggccuucuugccccuguacuuugccaggagaaaagccauccuagugaaaugcaugcccccguuuuccuaauguggaaguauagaucagaaaagauuucuggugacagccaccuuagggaaguuccuuauacauugugcuagugacauucugccuuauucuagagacugaaaugaaaagcaggauuuauggcaaggugcucgagaagaagguucuuugguguugccuuuauuaggcaugugguggugaagaggaugcucgugggcuuucuguuuaacuaaaaagugggaauagucucaugucugcuuugugcuuuauuuauucugcuccuccuuggcucacauaacuacaaggaguuacucuugaaacuuaacuuaaaggaacauuugcauauaaguuguuuaccagugaguaauaagggauuuaggugguugaagaaguggcaagcaccguguuaauagagcauuacacucacuuuccaggauuaugcagaacgcuggaauaguccuguacaugagaugcugcacuuagggcugaaagugagccccaugcaugcuaaguguucuucauauguauauccuuccaggauccaaggacugugaggcuacaauguugucaagacuuuuccggaugcauggccucuucguggccucccaccccugggaaguuauugugggaacagugacacuuacaaucuguaugauguccaugaacauguucaccggcaacaacaagaucuguggcuggaauuaugagugcccuaaauuugaagagguuaguuuacuucgauacugacuaaagugaauuucauuuucaauuucucuuuuuuaaauacaagugaauauaguucacucccuugagaaauacagcuuuuguaaggacuaucagaaaaaaaaaaugauugugaagaauuagauugcuuaaaaguugcauucaauuuuugguuucuauguuggcuuuugauuugguuguacuaugguggcguuucuauucuugugauaauaugugaaccaaugacagaguaaaaguuguugcuuggguccuuguuugaacgcuuucucugccaauaggacgugcugagcagcgacaucaucauccugacgauaacgcggugcaucgccauccuguacauuuacuuccaguuccagaaccuacggcagcuuggguccaaguacauucuggguaaggcuggucgccggcugugcaugcuggcagacuuuggauuucagugcacuacugaaagaguguuggguucauucagcaguuaguacucucagaugagaggccucagugauacagaggaacguggcagugcucuucuagagcacugagagagacugcaugcaucccguguguaguaaggagcgcagacuuuaacuguggcguuugccguuuagguauugcuggccucuucacaauuuucucaagcuuugucuucaguacagucgucauucauuuccucgacaaagaacugacaggcuuaaaguaaguaaaggccaguguguguucuucuaaacuacauuuuaagacccuuuauucucuguauuaaaggugaugcguacauuuaaaaguuuaaaaaguaggggaaaguuuucaugaacuugcuauuagcuagcucugggugcugacauuuugauauauauucuucccauuucuuuuggacaugcuuucugaguauuguacuguacaugcugugccaagucuuuuuugcccaacauaacucaucugcaucuuuucauguuaaccuuaguguuaaagucaguuacuagugauagcuguaugguauucuguguaaauauuuuguaguucguuauuccaauguuggauuaaguuaaucuuucucaguaccacagugaugaguauuuguauagacaguuuguguuuaugcccaccaucaucaccuagggguagaugcguuucacgagucacgcagcagcugugggagggcuuacuuuacagcuugugcuuuuuuagcugcuugccuugggggaggucggggcagcuucaccaguggguguauuacacaguuuacuuaaauguuaauccagguacauuucauaaacauagaagagcacuuugcugagaaaacacggaagagguguuucagugcguguucauuuacacuuuaacauuguccaguauuuuaguuaugcuggacauaaugacagugccuguaccuccacgagggccagggauccaaggccacuuccagccccacagcaaguuagaagucaaucuggguuucaugaggcuuugucucaaaagaguaaacaaaauaaacuuuagcaaauacuuugagcaucucuuauucaaggcuucuuaagaaugcuagcaggaaaguggucaugccacaugugugugguauggaaaggauuauauuaagaaguuucuaaaacuauauuauaccuguguuaaauguaacuugucuuguuuuucccucccccgcagugaagcuuugcccuuuuuucugcucuugauugaccuuucuagagcgagugcauuagcaaaguuugcccucaguucaaauucacaggugaguauugauuguuuguaacccuggagugugaugagagaguucuuuacuguucaaaguguaacugcugucucaagccuuuagacaaauguuuuaaaacugguuugugugagugucucacuuccccauuuccccuuugaaagucuucugaaaugacagugcccuggugacuuaggugaauacauagccuguuggggccucgggaaagagugagcgcaccgggugcuuccucauugcuuugaccaaauaccggacaugggacaauugcagggagucagccucguuugggcuuguguugccaggaggugguucauggagcugggaaggugugcacccagggccuggaggccuggaggcccagugcagccaagaagaggguugggccaggcucuggugccacagagcccacagccugugauccacuuccucagccucccaaggagcgccaccuacuaaggaucaaauguucaaacacaagagccuuugggggccuucucaccuucacacugcaacagaucuaguggacuagagccucccaucacauuguuucuaagccccucaaauuaacauuucucaucuuaaauucauccugacguucauuggugacuuuaaaaaacucaccauuguguuaaauagccuuguaguagaauucuuuuugagacagacuguaucucauucugcccugaguuauagugcuccuccugccguggucagcugagugcugggacugcggacauacacaccaccauauccuauuucguccuuuuaugauuuuccuucccugucggaccauuaaacuaaggaccuuuagcaggaucuuccagugcuccgucacugaacuagccccuuccccaagcucugaaagaggucauaguucuaucccaauuauaaauauuggauacugcuuaugaucauuugaacauuuugauacaaaaauucucuagguuuuauuguacuaaugugaccucagagaaucucagcuaagguuuugucggugggagccagaauguaaugugaaaugugaaagaguguauuagucaggguucucuagagucacaggacuuaggggcagucucuauagaguaagggaauuuguugaugacuuacagucugcaguccaacucccaacaguggucaggagcagcugugaaugggaguccaaggaucuagcaguugcucugucccaccuggcaagcaggcgaaggagagagagaaccuuccuucuuccaguguccuuauauggacuucagcagaagguguagcccagauuaaagguguguuccaccacacaccaagauccagaucagaaacuucuaucucccagccuccagauaagggucacuggugagccuuccaauucuggauuguaguucauuccagauauagucaaguugacaaccaggaagggccacuacagaaaggguguggucagguaggaguucaaugauugauuaaccacaggagugauccguaggccaugucucucacugcccgcucugacuauugaaugcauucuaucuuguuugcguaguaaaauaaguuucauguaggacccaggaugcucucuagcauuuuaaaaggcuaaugugcacuuuacaaccaccgauauauuuggucuauucuucaggaugaaguaagggaaaauauagcucguggaauggcaauccugggccccacauucacucuugacgcucuuguggaaugccuugugauuggaguuggcaccaugucagguuuguaaacaauuucuaguacacuuacaguugucauuaaaagggaagauagcagaucugauauuuacauuguuuauucuuggauucugaccugagugacuugaacggggauauuguaaguguguggagcuauggaccucugugcaugguaagaaaguaguaacagguuucggauauugcccaugcuugcuguccucucuuuuuguguccacuugugguacgugggguuugcucuugguuuauaaccaagaugguauugcaaggccuggagacccuugcuguuaucugggcugaaguagggauuccuuuccuuguauuuuaauugccauguuggagguggugcaagaggccagaucuaagcagguaguugggaagguuuaauuagguacuaggccauacaucguagccugccgcagcaccaaccucuacacacuuccucauccuuaaagcagcacggagaauuaauacuaagcuucaaacaggacuccauuacguacaguggagauuugccagagugaauguaucaugcuauuaugaggcauccuggucuuagacuagauuuuuuuaaguucugguuuuguguguguguguguguccauccauccaucuguggccccuggaguuauaggugguugugagcuaucuaaugugggugcugggaaccaaacugggguccucugcaagagcccaagacacuuuuagcuguugaguuaucugcuacuccaaccccuaauugucuuucuuuugggagaaaauuugguugucucuguauucauuuauuaaauauuauguacuucuuuaaauuucugauaguaauaacacauauucuacuauucaacaaagguuuuuauuuaggaaagaaaaaacauucuaaaaauuguuuuaaaauuuacugcuaaggauagggcucagcggcucagucuauagcacauguuuucucagacuuuaagauguacuuuguguaaccuaggaagauggcagguaaagcacuugccaugaaacgaugagagcugaguugggguuucuaggacccgcguaagccugccaugguagcgcgucucugcccucccagugcuccugugauggggcagaggcaaagagaauuuccagaaguugaagcucuagcuguagcuaaccugugguaucgcaaagagacaagucugucucuaguaacacagauacaauaacagacaacugauacuguccccugacuccauacgugccccacaaucacacacacacacacacacacacacacacacacacacacacacacacacggaaaaauuaccuucuuuaaagguauaguuuugaguuuuaaugacgauacugucaugucaucaccacuaaauaaaauguugaucaggugaaaacacagccacauaaacaagagaguuugagauguugcaggugggccaggaaguuacaggccuggaagcaaaggcuguguauuugaaucugaugcagaaaguaguagggcugaugccuugucuugaaucauuagagaaaugaaucaaagaauugggugugucguggcagaagccacugaagucaucuuuaucugcagaaauagggcuuaaaauuaauuaggcagcaacccacugccuaccuuuuuacacagugugagggauugauccuggagcuuguaugugcuuuggacacauucugccacauccugggcauaacugaaaaggccaguucagaaaaggguugggcuaaguguagcuaacucagugcuacuauguacuuugcacauauaaagguacagggugcaguucccagcacacauacaagccacagcugcucagacgucuuuggacuagagcuguggccugugugacaucaaaguggcagagcagcugcuuuuggaacagucaggaagaaugauggcaacagggaguuuaaccaaaaaaaaaaaaaaguuggugauugauuugugaaaagcauugguuaaguauugauuaugaaaaucuauucauuuaguguuuaaguugaauguauagauuugcuuuauuuauuauauguauaacuugcaguuucucagaugcccuugguugugagaauaaauaauguaauguaguuuuuuacuuuaauuugagccaaagaguaggaguuggugaucuuaauuuuuuuucuggucuguacaauuuuggcaccuucuauuugagauuaccgacugauccuugaaauaauuuuguggugaaauguuuguuaauuuucacucuugaguuauuaacauuuuugcauuguaucauuuucagauuaggucaaugaaguaaaaugcuuagaacaucaguaggcacugugggguuauagagagcugcacuuagugcucuguaaggacuguguacugagaugccgugucagaaaggcauaacugccuacugaucugugcauuauauuauaaaucaacguggacacaugggcuaauuaauugcuuuuaugauaagugagucuaggggaguaguguaguuuggaggauaaaguaauuccuguagaguagcuggucuuauagcugcuugucucagccaaagugauagcauuuauagaagaauuggaagcauuugucugccagcugugugaaacagccccauuacauacagcuuugugcugaugcuugggucuguguccuggcaggacugcuguuccucaggccauagaucaucuuuguguugcuaauuuuguuguacuaaaugacaaaggauguaauguagugagacuuggcugugcauaaugaagcgccuguaaguuaaguggcauguuagagacccacacugagcagcugugucucacucucuccccaggcguccgccagcuggagaucaugugcugcuucggcugcaugucaguguuggccaacuacuuuguguucaugacauucuucccggccugugugucgcugguccuagaggugaggcgggguuuccuggugucauuaguuguaaaguaguacuucccaugcugccccucuccuuaguccccucauaccuccuaacgcagugcccacuuccuucguagcuuucucgugaaagccgugagggucguccaauuuggcagcucagccauuuugccagaguuuuagaagaagaagaaaauaaaccaaaccccguaacccaaagggucaagaugauuaugguaauggcauuuuuuucuccaguaucuguaguuucggugugucuuauucuuuggguauuugggggcuuuugcuuguguuuuuaguuccuaucuuguuuaucuaauauuuguuccuuucggugauguuccagucuucucuuuuuucugaguuaguuuuuuguugcuuugaaguucuggggauuuuaguuugaugucuugagacaggaucuuacugguuuugaacuuucaaucauccugcuucagccccccugagugcugggauacaagguguuugccaccaugccccauugggcuuauggucuuuguuauucuugcucuccugaacagacagaccccugucuuugaaaggcuauucuuugggauguuugaacccuuacagcaccauugcuuuuauuuaacaaacuaggggcuuucuuaccaugauaaguggggcugaggacuaaagugucuggcuauggaguugggagggacgagaaagaaagcagaagguauacaauuuaaaauaugucccuucagucuuuaggcuugguccuuguucacgcucauagucgcuggauagcugauccuucuccucagaacagcacagcggagcaggcuaagguuuccuugggucuggacgaagauguguccaagagaauugaaccaaguguuucucucuggcaguuuuaucucuccaaguaagugacuggaacccacaauacucuguguucucauggggcugugcugugacuuuacuauuucugaacugacaacauuuaucuuggcuuucauccaggaugaucagcauggacauugagcaagugauuacccugaguuuagccuuccuuuuggcugucaaguauauuuucuuugaacaagcagagacagaaucgacacugucauuaaaaaauccuaucacgucucccgucgugaccucaaagaaagcucaagacaacuguuguagacgugagccucugcuugugagaaggaaccagaagcuuucgucaguagaggaggauccaggagcgaaccaagagagaaaagguaccgugcuguguucuucaucucagguccucuuguccgaggccacccccugaguugacuuccucugaaagugauuugaggacuuugagaugucuuuuugccucucacacaguugagguuauaaaaccauuagugguggaagcagagacuacaagcagagcuacguuugugcuuggggcuucuguagccagcccuccauccgcccuggggacacaggagccuggaauugaacuccccaucgagccacgaccuaaugaagaaugucugcagauacuggagaaugcagaggugagaaaagggugugcucacacgggagaauacagaggagggacaagggugugcucacacugggggagaauacagaggagggacaagggugugcucacacuggggguuucuuuuauagaggauguuuuugguaccuuucuuuaaucaagggaaguuaagacugguacuaccgaggccuacugugcccuagucucugugucacguggcuuauucauagcuauauaaaucccuauagccuuuggggguguuauccccacccuucggaugagcaggccaggcucaagaggcuuuaccaagauauuuaccauugaggaaacuguaaagcuagcagcaggguuucuuauuuucuggucccagaaucaaagcuccuuguagugaguuacugucuuguagacauggggagcuuuugaaucuguguguguugaagugagcuguguuuguacacuguguucucucaccacguuuacagaugucccuucaugcuuccagccuuaucagcuuaaucuaauucuuucuguaauaagaauauguuuuccuggccuauugauuuuuuuuuucccauguuugguaagauacaguuccauucuaccaucauuuacuaagauauauugacagaggaaauuacagauauuuagaaugcauaguuuuaugaguaaucaacacaagcuaaguaaauaaaaaauuucacuauguaguccuggcuagcuuagaacucccuguguagaccaggcuggccucaaaaucagaagucuaccuuccuuugccuccccaaugcugggauuaaaggcguguaauaccuccuggcuuuaucugguuuuuuuuuuuuuuuuuuuuuugagacaggguuucuuaggguuuuuauuccugcacaaaacaugaccaagaagcaaguuggggaggaaaggguuuauucagcuuacacuuuccacacugcuguucaucaccaaaggaagucaggacuggaagucaagcagaagcugaugcagaggccaaggagggaugcugcuuacuggcuugcucagcuugcuccacccacaaugggcccucccccacccccccuugaucauuaauugagaaaaugccccacagcugggcuccuuucucugauaacuccagcuugugucaaguugacacacaaaaccagccaguacacagggucucuuacuaaauguggagcuugucauuuugguuaaacuggacauagcaaguccccagcaacugccugugucuuccuccugcccugugcugggauugcagauguauacuacugugccuggcuuuuaugugcuugcuagggauuugaacucugccucaugucugcauagcaagcacuucuuggaucuucuugauauuuuucagaauaucucccccuuuacaaacccaaagccuuuugaauuuuacucuuaauguuuuuacuuuagcucuuuugagaauugguauccucagcugaaauauauccuauuuaagggccacaauuuguacccacaaaaauauuaaaugaagagaguauauauugauuguccauuguaaguaaauauguauugauugauauucauugaucaguccacgagcauuuaaguguagaggagguccuguuguacagaggcaggggggcuggacugagggcaaggcuuuguucuggguuuguucuucagaggggauggggcauagucuggcuaagugucauaguucccaggguugguauauacugcuuuauagccuugugaacagcucugcacugugcucuuucagccuuugcucuucugcucaugaacugcccuucuuaucuaaucccaucucuucauuuucuucuuccuuucugcagaaaggugcaaaguuccuuagugaugcagagaucauccaguuggucaaugccaagcauaucccagcuuacaaauuggaaacucuaauggaaacucaugaacguggugugucuauucgccggcagcuccucuccacaaagcuugcagagccguccucucuacaguaccugccuuacagagauuauaauuauuccuugguaugcucuuugauuagggagggcuugcucuguaacuuguagccgaccuucuguugcuacuuuaaaaauguuuuucaugauuuuauaaucaucccugggaaaguccaacaguuuguuugcuugcucgcuugcuuauuuauuuauuuauuuauuuauuuauuuugguuucuggagauaggguuucucugugucccccugacuguccuggaacuagaucuguguaaauuaggcuggccuugaacucagagauccacuuacccucugccucucaaggguuugagauuaaaggcaucugccaccccacucccagccaauuuaaauauuucuaaaguaaauuuagggugggguuuggcuuagugguagaauguuuaccaaacacugaugaagcccuugguuugaucacuaacaccuuaacaacaaaaagaauccauugaaaguauugaaaucuuuuauaggggaaagguugaggaauuguuagcgacagggacugagaugagugguugucugcuacggugcaggguuucaccuguagcccaccuguguuucuuaggugaugggagcuugcugugagaaugugaucggauauaugcccaucccuguuggaguggcagggccucugugccuggaugggaaggaguaccaggugccgauggcaacgacggaaggcugucuuguggccagcacuaacagaggcugcagagccauaagcgugaguuguuuacuuuguacuccuugcugaacuagggaggaaggcggcugggcaggggaaggcaaccaggacagauucggggacagacacaaggacgaugggagaaacugaaguggauuaauacagucccauaauccucugcuuagcuugguggaggugccagcagccggguccuugcagaugggaugacucgaggcccaguggugcgucuuccacgugcuugugacucugcagaaguaaagaccuggcuugaaacaccugaaggguuugcagugauaaaggaggccuuugauagcaccagcagguaggugugugugugugugugugugugagagagaacauguguguucauguguucauauggauauugagcuuguucucugugcuagcuaaauacauugccugcuuaggguaauguagugcccccugaauccauucauuuaauaugacuaauacuuauuccugguuaggguagauguugaugcagacaaauugucccguagaaauacauuggauuuuaaugguugguaagguggcucagcagguaaaagcacuuccugugcagaccugguggccugagccacucaguaacaguaaauuagacagacagaagccgucacugugacuagacuguuaguuucccuagagaaggauuuccgacagagaccaugagaguucgucuagcuguguuuacuuugaagacugucacagucacacggaagcucaugaguaaucgaaagcucccggccaguucaggcuagugugucugcuuucaucuggacuucacguguauuaaagaguugguccaccuucuauuccaugccugagaaugccuucaugugucuaaaggaaaaaaaaauacuccuugcugaacuaaggaguaaaaugugaaucucuuaccuuggauuaacauaaaacccucguguuuacagauuugcucgucuacagaaacuccacgugacgauggcaggacgcaaccucuauauccguuuccaguccaggacgggggacgccaugggcaugaacaugaucucuaaggugagcgugggcgcucugccucucagggcuccauggugggcaccgggcuggccuugaacucaugcugacucuugggccuuugcuuuuugagugcugagaccauaacugugcuaccguacccagccauaccuccuauugauacaccauaucccugugguacacaccuaacagaguugacugauuucaccuuuauuaaaagcuaacauaguuugguuugguaguguuucuguuuuuuguuguuguuuguuuuuuuuucuuucuuuuaauuaguuagauaaaauguacuuguguauaugggucuuuugcccgcaugaaugucugucccacaugcgugccugauguccauagaggccagaagaggacaugagauuucucugaacuggaguuugauaugguugugagcuuccaguggguguugauaauuggacuuuggcccucaggaagagcagccagagcucgugacugcagaguggucugccuagcugcacugcuguggaucugacacugucuguguccuaaauguccucacaaggguuggagggaucuggggcuaaaacuucagaagguugcccaguaacgacuccuuccugaggaggcguggcccugaggguucagcucagugcagauugaguguuguagggagguguaugggccccagaucaguucugagcacacccaagguaccccaaaagaaauugucuccaaauuuugaaauugaccuuuucuagagacuuuuugcuugcuuugugaaugugugugugugugugugugcgugugugugugugugugugugugagagagagagagagagagagagagagagagagagagaaggaaagggagagggagacagggucucacuguagccuuggucuaaccuggagcacauuguguagagcaggcuaaccugcaacucauagugaguuuuuuugugucugacucugacugcugguuuacaggcagguguuaccuugcuaagaaacaccaacuuuaagauaucaaaccuacucaguuuguuuguauaauccauucauuuuguuuccugagagguuuuuauaugguauacauuucauuuugcugauaacuuuuuacccagagacaaauucaaaauguuaaaaucaucuagucaggcuacagauuuuuuguuuauaaagauuauucagaaagaggaaaauaacuaaaugccuaagaaugaaaaauuguaagaaauaguaugggggguugugguuuuuauuuuucauacuguuuuuuaauuggguauuuucuuuauuuacauuucaaaugguauccccucccccaucccacccccaauuccccugcucaccaacucacccacuccugccuccuggcccuggcauuccccuguacuggggcauagagccuucauagaaccaaaggccgcuccucccauugaugaccgacuaggccauccucagcuacauaggcagcuggagccacgagucccaccaugugugcucucugguuggugguuuagucucgggagugguuuuuuuaacagcuuggaaauagaacugcugugucaucugucuucccgcucugcuuuuggaauugaaaauggucucaaagugcuaucuguauauucaugcucgcagcauucauuacucauacuagccagcaggaaggaguaagcuaaguguugauuggguggauacgugcacaagggagagaugcauuaaaguagaacaucauucuaagggaacucgucaguuaccaaagucuacacgguuccacuuaucugagcuaaccagaguuguuaagugcaugggcaccagucgaguggcacagggacaggaagggugauugaugcuuugucagguuauggaacauuagcauuggcagauacagauacagagaguucuggacauuggcuagcuaauaccuucguguccggaacggcugcguuacaacuguuaagguggucagaacggggcuccaucacgcauugugucuguuugcuucuuucuaggguacggagaaagcacugcugaagcuucaggaguucuuuccugacaugcagauucuggcagucagugggaacuauugcaccgacaagaagccugcugccauaaauuggaucgaaggacgaggaaagacugugguuugugaagccgucauuccagccaagguggugagagaggugaguguggauggauguuucagccugccuuuuacaugguagugucuuuagcugaguugaggccaggguggaggcccacagcuguaaucccggcucugggagucaggcaggagcagcccuggaagucugaagccaggguggguauaggucuaggccagccagggcugaaaguaaguuuuaaaaauaauaaaacauuaugagaaugcugcaaccuuuuauaagauuacauuuguagaguaguuuuccauucagaugguuguuuuauuauuguucgugccugugugcagguagucagcccuccugggacaguuuacauggggcuaccgguauuccccugcuuucuagagacagagcgguagaugugaguggcuuuuacuccguucucccggggacuguguaaaacguacauacucugaucuagguguuaaagacaacuacggaagcuaugguugacguaaacauuaacaagaaucuugugggcucggccauggcugggagcauaggcggcuacaacgcccacgcagcaaacauugucacugcuaucuacaucgcauguggccaggugagcuccgcuguucccacgguccucugcucugcuguucucuggaggagcuauacuguagcuuuccuuucuucuuuccaggaugcagcacagaauguggggaguucaaacuguauuacuuuaauggaagccaguggucccacaaaugaagacuuauauaucagcugcaccaugccaucgauagagauaggaaccguggguggugggaccaaccuucuaccucagcaagccugccugcagguaugauugucuggcacacaacuuggucucaggccacugacucccaguucuuuguuucuuacuaaaacaaaguugggaaagaggguuuacuucaacuuacacaucuagguagacauucauuacuaagggaaguuaaggcagggacuaagguggaggccauggaggagcacugcauauuggcugguucuagccucauguucagcucacauucuuugacugcccaggcccagggacuggguucuucaucaguuugcaaucaagaaacaucccgaggagauguccauaggccaaacugcuggagccagguuaucauugagauucccucuuccuacaagugucaaguugacaaccaaguuuaaccaucauacuaaugugucccguauagcacagcacucuauucuguauuuuagcuguucuuucuacccuugcuuucagccagucuagccucaggaugucuaaauaaguguaggcuuucucaaaaauaaauaagaacaaaaagaaaguaugcguguguauacguguacacauacacacauauauaugguuugggcgauaugccuaguaaaucaugagcagauaaacuaagcaagcaagugcuuaguaccaucagcuggcuugccaccagcguuucuaauggaguuuagggcuccuucuccgugcaguaaucuuccaugcuggccugugauuacagaugcuagguguucaaggagcaugcaaagacaauccuggagaaaacgcacggcagcuugcccgaauuguauguggcacugugauggcuggugagcuguccuugauggcagccuuggcagcaggacaucuugucagaagucacaugguucacaacagguaagacuuccacauagaugagauuuucccaaaugaaaguuuuauaauccuggucugggaauuaccacuaaaauguuuggacaacuucaguccaagcccuggaauccagauuuaaagaaaacaaaacaaaacaaaacaaaacagguguagugucaugaucuuuaaaguccaagcucugggcagauagagacaggcagggccugggggcuuacugaccaggcagccuagccuacuuggcaaguuccaggcuacugagagagacccgaguguguggccuuguggucuucugacaucuacacauucacaugcaccccaacuccccaguuuugcauugcugauauucuuuguguuacuacuuugucuuuuucugacguagaucaaagauaaauuuacaagaucuucaaggaacgugcaccaagaaggcagcuugaggauccugacacugaacugaagcgcgggcauuggguucucaaggacuaacaugcaaucugugaauuaaaaaucucaaugcacugucuaguggaagaugaauggacaugaucagugacaccccugcuugguuucuggcgcuuucagagacgucugagguucuuugcacagagacuccucagaugugggaacucugguucuuuccgugcuguguucuggagagaucucacguggaugguaccggugcucugagcaccacagaugugagcuacaguucguuucugaaagcuaccacaagcuggaaacuggugaucaguguggggcucaccucuccguggguuaaaaaugguuuuaaaugacacuguagcugacagaacuucugaucuuuauuuauucagucuggguuguagaacuuugcaaucuaaguuuauuuuuuguaaacuaauaauucauuuggugcuggucuauugauugggggccuacuucuucauggaagaauuacuuuuauucucaaacuacagaauaaugugcuaaguagugcuaaauaguucuugacgaagaaaacagucacugcauuuaucucugugagucuuuguucagagaggccuuuagucuagauucugccagcugugccacacucugcacuaaagauaucagagcucuuaguguuacuuagaggagaguacaagcaagucggaccucucagaacuuagagugugggaacaguuuuuuuuuuuuuuuuaaaaaaaacaaaaaacaaacgaccauuucucuaagccaaguuucuuuuagagacauuuuaacuuauuuagcugaacucuagauuuuuugguaaacuaucaaucuguauauguuguaauuaagugucuaaugcuaggaguuuauuggaaguguuuaagaaauaaaagaacucaacuuuuacacugauaaaauacucuagcuugggccagagaagacagugcucguuagcacugguccaggaaacccuggcuugcuuuccaagcccaaugaagggaaagucagcuuacagagccaaugauggagccacaugaauggcccuggagcugugugccuuguuccuguggccaggaguuuggugacugaaucauuuaugggcuccuuuaaugggcccauaaaagcucuuagcuuccucagggggucagcagaguuguugaaucuuaauuuuuuuuuuuuaauguaccaguuuuguauaaauaauaauaaagagcuccuuauuuuguauucuaucuaaugcuucaaguuuggucuugggaagcugacauuuguguagaagauggacucugaaagacauuccaagagugccgcggcagcaugggagccucuuagugauugugucaguauuauuguggaagauugccuuugcuguuguauguaaaguuucaaauugcuccucuugugacuuuucagccaguaccauuuuauuuaccugagcuugucauggaaguggcaguaaaaaguauugaguguuuuaugcuggugacuguaaccaaugucaucuugcuaaauucauguuuuguacaauuacuaaauuguauacauuuuguuauagaauacuuuuuccaguugaguaaauuaugaaaggaaguuaacauugaaaaguguaagcaguggcuuuuuuaaaauugaggauuaaccccaagccugagguccagaaguuagcaaagucuggccaagugguagccugaccucuccacugagggucauaagguccucccuccauuauccguuauacuaucagcaacaucagcagcuggccaguguuguuugucucagugaucuuucuuacacuaaggguuuuaaaauucagauccauaaucucaaccagauucucuuuggugaucagauggggcaaguuaagaggaagggaagaucagcuagcugacacaauggccccuucaaguauguuucagcuucgugggguagggaaggggcuuccucagaacugacuuccauuccuuuguaauuucuccacuuuugcuguuagaggugaaagauuggagaguugucuucucaggagucacagggaaugcucguggagagaccaaaggcuggcaaaucaagucagaacuaacccuggagugauaaacagcucuuuggcacacauuuacauuaguaugacucuccuuaggccucugacacacugucaguguuuguacucacaugcugucuuaauuaugguuucuauugccguggugagacacuaugaccaaaaaguaacuugguaaggaaaggguucauucucuggcuuuuaacucuuuggucacaguccaucaucaaaggaagucaaggcaagagccuggagcuagggacugaagcaaagaccguggagaacugcugcuuacugccuugcucagcauguuuguuuuuaaacuuauuuaugaauaugagugcuguuugcauauaugccugcauggcagaagaggacauuacggaugcuugugaaccaccauguggaauugaauucaggaccucuggaagugcucuuaaccacagagccaucucuccagccccaucagccuguuuucuagcaccaaggaccacuagccagggguggcaccauccacagugagcugagccuucucaaauccaucacuaagaaaaugugcuacauuuaaguugggcuugguggugcaugccuuuagucccagcacuuggggaacaaaguagaucuaugauuucaagaccagucugguagcaaguccaaggaaaguuggggcuaucucca

SEQ ID NO: 7177 - RNA, 13393 nt, Mus musculus
cucaaauagauaaaguauguuuuauucuguagaaguccagcaugcuggggucccccauuaccaagauagagagacaaccaagugagcuugcaggccagauuuagagcacaugaagggaauuccagggcgggugaccuuuaucuuccucuaucucuagggacauuccagaaccauuacuggggcguggggcuggaaacuuguugcugacccauuguugauguguuagaacagcggcuugugucuaaauauagcacaccaggccaaagcaguuccaccugucagagguuuauuaggagagagaggggcaacgugguggcagaaagagaaggggggaagagaaagagagagaugggagggguuauauaugggugaugacauaucacagguaaaggugggagguaagccaaguagauucuggaauauggugauuguuaccuuggcaacaggacugcaggucccacccaugugaugucacggguuuuggagguccugauaccaacauaacucccuucuuguuauuauaaagagaaguggggggaaagggagggggaagcugauggugaaaagagaaugagggcauccugucucuuaagcugccuccugcugucuuggggcgucgucaguuuugggguguagcugacuuucaccaucaggauccacuugguaaacauuagcaucagguuccucuguggacagcuggucuucuguggacaguggcugguaauccugcaacaggagcugauuaauaauuuuguuagaauuuuuuuauauuugucguuuaaggaauguagaaacaagauuaaugaggcagggagcaaaugauaacgccuggaagaugacuuggaaaggugucaugaaagggagaauccacuuccauauaggauuuuugaaaaucccagaacuggaggucucacggucucugaaguucuugaugucugcuuuagcuccuggauuuuauuucucacuaccccggauugguugacauagaaacaacaugcugguuggaggaacaggcaaagaccaccuucuuuagcugucaggacaucuagccccuaucaguuuugaagcaccaugccugccaaagaauugaucuauuucuggauaguaagcacgguuucagacauuucuugaaacuugcuuuuaaacuggaaaguaaauuaucauauugggucauagaagucauuaucccugcaauucgaguaccagcaccuauggcuauucccauagcaaccaagagagguacaaccugaacuucccucuuauuuuggacaguuaucauaucuacaacugggauuggcaggggcucaucccuggauuacucccaguucagggaaaaggaguaccaacgugcagacuccugaccagcugguguguaagugaugauauaugugagugccacaaagaauugguguucuggacugcagggcauuguggcagagaugauauaucgaggguuaugguucuauugcagucuagggaacuuaguguuccuacagaacgugucccagaggucuuaaaagaguuugccacaccaaagagagggauagagguaagguauggagucauggcaccaucagagucaggacaguugacaaagggugaguuaagguuacuuggcaguaucaccagagacacuguaagugacaauugugaguuaguuccagggguacaccagcaaucuuuaaaguguccaggccuggugacauuaaggaguugguaugcugaggucaaggucuucagcaaaaggcaaaaugagggcuggugaaauggcucaguggguaagagcaccugacugcucuuccgaagguccugaguucaaaucccagcaaccacaugguggcucacaaccauccauaacgagauccgacucccucuucuggagugucugaagacagcuacgguguacuuacauauaauaaauaaauaaauaaauaaauaaauaaauaaauaaauaaauaaaucuuaaaaaaaaaaaagggcagaaugacaaguuagugccauuuaugaggggugaccucaaagagguaaggacucagaggaguguuugauuaucuccccuacuuuuccgauaucuagggguuacgcaauugagacauauugucucuggauguggaugguacuuacugaggaccccagcugauuuuuaugguagagcuuaccaacaacuccugucucccaccuggagucccaugggucuaguauauaggauaaggaugucuugcaguguugauaaaagaaaugauugguccguaauccuaaaauauguaucugacaagaccagugugggcagcccccauauucaucuggccauuuucuacaauaaucuuuuguuuggucaaagagaaaggaacuauagagaucauaauauuuagaugggauaacagauacagggaugauagcaauuugcaucaguucuuggcaucuggcuauggagcaguuuccugacccuauuuggaaagacuauuuguuaucuguggggguuucuuggacccacaucuccagauguaagggcuacccuagauggaaaugaacagcagggggaggacacgaaacccacgucuaauccaaugaggucgagcacagcugccagaguggagucucauuuucuaggauuggagacaaggugggcggucucaacgucuucuggagcuuaacaaagcacgguccuguuagggucgauguguaugaagaagagucauuuuuaggaggaggaaugaaaggucugagaugagacagauggacccaaugagagagucccucgaguuuagcagcuguaggggucacgaggauuaccuuaaaagggcccugccauuuaggagagaggggugaaggccaacaaucuggaggggauuagaaggacuuggccuccaguauugacaggcaguggacagaagacaguguguggcugcaguagaggugguuagcaaaguuccauaggagagaauggagguggcaaaguaauaugguaaguagauggucugggaggagagagcacuuaggugaaagaccaggaguuaggacuggauguccauagaugaguccaaagggugaggugagaagaggucacuuggggagagcuuguagccugaaaagagccaggcguaggaguuuuacccaaucaaggugaaguuccugugacagcuuagcaagagugguuuuuaaagagugguuaguucuuucuaccuuaccugaagauugagaguaguagggaauguuaaaaugccaggggaugucuagggccuuaaauaggauuugagaaacuugggaaguaaauucggaaccauugucugauuggagagaggcugacaccaaaccagugaugaucuccucugaugaucucucagaggaagagcucagagacugucugagcccuuguguuaguugugggaaacgccuccacccaccgugagaagguguccaccaagacaaggagguacuuggcaagucugacagugggcauguagguaaauucaaguugccagucaguuccaggaagggaaccucuagccugauggguaggaaaaggggugcuacgauaucuggaguuggagucagacaucugacagauuuuacaagaagcagugauagauuucaagaaauguuaaguccucagaaguaggcuguagguaggucuuaacaaaauaagacaaugcugggcuguuaggaugaaagaguuggugaagguagggcagaguuuggugggugucagggggugaagguggagauguggguuguaguguaagaauguccuggggaggaugagacaagucuaggccccuaagggccgaagcucuagcugccucaucggcucgguuguuucccuuggagacaaauagagucauccgucuggugggaucugcaguggacaaucccaauagcuguggggagaugggaggccuuuagcauggccauaauuuggcuugcauuagugacugauccuccuuuugugguaaguaacccgcacuccuuccagagagcaacgugggacaggaggguauggaaagcauauuugggaucucuguagauauugagggauuuucccugugccaguugaaaggcuauuaguucagccuguugauuggugguaugagcaggaagggccugugccuccaccaccucggugucucugacacuauguauggcauagccagcucuucuggccccuucauguaaaaaggagcugccauuuguauaccaguuauagaugaccugaggcauugugcccuccuguaugugugagggaugagguaauaguuccuauaagguuucagugcaggaguaagauaggaaaugguuaguauuuggucgaggaagaagauuguaaauauuaagaggcaggcaugauuggaaagugaguguggagucuucuauuagagcuaccugaagagaaagaacccuggagggagguagagucuguaagccuuuauauguuaggagcugugacagguuaugagaagacaguuauaggcaacccaaagguuaguuuuuuuguuuuuguuuuuguuuuguuuuguuuguuuguuuuguuuuuuguuuuugacucuugaauauggaguucagcggcugcuaagguauggauacaaggcgcccaucccuggaugguuagaucuaguuuuuucaaaaaguaugcuacgggugcaaaagagggucccaguugaugaccuaaggcuccaaaggcaaaucccucuuuuucaguuauguagagggaaaaaggaugagucaggucagggggauguaaggcuggggccuuaaggggagccuguuggagccuuugaaagggcuugguaaaagguuugagaagagguuccugggugaggccugacgcugcuucauauaagggacaagaaaggagggaaaaggaaggaacccaggaacauaaaaaacuagcuauuccuaggaaugacaaaaucucuuccuuuguagaaggaacaguuagagaccgaaucagauucuuucuaagguaauagccuuguggguuuggaguaauuguuagccccaaauaggugaccugagggguggagaguuggacuuuagaaggugagacccuguagccucgacuggagaggaaauuuagaagagcagagguaucagcuuggcuaauuucuagagaggggcuacagagaaggacgucaucuacguaaaguauaaucuuagauuuagggggagauagagauaggaagucagaagccagggccugaccagauaggugugggcugucccggaaucccugagguagaacaacaguccggguaaguuggguagaaaaaauggauaucaggaucuguccagguaaagacaaauauguucuguggcugggcaucuagagggcuagagaagaaugcauccuugagaucuaggacugagaaaugggaaguccccaaggggauaguggaaagaaguguguaaggguucgccacaacaggauggagaggaaccacugcaaaauuaaugcaccugaggucuugaaccaggcgauagguagcauuagguuucuuaacugcuaguauagggguguuaaagggggaagagguggggcgaaggaguuuuuuuccucaagaggucagaaaugauaggcuuaaguccccugaggcucuagagagagagagggcauugagcuugggugauguaccugguagagucuaguaauuggauggcaacaggagaaugguguuuagcaacagagggguucuggacgucccagacuugggggucuaccugagaagcugguaaaggaaauaacaugguacuguuaguagguuggcuggcuaaagaaggagcagaggaacugcuggcgagcuuggguuuaggugaauggggggagcaaaguaaauagcagcucuccgccuagccagaagaucccuucccaauaaggcaacaggacauguuggcacuaucaaagagaaaugggugaaagguacaccccuaaaaaugcaacuaagugguagggucuaguaagggaaguaaggcugucccccuacccugacaauaggaaagugaggagaagugggcucccaaaacucugucaggaccgaguaaguggcuccaguauccaaggggaaagagaugggccacccacauaccaugauaucuacccggggcucccuguagugauggcaguggucgggucaggagagcucaggccuccucaucagccaucgccaagccuaggagaucagcuuggggguuaugugagagugaugucccucuguucugcauaacaugagggcaauugacagcccaaugucccucuuaauggcaccaagggcauggccuccuuggcuuguggaaguuagggcagauuuuugcccagugaucuuguugaccacauuuguagcagguaccugguggucucugagucuuagaagaccaggaguccggggcaguggcuggggcugguuuugccagccuaugguauuuuuguuugugggcauucuuaucucucucaugguacaccuugaaggccagugcuaaaacuucuuccuguggaguuagggguccccucuccagcuuuuuaaguuuaguuuuuaugucgggguagcucugggaaaagaaguaggucaucagaaguugcuuaccuuuggguuuccaggguccagauugguuuacuguaauuaacacuuugugaggcguucuaaaauuugagauggauuuuccugcuuguccuggacaaccucuuggaguuuuucaaaauuuacuggcuuuaaggcugccuuucuuuuuuuuggggggggggugaggggcguggguugucgagacaggguuucucuguguagcccuggcuguccuggaacucacucuguagaccuggcuggccuugaacucagaaauccuccggccucugccucccaagugcugggacuaaaggcgugcgccaccacugcccagcuaaggcugccuuucuuaggccugccaauaggcaugauauaaaccugucucggcuaaaacaccaccugcggaauuauaauuccaucaaggauccuggucaagcacuguuucugaucugauuggauaugcucuaucuguuugaugaauuucgucugcaugcauuuucgcuugcucccauacucgccugcauuccucaggaaguaaguuauuaguaaguaucauauguacaucguggaaagucaagcuguaagacugaguaauguauugaaacucuuuaaaaaagguggaguaguuagagguauaagaacccagucuacuuucuauuugagaaaguucacucacugagaaaggaacauguacucugacaaggccaucuaacccagcaacuucucucagaggaaggacugaugcugggucaggagucccugggggagaaggacuuggguuuggcuauguccuuagagcaugugaaggaaggggugaaggcaggugccaauguagggcguuuagagcgaccugcagcuggcacagaagagagggaggggucuggagagguagagcuagcaggcucugggguauccuggugagaaggagaaacugaggcaacaguuuggguuuuaagugguguggaaacaggucugcggcagaaagggggugguuuguuagcgggaucuagcauugucuggcggagguuguguggguuucauggcuaagagaaaucaaggaaagcacauggagggauuggaguguagacagaggaaugcuuggacauggggaaccucuuuccauuuaccaguucgcuggcagcauguauuaagaucccuuaaaauaauuggaucuaggguugcauuaaguggucauuuggaacucuugucuagcugguacugaauccagaccuuauugcagagguauauuaauuuugaugucuucaagucacauguuaacuucaaauauuugagauuuuccaggagacaucacaguggaguaccugaagguauauucgaagacaucaaagcacccauuggggguuuguuggauuauucauucucgagaacaauucaacaaccaaaaagaaaucagccaggcuacacaguaaguccaggacuuacuagaaaggacucugcccugggcccagaguuuucuuagaaggcugcaagagcccugagggggaggggaacgagagccacuuuggagggauauggucacccaaaggguugauguccuaacuccuaugucagcugggagacguggcuacaaaaugccaacagaaaaagcuggccaggcucuaucuugggaauuaggggcccuccugcugaccgaccuuaacaaucaauaugucggugucugugugggaauucuagcaaacugguaaauggaaacguguaacuugagugguugguguggacccggcagaagcuagucccacagggugggccaggguggcauagcucacgugguagaagucugugagucucauagcagucguggccgcagcagccauggccugcagcagcacugacaauccacguggugaaugauggcaggugucagcggauggaguccacgcaguauagcaguggcuacaggcaguguuggccguccaugugacauugguucuccgggucagugguggcuucacugucacacugggugccgcuugagcuccacagcuguccugcauaaucaccaaaugauguauuagaauagcagcucucggcuaaucauagcacaccaggucaaagcaguuccaccuguaagagguuuauugggagagagaggggcaagguggugaagaaaagagaagggaggagcgagauaagggaggccuuuucuauguauggguggugagacacaacucagguaaaagugggaggugagccaaauggauucugggaauaugguggcuguugccuuggcaacaggucugcuggucccuccuaugugaugucacaggcuucagagguacugauaccaauguuucuucuuccaguaccugcaagcuucuuucagaauuccaagguccuguaguauucacaggcaauaauacaaaagcuguuugauagcccaccauaacagacaugccagauuacaacacauuaacacaacuggaaaucaauacaacuuaaauacaacauuaaauacuuauggaagaaaaaguaauuuuaacaugaucaaucaauaacagauuuggagucuuaacacauacacuaacauuuguuugaaauccagauccugucccaauuuuaucuacugcuaacauaucaucauagagaacuacagcugacuuucaaaugucucuaaaaauguccagaaacagccuuccaaaugaagacuguuauuuccaauauuggauuaauuucuagaccaguccaugauugagucagaauaacuggucacauuaaaggaaagaaaagagucauuauaggcugggcgugguggcgcaugccuuuaaucccagcacucgggaggcagaggcaggcggauuucugaguucgaggccagccuggucuacagagugaguuccaggacagccagggcuacacagagaaacccugucucgaaaaaccaaaaaaaaaaaaaaaaaaagagagagagagucauuauaacucuuauuaaguuuuuaaaggugguuuccagucuccauguucucguucucuauccuacaaagucuaaaagcuugaggcaaagcaacuuguacaaucugggauauaggcaagcaaaaguggaucaggaacauaugcucaaaacagcuucccagucaccauugucaggguagucugaaagcucacgggucagcaucauucuaugucccagcaugagcaugucucaccaaucacucuugaagcuagcaugcuccuucagcauccugaagaaaaaaacacaagcaugcccucuuucccuguauuaaauaucugaucaggaacaugccaugugccaguauguggauccuucuauuucaccuaggcaugaguaugccugguuguagggugccauagacacugagagaauuaccuuggcauccaaauuuuuuuuuaaauuuuaaauaaaaaggacaugauuuaaauaaauuugugguacaaggggauauaacgcccccuuuuuuauuuuaugaggcuauuguuuuaaaguucuauaauaccuguuucucaguacuuuguccuugagaauuauaaggaaugacaauacuauggguaauguuaaaugguugacaaaacaucucugugcuuacuuuaauagucaguuccauuaucuaguuuaaucugauuuggaacaccacgcauagaaaaacaaugacuaauuacguuuuuuaguugcuuuuccuguuaaagcaguugcaacuagaaagccugaaaaggugucaaauagucacauguauauauuuugauuuuccaaaaucagaaauaugaguaacauucauuugccauaacugauuagguauaaauccucgacgauuaacaccauuaagugguacagguagaaauugaggacauucaggacaaguuuuuacaauuuaaccugcgcauugucuagaaauaccaaauuguugucucaaucuauuacuauuuugaugaucuaaagaaucaguuuggagccggguguggcggcacaagccuuuaauccagcacuugggaggcagaggcagguggauuucugaguuugaggccagccuggucuacagagugaguuccaggacagccaggacuacagcgaaacucugucuugaaaaacaaaacaacaaaaaacaaaaacaacuacuccaaaaauuuuaaagcucauuguauaagagcaaaggccugcaauaaaauuccauacacugaggaauucaaaguucuaacuuaguguaucaaagcagaaacaagauaauuuuuuuuucacauaauguaaggcuauuagcuguuccuagaggcaaaacuuuccaacgauaucacuucauugguucuuuaaaauuaguuaaaaauuaaauuuaaaauuaauuaaaauuaguuuaaagcaaaacuuuaaaauuagcucacuagaagcaaacccuuuacaauuauuaggaugcaaaggacuaauaaaaacaaucuuccaaauccauaauaauucuauauggaauaggcaggccagauuuuaaugccucuauaaguuccauagccucauuaaccuuccacaaaucuuuauuuugaacuuugaacuuuauuuugaacaauaccuggauagaucuguuaaaaaugcucuuccugccugaaacuuucuaggcaguguuugcaagacaaaggcagugccuuccaaaauugaggcugcucugagcuuugcauuaacuaaaauguaaauauuucuuaaucugaguuuacugccugaggccaggucuaaagauuaccccuccugcagugaggacagauuacaggggagugauucuacugucugucuauaucuuuaauuuuuuggacaaucuuucauaaaaugauguaugccccauacuuaaaacauuccgggggcuggagagauggcucagugguuaagagcaccgacugcucuuccaaagguccugaguucaaaucccagcaaccacaugguggcucacaaccauccauaacaaaauauaacucccucuuccggagugucugaagacagcuacaguguacucacauauaauaaguaaauaaaucuuaaaaaaaaaaaaguuccugccgggcgugguggcgcaugccuuugaucccaguacuugggaggcagaggcaggcagauuucugaguucaaggccagucuggucuucaaagugaguuccaggacagccagggguguacagagaaacccugucucaaaaaaacaaaacaaaacaaacaaacaaacuaacuaaaacaaaaacaaaacaacaauaacaacaaaaauuccuuaucaccucagcacugugaaagcauugcuuacuuguacuguaguucccugcagccauaaccagcccugauuguaugaggguccaauuuuugcacaaagaggaauguaagucugucuuugcuuugcuggauggccacauggcagacuaauuuagcauucucauaagacaaucauguaacaaaaagaaccccugcuugaggaucucuaaaaauucgauuagcugcuuuuuuuuuuuuaaagcaugacccuagccaauucugagacugaaggcaaauuaauuuucccaaucugcuuuuauaucaucuuaauugcaugcaaguguuaagggcgagcaguacaauaaggaacuaacaaggcaguaagcaaagucccuugauuacuccugugacagauguuuccaagggcuugucauaauggccaaaauaccugagcccacuuccuuguccaagcccaaaaucuugccugaagccuacuucuuuuguugcacccugagacuaaaauuucugccuuacccuacuucccuauuacagccugaaguuagauucuugccaaaacuuacuuccuuaucaugcccugaugucagauuccugucugagcuuacaucccagucauggccaaugucagauuccugccuggagcucauuuccuugucauggccaaugucagauuccugccaaguggcaccccaaaaggcucuccauaacucccuccuuuuaaaucaacaaacaaggcugugcugugauugaacugccaacugcagccaauggaacacuggcaguuuaacuguaauuuuuaaguuucucuuguaacaccggaguacaaccacaguuuugagaagcaaagcccaauuuuaaaaguguaaacaaucgauucucuuuaaaaugaacaucaaaaguauuacuuucacauuacaaaguuaaguguuucccugcuuuugaacugcaguuagcaagccugggucauucuaagacagcagcccagagcaugccagaacuuuggaaaucaaaacucaaucucccaaacaauccagucucuccaaaaacaccaagugaaucaccuccaugcuacaaaguuuggcugcccauuccugcacacaaacacaagaugaugcagccuucaaaaccucaaagagacacugcccuaaauccuaucuuuuauaagucugguuucuaggaaaagaauuacauaaauuuagacauaucuuuguuuguuuguuuguuuguuuguuuguuuguuuuucaagacaggauuucucuguauagcccuggcuguccuggcacucacaaaguagaccaggcuggccucaaacucagaaauccaccugccucugccucccgagugcugggauuaaaggcaugcgccaccugcccggcgaguuaccaguuuuaagccaacuuucuguuaccaauguuacaaauuuuuaaucauacccaauaacuuaugagccaauaaucuauaaccaagacauguacaacauauuauacuuuuaaaaccagucagaaacaaaaaugaaauggcugcauacauuuacuuauuuaaaccagacaaaauucuuaauuuuucuagcuguaauuucaugaggggagcaccuugucaccugcugaauccaauaaucacagucacagagauuuuu

SEQ ID NO: 7178 - RNA, 1132 nt, Mus musculus
ucuuuuuuuuuuuuuuuuuuuuuuuuuagacuuaaacauuauuuuuauuguuuauuuagcccuucacagcucaccccacacagagaaaaagguuauuuguagugggucacucauuuuguagcuuauguggggauaugguucaagcagaacugaugucggcugcugguacugcagagcaaaggggaaucuaggcacacccauaaagguggcuacacccagauggguugauuggcaggcuggaagacaaaacucccaauaaaggcacuuuuacagggauguagcucaguggagaauacuugccuaguaugcacacggcucuagguucaaucucuuguaccauaagcacuuucaauggggucagagaauuggcuggaguguuguggaaaccggagaaggaauuguuuuagagacaggaucucacuguguagcccuggccucaaacucacagggauccaccugccucugccuccugagagcuuggaggaaaggcgagcaccaccaccgcccgacaggaggaaaguuuuugauggaggagcuauugacagguagcagagacagcugaaagacgaucaugggccaucaguggggucagugggggcugcuguaugucuuugcugcuuuagagggaaggugauguaugcaucguagccaaagagcaacguagcaaguaagcccaguaucccagcgacaacucuggagcugccucuuccuucuacaaggacaacaauggaggugaucagguacaggaugguugcuaugagggaucugaagaagucaguccaaggccaguugaugaaugauaucuuggagugcaggucacacguguagaagacaaguaagacagcagcacagaucaucucaaucaccgacagggaggaguaggccgauguuguagaugcacugaagcaaaucaaaaucaccaggcacaguauaaucucagcaaacaggagaauucccuuuuuggugcgcgagaagcuggugcaagcuaaccagcagccgggggccgagagacgcucagaauccgccaugguggugugcuggagucccugggacgcagaagcucugcuuucuggcucacggguucgaggucgcugcacacccagccgucugucccgccgucuggccgggaagc

SEQ ID NO: 7179 - RNA, 1132 nt, Mus musculus
gcuucccggccagacggcgggacagacggcugggugugcagcgaccucgaacccgugagccagaaagcagagcuucugcgucccagggacuccagcacaccaccauggcggauucugagcgucucucggcccccggcugcugguuagcuugcaccagcuucucgcgcaccaaaaagggaauucuccuguuugcugagauuauacugugccuggugauuuugauuugcuucagugcaucuacaacaucggccuacuccucccugucggugauugagaugaucugugcugcugucuuacuugucuucuacacgugugaccugcacuccaagauaucauucaucaacuggccuuggacugacuucuucagaucccucauagcaaccauccuguaccugaucaccuccauuguuguccuuguagaaggaagaggcagcuccagaguugucgcugggauacugggcuuacuugcuacguugcucuuuggcuacgaugcauacaucaccuucccucuaaagcagcaaagacauacagcagcccccacugaccccacugauggcccaugaucgucuuucagcugucucugcuaccugucaauagcuccuccaucaaaaacuuuccuccugucgggcggugguggugcucgccuuuccuccaagcucucaggaggcagaggcagguggaucccugugaguuugaggccagggcuacacagugagauccugucucuaaaacaauuccuucuccgguuuccacaacacuccagccaauucucugaccccauugaaagugcuuaugguacaagagauugaaccuagagccgugugcauacuaggcaaguauucuccacugagcuacaucccuguaaaagugccuuuauugggaguuuugucuuccagccugccaaucaacccaucuggguguagccaccuuuaugggugugccuagauuccccuuugcucugcaguaccagcagccgacaucaguucugcuugaaccauauccccacauaagcuacaaaaugagugacccacuacaaauaaccuuuuucucuguguggggugagcugugaagggcuaaauaaacaauaaaaauaauguuuaagucuaaaaaaaaaaaaaaaaaaaaaaaaaga

SEQ ID NO: 7180 - RNA, 404 nt, Mus musculus
uagagggcggaaggugcuuauggagcuuuuguaagcugggagauccgcggguuccuucugcggguaugagggugucugagguggugggaugugguaccguguugccgguuccucucuuacuccccggcggacacuagcagaaccagccaggcgcccugugcgugccgcggucuugcuggucugccacugcugaccucguagcugcuacugacagcggguuccagacgagcacuccccggccuccgggccccgucugccgggucacggacguguugcuucauccauuauggagggcgacugauuuguuagucuguuucugucucuccuguugcuagcggaugcacaauugguugagauauguuauauggaaaauaaaacuacuggccaggccaggaaagcaaaag

SEQ ID NO: 7181 - RNA, 4224 nt, Mus musculus
accucaaggugagcaaagucucuggguucagucccuaguacuuacaaagaaaauagaacccccuauccagaaacaaaacaaaacaaaacacggaaagcuguuuuucuguauuucagaaaauacuuuacuaguuuugggggagggagaaacauuaaauauugcugaaggaauauaggaaauuuaaauuuggaaauuggcagaggaacaagguuuauaguuuuuauuaucagcuuuuuauacucucuagaugucauacaauuugaguguuaccuuuuccccaagguugguacuuuuaaagacuuaguuuugaggggucucagauacaagcaaucucagcaagggcagacagucuccuggggcagccuguuccuggcaucuuucuuuggcuuccuucauuauccuggcaaacguugagccucgagugcaggcccuccuuauucuucacgcauuuccauguguuuguccgcagacacccucgauagggugcuuggagacaagcggcacuuggugagugcggagcuggaaguccggccagcagaagagcccugugcuguggccaagaucgaguaugcugacugugugggugaagaccugcugcaggccucucgggaggccauugaaagugccguccacagugcaugccuccaggguaagggacacacaccugucuccuggugacuguuucuuuuuuucucucaugcuggaguuugagccaggaucuugggcguacuagcgugcacugugcacucugccuugauguuacacucagccuccgaguugguccgugugcuacagacacgccaguguucucugugcuuggacuucacaugaauucuugcugcauugcuccuuguuacuggacuguguguacuguugugcuuuauucuccccacccaggaccucugcucggauccccaguccaggauguggcaaugacguugcacucacugaugauucacccuggcaccuccacaacuauggucacugccugcaucucacgguguaugcagaagguacggagcacccuucaugcucugcauuaaggaugggcacugaggccagcaccgcagauuccacagaccuuaugucaccauggggccacccagaucuaguaccaguggguaaagguacuuagcaccaaaagccugcuucugaguuuaaugcucaggaacugcauaguggcuucagaacguuguccuaugaccucuacaugagcacauaccacacacacaaaugggauuuaaaacuuuuaaacuagcucuuguaugggaaaucuuugauuucuaaaacuaaauuuucauuugaaagauuuuagaaauuacuggucagaaagguuaaacaaaacauucugauuuuaccaaaagaucuuuccaaacaaaaccugggccugugaagagugcaccuuguuuagacauuccuuuuuuuacuuuugagauguuacaguuagcuacaagccuggcuggggagaggggaauauauauauauauauuaauuagauagauaauccaucuuuccagccccaaagccugguggauuuaacuggacagaucugaggucagcuugacauugggcuuuaauguaaaggacaauggaaaucuaaugugaauuucaacuucuuuuuaaagauuauuuuauguaugugagugcucuaucuuuguguacaccugcaugccagaagagggcaucaaaucccauuacagaugguugugagccaccaugugguugcuaguaauugaacucaagaccagacaguauucuuaacugcugaaccaucucucaaaccuuuaauuucaaauauuugaauuuguccaaauaagauuguuuucauuaaaaaacaaaaacaaaucagucccauugaacaacagauuuaggccaagcaucuuccaugcaugugaucaccugaguuguccugagugucauggccuucugccuccugccucaguggcccaccagaucugaucaacccccaugcgguuucccagugugggaguaccuuagccuagcacuggagaguaaagucacaggucacacugaagcuuucaagcacuaaguaagguuugaacuguguucugggaacaauggagaauaaauguuuugaucagugaaguauauauagucagaacacagaagugauuggcauuuggcacgggaaagacagucuaggacagacaggaacuagacgaugucugaaucaagaugccagcaacaggaauagaaauacugguguuugcuggaaaaaggaaaucagagaaguacauuuaagcaaacugagaucuacuaaugccaucagcaaauaagaaaggccagagacgugcuuggaaaagaaacugcugagcuaggcuuggggcccagugggggacaagacugaguccuccgagaugggcugcagcuacugcugguguggaagcucugcagugagguacuguucagaagucugaaaaggauagagggcagcucugggaggccagucccucccuaaaggaagcauuuuucucuuauauuuacccuuucccacaugauuguuuuaucuugaaaacauggucagguucccucuguggccgaugaagucuaagauuauaaacuguaaauacagaaaguauuuguagacaguugucuugacucuugccuuuguuguuggcuuuuugaggugcucuccugugcuguucuuuccagcauguggccacuguacaaguucuaacuucuuggcuccuuauacagugagcuccccagagcccucugcucaggaauauaggaauuagccuuccucugucuuccguguacuggaauagaaauuuguucaguuuaugaaaucucuucaggcccugaagaaagcugacaaacaggugcuggaaccucugaugagucucgaggucacagugagcagggaguaccucagcccuguccuggcagacuuggcacaaagaagagggaacauucaggaaauccagacucgccaagacaacagaguuguucuaggauucguuccucuagcagagauuauggugaguuugcauuugacauguacacguuguuuacucuaggagaugaccccgacagugcgagugacacugugggcauugggcuuggguuuagagaaugcaugccaagguuucagccaccaugaaacuuugccuucagugguggcugagaacuugggaacacguuacuuccaaucacagagccacaaagauuaaggcacagugucucaaauguggucaggcuguuaacugucuaaccccugcuuccauguauuuucuuauaaauuuuggggccagcauccuucucuuccccacccaggcacuucugccccucggauagacaugaggguacugacugacaaaggggaaggacagagucacuuaccucagaaugcaugcacagcucaccuaugcgaaguuuuugccauaguauuucccuuuucuuucuuuuugaaaaccucucccuggaggcggugggacucaccaccaccuucucuucuguggucuaagauaauccccaagauaaaaaauguaaggcguaaauuaagugcaguaacaaacugaacuuuuuuucauuagggauauucaacugugcuucgaacucugacaucuggcucagcuacuuuugccuuagaacugucuacuuaucaagccaugaguccucaagaccagagugcucuacucaaccagagaaguggcuuggcccaugugcuauaggcccuuggaaacggggaaagcugggccaguugccugcuuuauucccggcaagaaugcuguuuuauuaacuggcuaguaaauugcugcuuugguguggaaagaacuugacaagacccuuggagcugccauucuaauucuguuggguguacuuugcuauauugcaccacagcugggccccgguuaucucugccaucucuggugcugggauaaaauaaccuggccagggcagcuuaggaaaaaaaaaagguuucuuuucucagcaggaagcaaggcaaugagcucucaaaguccaccuagugaugaacuuccugaagccaagauacacugccuaagccuccccaaacagcaccacccccgggagcagaguccagaagccugggccugugaggagcggaccucguuuagacauuucuuguuuuacuuuugagauguuccaucccccuggagcuggaauuguggugugauuacggagauccagggccugagcucggguccucugcaagagugaucuuaaauaccucagccuucu

SEQ ID NO: 7182 - RNA, 4224 nt, Mus musculus
agaaggcugagguauuuaagaucacucuugcagaggacccgagcucaggcccuggaucuccguaaucacaccacaauuccagcuccagggggauggaacaucucaaaaguaaaacaagaaaugucuaaacgagguccgcuccucacaggcccaggcuucuggacucugcucccggggguggugcuguuuggggaggcuuaggcaguguaucuuggcuucaggaaguucaucacuagguggacuuugagagcucauugccuugcuuccugcugagaaaagaaaccuuuuuuuuuuccuaagcugcccuggccagguuauuuuaucccagcaccagagauggcagagauaaccggggcccagcuguggugcaauauagcaaaguacacccaacagaauuagaauggcagcuccaagggucuugucaaguucuuuccacaccaaagcagcaauuuacuagccaguuaauaaaacagcauucuugccgggaauaaagcaggcaacuggcccagcuuuccccguuuccaagggccuauagcacaugggccaagccacuucucugguugaguagagcacucuggucuugaggacucauggcuugauaaguagacaguucuaaggcaaaaguagcugagccagaugucagaguucgaagcacaguugaauaucccuaaugaaaaaaaguucaguuuguuacugcacuuaauuuacgccuuacauuuuuuaucuuggggauuaucuuagaccacagaagagaaggugguggugagucccaccgccuccagggagagguuuucaaaaagaaagaaaagggaaauacuauggcaaaaacuucgcauaggugagcugugcaugcauucugagguaagugacucuguccuuccccuuugucagucaguacccucaugucuauccgaggggcagaagugccuggguggggaagagaaggaugcuggccccaaaauuuauaagaaaauacauggaagcagggguuagacaguuaacagccugaccacauuugagacacugugccuuaaucuuuguggcucugugauuggaaguaacguguucccaaguucucagccaccacugaaggcaaaguuucaugguggcugaaaccuuggcaugcauucucuaaacccaagcccaaugcccacagugucacucgcacugucggggucaucuccuagaguaaacaacguguacaugucaaaugcaaacucaccauaaucucugcuagaggaacgaauccuagaacaacucuguugucuuggcgagucuggauuuccugaauguucccucuucuuugugccaagucugccaggacagggcugagguacucccugcucacugugaccucgagacucaucagagguuccagcaccuguuugucagcuuucuucagggccugaagagauuucauaaacugaacaaauuucuauuccaguacacggaagacagaggaaggcuaauuccuauauuccugagcagagggcucuggggagcucacuguauaaggagccaagaaguuagaacuuguacaguggccacaugcuggaaagaacagcacaggagagcaccucaaaaagccaacaacaaaggcaagagucaagacaacugucuacaaauacuuucuguauuuacaguuuauaaucuuagacuucaucggccacagagggaaccugaccauguuuucaagauaaaacaaucaugugggaaaggguaaauauaagagaaaaaugcuuccuuuagggagggacuggccucccagagcugcccucuauccuuuucagacuucugaacaguaccucacugcagagcuuccacaccagcaguagcugcagcccaucucggaggacucagucuugucccccacugggccccaagccuagcucagcaguuucuuuuccaagcacgucucuggccuuucuuauuugcugauggcauuaguagaucucaguuugcuuaaauguacuucucugauuuccuuuuuccagcaaacaccaguauuucuauuccuguugcuggcaucuugauucagacaucgucuaguuccugucuguccuagacugucuuucccgugccaaaugccaaucacuucuguguucugacuauauauacuucacugaucaaaacauuuauucuccauuguucccagaacacaguucaaaccuuacuuagugcuugaaagcuucagugugaccugugacuuuacucuccagugcuaggcuaagguacucccacacugggaaaccgcauggggguugaucagaucuggugggccacugaggcaggaggcagaaggccaugacacucaggacaacucaggugaucacaugcauggaagaugcuuggccuaaaucuguuguucaaugggacugauuuguuuuuguuuuuuaaugaaaacaaucuuauuuggacaaauucaaauauuugaaauuaaagguuugagagaugguucagcaguuaagaauacugucuggucuugaguucaauuacuagcaaccacaugguggcucacaaccaucuguaaugggauuugaugcccucuucuggcaugcagguguacacaaagauagagcacucacauacauaaaauaaucuuuaaaaagaaguugaaauucacauuagauuuccauuguccuuuacauuaaagcccaaugucaagcugaccucagaucuguccaguuaaauccaccaggcuuuggggcuggaaagauggauuaucuaucuaauuaauauauauauauauauuccccucuccccagccaggcuuguagcuaacuguaacaucucaaaaguaaaaaaaggaaugucuaaacaaggugcacucuucacaggcccagguuuuguuuggaaagaucuuuugguaaaaucagaauguuuuguuuaaccuuucugaccaguaauuucuaaaaucuuucaaaugaaaauuuaguuuuagaaaucaaagauuucccauacaagagcuaguuuaaaaguuuuaaaucccauuugugugugugguaugugcucauguagaggucauaggacaacguucugaagccacuaugcaguuccugagcauuaaacucagaagcaggcuuuuggugcuaaguaccuuuacccacugguacuagaucuggguggccccauggugacauaaggucuguggaaucugcggugcuggccucagugcccauccuuaaugcagagcaugaagggugcuccguaccuucugcauacaccgugagaugcaggcagugaccauaguuguggaggugccagggugaaucaucagugagugcaacgucauugccacauccuggacuggggauccgagcagagguccuggguggggagaauaaagcacaacaguacacacaguccaguaacaaggagcaaugcagcaagaauucaugugaaguccaagcacagagaacacuggcgugucuguagcacacggaccaacucggaggcugaguguaacaucaaggcagagugcacagugcacgcuaguacgcccaagauccuggcucaaacuccagcaugagagaaaaaaagaaacagucaccaggagacaggugugugucccuuacccuggaggcaugcacuguggacggcacuuucaauggccucccgagaggccugcagcaggucuucacccacacagucagcauacucgaucuuggccacagcacagggcucuucugcuggccggacuuccagcuccgcacucaccaagugccgcuugucuccaagcacccuaucgagggugucugcggacaaacacauggaaaugcgugaagaauaaggagggccugcacucgaggcucaacguuugccaggauaaugaaggaagccaaagaaagaugccaggaacaggcugccccaggagacugucugcccuugcugagauugcuuguaucugagaccccucaaaacuaagucuuuaaaaguaccaaccuuggggaaaagguaacacucaaauuguaugacaucuagagaguauaaaaagcugauaauaaaaacuauaaaccuuguuccucugccaauuuccaaauuuaaauuuccuauauuccuucagcaauauuuaauguuucucccucccccaaaacuaguaaaguauuuucugaaauacagaaaaacagcuuuccguguuuuguuuuguuuuguuucuggauaggggguucuauuuucuuuguaaguacuagggacugaacccagagacuuugcucaccuugaggu

SEQ ID NO: 7183 - RNA, 738 nt, Mus musculus
gaggagacgaggaggaggagaaagaggagaagaggaagaagaagaggagaagaggaggaggaagaagaggaggaagaagaagagaggaggagaaggaagaggagaagaggaggaagaagaggaaaaagaagaggaugaggaggaggaagagggggaggaagaagaggaggaagaagaggaagaagaagaggaugaggaggaggaagagggggaggaagaauaggaggaagaagaggaagaagaagaggaugaggaggaggaagagggggaggaagaagaggaggagagagaggagaggaggaggaagaagaggagguucugcagaacugguguucacugagagagaagaggaccagcugagcgggggacucccugaccuggcaugguauaucugugaaucucugaaaauagggucuguccuguagucaaauuggugcuuuguccauccugggagaaucgugagcagggagaggaagcagagaagcaggcaauguuagcucccguagguucucccaaggaacucugcaggcaagcaaguuaauccuuggagggaagacugcuugaaguagcauuuccugaacaagacagaaauguggcgccccuggaaacucucagcaguauggcugcaugaacaagaccaugacggucaacacgcccucauuggugggagaaggacuuacaaggcccaaccucuagucaaagagcuagagacaauccaggccuguugagagacaguca

SEQ ID NO: 7184 - RNA, 4601 nt, Mus musculus
cagauuauugugagacauuguuucuguucagccguuccacuccugggagcuaauaaucuacucggaggcagaaagccuucauaggaaacaggucacaaggcacggcauuacagaauuucaggaccgcagaaucugugcccuggagcagccaagcaguccuugacaguggcaucuccuuagacacacagcuggguucccagaaagccaucgucuggccucucucccuagacuggugaguuucucugugccuaagcuuucuucuuugcaaagcuagguuuacuuguacggauuuuacgcuugauaagagaauggucaggcagagggagacaaacuguagcuucaagaggacagagugccuccucacugaccagggaagauguggcugguuuauggaagaagaaucucaugggcggacaaaugcucgaagcucaccgacaggacccaccaccaagggauuagaaaggacugcacauggccccugacauaaagaggcuuauuugucuagaggaccucaucugucaaagugagcugggagaggccauccgagaaucacaguguuuugccagguguuaaggaagcacuagguccugauccuagguugcaguccuguuuguggggcuccccugcuuccggcgcuccccugcuuuggagauuucuuucuuucucguuucauccucuguaaggacaaagacaaagaccuggcuucaggguccugccacacacgagcugugcagccguuugugagauuucaaguuugcuugugcucagccuuuucauuuucauaaacgagaaaaauaagaccugcuuuuaaaugcuucuggccucaggucuaaauggaagccagcauagcaugccuaucauagcagagagugauuggucaauguccaccauguucacauaggugauuugacucugguauggcaucuggggcgaguggugacucuuaguagcuggucuugaaauucauuucaggauagguacuguccacuuuguucaagaguugggguagcacugaucucugagaagcugaaucugaagaagagucuagccaagggaucuuggcuuucuccaaaguucauggacuuaggcuagcagacccugaacacucaugcuguggccaggggcagcaauaaugacugccugggcccauauuacuucuucucuucugccacuggccugaaccaauacaaccaauuguuccacucuuccauuugguaaccuggaaacuucugaagaucuaugacaaccgcauugccauuucugaggagaaaaugaacaaaaagacagcuauguggcagaggcaaggaucaggcaagucuccaaaauuuggcagaaaggguugggguuugaaagacaaauguaacuagaaaaagaacuuguucuuccuccuucuacccccauccccacaaccaccccaucucugggauucuauuuccaagauauuuaauuuugaaaacuuaaacaagaaagugguuuuaaucuucaagggcucucauuaaucaccgugccuggcccaguggagagagagagagaugacucacuuuuacaguugauuucgugguaauggagggucaaggccugccccuacacugccccuuugucgagcuaauggagaaagcucucacugaggaagcacccauucuggagcaauuuuucaauggaaaauugcugacaggaauagccaccgacaagaaaagauuucucuuagggaaacaaaguaaguggcucggcagaauuagaaacacagagccugccuugaagaguugugggguucaauggcaggauagagcaaaggaaaggcuuuggugugugccauauuaaguaucucugcaauaaauaaugaaucuuuacuacagcccuucuuggugccaggcacugugcuggggaccuuuucuaugucauuguuugauccuuauauauuaugugacaggugacaucauguccccucauuuacggauacaaauucugacaugcaugccaaaugacuuguucuauaaaugacuuuucucauugauauaauaaaagacccaacgaaagcaacuuaaggcagccaugguuuguucuagcuuacuguuugaggggcuacagucuucacaguggaggugugugagucagcugcucagaucucaucuaccaugaggaagaagagagaaaugcaugcuaggagaucacucgcuuccuacuuuuucuucagucugggaaucccagcccgaaagauguugcugcacacauacagggggauccucuucagguaaaucucuauggaauaccuccacagaugcacucagagacucaucuucuaggugcaucuccaaaucuagucaagccgacaacaaagauggaccaucacaguugcuaaggccucacagcuaguaagagauagaaccaggcucuguauccauaugguuuggugcugaagcugaaacacacuuccacucaccgugaaguaggcaacacaagcucaccucucuaggcuacaggcugagggcuugcuguaauggagcaaugggucacuuuccauuugcagugacuacuggggauuguggaggagaguagugugcugucccacuacuuuccacagaacagucucaggaucuguuuuuagagguuuggagugcugcagcaccagugggugagaggaugggcuguugacuuacugugcaagccagucuucaagaguuuaaggauuuuaaaaaccaucgauuuggguccuggcuaauuucaucaacgcgagguaagccguugccagcccacagguggucugucccagcucccugguagagcucaguaugggcagagcugggcaggguugguauggguucuauagagggucuguuccagauguucuggggcuuggaggagucuuuuccagauccuaggguggaggugaugcuggggucucccucauauugugagaacacuuggaacacuuaaaaaaagaaguuggcucuccuaugggugaagggagacuugccuuaugggaagguuugcagggauguaagccuagcaguuucuauaaaaugucuacauccccaacuuggagaaccggcucgggcggggggggggugcggggggggggggacccguuggguuggaauuguccgauucggugacucccaagccaggcuuugggucccccuucuaacacuccugacuucccccguugccuucugggggaggcuggagcagacggcauguucaggaacaccuuaaugaugucaggauacuuuucauugcucauuuaucacuuagcaguucagauuuguagugcacuccccguguucguucucccuuucacacggacaaugcauucuuucaacagugugcagcuccgugggaagggccgugcugaaagcaaaaacaguggugcgugcagccugcuccccuuugggggagagggggugggaggggcagguggggaccagaugccuggccacagcugagggagggggaugagcacacggagcagccacuucugguuccacuuacucauuucucugcgcugaaaggugucauauaaaugcuaaauagaacagagagagauagggccuaucuaucugcguuucggcuaaugugagcagauggagauaacaaagccgcuuuagcagaugagguucaccugcccugccggggcuaagguccgucuucaguucacgucaaugcugcccggucaguucugcuccagcgcugcagcagacacgguacuccguacaaaaggggguucgugcuuucuguccucaguggguugacaaaacuuguugacgagacaaguuuaaccacaggaaccaucugagaacaauacgaccaggcuuaugauuaagugguaaguccuggggaacagaugaagugcuagaggaggcuguagaagaaagaggaagccuugauuggaagcaaggcuuuguggggagaagggcuggaccacugucccacugaccagguagcuucuuuccuucggaugcucacacacauuccucuuacccucuaggucuuaguuuaaauguucucuguccacagggccuuauuaguuauccuaaguggcggccucuauccacuuaacaccauguguaauagauauuaacauguuucucucuuucccguugcuuuguaaccacuccauaggcagcgguccauacaucuguuucauucacuauugaauucgcagacaagcacaauuccuggagcccaagaggugcucugcaaagacuugcugaucgaaugagugacauuugaggaaagccucauuuagcuaauguuucuguuggccaaccgaauccaagauuuuguuuuauauuuuaggaagaaaaucuauagaguucauacauaguuccaguguggagaugaaugucuuucaaggcaaaggguuugcauuaaaacauaaaaccaugaugaaguagaaggagaaacuggucgucaacgugagcaugccagacaagucagcaugcuacgagaagaagcaugagaagaagaaggaggaggaggaggaggaggaggaggaggaggaggaggaggaggagaaggaggagaagaagaaggagaagaaaaucaaauguguaugaauaauugagcugggaccuugaauaaacuuaacccauuacuaugca

SEQ ID NO: 7185 - RNA, 3393 nt, Mus musculus
uuagaagcagacaaugagauaacaguagauaaaaguauggacuaugacaaacagugauaaaugcuauagaaguuacuaggugggaaggcaguuagggagagcagcgagcaaugaauacacagaucagguuauacugaaaaggcagcauucugguaaggaccuggaagaaggaagggggacugucacuaggacagagggugcagcagugaaggcaaaggccacugugacuguggugagugagaauaaucucaaggagaugucagaggaugcuggacagcauguuggauaggccugaagggcuagccaccaucucuucccagacuuuccacagauggcccuccuucucacacacauauuuuccaacaucccgcaguguauacucagcuccuacacugcuguuggccucccuggcuacugcccuuucaaagucccuuucuggugccugcuaugaguucuggaaauguggugaggggaacuuuuuugagucagcaugacuaguacacccaggucaugagggaaacaucuccugguguccccaaggcaguccuggaagaaauuaacauuugagucacaggcugaguaaaguugauccacugccgcuaaggguaggcauacaccccugaaccaacuaagggcuugaauaugauuuaaaaaaaaaugcagaacacaguaagcacauucacuuccugaugcuuuuuccagcccugcagcagagguuguaggcuuuguggcuuugagaucuaguguaaggguccaugauucacugaagaaugguaccuuggauucaauuaguaugcaaaagcaaagagcguuuuauucugcauaaguccagcaugcuggcgucuaccaucaaccaagauggaggccccuagugagcucgcaggccagauuuaaagcacauuagggaaauucugggagggguaggcaaccucuaucucaaucugugggcucuaucucuagggacauuccacaaccauugcuggggcggggccuagaaacuguugcugacccauuguccuugccucaggccugauggcccggcaguuucugacuggcugccugaggccuggguuuuuuuuuguuuguuuguuuuguuuuguuuuguuuuuguuuuuguuuuuuguuguuguuguuguuuugguuuuuguuguuguuguuguuuuuuuuguuuucaguaacuggcuuaccuggacuugcccaguucuuggaaacagagauuuaggccuagucuccugaacugccaauuugaagccugucucacuaggaggcugagggcuuuccuggcccuucugcuuguagauagcucauuguggaacaucucagcugauucugcuucucugguaaaccucaauacggcggccauguagaaucaccuauuucugcuugccuuaacuucucaucaagauccacacuguugggcaaaagccagacguguauucuuuuucuuuaugucacgcacucugcauacacaaggagaaugcuuguuacauagaaaccccaacucuaccggagaguuuugagaacugugugcuuguccuuuugucugaaucugaagagaacguggcgugggaucguuuaauccuguccauuaaucaauauucuuucaaguacaaugauuucauuuuggaaauauucaagcccaaauccaaggauuauagaauuucagagugugcuacguuuacccugccuuuuuuagucuguauuaggaaaauagugcaccuuugaauauaugccucaauuuuuauauuugauuggaauacaaauagauuuuuuaaaccuuucaaagcaugaagaaauaacagucugagguacuuagguauggaugucucaguuuagugggugaacgggcaacaccuccaaaagugacaugacgccagagaguuggcauuguagagugcauggucuucaucucaccccuucccuuaggcuucuccauugucugcaggcagaagggacccagcaaaugcgacggugacaauguugucaucagcccaucucacagcggaaagcugcaaaucacacacagcauuugcugguuacauagaucuugguggcagguuuggucccgaaaaaaaaaaugcuugcacucagugcuccccaaucuguccuuagccaucaggauuugagaauguguaaauagugucaaucuuucuuuugcacuuugucaaucugucugucccacugacucugggaagauaaaugagcccuuggguuuccaucugguggaggcagaugguaggaaguaccuuaauacaggugacauucagcuaucagcaagauaaaggagccugacucagagcagaugccuggggagcuuggucggucgugacagcugaagacaucaccuaggagcugaggcuauuuuugacugugguagaaaaguugccacaugcuccuucuucuugccuuguaguuuaaagguauaugaaaauggcuuggaggaagaguaauaaugucuguacgcugacucagcauucugagaaaaguacaagugauuucuagguacuagggggaauacaguggaugguaguccacugcaccacagagacaggguucugggaaaugaucuaggggcuccugucaaggagaggugcagaccggaaaaaggcagucagagaaagugaaggcagcgggagacugugucuucucugaguucucugggcuuccaccucucccagaagcagaggcugaaaagaacagaagguuucaugucaaacuaguggguucaagucacaccucacucccagcuccguggacagugccuuaccauguucauguccuccccaugaccaaccaacaccuuuuggucagcugagacccagaccucacaccgauguucuuuuugugugcucugccagcuaccugcuucgcuuucccugcaucuguauauucaggccacacaucagccaggccccugggacucugagacauucaccucuaagcuuugcaacauccuguuaaagauggaggacuaggaaggcuugaguggucccagaaagccaaagaugggagagaaggacaauauuguaucuuugugcaucugaccauccaaguguguguuuccuggggggugaguuaggggaggggggagaaucuucuuuagcuuugguaucaccagguaaagcaauuuggcaaagagagccuguucuuuuggggaacugagccagcucacaugccgcuacuuauacaggcugcuugguuuuccccaguaugucacaccaucuucaggguggacaaucuacauacgcagacagcugauauuacuucacccacacuuagaaauagcacccacugacuuacucagagaccacaaccaaacaaaaaugauccagacugacccaaagacagacagacugacucugaaaaacuaaugguaccuuccuuaaauagacu

SEQ ID NO: 7186 - RNA, 585 nt, Mus musculus
ucgaaucugauugguuuauuucuuuuuuuuuuccauagguauauaaacuauuuauuaagagcaaaggcccagagacucauuucuucuuggauacacccacaguuuggccccugcggccaguggucuuggugugcugaccgcggacacgaaggccccaaaaguggugcagcccucuaugggcucgaauuuucuucagccgcuccagguccucacgcagcuuguugucuagaccguuggccagaaccuggcuguacuucccauccuucacauccuucugucuguucaggaaccagucugggaucuuguacugucguggguucugcaugauggugaucacucgcuccaccucguccuccgugaguucuccagcccucuuggugaggucgaugucugcuuuccucaacaccacaugagcauaucuccgccccacgcccuuaauggcagugauggcgaaggcuauuuuccgccgcccaucgauguugguguugaguacucgcaaaaugugcuggaacuucucagggaucacuagagacauggcggcggcacagacggcggcguguaggccuccuguggaagagcgguuua

SEQ ID NO: 7187 - RNA, 2697 nt, Mus musculus
cgauuuccguguuugauuuuauuuaaauuaucucuuacaacuccauuuaagcaauaaaaucaucacaguacuaagucauucuauuuuccacaagccuaauuucuugcagggcugcaagguuuuagauuacagaguguuuuuuauugcugcuuagaguuggaacacaauuuaauuuuacagcuuaagaaacgguucacauagcaaauauucuugaaagaaaucuaugacaugagugaguguuuaaaaugguaaggauggaguacuggugagauggcccagcaagucaaagugcuugcuaccagaaggagaaucugccuccuacaaguuguccuuugaccuccucuaccauggugcagguacaaauacaggcacacacacacacaauuaaaaaaauaagucuuuacaaaaauuguauaguuaguguuauggcauaaaugagaaggaggugcaaugucuaugaagaccaaaaauucacgggcacaugugaaaaaaugaugacauaaacauuggggcuacugauuauucucccaaguaaagucccacaucuucaaaggaaagaaaugcgacauaacugguucgaccugagcgaagucucagccaucauuuuagaaaugcacuucuaugcacgguacagagugugccauuacuuugccuccugagguaguccugugugucaaacucaacaugggagagcagcacaaacagggggaaguguaagaagucauucucuaaaacucacaggggguugguguucaagcugccuugcuaggagaaugcuccagccgaguguaauauagaaaguaaaguaacauaaaauaugaaacgguugggugugauggugguacccauggugcgggcuggcauagcaagauggugggacacagggggagcuggcagcgccauauauaacaacaccuacuaauacuggcucaaacauuggaggggcauuuaagagagaaaaagaguaagugggggaaaucaacugugggaccagagcaauguugugcauuaggcugcuggcugcuaggcugcaucucugguucugucuagaccucuuuguguucuucucucccaucaaucugucacucaggcagccuguuuaugaggaucacacacacaaaacacauaaauacacaggucauaaauguauucaaccgaaagcucuuugcccggagggauggaggcacagcccaugggcagggagcuucacgguucuuuuaaauuucuguuacacucaucucuuuggggcugcauaacaagcuggugagguaagcacccacugagaaagccugauguaaaaccaagcguaaguacagccuggugguuugaaaucccucuucucuguaguccccggcucccucuaacaacuaccagcucugcagaggagccaggucuggccccuccugugagccagacccaugugguuauuugagaucuuaucaguucuggaaaggaaagaaguuaaauucucuucgccuucuggaaaggaucaacugcuuugccuuuuuaccuggagauucgauucuucuugacaagggggugaugagcuaauguaaggaacacguuuuuacagaccugguuuguuuucggcugcguuugugaaguuuucuugaagaugugucuacuuguccaugugacauacaccagugugucugcagcaaggcaaccccucuuaaagacguuaccccccaaagggccuuaaagccuggucauuaaccuucccccuucaaaugaagacaccucucacugugugccucugguucugccccuuucugcaacaucaccagggaggguaaagaguuaugcaaggauauaauauuuccaccucagaagcccaacgucccauccuuacauauucaucgcgugaucugauggagcugcgucuccaaagucaaauuucuagggaaaguuucuuuggguacagaauggcaugcucaaaaaaaaaaaaucucgggagguaggcgguccuucuaucuaucuguagcaucuauugagauuuguucuacugagaucaaucaaucaaugucuuugcugaucagugggcugacaggaaccugucugggagcucuauuuuagauuucauugcacaagcuuggcuguaccacacuguuguggguugcccuggugcuguuuuguauucugauguuaauucugcuuccucaagaggagaggaucacucacucaggugguuucaugugaaccuccuccccauuuuaacuggucaaauaaaggcuguaacugggcaguggaagggaagcguggggcuggagguuuuagagaaugggggaaagagagugaaagagagaggagaagacagaagaagaggaagugugaggaagauggagcagagcagaaccacacggcuuggagaagccacaaguagcgagagaucucauagcuggggaacagaguaguguaaucugcccagucugggugugcagcuuaaaaauauuguaauugauuugugugguuuuguauaggcuuauugggauuggagauuuauuauaucacccaauuaguaguaacugcauaucacaaucaacuucuauuuuccuaacuaaagaaugacauugagugugucuaaguggcaaccacuuuaccaaacaucuuacaaugccauucuguucuccucccaaucuucuaaugggaaaguuacuguuaauauucccaucugguggaugagaaaagcggaggccg

SEQ ID NO: 7188 - RNA, 11681 nt, Mus musculus
aacuacaagaaagcgcccuggugggcggggcccugggcggggccccgggccgcucuccaaugacccggaacugaggcgauccaugguucuccgagaggaugggcuacggggcgcuagggaaacaagaagcgaucccugggagucgucucgccuucaccgaacgcucugggcuuuuuccagaggagauaaaagauaggaagugacgucugggcccgaagcaggcccggggcucgggaccgaucuggcuaggccaggccagagccgcucucccgcugagcucagggcgcguguaccacccgccugaccggccccuguccccggauccgcucgccgcgucggagcgggagcgggugucaccccgcggccguagagcgggaacgcccgcccggacaccugucgcccgugagacgccuuucguuuuuuauagcaccuuugcccccacuguaggacaauuucaagaauuaggaagaacccgaagccucugugauuagcuuccauuggggacugugcccccugcuugcauuauacucucccuucccaggcgucuggcuggcgagccuacccacccuuucuuucuuaacucuuucucaccaucucugucauuucguuuuuucccucccuugugcuucaagucuuggcgaaucaacagucuuugcuuaucucuguaauccagucuagauaaccguucccuuuuccuuuccuguucucuggucaaagacugguaauuccgucuauugaaaccuauuguucuauagggguccgcaaagaggugacuauuuuaaccccauuuuaggaaggauugagucucgggaaacucgugauuugcaugucuagcacaucgaauuaguugguguugaaaauaaauuaucagacccaauuagaaaauaugggaaagaaacuguaaaaaaaaaaauuguccaaauuaagaucagaaaauaugaggcacuagguagguuuugugugcgguggcuccuaagagugaucuuaaaccaggugagggaggugguacacaccuuuaaucccagcacuccggagucagagucgaggcuacaaaauaaguaagaccucgugucaaaagaaaaaagaucuccaucuggcaguuuuuucccccuuuaaugggagcuugaaaggaaguuuucaagagaauagcacuggacauccccugggagaacuggggaggagaggggguggaguugcggcucaacccacacgugccuagaagaaauuguucuuuccuuagaaacaguucccauugagugcuauaaacuaacuuucuguuccuguggccuucugacaaaauguagcaacuuuguuaugugauacuuugugugacuguagugucuucaugucucuccuggaaguuuuguauucuuguauugcugcuuacuuacugaccucagugauggaguugauagagcaacauauguuucuccggauucaggagcuuucuuuuuccacugagaugaauguuacucacccauucuacucagaaggccgugauaaggaccagugguuuuuaaaaagaaguuuuugagauaaagucucucuauuaaguagcucuaacuguccuagaacuuacuguguagaccaggcugaccucaaacucccagagaugugccugccucugccuuccaagugcagagcuuaaaggugugugccccucacaccuggcuuguguaauguuucuuguguguauguuuucagggcaugacuacuuaguauugcaugaccaguugcugggcuccuuucuggggaggacuauuucuccugcucucuagugcuccaccauacucaacaggaucagucuuuugaaaugguuuuaaagugcugcaguggucauacauuacugauucguuucucuccuaauuccaggcaguucugaucaucacacacucaguucccuuucaagguguccaaaggggcaauaugcugucaaaacaaaaauucacuggaucuucaguucuuccuuuuucaagugacuguguauuugggacugucacauauccugugacaccaauccauaaucuacauauuucucaucaaaacuuacaacaaguugcuuaugcuuucucugaacaaacacugauaaauauacuuuuaauucuuaacaaaauacauuuuguagggccagggaggugccucaguggguaaagccacuugcugcccagccugaugacuugaguucaguuccugagacacacauaauagaugggaaaccccagauccugaaauguauccuccucuacaugcaugcuguggcccaugugugcccauauacaugcgaacaaaauagauaaguguaauagcucauuuuuaaaacaagucuguaaagugcuucacugucugaaucauggguaugauagaaaacagugcuggucaaccuggcuacaaguugguuauaccucagcucaaauugagaagacuuacagaaauggcauuuaaaaaaauaaaucucaccgugcaauggugagauucacuuuuaaaacaaaaaaaauuaaucucaaauaauggccuacugucuuagcauaaaaguuuauuuucuuugguagccugaucuuuaaauauuuggcacuagucaacuauagaaggggagaaacuaacugaaauguguuuugacaguguuggaggugugcuguguucccugcauccuuucccaggacccuguacauaagcggcagcauccuuuuugucuguuuuuugguuuuugagacaggguuucucuguguagcccuggcuguccuggaacucacucuguagaccaggcuggccucgaacucagaaauccgccugccucugccucccgagugcugggauuaaaggcgugcaccaccacacccggugugcaucccuuuuuacacaggacacucugucaggcuccgcaacuuguacacaccacacagcuaauaagcaaauggcaaagccuugguucacaggcagauccccuaccccugaauauccugugcauccuguuaggaggcuuacaagagcaguguuuggguguggaguuaaaaugauuguguauguacauuuauauaaguuacauacuaccauaaauuuucuaauuuuuuacuuucagauauuuuaauaucccaauuccaggaaaauacuggauaacaccuuugagaaaaaaaaaaacaagaaaucaugaagaaguguuuuaauuauuaaagccauggcuacaucugcaaaucuggacauuggggcccagcugaucguggaagagugucccagcagcuauaucucugggaugccagacaucaagcuagagcaccagcuagacccaaacccagaugaaggagcagcccagggcgucgccauggggaugaaauucauauugccaaaccgauuugauaugaacguguguucucgauucgugaaguccuuaaaugaagaggauaguaaaaauauucaagaucaaguuaacucugaccuggagguggcaucugucuuauuuaaagguugaaaguuaugguacaacucccuacauucacuuucauuuggcugacuccauucuguuuucuuugaaucaggagauucagaguugaggaaaagcuugaaagucaucuuuuaaagggauuuucuagagucucacagacacccauauuaaauuucuguugguuuuuuaaaauaucccuugucuaagccagguguaguaacacauaccuuuaguuagucccagcacuugagaggcagaggcagugaguucaaggcuagccuaaucggcuuagugaguuccagaccaugcagggauucauagugaaacccuaucuaucuaucuaucuaucuaucuaucuauauauauauauauauauauauauauauauaaauaaaauccucaucugaucucuauuuauaauuucccuaagaaaguuguaucuuuuuaaaugauagaaaaauauuucuuuucuuugucaaaacuaguuuaauauuuccuguuucaugacuaauuuacaucaacuucuaauacuguaauucaaugaucugucagcaugcuauaguuacuuuguaaugaccuauugaauauuaaaucuaauagaucaagauaaauaauuuucuuuauagugcuuacacuacagccuauaagucuauaaguuuagacuuauauaauuaauaaauuaacaucaccugauaaacccuugugaacugaagcuguuaaaccucauauauuauuucaugugaacauuaacacguuuuuuauacugcucugucauuaaaauacuauucuaauuuguuuuauuuagcugagugcaauauccauacaucuccuucuccuggaauucaaguaaggcaugucuacacaccaucuacaacaaaacauuucucacccauaaaacagucaacuacuuuaaccaacaagcacaggggaaacgaggucucuaccacaccucuguuagcaaauuguaaguaugccuuagaauguaucaaaauacuguguaaauaacuaaugccauucaaaucaggaguuuguauuugaaauauuagguucaguaaauaaauauucuagcuuuaaaagcuuaagugauacauuaauucuauuaauaaguugaaacuuuuucauguguuguucuguguuugaaaguuuguuauaucucuaugagagcauauacaguuuaaaauauuauuaaaaccuuuauaguuuugccaaaaagaagugaguuacugugguuuuuuuuuuuaacaaauuaagguaucugugcuuuuguguucuucuaguuuaauguuuuacuuauauaagaacauaauuguaaauaaagacuuauguauuaguucacugaucaagaaauggcuuuguaguaaaagauauuuaauccuacggaaacauuucauugguggcugucaacaccaccaccccucuuauggccucuaugggcauacauuuuaaaaauacguguauuuaaaguuuaaaaggcuggcaaugccugcauaucccuuuagcuucagcuacucagaaagguaaggagagaggauugcuugagcuuacguggccaacuuuggggcugggccucucaggaaaaacaaguuagaucuucaguggagucacuaagaaaccaaaaggaugcuguuguguuguuuuggaccgccuucauaaacuuggaaccagagguagcauuguaaaaaucaaguaccuaaaucacucuuuaggauaaauuucgcccgaaaauaauaauuugcaggagucacauuaucuaucaugaguccguucucagagaguaugaccugugauauuaggauacuuuguuaggcuuaagugacaacauggugggguuugucuuggaaaagaaacuggcuuccccauagggcgguagcuguguggcccauaagaugcaugugaagaacuuuaucguaucguuucagcucugucugcucaccaguuggcagcccagggagagaugcucuaccuggcuacucguauugaacaagguaauacccugguuuuaaguauuacauuugaauuuauuagaauuguuauuguuuuauuuuuguauaggagacuguaaagacaaaagaaguuguauagucucaccaaacacauaacccaauggguagcaaagaaggaaaauuuuaaguaauauaaacuauaaaauuuggggcuuuaggguggcucugagguuaagaacacuggcuauucuuccaaaggacccaaucuaguucccagcacccacaggacagccaagccugucuguaacaccacaucuaggagauucaaugcccucuuucuaaccuccaaggguaccaggcucacauguagugugcauauauacacacaggcacaacacccauacacacauuuuuuuguaaauauguuuugccugucucacuauguuguccaaauuggccucaaccccacaguccuccugccucagccuuccgagugcugagauuacaaguguauaucucuacaacccagcuaguucauacuucuucacuauguguucaacgcacacuaugugcuaugauuucuauuggguuguuuguuuuuugguuuuucgagacaggguuucucuguguagccuuggcuguccuggaacucacucuguagaccaggcuggccuugaacucagaaauccgccugccucugccuccugagugcugggauuaaagacgugcgccaccccgcccggcuuuucuauuuguuuuuaacuaugcaucugguugauuaaaaauguuugcugaccguuuuagcauucuuuauaaauguuauuuauugaguaaauuuucaccaguagaauccaagucacaaacuagaugacuuuuguccugcagagggaggguacaguuagcucuaaagcuaugcuaggccaaugcauagagcuacgccuguaccucuggcuucuuguuuuagcauuuuaaccagaugacuggccucaaauuaguguuagaguuacaguuuccccaauagacacagugagauuuaaauucuuaguaaucuguggguuaaaaugguaccucacaguaauuuuguugauauguuuagauuauaaucccuuugaguuucuuuuuuuuuuuaagauuuauuuauuuauuguauguaaguacacuguagcugccuucagacacuccagaagaggacgccagaucucguuacgggugguugugagccaccaugugguugcuggaaauugagcucaggaccuuuggaaaagcaaucagugcucuuaaccacugagccaucucuccagcccccauguuucuuuuuugucuaaacuaucaauaauauauuucugucauaugaacuccacaaugaagcugaccucuauuuuuucaugcauauaguuuuccacaguuuauucuuuuuguaugaccucuucagauuuuuaaucgugaauuuuuguccuuugugacuuuggaguuuuacauccuacuuagaaaagauucuccacucuaggauuauaaagaaaccacccauucuuaugcuagacuuccaugauuuccuucuuuauagucuuugaugcaugugaaauacuuuuuuaguauaauaaagaguaagacaccuguuuuacuuuaaaguuaggcgucccaauguugucugcugauuccagggagcaugauccaagagucugauuuuugugagacuuaguuauauuucuguuaauuuguguagauauuuggggcuagagagaugacucagaaacuaagaucugaugcugcucuugcagaggaccugaguucaguuucuagucucugcauuagguggcuuacaccucuccagaacucuagggguaccugaugccucuuguuuugacagccccugcacucgcaugcacccauacucccaacagacacauaaguuaaaaauauaaauaauuuuuuaaaaaguagaaauuucauguucagccucccaaguaaguguagaagggaagcugugcaauguuuaacuauuaggcuacauuuagggaauaaaaaugaaguuggaaguggaauuguguggcacugguucagauuauccagucuucauauuucguauuauacuagggacugcauggacgaaggaaacucacaggcagcagggcuagauagagccgaggcuggccuuugugagaugcugaaguucuuaaguauacauucaggugaugcgaaggcgcucauuuuguugugaucuuccuaucuuguauugagaugacuuugcuacuaaucuguguuuagcagaaauuaagucacuugcccagcaccaaaccacuagaaaaugaaagagccaggauuauaucuugggucuccugucccugagaccaauacugaccuaacaugauucugugugugguauuuguacuuuaaagagugugcuccaugcacccgcuuuguugcauggcccauuuuaacaugugcagacugaaagucacaacaguacauccagaccucagcaaacgaaauucagccuguugaacuucacugagucauaaguuuuuagaacaaguguuuucaaagugauauuaauaugugguuguuaacuuagaucacaaaaaaugcuuuucuuuccaauagaaaauguuaucaaucacacggaugaagaaggauuuaccccccugaugugggcugcggcacaugggcaaauagcugugguagaguuccuucuucagaauguaaggaaaaugcucagccaaugugcaugugugguuuccuacacucacuuaagucuguagugcaguauuucugucuguaaccaaguagacauaaggauggagggcacaagagaaauacugucuaguagucccguggaaccugggucuagccaggaaagcaauggaaucccacgugaaacagugagaagccguugcuguccagucccucgcugaguggaggaggaacagaaguagugucaagggguccuggugaaaaggcuucuuggaggagcugggaccuuuccagagugagggagaauugggacugaggcagcuggaggaggugagggagggaggaggucggccguuaagcuuugguaacaagcgcauccauugugcuuguguuacguccuuaguaacccuagagcguggccucaccucagugucaaacuguaaccguauucacagacaguauucuuguuuauaucggcugaaaacccuuucucuucaugucugcaacagggugcagauccccagcuucuaggaaaaggucgagaaagugcucugucucuugccuguagcaagggcuacacagacauugucaaaaugcugcuugacuguggaguugacgucaaugaauaugacugggugaguccacccuggagcgggcugaaccucaggugggaagugcuggccuggcgugcacagcacauggaggugcccaacagcucaugagguggacacgggaagaaugacgguccagcucacccuuggcuucuuggccauuucaaggccacaggacuacuuaaaacucugccucaaaaaaauuaaacaaguacaauuauugugguauuuauaggauuuaaucuuuuuuggggaaauauaaccuuuauuaagacauugggagaaaaaaaaguacuuauuuaggaugaacaaguuagugucaugaauccaguuucuuccugugguuuaaaaaguuuuccacacaauaugaauauuguuuuaagcuaguuuuacaggcccagguccguagcagcauuugauugacuauugcucacugaaaauguugacgacagacaauuuuccuccugcagaacggagggacaccuuugcuuuacgcuguccaugggaaccacgugaagugcgugaagaugcuguuggguaagcaggugaccguaguccuuguuuggaagaaguccugugagcgucuuaagcuguccuguuaagaagagcaaacauaucguuggguugcacggcucugcuagcauuugcccguggguucccuuaccacaggacugcccugggagaggcgguccaacaucuccauccgccucugcacggggagcuuuagcccuuucugcucacuuguggggucaccuuugacuccacuguuguguucucuguacgcagugucuucauguguacguugugucuggugguuuaaugacgaucagcuacucuagggauacuuggguaucucuccuucagcccaugaaugugaacucuguggaucccaugcacucagugcuuuguaagagcauguuggcugaagcucuguccaaccauucacauaugagccugggguagacggacauacacguuuucauuuuauuuauauagguuuugcuguuuuguuacagaaaauggagcugacccaacaauugaaacagacucuggcuauaauucuauggaccuagcuguagcuuugggcuacagagguggugaguauuuuagaacucucgggucauuuuaggaaagcaucauauauaggaaugccagugcuccaaaccgucuucauugcuuucaugcauaaaacacuguaguauucuaacuccagacauaggcuuuaaugaagugccaaguaaacagaccccguaaagcgaagggcggaguucacuuauuguacuuuuccauaaacucagauaguuacuggaagaaaaguggacaguguuugcaagauuuucaaaaauguuuucauuaaaaaauuauauaacagcauugcacuguguaauaaaagcucaguucagaaaacucggaagcucgggcagcggcugaauuagaagcagccuuaaugucaaggguagcugucgcacauuguccucagauggcgacaaucaguccuaacagaaauagcuucauuguacagaaucccagggcucgguugagcugacgcagugacuuuugugugcuugcucuugugucucuguguggugagcuuacugacuuacccuuacuuacugacguaguccaacaggccaucgagucccaucugcugaaacuccuucagaacaucagggagugaggagacucgggaaacgcccucugcccucccucacuccuugguccuuaaugauaguuuuguuuacauguaaauuuuuauaguuuuguuuggguauacauuuuuaucucaguugcaauauuugcuggguuuuagugaguuuuaauaaauauuccucuggauaauucacuuguuuauaauaaaauuaauccugaugguuuuuuaaauaaauguguuuuacuauauauuaaaauuauuaauuaauguuuuguggcauguaaccuuuuaugguacaggugguugugagucuuuguaucaaguagcacaauuugacacuuuaaggaaacuccaacuuguuugucuuuacucuuguauucacucuuuugacuuugcacagggcuuacuguaagugugugggagggaaauaauguucuuguggaauuaaaaaguacagugugaugguuuacaaaaucaugucuaaauaaaauacuuugucuguuugcauucuagcucugauuauaugcuugucacagaugucuucaggauuuucaguuuaaguuucuguuaugcaaauugaucaacaaagacgcccaucucuagaaguacacuuagaguguuuuucucuuacaaguaggcuugagaaggaaagucguaaaagagaagcgagcugcucuuuaacccugcuagaggaaugucauuaacuugccucuuacuaaaauccagaagagggaaccauggacuagagaggaauugaagaacugugaggguugacugagguaaauucaucugaaaaauggccguuauaucagugguaaaccguauagccucgaucuggggaacacgagaaaaagagaaguaaggggagcaggaaaggugcccuggugcuugagcgcggcugcucuugcaggagugggguuggggucccagcaccuccauggcagcucacugaucuauaacuccaguucuagaggacccagcaaucuucugcaugcguguggugcccauacaaacaugcagacgaauacucauacacguaaaauuuuaaagcgcuauguuacagguaaugcugcucuaugcaaguggguuuugucugacaggaccacacacugcaggguagggugggcucucuacagucacuuugaccagcagagcagcaauauacucaagaggcaagaaggcaauucaguucaguucagcaugacuaaguagccaguguugguucaaacuucgagagucugaccccaaguaguuuauuuuaggcauauuuaagcacagcacaauuuguugaaaacuuucuuggugauaauucaauccacaugcaaaauaaagcuuaagccaugacuuca

SEQ ID NO: 7189 - RNA, 7116 nt, Mus musculus
ccauauacuaggcaaagaauuuuauuaacccuuuccaaacuuuauucccaggcuucuucagcuuuauuugccgcaaagaaugaauuagguauagcgaaaacugaaaagagcugcaguguccgggggcuugggcuuaaaaauauuagagaucuagauuuuaucagauccauaauaaacaaaaaaauuuuaaaaagcagucaugauauaaaauagcagcuccuguaauuucugcaaguaucaccuucuucagaaguugcuucaauucaguuugccucauucuuagaagccucaucaaaauucuccaccagaucuagaaaagaaccaaaauagaagacauccugaaaacaagccaauucuacaaauaacgcgcagauauuuaaggaaacacucucaaauuuaaagacuugccacuuccccauuucucaguuguaugguuucagguagcuauuggagcaguuguucucagccuucccaaugcuaugacccuuuuauauaguucguguuaucaugaccccaaccauaaaauuauuuuguugcuacuuacuaacuguaguuuuguguuauuaaucguaauguaaauacaugcugugcuacccgagggguugagacccacagguugagaaccacuguauuagagcgugcaucaugcuuaauccuauugaucacucauccucccucaauuuaagaauuagauaguaauccauuggccaauauaggagagagccaaaggguaucaugacaugaucugagcuuuucuuuaauugaacauaugucacaugucugcaaucccagcacuaaagaggcugagucagaaggggucucaaaucuaaggcaggccugaguuacauauugaaacacuguuucaaacaaaaccaacaacauaaagaaaaacauuacauuuuuagaacaucaaaucucaagauauuucaauuucuccaugcuuuuucauaauccacuauguuucaagguagcuucaguuccuaagugagguuccuguccuguguccucacauucaccaguucuaacuuauaacuaccacccuggaauguuuucugucgguucaucucucucccuugaagugauucuuaccuggaacuucaucaucaucauccucuccaguagcaaggggugcuuuuccauccacagcugugaaauggaaauaaccaacgcauuucuuuagaucaauaaauguccaccaaaagaacacaugaaauacaaugcacaacuuacacucaugucaagugacaucugaggucucaccuauagcaccagcaaggagaccuuuuugaugggcacaaaccauccucuggguacagagaacagugagaguagggaacgcucaggauaaaaccacacaccaaacugcgggagguuuugggaggcaaaugaagaggccagccauuuuccuaaauauauuuacugaaauaaagcauuaaaaaauuaagcuaaacgcggugacucaccuaucaaucauagaacuuugaaugcaaagacaagacuaugguaaacucuaggacagccagggcuauauagggagaccuaucucaaacagccaggaaggaagaacacacacaaaagccaacuuuaaagucucucucaacuguacugcuccuucuccucccccgacccagggccucgaauacacaaacaagaaccacacugagccuuaccacccggccuauuuuuacuuaaacaaaccaccaagaguugacagucuaauuugcccaggcuuucaacacauaaaaguucuucaacuuguauguaacgcuccuacuucagccuccccaguggccaucauaccuugagcacuuucacuaaacagaaagaagcaagcucugagaacacacagcucuaacccgcacagacaucaggggaaauuucaaaacccuauuuaagcucucaaaguccaagauggccuagaacaucuugaugccccucccuuaauaaaagcauaaaaugagucagcgucugacgauagccgaggaaaacaagccacugcaaaccucuguauuccuagucaauuuuuuaagcauccagcauaaguugucauaucagcuaugauggcuaaucuugauuaaucugacacccauggggagaagaaaccucaaaugagaaauugccugucagaucagccugguagcaugugugugcuuugggugagggugggcacauuucuuuauugcuaacugauguaggaggaacuugcccacuguaggccagugcuguuccugggcaagcuggacugggauaagaaggcccuaaacacauacauacaaguaacauuuauacacuccaccaugcaauaacaauuaauugagggagcauuaacuaacuuaaagagagcaaagagguauacauggugggguuuggagggggugaaaaggagaaauguaauuauaaucucagaaauaaaaggcaguugauugugagcuugggagcaugccaauaagaaaugcucuuucauaguuucugucuuaaacucccgccuuggcuuuccuuaaugauggacuguaaaaugcagugaaauaaaaauaagcccuccuccucaagcugcuuuugguuauggugcucauuacaacaaaaaccaaaccaaaacacagcuuguccaacacauaagucaacuaaacuaaaucccuauaaggugaaacacugaaauaccggcagcuaucaucuguaucaacaauaauggaguauguuuuaaaacaguuaagagucuaaaaagccaccaaacacaaagacuguaaauaaggagauggaaugcuaguuuuauucuuuuucugaggcugcaugucuauagcucagguuggucuugaacccaguaauuuuccucguccagucucucaaaguacguguguaagucaccuugcccagcuugaucagcaccuaaauuuuaaguagcagcaaaacccaaaauugacaguuuuuucauuucuaacuaauaaaagguuuaguuuguuuuaaaccuaguaagcuaguagaaaacaaacacccacuaaaucaaguauaaacuagacuaaaucacagauaaacuagacacaucauuauaaacaaaacacacauaagcaguuaaacgucuacaauucuuuagauauauaaguuggccuucuacauguaaagacauucuuaccaauucugaaccugagaucacacaaauagcuugcuaaguaaccagcaaguacagugacucuaaggauacucacauuguuugggcagagcuucagccagucuccuuaaacuagucaggcugucugcaccaagcugguugaggaugcugggaagcauuucugucagcugcuuugucucagcguggccuguaauggugaagguguuugcugccagggaugccugaacuuuaggguuguuaaaauggaucacuguuccuugguuuguaaacauguucaccuauaaagaaaauaauuguuguaaguaacgaauaccaaagauuccuuuaaaauuaauguuuuuauuaaacaaaaacuggauucuggcuacguggugcaguucuuuccuccccucugaagcacggaugacaacuucccuggaauguauaaaggaacagcuuucuggcuucacaauauccuugaucauuuguuuaguuaauagggcaggaacaccucccaagacauucaaacaucuaaacaucuaauggggcauggggcaugaacuacaaugcuaacagcagagccacgacaauuacuuaauacaugaccauuaaacuuugcagucacaccacguuuuggcacguaccucuucaauaccagagauguuguucaccccuaacuucuuuaaggagaacugcaguuucuuaucgucugcuguggccguucugugaaccaccuucuucuuccuacgagcaguucccuaugggagcaagaggggaaacgacacauugacacagcagcagaucuucuccaauucuuuucagaccuuugcuuccguauaagacaguuaaucagauguaacaagguggcacacucugauggaucucugaauaugaagucagccuggcuaaccuuacugaguucuaggcaaaccagagcaaaacaacugagaccugguuucaaguaaaaacaaauacauaauaaagacuaacgguaguuaucaaacccacaaacuaagaaguucaaaagacaggcuaagauggaaguaaggaaugacauaggaauucuucauaagcaccaguuugccacgugcaaaaaagucuuucacaagcccugacauuuuaagucuuuuuaggccauguuucaaccuaagcuaagccucaucuuuaccucuuguuuucaaagaaaaaucaauagcuuaauauucacagaugagacaguauacaaacaacucaugaaucuguauacaaauaucuauuauagccaagaguagaaaguucuuaacccacagagcucucguaagucaacuagaccuuucucaacucucucccucuucccugcauugcucaccccccuccccagcaaauuucuucuccccucgaaaagggcucuucucaaucacucaacaaaaggacuucacaaacaucuccauuuuuucuagauuuuauuguuagucauauuuuaaaauccuaucaagucaucguccaaucugucuuuccucaacucugcacuaaaugcaugacaugcuauguuacuuccaacuuuauguagacuauaaacaaacuuuuacaacaauaagaaccaggaaaauuuuagauuauaaaauacagacuaccacuuauagaucucacacauuucacaaauguagaacuuaaaagauugucaguuuuuccauuagacacugaaaagggucuugaauaauauucaccuaacagcaugugaaucuuacacuacuuuucucuaaggcuacauucacucauucuauaaguaaaguuucuuaaaagguacagaaaaaauguucccauauuauaacuggaaacauugucuuagcuuaacaaagacuagauacaaaguaucccuaugagacugacuuggaaggcuuucauuuuccauguauugaugaugcuaaaacauaaaacccaguaauuaaagaggaacaaccuugcacacaagcacaucacuccagaaacuaaaaagaaagaaaacaagcccagcuuuuuccuagcaccugaaggcuucugccuuaaaauuaaaaggucgagaagcaucuaagguuaauguccugagugcaaacugaagacuacaauugccagcaaaggcaaacaggaugcuuacugcuggugccaacucuccuaacuuauguuauguuacguuccacauuuccuuaucucucagaagacuacugaagauuuaccuucaguaaaaguuaaaguuagaacaauuuaauagguaauaaacuuguacuauggaagcuccacagguuucucggagacuccaugcuucaaccuguuaaacaccaggaaugugcuaacucgauacuugaaacuaaggagcucuucaucuggaguggacccagcaccaacaccaaguucaauucuuucagagcagaauccacuuggagaaaccaaccugccaacacauuugcauucucucacuguagcauaauuacaaagguugaggaacaaaagacaugugcuaagguaggauuucccaaccuaacacuguucacgaauuuaaauaggaagguauccucaaauacccuaaaaaagacaauuagucuguugagcauuuaguucagaaagcaaugcagaagagcagaagaucuucauaauaauaauaauaauaauaaaauuaccuaaucauuaaguagaacaggaaaagccaauacuuucaguuaacuuacuuuuaaaaaaaauggggugggaaugcaguuugggaguugagagguccucuagcauguaccaaaacauguguuggaucucaggacaacucaaagguaacaaaauaaccacccccaacauuguacaagucaaggguacacgguacacaaagauuuggcagagaacauacuuucccccccauucauaaaauccaguaacauuuguuuauaugcgccauaauccugaaccucuugcaagcaaggcaccguuuuuaagugcuauuuucuucucuacucgaugaccgaccucaccccuacuaucuaucuaucuaucuaucuccuccuugucucuuaguauuggucucauuucccuuggauuugcuagcuuugcgaaauguccccugccaagcaaagugacaaaaaaaacccaaaaaaccaaccaaccaaaccaaaaacaacaacaacaacaacaaaaaaaacaaaaaacaaaaaacccaacaacgugagaaaugcaaacggaacuuuggaagagagagaggagagaaaaagaaaggaggaaaaaaaaaaaagaaacuuacuuucccaccaaugcgcacuugugccugcaguuuggcgaguuucuccugguucaugauuguuucuuucaucuacaaagagagaggaaaaaaaaaaauccucagccaagaacaagaacggccgggcccccccuccagcauuccacgcucguuauuucccgcuacacucgcaggagaacgucgucccccucgggcugaggccuggauccccaauucaccccuccaggcucgccggggcgcacagggccccucgccccucccccgcccggcccggcccggccucgggcucagccccacggcgaccgagcaucccccgcuccccgccgcccugcccggccugggccgaggccucgccacggccugcccggcccggccacucuccgcaggccucgcgguaccugagacucccguccucggcuuccgccgagagggagagagggcgucgcuucggccccgggccagccgccccuggcucgcccucgcccccgagaguccgccugggugggagcgcccguccgucgcaucgcuuuccucagcuccguccguccccucccugccucgcuccugccgggaaacgcccgccccacccccaacucccggucuccucccacgccggcguccacggccuuuuuucuguaccuugucggaguggaaauggcgccgcgcggggaacuaagguucacgcucagggggucucgggcagaccagcugagagaaggcgcacacacgcggggacgcaagauggcagcuagagggaggccggaaguaacgcgacgccacu

SEQ ID NO: 7190 - RNA, 5603 nt, Mus musculus
ccccaauucaccccuccaggcucgccggggcgcacagggccccucgccccucccccgcccggcccggcccggccucgggcucagccccacggcgaccgagcaucccccgcuccccgccgcccugcccggccugggccgaggccucgccacggccugcccggcccggccacucuccgcaggccucgcgguaccugagacucccguccucggcuuccgccgagagggagagagggcgucgcuucggccccgggccagccgccccuggcucgcccucgcccccgagaguccgccugggugggagcgcccguccgucgcaucgcuuuccucagcuccguccguccccucccugccucgcuccugccgggaaacgcccgccccacccccaacucccggucuccucccacgccggcguccacggccuuuuuucuguaccuugucggaguggaaauggcgccgcgcggggaacuaagguucacgcucagggggucucgggcagaccagcugagagaaggcgcacacacgcggggacgcaagauggcagcuagagggaggccggaaguaacgcgacgccacuuccuccagaauucaggaagcggaguuggcgucgccgcgcaugcgcagccgggggccgguccgcggcuguuucuuuccuuucguccagcggcgggccgggagcagcaccggagagcugggacccgcggucgccguccgcgguccugggaaaggccgcggauagaucggacagugaggcucccuguagagcugugguuaaaucagucugcccuguggccaccccguagggcguccagcuuuguccaguaggcugcagugucugcucaaugccggguguaaauaaaaaacuaucgaaaucagccaggcuaauguugcuuuccaaaauuaagugacuugggugauguagaaaucgcgacucagaaugucuagaaagcauguucggaaugcuuuccagaucuccacccuucagcaauucgguuuauucaagguugaaacaggguaacaagauuuguaaccucuuaacccuucuacaccucuaccaucgacucccugaucucgaaucgucauggauucgaccaugaagcauucacgauggagcaaacuuuaccuugaauucuuccaagaugaauuugagccugcgugcuuggggguaaaaacguggcugugaguuaaaguuugccgaacuccagcacgaauugugguugucguuuuuuuguuuuuuuguuuuuguuuuuuguuguuguugcauaauuugaugguuguuuuaaaaagugucucgauaaguaauccuggcuagucugaagcacacagcuauucuccggccucagagccccucuguccaaugcugggauuauagucgucuagcaccauucccagacaaauuuuaagauaaccuuagaaaaucccuauaugaagauuaaaaaacgaaaaagaaaaagagguuaagugaaaauucugugugcuuaagccuuuuuccaaucuuagcuacgaaauguuuuugaauauuccaaagagaaaguuguguuagaauuuuuagagaauacaauuuauccagaaaaguugccgaaaugaauacucuagcuaaaaucaauuuuuuuuccccuuggaaaccuuuuuacacaagaguuucuugcaacagcgaugagucauuuaaaaaaucgggagagacaacuacguugcuauguagaaaauuguaacaaguucuuuuucuugaaacaacaacaauguuucuuuuauccgaacaaguaaguuugucucagaaaaccaugcuuguugucuacccuaugaaguaccuaaccauucuccaaauaacugagaugaggcaacagaauucagugcuacagaaaauauauaaaacaugacuguguuacauaugauggauaaaagguaaaacuaguucuuuuuguuuuuguuuuuuuuuuuuuuuuuuuuuuguuguuguuuuuccagacaggguuucucuguauagcccuggcuguccuggaacucacucuuuagaccaggcuggccucgaacucagaaaucccccugccucugccucccaagugcugggauuaaaggcaugcaccaccacgcccggcuaacuaguucuuuuuaaagaaauguuuaucuguagaauauuuuacucuucauauuacacugaaaguaugugaaacuuccuaaucaugauauuuucugaauuuuuacauaaaacucuacaauauguaacugauaccugucucaucuuuuaggccuauauucaagaaauaugacuuaguuucuuuuccccuauucugucaugguauagaagacuuguaugauuuugaaaaucaccaaacuguaaggaagacgauguuuauuuugacccuugcugcaccaggacuucagauuuugcuaauauuuauauaccagccuuuuaaaaaacaaucgaaggacuuuguuauuguuuuacuuuuccucuagaaguuaccauuugcggucugucuucaggacuaccauuucccacuugcuccggcugucuacagcaaguguaaaggcuugccucccacccuuuacugcucauauagaacaaugcaagagcugcuuacuuagcauugucaacagaauucgagaaaaaaaaaaaacaugauugcucuccuugauucauaggacaugucuaaacaaaauauauggucauuuucaucucugacuggaacuugaauuggcuucagcaagaaccagguauuuacuugacaucagguugcuucuucuucuuuuuuuugagacaggguuucucuguauagccuggcuguccuggaacucacucuguagaccaggcuggccucgaacucagaaauccaccugccucugccuccugagugcugggauuaaaggcaugugcuaccacugcccagcucaggcuuaauucuuaaggggaauuaugacccacaagaaguuuugagaaaugacugaagaugaaugugcgugugugcauguguguguguguguguguguaaaggacagaagacaauuauugggaauugaauuacuuucacuaugggucccacagauugagcugaggucauaaggugaugugacaagggcauuucuccugaggcaucucucaggcagguuccugugcuaguugucagagaaccacaaugggcauaccauccauuaaacuucuuuguguucuccuuccaguaucugucucucccacguggauaucuauacguuagcuugccaagucucggaaaaucuugcuuuuuacaucucuuucaccuuuuugccacagaaauauuguuuuuuucuuguuuuuguuuguuuuuuuuccucucuccaaauucuccauuuguugacagguaguguauaguaggaccaucuuggacccaccagugauauaaauaauggcacguaggcuuuucaauauuuuaaaaguuaaauuuuaaaauacuaaaaaaaaauuaguauguuaaagcuuaggccuuuugcugggcagucucccaacuccucuaaaccugacuggauuggcucuaccucugcuucacucuggucaacccacugaccccugccucuagugaaucucccuccucucucucucucucucucucucucucucucucucucucugcugggaaguucugccuuacacuuccuacccagcuauuggcugucagauuuuuuuuuuagauuucuuuauuucauguaugugaguacauggucacuagcuuuggacagaccagaagaaggcaucagaucucaugacagaugguagugagccaccaugugguugcugggacuugaacucaggaccucuggaagagcagucauugcucuuaaccacugagccaucucuccagcccuagcugucagaucuuuauuacagccagucagauacaauucuagauuaccuuaggcagaugaggaagaacaauauuuaacaaaauacugagaacagugaugggccauaaaguaacaauaccaaaauccugcccguauuuagcucucggaggguauuaacaauagaauauacagagacacaccuucauacaacaggagugcuuuagcccacauacauaguauguacccauagagaaaagaaaccuggggguaccugggcauuccugaggagacacacaucuuggccugauacagaggaacagucaguccauggccuggauggaugguauguucuuuccucuuccuaguucuccuuccuacuuagacuuaaaguccagagaagaaauauauuuuuccauggguggaacccacaaggccuuguuuguuuguuuguuuguuuguuuguuuguucauuucuucgagacagugauucuuuguguagcccuggcugaccuggaacucacucuguagaccaggcuggccuccaacucagaaaucagccugccucugccucccaagugcugggauuaaaggcgugugccaccacugcccggcccccacagggccuuguaagauagaucucacuguacaguaucguaaaaugcauucaaagaaaaugagcccagacuucauggcagcacugcaaguacuggcugguccaguggccugaccucugacucuagacagggaaaacgugucuacuggaugggcauuugaugcuugcuuaugauggagcgggggugagcuuccucgccgccaauauacuaucagccccuacccagcaguccugcuugcuaauugugggggacagauguguacaaauuguccauugaaaucaaguaugcaaggaaauaagucauuuggggcccauuuucacacagcaacaccuucucuuccagcucacaccuaagucaucaacaagacucuugcagauuucuucuggagagacagaaauaucugcagccaggaggacggcuguuggaggaauucaggagcauucgacggagucuccuguagucggcgaguggucaguuuuacacauccuccucaggaccucacaggcaagaacagcaggaucugcuuccuucaugaaaccuuggcucuguucuauccaucgacaguccuucaggauaccuaaccuguccagaaaccaagguggguggggggauggacaguaccacuuaccauucucccaucaauccaugacagaauuugcuuugucuucuacaguguuauacuuugcuggcugagaggccuuaguuccagcaagggaggcaucuuaccaggagaaauaauaagaauggugucacugagcugaaaauuagacugccacuuggacgcucuaggcuccuugugccucugagucaacaggcaaggaaggaagucaaggguguugcuguaggguggggugcugaguacugaggagaaacugggcaacuacuccacagguaagggagguaaggauaagugugucuggacuauaggagaauggcucuagugaaggcccauugaauaaaggaccauaccagcuaaaguugccaaaggcaacagauaucuacugugcaguagaagauaguuauaaaaaccagcuaugaccguauggcaagucauaggaauaaaagcuauaauugcuauggcuucucuccaugaaagaguguguauuuguauguguauuacugugcuggauaguuucaugccaaccugacauaagcugagucaucugagagaagaga

SEQ ID NO: 7191 - RNA, 1093 nt, Mus musculus
gaagaaauaauuuagagguaauucguaacgagguaggaacugaugggggggggggggcggauguagguacuucccuaaacagcacguaacaauuuacaauaguauuaaauuauuuuacaugcauggguguuuuucagggaaguacgucugugcugcauguccuugcagagccugcagaauccaguguagucuccccucccccagccugaaaccggcuugcucagggguggagcuucccgcucaaucguucugccacgcccacugcuggaaccugccgcuuugcuguucggagcugugcacguggucacccugcuauuggacuccaagauuaauuggcgggaaucgggccccuuccccugcuucauaacugcgugugaaacaguaaaauugagcuuugaucagaaugccugucuuagcugcaucagcaucauuuucucucgccgccuagccccucuucucuuccagguuuccaaaaugccuuuccaggcuaaaacccagguugugaucuacuggccagacacaacaauccagaaaucuucagauccccuggaacuggaguuacagacggcugggagcugccacauaggugcugggaguugaaccaggguccuauggaagaacauggauccaucucucuagccccaguacuuaacuagaauuuuaaaggggacuguguugauucaaaugagcuguggaauccacaaaguuaacacuccuucaucugaugcugugcugugugacuacaguguuaccuugaucguugucccuugagagcuuaaauuucaguugagagauuguucacaggaugccucauguaguuugguccuucuccguuccccugagcuucacauguuaauagugugccucccacccuauuaguacuauuggggaguaguaaggcuuuggggagguggggucauuggggugaacccuuggaggggauuaugggaacagaaccccuaccuaauuuucuuuacucccaacuaccaugaggugagcauuuucuucagugugaggcucuguuaugacauacggcuuugcuacagggcacagcaacacagagaccaaauaaacucaccaucuucuuucuaac

SEQ ID NO: 7192 - RNA, 505 nt, Mus musculus
gaugaagaauuuagcucugcagccggguccaacgcccaguggcaccaacgugggcuccucuggccgcucucccagcaaagcgguggccgcacgggcugcgggauccacuguucggcagagaaaaaaugccagcugugggacccggagcacaggccgcaccaccucugcagggacuggggggauguggcgauucuacacggaagauuccccagggcucaaagugggcccugucccagugcuggugaugagucuucuguucaucgcuucuguauuuaugcugcacauuuggggcaaguacacgcgaucguagauugggcuacauccaucugucaucugaagaagaagaagaaggaaaaaaacccaacaaaucuuggaccaaaaguguaguaauuuucuguucacguguauuauuuuacagagaauaagaauugacuuugagaaaucaguuuuuucuaugacuaauaaacuuuggaauugcuuuauauggaaaaaaaagaugaagaau

SEQ ID NO: 7193 - RNA, 1239 nt, Mus musculus
gguuauuugaucguuugugugauucaucagcuuugaaagagccucgggagucgcugccugcuccucuuacacaggcccugcuuuucgguuuugcuuucugugaaacggaguuaauggcauuagccacugaucuggcuuaagaagagaaaaugaggagaaauagcaggaggcuuaccaagcacuggcgagaacacauuggaaaaucugaggcagacccggaggaggugaguggucccacuuggcaucuccuuuauugguugugucauguuuugcacucugugccucguggcaauggcccaaccuauagauugacauuuuggucucauacucauggagcguaacucuggccugucuucuaccacucagggaucucccuaugcuacccaagugcccauugcacugccugggcauucugagugcccacugccuacuuguuggauugaggauuugaggagagaguccucucagguuugugacugggucagaacugugggcagccucucucauggaaacagugggguaggugugggagccuucugucagauaccugagaguagucugcucuuacaaagaaagguuguuugcauucaauucuggaguuucccuuccuguguggucaguugaccucacugcuuuagccugaggugaagucucauagggcagagcaaagccauuugccucagaaccaguuggugccacagacacauccccaaugaccucgccuaccccucuaggugucaccuuuaaaaggccaccaccucccagcagcaacucacuggacaccaaaccuuuaucacauggauuuuaggggcggggcauucagugccaagcgauagcaacuggaaguagagagaaacaucuggaccgagaaacucggucuggcuccugcugacucucguuuccccaauugagcuauaaaccuuuucuuugaaagaguuuuaccccuuguucacagaaccucuagcacgcuagcucacggugcacagcaaaccuggaaguugacguggaaguaaaauuccaggcgcgaugaagugaaaagcgagucacucaccaacaguugucacagaccucagauggacugugcgacccgugggaacuccacagugagcuagccaacagucaccccuucucucccacccaucugggcuuacaggcauguccugacagugauguauggucacuggaggggcacagugggggacaaggcaugguuaagcaauaaaaguccauuuuccacag

SEQ ID NO: 7194 - RNA, 1080 nt, Mus musculus
cagccccccgcccccccccccagccggccucggcuucaggcuccacucucucccaccccuuccaggaggaagcuaguccaaccugacagagagcaaugaucucaguguaccagcaugcaaacgagggacagcgaggcuccuucaugacacuguggcccagggcuccuaauaucugcgccagugguuugcuccuuuuaugucaggaucuucgguuacucagugucuaguucuccagcagggcaguggcccaggcggucggauuuuccacucgcucuucugcuggcuuucuaccuccaccccuuggaaauucgggcgauuugcuugcaucuccagcagaggguaggcaggagaaagaaaaaaagcugcgguucugaguugacuguuccaggguuggugggaaaagagccgcgcuguuggcuaaaaugagauuuggggauuaucaguggauuuaaucuggucucacauuuaccaucucugcaaauaauuagagauuacuagucacauucagaaguugcauuaaccucaaagaauucacagaaaaucuaaauaggcuuaaaucccaucccgggauccagaaugugaagugcaagcuaccguuccagauaauuaacauuuuaggcucuccccucccacgggggcggagcuacaacgacaccuaggugugugaauagacuugaaauacaguaugaaggagagaauagcccaauaggaagaggaccagccgugcaacacugcuuccuucucuagucuccaagagacuauucugauucgggagguguugagaagagcuuuguuuuuagcauguguuggaggccaccaggcagcgguugauucgcagggcaauacccacucugcuccugaagaucauacuggacauagaggccuccuguggggacagggaaggggauuacagagaacuuuaguccagagcccuggugagagagcacccuuacauuggcagucaagugagaaugcuguugguccuacaaaguucgugagaacugaaugugcuggugucgcuguggugguuaacguuuucggagacguuucauaaccguucuuugcuugaucuccauggua

SEQ ID NO: 7195 - RNA, 1707 nt, Mus musculus
uuccguuucuuccauugaaacucauguucauaagguacuguuuagaucccccgcagaccauccucagcggucccuggcucacugccccucucuuugcaccacuauuccagcauaauuuuuuguaaagcuaacuauccauccagaugacccuuucaauguccgucaucaccuagcuuuucagugucuuucuuacaguggcucuguccuugagcucacucagccaggccacagucccuucauaguuucacaauccucacucaucuacucagauuccuaauuugucuaacucguccaaucuauuaucaaccuacuuccucaccauccuaccccauuuccauuagccuuuuaaacaucacacccuuacacaccaucugugaaucuccagguuccucacuagacacccuccuuuguauaacucuccuuacaccuucacuaagacuuagcucaacagccuuggcuaaauuagcuuccuccccacauuggcacagcugacugugaaugagaaacguccacauggccacaccucucccaucugcucccugagcgugauaugguaaucugccccugucuagucacucacgguucuaccaccucagggccucuaaccucagggccucuauuucuccucaagucuacacuuacucagugagcuccagaaucaugugugaagcuaccaacuuguccacauuaauagcacucaacaaguacuucaaaccacauucuaaucucaacaaaucuucauaaccacuuauaacuuuuccugcuaauauucaagucaccaccaucucuuaucuggguuucugcggcuaaucuuauuuuucuugaguuuaauucuccaaagaacagccagaauauuacaaaaccacaaauaacuucaugaccucucaacucaagaguguccacuugccauguugccuuacuacaguugaauucccaauuccuuaccaugaccuacaacagccgaucuggccugggcccucucuggaugcauccucaaccuuuuccuaugcagugaccuaccucccuucaccgucuccugaguuuuccaagcaugccuuuacccaagauccucucccaagagugaaugguuugcuccacuguauuuuucaaauagcugcuuaaaaucuccaaaagcuuuuuucccuacuguaauuuuccaccuucauacgccccucuuaguaacauguaucaaugcauacucuaucugcuucuccgauguuuucuuuacuauaaugcaagcucaggagaccucuguuuucugaaguagcuuuaguacuuaucaagagacuuacuaguguaauagugcacaccuguaauaccaagcaguuggaaggcagaggcaaguggaucucugacuuccaggccagccaggggcacacagaaagacccugucucgugaauaaccaaaacaaacgaaggaaggaagaaacgaggaagggagggagggagaaaaaaaaggucuuacacauagugagcgcucaaguacuuugugaaugaauauaugcugaauacuuuagugagacaguaggaauggaggcuggaaauagcuuggaaaauaaagagugcuugcugcucuuauaguggacccaaguccagcuccuagcagccacaucaagcaguucauuccaguuccagggacuccaaugcccucuuccagccuuuguggguaacauacguguauucaggggagcauauacacaucaaaca

SEQ ID NO: 7196 - RNA, 7055 nt, Mus musculus
ucauuauuaauuauugucauuaauaucuugcucugcccacauuaugaaugaagcuuuaucguguaugaauggacaagagaacauguaucuguaaggauagguacugccuguagccuuaggaauccacagcacauccccacagcuaaagaccagucgucacuacagaggaaauaagaaaguuuauucuggagccaaauaugagugacuguggcccaggaacacagauucaggguaccacaaaugccgugcuccaguggggaaacaguuuugugaagcuuuuauacguguuacaggauaaaaagagacauaaguuaaggcuuguuccaaaugcauugguagaagcaccagguuggugguuuccgcagaacagggaaaucucugaucuauguuucaaaugcugucuaaugauauccuuggcucuagggcucauagaauauagugagauguugaguuaauaugucccaaaauauuuccugucauagucacaaguuaagucagacacagagguaaugaacagcuagcaaugggaauaagaauaucccaagauaauuuggcucuggaucuguaacauuccaguuccccacaaucacaaaguucuaaucaaugagccuuguagacacuuuaacuuaaacaugccuuucuuuucugggaucuucagcucacgucaccauugcccaugggcagagaacagaggaccaugagguaugaaggcaaugaccuucucucugccucuggccaggaaguuuggcuaaagcaaaucagcacaagucagugaggguacagagguaggugucaugucagcccuuacagaagguuucgcaguaggggagcagcaccaagagucuuacgucugaggcaagaggggccagccuccacagcccacacuucagaaugggcugcagagaaacaugaaggaugcuuugaggagcagugacuccgcaggcaucuucuuccucucugagaagguagauaggugggccugagccgaguggagauggaguccuggagagcaguuaauacagagaguagauuacauggcuuuccagaagcucaagagacaagguuggagcacagcagcucugaggaaagugaagccagggacacaaauggagggcagcgagccagguguggccaggaagucuaugggaagauguauugccaagcucagccauggccuggucggguacccaagagccacuggggaacauagcuugggucaucauaccccgaggaguaagagagcuagaccuuuggaguuacaggugcuucugggagccucagcuuuccagcugccuuggaucacagacuguucaugcaccagggaccaaagcccugaggcagauggugucuuccaugagcaaguugacuucacuuguaaagugggugccacaggaaggggacagcauguggcaguaguuuagacccugaggagaagauggccauagggacagaacaaugaagaagacauauaucucuuccagacacauugccagauaugagaagaggcacaggcuugcuuucucuuuccucugucuuccaucccuucugucccucaccugggauccacauaucagaugagcuggcaauagaaguuguguggucaucugacaguccuuuucugugucaugucccuuccucugucccacccaugaucuaagccaaggagggguaaagcaggcagugggucuggaaacaacccagcacaggauggugcuggaaggccagcaccagcuucccuccuacaccgcccugcaucugcuguaccugugaaaauaaaauaaaaaggcauuuuaagugaugcaugccuguccugcagugaccucuaggucuugugugagcugguguccugguucuauaaggcagacaaagccaggugagccaugugcauugaacccagauuaccugaaagcaggcagagggccacaguagggaacaggugugcuagaguggggucuuuacuaugggaaccugaaaggcaguauggggagguucugaggcugcccccgugaacaguuauucaaaguccacggauaagcagauagcacuuucuaauugauguccugagugaugucuaauugauaucuggaagauuccaagcaaacagacauaucaagaacucagaaaauucugacaauauuucuaaaagcuucucuuuuaaguguucaacuccccucuucaucaguacaaagaguugcaagaaagaaguguuggcaugaugguuaagaaugcucagcuaaaggcuuugcaauuaggagaguuggaguguccaggcaagcauguuuaugacauuucuaguuggguguuaaacuaauaaaaguaugaugagucacaaauggcaguuagagauacuggugugcuggagccagcucacacuggcuuauaugaguccaugcuaauuguacaggaacauuacuagcaggcuguuaaaaacaucgucaugggcuggugagauggcucagcggguaagagcacccgacugcucuuccuaagguccggaguucaaaucccagcucacaaccacccguaaugagaucugacucccucuucuggagugucugaagacaucuacaguguacuuacauauaauaaauaaauaaauguuuaaaaaaauuaacaaauuaaaaaaaacaucgucauuauuaaagucagaccauaugaaguuaugguucaauacaauuuguuaaggacaaggcuaauaacuauucagagcucaucaaugcaucccuauucuuccuguuguccaugcuccuuggcucacuagugccugccacucuugagcuguguagagguuacuagaggcugagacaugggaccgccuuaaaauucucucuucccacucuacuuucggccauccugugcuggaaacugaaaucagcugugaacccagcaaauacugaaaccaggggcuuaauugaucauuucguugauugucuagauuuaaggucaugauccacaaaaugaccacaauaaauaucagauuuaaagccugucauucuguagccauuacccugugaauagcagguauauaugugcauacaugaauucacaggcacaccuguauacacacaaacacacacacacucugagauaacaucucuccauaauuaagaacuauacucuaauuuuacagagaaauugcucacagccuugacaaauaaccugauuucagguuauuauuuugcauaguuaagaaauaacuuacuaggauaauauuaaagauugcauauuaaagcaaagguaaguguaucaggaaagagaggauugacacgcugcucgauuuaacucauacuccgauugcaacccuagccuagcuuggcugcagagacuagauucccgugaaagguaaugaaagcauuguucaagaaucaaugaaauuuacaguaaagaguauuaaauauuuauuccuacuuggggauugugaaauacauuguuuauaucaguaaaauugagaauaaagaucuaugcauauacauugcauuuguuucucuggagagcuguguguuccggcauauggacauuagaugcauuuguucaacuuuggcuuuguuuuaugguuauccuguuuuagggaccugcagaugucauaugcuccaaauaucuccaugggugucucugucuauuuaaggaucacaaagaaugucucuuuuaguuugcuuuaucauguggaacauuggcuguguacuauaaaggauucauugugucaccgccuuaaaauuuuacauuucacuucauuuauauuaaauucauuauauuaaauuuauauaauauaaaauccaccaucuuagccauuucauagggauacagucugcggguuuuuuuuaguuuucugugauguuguacagccaucucuacuaucugguuucccugaaagagaccuuggaccauuaucagucacucuguguuccaguucuugcaucccugaccucugucaaguuuaucucuauggguugaucuguuaggcauuucauagcaacaguguccucgaagguauggcuauuuguauaaauuucuucuguuuuauuucucuagguuuucgaguuucaccaugccagagcaaacuacauuguuucuuuucuacugcuacacagugucccacaggggaccaggcacacucuuuauccaguuacacaucauugugcugugcccuacagccaagaggcaugaauaaguuucacucaugacaagcuccuguccgcaugggguuuggguucuguuggguauggaacacaugggugaucaguaaaugacuaggcaguuucucaguggcugccuacuguaucccacugugcccccacugugucccgcugugcccccauuguaccucacugcaucccacugugccccacugcaucccacuguaccccuacucugucucacugugccccacuguaucccacugucuuagucaggguuucuauuccuacacaaacaucaugaccaagaaacaaguuggggaggaaaggguuuauucggcuuacacuuccauagugcuguucaucaccaaggaagucaggacuggaacucgagcaggucaggaagcaggaguugaugcagaggccauggagggauguuccuuacuggcuugcuuccccuggcuugcucagccugcucuuauagaaccaagacuaccagcccagagauggucccacccacaaggggccucucccccuugaucauuaauugagaaaaugccuuacaguuggaucucauggaggcauuuccucaacugaagcuccuuucucugugauaacuccagcugugucaagcugacacaaaacuagccaguacacccacugugccccacuauaccccacagugcaugccuaucaacugugcauuaggaagacgucucuuucagacuggugucuaaaaccuaagauaguuaagugacuuucaagaugucauuguagaacagguuagaaaacucacccucuccaccuauguguugcuccacacauguacccaaaaguaagccuaaugcgcuuuuucugucuuccaacaggaaaguagucauuguaaaaacaaaacaaaucaaaaagcagcuucauauugauaaaaggacucguccucagaaacucugaauuaaucagaaaauucaagucaucagaacacauucaaguaauucuuaugcaucccuuagucaguacgcccuccacccagugagccagugucacggauuucugcuccguugaagcuaauuccuccagcagcuaagggccugagaucuaacacucagagcgauaugggcacuaggccagugcauuuuaaggaaccuucuggguugugugcccugacucccccaaccuguugacuaccccacccaacuccucuuuccugacucugcuucaucuaccgcaauuucuaacuuuuuuucugagugcaguuucucuugucugacuccuguauuccaaugcuuuuccaggauucccuuguaacugucccuauuguauccacuucccuauuguaaacaacgcuggugauuucccagagcacacccagguccuuccugguuuaagcuccacuggccuuuggguuuaagcacauaccaccucacuuucagccagacccaaaggacuauagcucuaucaucacgucccgcacauccaugcuuucaagagcuuuaacaaacuaaaguacaacacugaagccaggcaugguggcccacaccuuuaaucucagcauucaggaggcagaggcggaaggaucucugugaguuccaggccagccugguuuacagagugaguuccagaacuaccaaggcuacacaaagaaacccugucuuaaaaaauaaaauaaaauaaaauaaaauaaaauaaaauagcuucaaagccaaaagcuuugggugugcagucugggaauccagacgaauauacuaccuccuugcaaaaaaauagucacaauuaccaaguucagugacagcuucgcuauagacagacuucucauuaagcaacuuacaacaguagaaucugccguguaaaauggaaucuggcugaaucugauauauuuagaaguucagaggcguccaccaaaggcuucucagaggauggacucccagagcagggcuuuagaagaugaauaggaguuuaccaagggaccgugaagagaaagcggcaaagaacucucagcuucugagaaugcagauugcauaaaccaaaggcuuaggaaggaauucccaaacucugcuagaacucuagguggaaaacaacaggguggaggauggcaggagauagccuauuaagaucuauguguggccaaaaaggcugggccagucacugagucugcgccuuacaccguauguuaaccuagaucaggacacagagaagggaauggauuuuugaggguccucaaagaguggcagccaggagccucucaccucagaugaagagagcugugguuuucugggacagagugcggagaccuuguggucuuucucuccuggaaaaccaccaccucucagagcucccaguguggguuauaguggggguggggauccacauggccccuucgguugucuagcgcuccggauggauuucaacacugcuuuguguaaugagcgcucuuguaauuuguguagcuuugccugccuucuaugggaaugaugguucuauguucacagcauuuagacugugccuuucaaacucugagaagauagaggcuuuguucagugggucuggguggagcgagaguaugaacuucuuguggggagcugcggagguuugggggaccggggauagaacccaguacugugccuacuaggugaacacuccgccacucagcugcauccucagcacugcagugugcuucuagccagcucccaggaaugacacaaaggacacuuguugccugggcaagaacuaacggcuccccggaguggagggucccagcacacgcccaauuucugcuuccuaguacuuacaaaagaacuccacaucccguggccccggguucccggucgagaagagagcuuuggugaaaguccccuucucuuaaaacugcucauuuuccauggcaaugcacaccacugugcaguccgaauggagagcaaaaaccacauc

SEQ ID NO: 7197 - RNA, 95163 nt, Mus musculus
agaugucucaacacaugagugaacuuuugccacuuuguauuuuauuguggaacugaguuucuguuguuuguuuguuuguuuuuccuuuacaucaaauauccuugauagaagaggggauauugcacacaaauaucauaaaagcacuacauauuacuuucacuggaaacuaauuuuucuacauuagauaugacuggauaggauggaagugaugcaggauuauaagacauaauaccauacacagcugcagaccgacacaaacaccauucauaacaagagagagaguggacuucuccgcagccggacguaggacugcacguugccgcgggcgggcgcaugcgggaaagcaaggaccggcggcgcggcgugggcgggcggcugagcagagccacuucuccggggcgccuguuucuccggagcuccacacgugcggagaagccgauuauuagcuguuguuguuuuccuuccuuuucaguuuuuugaugcugccuugaaaugaauucauaaagucucgguuuuuguuuuuguuuugaaauagugaauaguuuuaauaccaggugaauaaaaccuaauugcuaccaaagcggugcucauccguaggcugcuuuuggugugguguucagcugguuaaaugauaaaagcuuacaguuccucucagguggaaacagaaucuuuuucuccuaaaucuuaaguacgaaaggaaaaaaagaagagaaggaaagucauuauccuaacucacaaaugucauugccaagcagggaccuccugugacaaaugacagaggggggugagcagaacaacucuggaauuguagcgccgcuccgggagcuaagauuuguaacagaagugggaggugguaaaauuuccauuagcaaaugauuaaauuuauaaaacgaguauuagaaagcuccuaaauuucauaagcuauuggaaacacuuaaaacauucauauacacuggggaaaccauucacuaugauauguaacguuaagggaaaaaaauuuucuuuugaauuccauggaaaaugguguuugggcgaggggucggucacuguguccagucccaucacaagacugagaaagcaugcaugggguucgggguuuggaaaaagaggacagaauugguuaaaauugaaauggaggauuaucgcuaagauuuagucucuguagaauuuuguuuacaaauacuacuaaaaaggucaugaucaggagugcuagcucaauagaauuccaucauuuaaacaggguggaaaugccuuccacucaaauauucaaucuauacaauuggauuaagaaucguaugcacaaaucuucuagaagucugugucgguuuuuagcuuucaccacaaauguacacggucccauugugguggcuaccucuaaacuaauuguguauguauggaacuagcaagaucagauuagccacacagguaggagaggugccugggaggucaggagccccuuguaaagcaaauguacuucacccugguguccucggcucggcuccguggccaucacugaggacaggggugcaggagggugccugccagauuguguaggaaucagagccaauggaucagugacaguuuugugaagcauuuuuccccauuagauucuguagaaacaauaagagguaugggggucgagugguuauaacugaaggcuggcuauggcucuucuaagguauuuauauauauauauuaaaacaaaauaauauaaaggcuaaauaaauuuaaguuggaaaacuggaagauaacuccaucuucuaugaaagaaaagucaaccagaggucuggauuuggcaagaaggcuagaaauuguuucucuucacguguggaccagccuaacagcucccauuaaauuacuaucuuguguguauugagcuugucugaugaagugagaagcaagugggcuuacaggcaacgaacucuguuuucaucaggaugacuuuuccaucagauaggacaguuuuguaccuuuaacgugucacuguuacggguuuugaaagaaacaggauaauaaauaaaaaagcugcauuccuagagacaccuaacaaaaauagaauauuaauuuucuuuaaaaaauuaaacauuuggaaaaugugauucacagcauuaaguagacugcauggguucucagugaggaaaccccuggagaaauauuguuuaaacccucagaguaaaagagcagugcgaaacauacgcuuuacagacgaaaauaaacuaaaauguaaauuuugaaauaaauaacuaacauagaaaauaaaaugaggucauuguucacuaccccguagaucuuaagagucugcaggaaacguagcaugaccgagcacagcugccacugagaaguuugccaccucugaacccugggacgugaaucugccacuugaaacuuggcgacaguuuuccucgcgaucuggcggcgcaagucugugguucagugaugacaucgacagacauuaugucugaacucucuacauggucaacauagaaguugagaauucauuuguuuucaaucuauuacuucucucacugaauguuuuccaggaaaaacaaaaacaaaaaaccaacccaagcaaacugggugcuaggguacuucugaacuuggcucuuuuaccucauggugaauaaucuugaaaggaggaggggauagcacugggugaugccccggacaguagccuaccccgccaccuacccacucucaaacagcacggacucaacuuucacgguaugagagucaaagggcaggagguaccaccguuucugguagugacagguuuuuaaaaauaaauaucaugacuucaauaucagacuucaaaucuugccagaaccuuaaaaaaacuucaauuuuugucuuacaaaaaacacuuaaaauaauaauuaaaaagaaagaccaucguuucaaaauuuucuuugcguuuuccuguaaaugaaaacauuuguuaaaaaguucaucuaugaaaaguucucgaguagcuaaaaaaaaaaaaaaaaaaaaaaaaaaucuucuguacauguguucccauguguugaaauuaauggaaaauuaaaauagccaaugcaagacaaaggaaggcagaugcuguacacuugcugagagcucuuccaccauaagauucacuguuuuccugguucugaucaaagaagccauuccggucuugaacuugaagaauuaaagaagcuacgaaaggugcaacggauuugguugaguggccacggguacaucagaaguggugauguucaccaagcaugacucugcacuaaaccguugggccaaucagaugagcuucugguaccuucccuccccacacgcuccuuucccuggaguaucuacaauccuacauggaugguuuaaaaacuugcugucucacauuaaaaaauaagugcaucaggugucuuuguacauucaagucacuuccuaaggcaaaaugucucccauguguacucccaccugcuuugguauuugcuucaguuaaccgggguggacuuggguguugcugcaugcagcuugacuugguguggacuuggguagacaaaugcugggagcaugccuuagaucaaccuacucacguguucgaaaagucugagaguucugaauggggcgcaaaccacucacucauccagucuacacuugcuacauuaugccgugugcagccuuuauaauagcaaaggcauugaauuaaggcgugaaaaagcucaugcccucguaacaggcuucauucuuuuuguucuuuagaaacacgcuuuaggagaauaagacucuuucugaugacucugaugaaaaugggaaacuccaccuguguagaccacagaauagcuguggucugagaaaaugcagaccugguugcuggugucuucucuauaccccaucuugcccacucucucucccugggcaucucaucagaacucucuaccuuugucucuugcauucuuuuucuuucugauucuuccccucucacucucucucucucuccugcagucucuuugucccucucucccgccucucucccuccccucccgcugacucucuuucccucucuuucucucucuaugauaaaugccaauaccuagcagaagucaguugggugcgugagugcauggcuuccgaauguucagcagagaugaacggggguaggcaauuuugcaguaacucgaaaucuauugugggaauaugguuacuucccuuagcagucagcaaaaauugagaacuaucagugacuugcaucaccaugacauaguauagcaucuggcagguaauaacuguucagugacuuaauuggaugaauggacguuuuagaaaagguaguuucaaauucaagaauuucuggaaacacaguucaaauccugugguguggccggcugcggucucuacaguucuaucuugcaugcggggaaggacucgucuugcaugaccacuguacugcugcuugcuaagaccaugauguugagguccugcugcuucucgugggucuccugguaccacucccucaucaccucggagucaugugucggaaucagagucaccuacggagggggagaaaaggagauauuuaaaggacagcagggauagaugccagaguaaaaacagaacaaggugucuguuggaucacuagcagaaagggauaaaaggaaaaaaaaugccguuuuaccagaaaaauaccaaugaaguuuucaacugauguuuuccaagaaccacaaccaagcuguaaaaauuagaagguuuuuuuuuuuaauuuaaaaaaaauuuuuugggaugucauugaagggaagaguucaagccuagaaucuaaauuaccuaggaacuugcauguaaauuucagauggcuuuuuaacgaagugguguugagaacuguuuguuucucguguuuccauuaacauggggcagauguuguacagccuauauauuccacacuuagugcacgaaguuuaauauuguagcucaaacccccagaagcccacacauuggccugaaaacagagucugugcuguaggaggggaguaccgacuuugguacuucucaugugaacacuguggaauucuuuggaagcaaccuuauggaagaugugagcacaaguugcuaggugaugauuugcagucccacaaaucagauaaccagugaucagagcccaauaggaacauggagacuggaugguucauagccagcccggaggggcuggagcagaauauauccggagaggagaggcaaugacaccagucuggaauuucaccuggagacuugaucccacguaucuuggccagugaccauguuccuagcuuuagucuacuagugaguaagauaauuccuuagcagcaauuccacaggcucaggacaacuuugauucacacauacaauacucagaauuggggggagagaggcaggguugggacagcaauucauuucaggucauuuuaccgauguguggacucugucuuagguaaggcggugcuccuccacugcuacugauagugacccugucaaggaggccaccuuaggcuaucuucuguaagcuaaacugaccuguuauuugaacuacaaguuccuagcugauuuagauucuaggcuacaacuccuccccucgaugaaaaaagaauuaauuuuuacagcuugguugugguuccuggaaaacaucaguugaaaacuucauuggcauauuucacaugcaacagucaggaggcacuacauguggauccacagggacaaagacgccuauuucaauguuuccuucucuuuacuucuauaaugaguucaaaugcaccucagacauggccccaugcucuuaccugcauguugcuuccccacugagccuucccuuccaacaaggcauccaggacagcccggcugggcuccuccgcggcagggucguucccacucaccacguaguaagaugaccucacucucuugaagaacucaacaucgacauucuuacuguugcugugguugggaauauagcacagguccaaauacacagggaggccuggaggcacgguggacgacuuggcugucuuagugguuccugguccuuugggaacaaacacaaagcaagggucauagcagugugaagacacagacacauccacggauccccagcugcagucucugggacaugaaagggaugguaggagucccaguucccuggcuccucauguagggccuccaacauuaggagaaauuauaccgugcuucuuuaccagcucaauaggagaaacugaaaaagacuuggcuucccuuugcagacaaccccuuaggaagaaaagaaaaaagaguuucuucgauuuguuuuuuuuuaaaggcauuagugccagguaguggugaugcaugccuuuaaucccugcacucgagaagcagagucauauggaucucuaggaguuugaggacaggcuggucuaugaagugaguuccaggacagccgggggcuguuauauaaagaaacccugucucgagaaagccaauauauauauauguaggaauuagauaagaguacucuccauccaaagggucuacuuguacuaauguguauuuuaguuugaaaagcucuauaagacagaggcuuaacuuauggauccugaugccauacggaauugaaaaacuaaacaugaauggacaaauauguuuuucaacaguaagaaauuucugaucacccauugaacuuaauuuaaaaucagauguaaugaugcaugggguuuccggucaugugugcagcauggcacacacagcuucacgguagcccugguucuggucccacagugugcucgcugucuuacucugcaauacaauggguggugucugaaacacacugcucuuguagaaacagaagaguugaauuauggaaacaaaggcuucucauaguuuucuaccauugcaucagcaccuaaguaucaaacuaguguaucuuuagauugguucaugcuacaaugauuuaaaaauaaaacacugcuauuugaguuaacgucuugagcuucaggggaaaaauguuuaagaaauuugggguuggagcuuggaaauaauugccaauaauuucugaaauggcaagaaccuaccucacaaaaacaaaagaaaagucucaagucaucacuaaggaauggagauugcuggcuaucaguggcgaauggggagccagcaggcauuucuacuuagcuccugcugaguggaauuccgggccugagaaaucacugugcuagcaaggccguggguagaaaggagaaacaacuuuaacgguuuccucuuuuucuacucgauauuuauuggucaacuggaaucaaauuguuuacuagcagguaagaaaacacggcagauguuucaaugggcacauauauugccuacauguuaggauuuuuuccccaaagguguacauuuuuauaauuuuacauuuuaaauuuuacagaagaaauaaauaucgggcuuagacaaaauuccagguuugccagggaaaccuuuggucugccauacgccuuugggaguuccugaucugucacccugaugugauuuuuaaggucagccugccugaagccucccugagcagcccgagacacacauccuuaauucugaagguuugcaacaggccuacagcugcuguccagaaugacaucagcccagaaaucccaccagacggaucccaccacacuuugcucucucuaagccacacugggccaggaggugaaccuuuaagcagaagaggaagguggacgaaagguagagcaucaguccaccauuucuggucuucccagcaaaaggacagacagagaagcgggcaggcuuucaagugaccccaccuaccugccguugcggucuucgcugauuuggaugcagaggcguuagcugcguucuuggucuccuuguccuucucuucuccgcguguggcuuugaccucaggaguggugguggucuuuguagcuuuuuccacggauucuuucuucuugggagaagccacucuggacaccuugucggaggauuccuucaaagcuccugguuugggggaagcugcuaaaggcuuggacuucccaucacccuuuuugacaggugaagaggacuuggucuuugugccuggcuucuuggucuuggucuucuccuucaggucuuuuuucagagccuugccuagguucugaucaacggccaaggcgucuggguccaccauggacacgucgggguggcgaggagaagggcuucggucuugcaugggggcuggagguggguccauguguuuguaugugacgguuuugucuguggggauaguuucugacucaucuucagagucaauauuggcgucggcugugauggaggggcacucuuccgucucugggggaacaucagagucugucugggauggggcugacucacugacugagguggguggcguuucaucgcauugccugcccuguuguuuuccuccugaaggugggggggcuccuccagacugagugaggggcuucucugauucuucagugggcucuucaccagcaaaccacucaagaggauuuggauuaaugaaggaaggcgagagcuccgucuugggaugcuugaauucacaggaggacaccagacauaaaucaacauccuggcgugccucugagggggacuucuuuuccguaguguagcaucggucugaggucucauaggaguauguggaugccuguggggucuuggugaucuucuccauggucucguaacaguaugcagaggugucuggacuccguguuguuuuuguacuugucucguaggaauagcuuucagacucaggaaagcugguaauuuucucagugguuucauaggaguagcuacagucgccaaguguguggccgccauccucagugucaucauagccauugcuaaugucauccaggagccuucuggaccucucagucuuuucauagguguagccgcuuacuucagggguccgugucgucuucucgcugaucucauaugaauagccacccucuucugggguccgagugguuuucucgguaauuucacagguguagccaccaucuucuggggucuugauggucuucucaauggucucauaggaguacccacugucacauggggauuuuaugguucucucugucuucucauaguaguaaccacccacgucguggguccggaugguuuucucuugagauucauagucauaaucuucuucaucuggagauccggcggcauucucaggcuuuugauaggcauaguuaaagucuccgggugucuucccuccgcugucuuucuccacacuagauguagucaaaucucuauucaaggccagaugauguugcauuguaucaaauagcauugaggagcggaagccauagggcucugcuguugcugcaucuauugguggggaagaggaggcuuggugagcugcugcagucucuuuagcugcagagguagaaucugaaaagccaggugaauauaaaggugaggacucucguggggugaguggagaaauaucagauuucggagagagcuucucuccuuccaggcucugcacuuuuucagacgcaagugaggcauauaaggacaucucucugggaggaacaacaucagagagagugucuuccugaagaggagaggcuaucugagaaggggugugagcugaagagguggacggggaagccucuaccugagacacagagaugagcucagacagaucauuauccuggguguaggauggcucuuccguuggcgggaucuuaugcgacaaacuagaguccuggauaucagagggacuauaguccacuucaguuggcccguuuucagugauaugaagcacacuggcacccagaguagggugaucuggagacugccgacuaaaguccauagcaagagaaugcucaggggauuccuggccgaacucaauagacauagaagacuguucagaucggugaucuugaacugguguccuggauuuggcugucuugggggagaagucuggaggagaaauugacaucggucuugggcacucuucuuuagauggagacauuucuguuuccuggaacgugguagguguuugcaccacagaaacggacagggagucaucaacuucuguggaauguggagaacccaccucggcaugcagagaaggagacacgucaucugugguuggcucuggaaacgaacuuguagccacagaggcaguagagacggaggccacacccuccaugugggaguaggugucuucugccacacccucauccacagguguggcugacuugucugaaacagugccuucugaaauggacaucuuggugucuucuuugaaagagccaaacugacugacgucuauuuguguuggagauacaucuccucccaauuuccuuucauccaaagcuagagcugauugagaacucaugguuucaacaucacugguuuucuuuucuggaccaaagucuuccuuuauggguaugaagcccgugcuuuucucuuccuguuugucuugguaaagaccaguggaagucaggucagaaacugggcuuucucugucugggaagcccugcuuuccauucuucccuucaaaggggcuuucggaacgucugccaagaaccuugcuaucagcacucaggaagucuucauauggggacucagauccaagaaggggaggacugcguaaaggagacagaaccuucuccacaggagacucugagucaggcacaggcucauccauggggcuuagggacgcucucucguucucaucuuuggccucacugaauucaaagcucacuggaacugccuguggcuuuucagugacuucuguggguaggugacuggacuucucaucggugggagauugguaguaagguguguggccagcacugccugucacagacugggauggcgacacuacuuccagggucuucuccucaggacuggcacaauguucuucaacuacugccugggucacuccaggggacacugaccuugcuucucccucugcugacacuuuaaucucauugggugucagagagaaauucacgcuacguucacccaggggagucuucucuaugggggauggcggagaaggacucagggauggacucuuggcugggcuaagucucucaucugaaacaucuuugaugucuaacucggcacuggcuuucaacucuuucucuucugagcaguaagcaucacgaagagcagacuugcugaauuugucuucuuccauggacgaagguggugauaugguggaggcggaagcguuguaauccuuaccaucaguggcgucuguuuuugacccuucugacaauccauugaaugaugcaacagcagguuuggaguacuccugagaauacagcgaggacucauauuugguaauguuuacgaacuccugagauggggacucugucuccucguuguuggucucgucgcucaucacaucacgaggaguagacaucucauccauuggcguaggcucacuagauaucucaaugguagacugaguauauccagagguagcagugaauuccucaggcuggucuucccgauucuccucauccgaagcaguggccucgcucucagagccuccagguagggucucaucaugaauugaagaugcagguucucggcuaggagacuggauuccagguugcuuggccgacgugcccagguauccguacugcuccucugugacuccagccucagccgccuugucagccacggccaucacauaauccucagccucaguuuugucgggcucauagccuuccucucuggcauccucugcuuuguccuccucuucgcccucuuccucagacuguucagcuucuccuuucucaagcacaucauccaugucuucuuccgcccggucgucaccacugaccacagacucccucuucuccuugaggugcacguccgccucagccuuugcgcuuucgucaucuucuguggggcugugcuuagaggcacucccgcucgcauugucuuccccguccucuuccgguuccucagccuccucaguuuccgccuucucuucguagucuccggucucugaggauucuucaaaaccagcuccuucaucuucaaacuucucaaugucauccacgcccugcuucucaacuggcuccagcuccucagggguuugcucacacucgcccucccccucggugguggugauucccucaucgggugacucagcggaaccuuugcugacuuccgucucuuucuggaugacguaggcuucucccggcuggguuuccuucaguuucucuucaucuucaaugagcuccagcugaggcuugauguccuuggccacaucaaucuccucagccuuuagcuccucaaaguccuugguuagauccucaggggaggacauaagggaccucucagcuuccaguucuuugacaggaccacuggccgcuauuccagcugcagccaccacggcagcugugguggcagcagugccaacagcuguggcagcugcuucuguggucuugccuuccuuuuuaaugacuuugacuuuccccuuguccuugaguuucccagcagcaagaggcuccuucuuaguggacucuucuuucuucgcuacuuuugguuuuaacgcagauggcuucuuugugucugacagaggaguugauuucuuuauguccuuggagaucuucuugauuuccuuuuuggguuccuucucuuccuuuuuaacuucuuucuucuccucuuucuucaccuccuucuuggcauccuucagggguguuuccuucuucaccucuuucuucagcuccuuucucucuucuuuuuugauuucuuucuugaucuccuucuucaccucuuccuuucuuggcuucucgucuuucuugagggguguuuugucuuccuucuuaaccacuucuuucuugggcuucuccucuuucuuuuccucgaguuuugucuuuauuuccuuuuuuaccacuuuguccuuggugacuuuggguuugcucucaguggcuugcuucucagcgaccucggcuuucacuggggacugcucuuccuugcuggacaccuccuuuucugucacugaagguuuacuuucugucuuuacaggcuugucuuuuuucacuaacacuuucucuuugcuuucaacuuuggguguuuucuccacuugacuagucuuugugacuucagggguuuccuccuuggacuccuuccucacagauuuacuggcaacugguuucguggcuggcuucagacucucucggcugucagcccgcuguuucaguuugaccuguuucacugggggggugggcaccuggccagugagaucuuuuuggguggccaguggcugcuuuaggaaaucuagauguuugaguuucuccaguccuucuaggauguuguacuggguacuguuuccgggaaacagaacccgaaugauuuucucagcgggguuggccggaugccacacaaucaaagaugagacugagguuaaguaggaaaucgggaugucuacuucuugaccauugggcaggauuaguucggccuugucuuuguuggugccaguccacuguugcauaaaauacugcauuuccuugcugcuuuugacuggguuaagcacguacaucucaagcuugcccacucccaucuucuggaacaggaugacaggcucaaugguauugccuacacuucuaaauagaggcucugguuucauggacaguuuguuuaaguacuggagagugaagcaugcuucuucuaugcuucucuucaucuugauguuggguucugggucuuucagguuuucagguacguugagaaacacaacccccaggucaggggagaugagguuuuucauccagucacuguugcugguggaccccugggaccgcuccucuuccagcucugcaaucuugcgcugcagcaugcuauugaucccaggcaaauugucauccccaaugugggugagcaggauggaguccacacgguccaagugccggaugagcuuccagaagcaagacuuucucucugauccuccguugaugagcauguugaauccguucacugcaaacagggccgaguccccacggcccccugggaaaauguaacagcaaggcuuggagagcuucagaaagccgcccgagguuggggguuccaggaugucaaagggagaggggacuucuacagacucugagagauacucggugaacucagaaagucccuccauuucuggcaagauagaagcugaguugagcuuaauguugaugaagucuuggagauugugucugucaagguuggaguucuuccagucucccuccucgggacagaagagggugaggcuggcuuuguuggcaggguggguggugcuuaggagcucaccaaucuggguuugcaaacagagaaaggggggaaagugucagugaugucaccccuggcuuaucaucuccaucauugcuaguuauuauaggaucacugacuuuacguaggacuuggccccagcacuugggaggcaaaugccagugguuuuuucugaguuugaggccagccuggucuacaaagcaaguucuaggacagccaggucuacacagagaaauccagucuucaaaaaacaaacaaaaaacaaaaacaaacaaaaaccugaccauuacuuggccauggcccugacuaaaauaucgauaaacuugaagguagacagccucuguucugaguccccauuuguauucucugcuaccucagggucucugcucuaagauccucucccuguauguucuugucccagaacccuguuccaguuccaaaccuggggaccaucugggugacugguguuuauaucacagcaguuauaaaauaacuugaauauugacucuggguguuugucaugcuaagauggccuuuaaaaacuacuagacaaucccaggagagaagcuauccaucacuuuaccguggguaaaguaugauuucuuguccaacaauugacauagacccuccucaccacaaucucaacauggcaagggcucucucauuccuaacuuucacacagagcauaugagaacuauccaugcugugcauuuuuugaggggggggguaucaaggauaaucgaaacugccaagucuuucacagcaaaaaaauugaaaacuaaguucaguuccuuuuaaucucugagauccagucuagcugagcugaagcaaacugaagguccaguguagccggaugcaucugggauuauucagucacugacuuaaaaugauauuucuagauuuauuuauguuguuuuauguguaugaguguuuugccuguuugugcagcacacauauggugcuuaugaaggacagaaaagggugucaggaugguuguggaccaucaagugggugcugugaacagaacccuccuccuccucuggaagagcauccaguucuugagccaucuuuucagcuccuaaccauuagcuuuuuaauauuuuaaaaauuuauuuauuuauuauuuuuguuuguuuguuuguuucuuuguuuguuuuguuuuuucgagacaggguuucucuguguagcccuggcuuuccuggaauucacucuuuagaccagguuggccuggaacucagaaauccuccugccucugccucccaagugcugggauuaaaggcgugcaccaccacugcccggcuccauuagcuuuuuaauaugaaauauauagucaccuaguucaaggagaaaguaagaugauuugagaaauauuauccuacuuucuaccucuuccugucuucagagaguuccuaugaaaugcagaaaaugacucaaagaauucugaggaagccagggagcauggagcauagaaugcuacaguuuaaggagaccagaaaagcaagccuccagcacagcuggacaagucccucuccagacagggaaaaucuaaucacucuggaaaaaaacaucagccugcuguacacaacaagagagaaggacaaagacaagagcuggagagagcccauuaaggaggcagaugggauaggucaggagauaggagagauaucacaacauccuuggggcuacccaagagaaccacagccccuguguuuucccauagugcagcuccaggccuguaggauaaauaucaggaugaggacaggagucaagggcaacagguaucuuaagauacccacuccaugguggugcucaauccacaccucugcagugaauggugagaccacuagggcuuuggcaaugcuggcaguaguaaggaccugaggacuaguucuuugaaacuggggcugcuuccaaaugaacugggaagccauguucauuggcaacagcagccacacagcaagcccuauuacaaugaaaguuucgguaucuuuguuuccccaguguauaaccagaugcaguacacuagguuacauugcauuaaauuuggucaguucaauacaugcugucuuccugcagcugggacaagugccugccgaugcuuaucagacagagccgguuaucaugguucuucacagauggaugauggacaugagugggcguaauacugcuuugggauaugauugucucuuuugcucauuaccuuuccugauuaaacgcagacacacggaaagaggaaggaagauacaggaauaaauggcuuuacugaagauauugcaaaacaaaugauaauuucuaaaccacgaacuucuaacuacguuuucuuuuuuugauugaaugaccugcuuagcuaaagaggaaauacuauagacagugugucucugggcuuuggcaagacauguaacaggaucuuggaacugugugauaagcaguauuacguggaauuauaagcagugguguuccuuagugucaaacaggaggaagaucugcgguaggcugcuccaaguucauuccucugcuguugaguaucgauugacugggaugaaaauggaacagacgcgcucaucaaagcugugcacagcuucaaaacgagaggaguaagggagugugggacgguagagcuaagguguuuaggaaagcuuuggacuuagggcauaauggcaaggcaacugucaacagggaggcauucuaaagggauaaauguaagggccagcagccagcagauaaggaugggcuuggaagaugcagcuuaacaauauccaugggaaaccuuggggauuuuaguugacaaucaaauggauuuauaugaagccaaagaagcuuaaacuucaaggucccuuacuggcuugguccucuacugaaguaccauacuuaaaagguuuauuauuuuucuccauauuauguuaauuugaagaaugccucaaggcccguauuucuucuccacugacaccuaaucaugcucugagaaaauuagacuuauuuauuaacuggacugagaacugcucaaguugcugacucuggugacacuaaucuggucagaugauuucuggaaaacagggccuagguuagggcaggucuaacaaguuguauuuauuuguuuccauuuaguucucucucucucucucucucucucucucucucucucucucugugugugugugugugugugugugcgcgcgcgugugcaugugugcauguguguguauguguguauguguguguacaugcauguguguugaugcugguugucaaacucagggucuugggaauuccaggcaaguauucuaccauugagcuauaaucaucucccacccaaauugugacauuuuagagaaaccagauuaagcaaacaaaacuccagaaacaaguccuacuugcuggacccuucucuuugacuuuaaccucuagaguuuuucuuaaugcuuucucucuagaguaaagcaucuaucuucuaggcucuaaauaaccauacuaugcaaauggauuacaaauggguaucucucaccagcucaaagucucuuagcucuagguucgaauauccaccuguuugauaauuccaaggugucgaagaauggcaaguucugaaagcuuggauaccccccaauaccuacugugacagggaacacacagggccuuugcauuuuauagauaacuaagaagaaaacagaagauacucuaggcuaugggugggaaugaugcuauaggugaacucaggguuaaagucccuucuugaagauauaaugcaacagaaagaaaagccuuuuccauggaaagguuggaaaacggucucagaaauguuugcuuuucuaauguuauguuuuguuucaaggguuggacaaagggaacaagacugaacagcaaaugaccucaaaugagucauucugcaaaccuuccggguaaccacagcuccaaaccugaguauccaucggucuacucuacugauuuuuaaacauuuuuauuaacugugcccgcguguaugucuguauaguacauggauccagugcccuuggaggcaagaagaaguugugggguccccugacacuggagucacagaaaguugugaacugccaugguggugcugggaaucaaacccgggucucuggacgaguagcugguucucuuaaccacugcaccaccucuccagccccuagucuaguaauuuucaaucuacuuuagcuguagcaaccuuucuucaauauuuagguaaaagaaauauaggcugaguuccucgguuuggcaggggguagccacgaauucuaccuuccccacuuccugccaccccaccaccccaccacccugaucuagucuauuaaaacuguggcgagccuuucacgugcacugagcauggcuuccucuggagaaggugggguaggagaggagaauaugacuguccauggcaucggugguggcugcuggauguaauaauguguaagccacucagaacccacauuuaugauuacaaaccuggagacgcugucccuucuacagaacuugaagucuuuagauaaggcuuucuuuuucuucguaauuaaugguaaaguugggcacacgcacagcccacuguacaaaaauuccauugcuaggucuuuaaaaagugauuuaaguggcaacuucauaaaaccauucuucauucucagagaggggauuacuuagggcccagaugaauggcauauggauaccuccuuguguaaagucuuggcaaugagaaaaugcuuuuucuuacacauuuccuuuauuuggcaaaggagcuacagaacuguacaggaguucgggaaagcacccacgugcaugcaaaugaaccaaaggcugagggcugagcugaucuuaccagcuguaucacuuaaccacccuacaugagauuggccacuacaacucaaucccaucccuuggacaagaugcugacaucuggaaugccagacaaaagcccaaguaccuguuauagcacaugaucuaagaacagauuuugaaaaauaacugguauuugauugacuauucaacaguuucccagcagucccaccaggguaaaucauagcucuuucccuggcauuucagggcaauugagcaauguggcugugauacagcagggcauuuggcuuagcccuggggguggaggaagcccagcucuagagaaagacacaggcaaagcuuccaccuuaaagugggaagacaggcuagcugugagugugcacagaggccuccgagcaaggagccacuugccagccagggaucuuucucacucuggugagcuggugcuaugugccuccagauauagaugaccucacacccucugaacaaacuggggcuccacacacugaauagaaaugucccuuuucacacuuccaugcugucucccugaccuaugucuccgugcggagagggaaaacuggugugucaucucuccaggguuuuccuaaggccucuaggugaaaccgaaugaagccggacaguuugugagaggccaagccaugagaccucucugugaagcguggggcugaggacgacugaaggcugggagacacaugguccuucccaguacacgacacaccaagccugccaucucagggagacagcucugacugcaguagcucccggaagugcaucucucaguccacuccggccggaccccaccccagcuucucauccugcugaaguccaagagaucuguggaaaaaucucugagaaagcaggaaagcuguguuucuccuggaguucggucgguucuagugucgcuagcacuucugccauccguuaaugacgaccauuccaaaugcacucacagugcccaccgacgucuccuccagcacaauggccgagguugcacucauccaucgaucguaauagugaucaaucccaggccuaagcaauuuugggccauaguuuugcuuauuucaaagaggccccuccuacuaccuucccccacacauccaagcaauagcccagacacgaugcccggaacccaccucuugaucugugaaaaucucuaugaaguucuggaaggagaaagagccagacugcaggaugagcucgccaguguucucaaagcacuguccggugagcaccagcaguuuauggcgggcagcgucagugaucaucaaacgcaccugaaacacagcgaaggcacagaguaagggagggugcggaguaagagcgagcuguccccuuccccgcccccaagucccaggcacuaugacugugccugaagcuuacugccaaccaaacgcguucauuccgagugucuaauuacuucagcugagagugggggcagggagugcuggacagagcccugccuguaaguuauuccuaaaauuaaucaucgugguuauuagugugccagugaaucccguguugagaguuuuacuucaacccaaaacagcaggguauuauugacuuucucccugagucuccuccucuuuucaaaguggucuucacagcuggcaagcauuuguuccacagcuguuauaaagaaucuacuagcagccugcagccugcagccuaugaggccaggugagacuuguggcuaugccaauccaggucacccagcuagcuucagaaaagacauguuuccaagcaggccucaaguuccuacccaggauuccuuucuugcaguccuuccagagcaagcacaccaugacaaaugcagacugcagcguuugcaucaagaagcuugacgggacaggggacagaagaaaaggcgacccuugaguggcgaucugagaaacugaauugaaaauaacuuacgcaaaagaaccuuugcuggcagggaggugggggaggggggccaguuguccucugcgggagcacuacccucugaaccaagguucugaauucaguucaugaauguuuagcacacacuacgugcccugcaucauguucugcaccagggaaaauucaaaacuaaacaggccaugaccccugcccaugaaccccacaggccacacucauagaaaagcaugcauaccuaagcaguugucucaggcucauguggcccacaaaguagcuugauacuuccaacaaaagcuuuuaaacaaacaaaaaacaaccaaaaaacaaaaaacaaaacaaaacuccuguuucacagcuaggcagucuaccuggguacauacuagcccuccggcuucugggugacagaaagugccccuggguuuucugugacuucaugccuaauuggauugucagagcuuuugcacgcagaaguaggucaaaacaggcccgauuacgauagccccaaaccgaaagcaacgaaaguggcagaaacuaagaaaugaguuaucagaugucuacaaaaggaugccacacaauggucgaaaggagugcgggaccaacgugcuacacuuggacuagaucaugacgccacuaagcuaaguuaagcuccacaaaagaggccacauguuguaugaugccauuuguaugaaaugucuaagacaggaaaaaaucuggagagagaaaauagggauugucagaagcuaaggggcagugggauaacugcuaauggguuuaggaaauuuuggggagugacaggcauguuuuggaguuaaacugcucauuuuuauaauaauucuuaaaaaaaaaacacccacaaaacuacacacuuucagugaaugagucuaugguucaugaauuacaucccaauuugaaaaccugaauagucagaguugcuaagacaccggcagaagacacacacagccuaggcuaggauguugccagggccuuugguccuuaaugcucaggaagcaacucuaucucagaggagguggaagaggagcucuaucaacgcuuggccugaggggaccagagauucucuuggcuuccuccaaauucuuaugucaggguggguccugaaauugccaauuacucucucuaguaguaaguauucucaugugaugcuaaugauacagcagcaggagccagcauguacaucuuagucacuaugugccacacuucuucuaagcccugagcacuucagagagcauuacauaggagcauuaaauucaggggcuauuaugaucuccuucacagggaggggcaaaccgaagcaguaagauaacuugaccgaccuuggaugaugaaaccaggugauuugaccugggcuagagaccauguuucugaggcuggccugccuuccaaggguagcuagugcuggccuggaucucucugaacagggaugcuauugggaugcucgucgucucugaguuccaucccuguaugugccagccuggagcuugccgucuauuuccucugcuacauucuugcucugcauccuggcaacaacauacccagugcauaccccccauucuacaccccucaacaaacaugcuuccagcuggcacuguucgcuuguguccuuaauugaaagaggcuucuggugagcuggugcuaugauacuagaugcagagaagcaggcucugggcaucgaggaagccuaggaccugggacuuaccccuuguacaucucucuccaacucccccaccuaucuagccccuuugaucagccaaguccccauccuuggaggcucuaagaccucccagaacugaaauacucaccucagugcugacggcuucaucugaaggguugaucagaacgacuguuucuaagacgucacuucggugaugaagaaucuuuuguccugaaggcacaaaaaaaauacacaaagaagagaccuuuagcucuuccagaugaaagcggcucgccuacuucugggacagcagagaaauuuccaacucagauguggcccuggaagcugggaaacacaguggaugcuacugagcacgagggugugcacacaacaggcucaacuggagcugggguagccuggggcccccaggcuuuuacacugggucuuucauggucgauggcuaggcagccuccugacccaauggccggguuuucaucagagaccagggaggggugccaggaaaacucaguggagcucuugacauuuccuuucucaugguaauuggggauguuucucccuaacguccuuucuucuggugagaacggcgcggagauuaauuaggagccucauugugaagugaaugacggccagaaacccgacuaacaauuaacccagcagccagaauggcugucugaggcaggcuuacggucuguugggguauucacuaauuaauucacuugcuuguaggaaagugaagaaacagugggcaaaagagaaguggaaggcuacccucccccaggacaggguggccaaacugccccacaagacaaaacugagggagaacuaaaguaaggugugguuugggaugagggaguuuaaggaugcucugcagggcucuugauaucucccacuccuuacagcaccauccugugcuggucagccucaggcuuaggucagcagagaccuauggauugccuucuacaaacauuacccugccuugacaaggagaugaaagccauccagugaauguagccagagucgcugauguaugcuuuaccagcaaacaacggacagagaggggcguucccucggaaaugugggaggaagccacgugguugggagggaaagcacgccugcuguuuggaaguacaaugaagccuggaagacuggaagaaacaggagcuucugagggagauaccaacagagaaaaacagaaggaaaguagaucuaggguucuuggaaaagcuaaaacagaauccuguaugaacugccauuuaauugguuggugcaaguugaaaguaggaaccugagcaaauauuucugugcuaauguuaauuacagcauuauuuuaauagccaaaagauaaaauaacccaagugucuggguuagauguggucuacccacaacggaauacuagucagaaauagaaaaaaaaaaaaaucaagcucugcuaauguuacaaagaugaacuagaacauaagggggaaaaaaaagcugaacacaaauggauacauaaaauaguacuuuaugcccaugaaauacccagaauaaguaaauuuaaaauagcaauuaccaaaggcuaaaggagggggaauuggggagcuauugcuuaauggguacuaucccauguuugggguaaugaaaacauuuugaaaauguaagugaugacauauacaaccuuguagacauauugaucacuccugaguuguagauuuaaaaaaaauaguuaaaauggccaauuuuucuuuauauguauuuuaucacaagaugaaggaucaaugagacagacaaguaagcccugaagaaaauacuuugcgugcgugugugguauauguauauacgcuaucccaggaaagccauuagaaaggaggcgguuccaggcucgacucagcuggagauuuccccuuuguauuaucaaggaucacagaaacuagaaacagcugcuuagagacauucuacucaugucaccauuauugaucaucccugcuuuuccuuacaguaacauuuaccagucaacuuuaggaaggcagaggagcagcccaaacuaaacaaugcuggugccacgcccuguucugagacccauacaguuucacugaauccccugaagugcucucacacgagguaccaugaccauggcucacuacugaagacaaagaguugacagaggacaucgaguagcucaggacgccacaacagggucaggucaggccagggucuggucccaggcugcccagcucuagaucccuucuggauuuaaccacuucugaugaugcuagcuaguuaucagaacuuggcuuuggcaaaacugucaucagaugcugaagaagaguuaggggaaagaccaacagacuaaaaacaacagaugggcuuaaagaagcaagaugucagcagagaauaccggguggucaggcgaggcacagcaccuauacacagcaaagcaaaaauuaaauagaaacaugaaauguucuacugcaaaagaccagucaggaagacacuccaaauaagaacaguguuaacugcuugagcaggcaaagacccgaggcuuaggaaaaagaugccaaaccauggaagacacaguucauuuaucaugaaugcuauguuuuguaauuaauguaaaauuugccuuuuggcuguuuuccucuuugacauccaugcacacuuaaagcuaaaguaaacacaauucaaauaagcagaugacacagugaaagaucacacaaaucuauacuggaucaagucgcccuuccaucaguggccuccucggaacaaagacuuugagaucuucuaagacaagaaugaagcugacauuaaccaauaaaggaauggcuguuucuucaucauaucuuugaugugagcacccagagcauccgacagugugagaccugguaugacuauugucauuaacugugcucuguaggagucacagaagcaagccaaagcaagguuugcagaagcaguccccuccccgagagucccuaauggagucagagcccuuucucugcugcugacugcacccuucaaaagcaacagcagcuaccacaaccacgcuccuaccugcacacaccagcccuccccagagaagucuccagcugccucugccaggggcuucuuaccguccaccagacacucuuuuccuccuuggcuuucucuguugccaaacagaacaaaugccacguaacagcuguuggucaccuccacaaucccuaagucauguuucagagcagucugcccaggaauucagcuaaugaugccuuguccaucuuugugagaacucggagggagaacacugacaacggaugugcgccaagaugccuuuuuguagaguugauuugaaggaaggaaggaagggauggauguaaagacagucagagagagcucccaguucuugucuuggcuggaauguuguccagauucaaccacaagacccguaaccgaaggucgggccucuccagcaucugccaagacaagggccucggcugagggacccgucaguuccccacacccugcaucccugggugcccacucgcucucuggcagcaggcggcugucugcucaggcagcugggaugcucacaaagcugcauauuuggggaauguuucacacugggaagagggccaggcauucucagggagaagccaccacccuugccuguaaagguccccauucaguggcuucaggaaagaaguucccagccucucuccucacccuuuagucugcccucccuauagauaccucauaaagaaaccaaggagcauccuaugaauagcuaacccuccucagcuuuguggaggauggacauggagugauggaguugugucaguccguuuccauaugaaaaaaaaaaaggucuuugaagucuuccuaaaaaaauuccacauagcugugaggcucgacccggugaggugggggcaacagagaagguugcugcuaugugacaaagggucugcuccacuucagaaucaaaagagaaugaggaccccuuggagcagcagggcccuucagacaauggggcuuuugucuguggucuccuacagcuguauuugaaauucaaacagucuauacuuugcaguuauugcugggauuuuuuuuucuauuuuuaaaaucguauuuaauugaaucuacuugucuuuugaaguuggguuauuuuguugauuuauguucacgucacaucuaggugauuucugaaaucuuuuaagguaaaaaaaaaaugacauuuucauguuuccaggauaguuauagaucuccccagggaguuuaagauuuuccucucagcauggguuugacacacaacacauaggcacccuccuggguuucagagguugacuguggcuaaauucaggcacucucaucacagaggguagcaacacagaaccugggcugggauagagcucagucgguaggauacuugucuggcuuacacuaaggccuagguuugaucuccagcacugcauaaaucggucguggugguccaugccuguaaccucacccauugggagguggaggcuugguaaucagaaguccaagaucacccaauucaaagccagucuggacugcacaagacccugucucaagaaaaacaaaaucuagaaucgcuuuuguuguuguuuuguuuuguuuuucaagacaggguuucucuguguagcccuggcuguccuggaacucacucuguagaccaggcuguccuggaacucaaauccgccagccucugccuacuaagugcugggauuaaaggcgugugccaccacugcccagcuagaaucucuuuuuacauauggaugagucuucucucccacacgcagagcaacugggaguaccgaguaacugggagacugaagcauccuugcugaggccagagcaacuccgcagcauccuuggcccagaucaaagcaucaagguagcugagcaaccuccugaugaacacagaacugcuaaaagcuuguuuagcucaacacccaucuugaacuccccuucaacgauuacaggccagagcuuuauuuaaacaacuucaguuuauuaacuuguaugacagagagaagaugaagcaggaccugaaucacagacagccaagauggcggucagggggaauuccacagguccuugcuacccuaucucuaccuuuucuccugccaguucccacugcugucaugccuuuuccuauccccucccaccagucuuugcgggcugaacacuagagugacuguuugaucaggcaucuggucuugugaaccaacacuagaaucuagacuccauugugaagaugaaagaacauccuaggguuggguugggagacgcuugggcuaaagacagccugagacugcuucauuaaacauaaggucugaucacucaaggacugugaacacccugcauguuaaagcaggaaaggaggcagggagacggaccuucaucccaaccccuccaucacagaagggcugugaaggggaaacccucucaccucaaaccuuugugcucaauaaaacuccaccggugaaguuuagcuaaauggauaaaagcaagaaucaagagcugugcuucacagccauggaaaucacagcccuguggucgguaauuaccuacaggucucuaggcagcguuuaauaacaucuuuuauuuaaaaccauaaccaggccuccuuacucuaggaacccacauaauaugcagggcagauguguggucagugugaagagaaacagagccgggaugggaggaauuaacucugggaggaaagcaagaccugccuuggcaggaacuguggccaaacuucccucacaggguagaggugauacaacaggagaggaaucugugaagggcccaaggcgauugguccccugugagccucugcccuaccuguguuucuaaacaggaaaaccagagucugggugaauauaguuuaucaggaacagagcuucugagaggccacaauuagcagauucccacccacccccaccucugcccacccuccccagccccuucccuccccccuuugcacucaggguuagaaauuggaagaagcaucuagaagagaggaugaagcaaccugggagcaaauaaagccaccuucauguucccuagagccaaaaaucaccucagcguagagagacaugaccacaagacagggaagacaccaaacccuuaaaggcugcuuucugagaagcuugagaaaacaaaggcgcugggggacuugguaucuccugauugcuaggaucccccaaagaccagccuuggcgucagcacagaaaacagaaagccaacuguuuaucaggaaaugauacggcuucccucuggggagacaacgccuuucacccuauagggaguuugaauucuccaaggacuucucucaucaagucaccuuguucaucucuucugacuuaccaguuuaaccuuaggcuugggaaaggaacuucuagccugguaucugaggcagcaggaccagagguagaaggcaacccaaacauaauccaguggaaaggcugaccuuacgagcauggggaguaagagaacguuccaugugggagcugccaaucuccuuggaucacaaguuaacuacaaggcugaaagcccaucccaagaacacagcgaccaaaucuuaaauguggagagugauuuaggagagcuaagcauuccgucuugcagguggaggcuguguuuaagucuccuaacacuccaaagacagccugagugcaaacauucucuccucuucauggaccacaaaccugaggucuaaugaccugcccaacuucucauggccaaggucagggauguggcguuaucccuuucacuccuccugagccacucacccaaaauaaagguugccugauuuuaaagccaacacuuccuuuuguaagagguuaacacacagcgugggccagcugacagucauccaaaaucugcuggacagcgugaucaagccuccaucaggguuguuucugcugaauggucagccaaguucucccccauccuccccgcugacagucccagaaaugagauugcuuuccuguugaaaagaagucuuuguuuuugauguuucagcucuguggcguguccuucacagucacguuguucuucagauucugaccauuuaguuuuuaagagaauuaaagcaucgaaucccauuguacacaaauccggggcguauucugaauaaucuauuuucaguguaaaugagcugaucagugcuuggaagcaacauggcuccuuuucaucagcuugguuuuacaguugcagacaauuccgugauuugagucuauaucucauuucccuacacucccuugccguuaacuauuuuucuuuuucccugucacuggcuguggucucguuuuccaaggugcugggccuuccauccauccuucccuugggugcccugcccuccuggacuucauguguucccaaccuagaaacaaguaacuaaagagccaacucccaagguucucucugucccaagcugguccaaguacguagagaucaccagccuuuggcuauagcagucuggcuuugccccugcuggcaggagaguccuuguuuuguguuccauauucccucauccagaauuugcagugcuaggacgcaaagcaguggcuucuguucucuuugcaaaguucuuauucacuuucuaaaucgcccaccauauuugucucccucuucagcccuucccuagccucuucauuugcuuuuuaauaucuuccucccaccaucuccccuuuuuucucccuuccuuccuuccuuccuuccuuccuuccuuccuuccuuccuuccuuccuucccuugccuuccuuccuuccuuccuuccuuccuuccucccuuccuuccucuuccuuccuuccuuccuuccuuccuuccuuccuuccuuccuuccuuccuuccuuucucccucccucccucccucccucccucccucccucccucccucccucccucccucccucccucccucccucccucccucccucccucccucucucucucucucucucucucucuuucuuucuuucuuucuuucuuucuuucuuucuuucuuucuuucuuucuuucuuccucucuuucuuucuucccuuauguguaauuacaugucugcacauauuuaugcacagguauguagaggccagaagagggcacuggcucuccugggacuggagcuguaggugguugugagcuacuugcucaggugcugggauauggacucuaguccuuugcaagaaaauagcucuuucucccugagccagcucucuagcccugugguuucuagcccucuagcucaaccuagccuccaacucaugauccuccugucucauccucuuguaggcauuugccaccacacccagacccucuucacuaggcuuucaaagccuccagacaaacugucaaggguuagaagugaacaguggcagacaaaagaaagaaauaucaacaacguagauaaaaucaggcucccuggaggucaccuaaagaacaaacaacacccacugugggccuagacuuacaggauuggccugaggucccaucacccacaaggcauuuacuccacauggcacaucagauacagauaggucugcccuguucaggcuccucaggaccacaucaggcucauuaaagcggaucagcacgcaugacucacugcagcacucccaauaugcuccucuguguucauucuguuuagccugguccaagccucugaaucugcuucccuggguuuggauagggugggaacuaggagcucucucuuccuuucucaaccuccccaacacccccaaauuccaaaucccagcaacaaacaaacagacagacaaacaagcaacaauaauaauaaaaccacccuaacacagaagaaaaucgucuugcuccuuauguaccagcacggaguucuuuccuuugcccugaagaugugaggccuccuccccagucuccugaggauuggucgcucucaugcuggauggagucugaauuugccuuuuucaccugggacacccgaaggaacccuggugacaguauuuuucccccgcucuccccauuuuacagagaaggaagcuucagagaagaucagaccugcauggcuuuauagacccugacuuauagaugccaaaagauuuccuauggauacaggggaacauuuguacugggauuggguaccaaacacuugguugccgggauuugaacucaggaccuucggaagagcagucagugcucuuagcugcugagccaucucgccagccgccauguugucuuuucuaaauacauauaaaaaaaauguaccauuguaaucccuccuacuguacagguagagagguugaagcugagggaccaccuguuuaagaguuggcugucucaaucacacagauacagugagcuggucaaguagaaguucaauccagccauaugguuccugacucucacuccuuacauuagcuucucagaaugucuuaagauuuuacaguuaaauuaacuuuuuuuuucuugugguacugaggaaugaacucaggauucucuugaugagcuacacucccagcccacaaggcuuucuuaaaaaaaaaaaaaaaaagguuuauagcuggguguacugcaugccuuuuaucucagcacuagggaggcagagguggguaguucucugaguucgaagccagucuggucuauagaguaacuucuaggacagccagggcuacacagagacacucuaucaagaaaaacaaacaacacacacauauaauauauacauauauggagagagagagagagagagagagagagagagagagagagagagagagagagagaggugagauauauuuucuuagauugaaaaguaauuccaaucucugauaaauaauaucggggccuuuuauuuugaaaaccaccugcuacgcgucuuuguggugaguuagguaguaccaggagauuauuaauaccggcacuuucaucuuaaaauuacauuuucuuagguuuucccaaucagauguaacugccuuuguuugugugguuguugacucugggaguuuuguuugcuuguuugcuuguuuugugaugauuaguauugaaugaacuagugccuuaaacaugcucagcaagagcucuaccacugagcuacaccccuggcccuguucaacuuuguuauuuugagaaaaguucucauuaaggugaccaggcaggccuugagcuggugguccucuucugccucagccuuuugaguaucugggccacuaaacccagcuagacuuucuugagaagaaaguuucagagagaguuauuuaaaucuucggggcccugcuaccauuguaaaaagaagcguuuccuauuugugcaggugauacucacugccuacagaggacagauuuucuggaacuuaauucaggcggaucagcgggaucuucuuaaaugaagcucggggguuaaaauaugagugacacccccucuguccugaagggaauacaguuuaaugggggggcucuuuuaacucagaaaaccuaacucugaaacacugucuuauacacaguaggaacucaaucaauaucugaugaaaggauaaauaauaaccauggcuaugauguauugaauauauguccuaauucaauauugaccuaaguucuuuaggaacauuaucguuauuaauguguacccuagaccugcuaggaagacauuguacagauaaggaugaggaacuugaagcccagggcugugacugucccuuagagugaggaccagaggcagugcucagucuauagagucaggucagauacugggauaccaucuuauuuuauuauaucauuuggguuuguuuguuuguuuguuuguuuguuuuuuaaagacugguucucacuauauauagcucaggcuagccucaagcuuguuauuuaacccaguucauccaugaacccucaaucuuccuacaugauuagucuccugagugcuugagauuacaggcagagccaccaagcucaacugugaggcucauaauuaagguauuagauuggggaggaauaaggagagagagaguuggggugggggcgggagcagauagcaaagacagacugauaacagugagucacauggguuauacugcauuuaacguccccacggccugcccaggcggcuagguccaggaguagauggaaagauggauccaaagcuugggucacagauugagccagaucagggucuauuuuuaguugaugcuguuggagagugcuucgugcuucucucugauuauagucuagagaaaugcccauaauuaaagggcaagcagaggcagaaaaaggcugauggagaugcuggggaaaacaaaggggagaugaacucccaacccauucugcgaaguuucaccgcacacaagguaaccuguaacugcagccuguucuaacacagaacucuaaccaccucuacacagaauugaggcagaauauucuagacaccaaauaaccuaaugagaacugacguucaaauucaaccccaaacccucuugguuugaucuccacagacacuaugauauguaaauaaacaggccugccauaauaggccagccaccaagggacuuuauaaaauucuccuauccauggauccacccuuggacauucagacucaggaggucuggagggccuggggcucugcacuucugcagucuccuaggugaugcagauggcucugaguuuucuuuaagaaacaagacagugugacaauggcugcuccaaugaucaguaaggacacaguaaguggccucacuaacaucaucucuacauuguucuccugugccacuugcccgguguuucaacauaaugcuagaauuauuucccuugggacaaaggaugaucauuaaaggcucaacuaauguuucccacuaccuauugauucucagaaugcauuaacauguuuauuggacauuuaauuugccacccaaaacuccaaccauugauuaaauccaaggaaacggcugaccuuuuaaaaauccuccccugcuccucucagaaccaaauuaucaugcuguuacucauucccaaagccaucuugccuacaaaacaaaaaacuguguugguccuuuuuagugucuggcuauugaagaggaaaaaaggaaaaggaaaaaauacugauagaggacagaacgaacacacguuaaacauagaaccaguuaaagcaauuaucccaaccugggccagucuuugguucuacaccauggagaaauagcaucaacuggauuugguuuucuuguuuuuguuuuguuuuaggacaggaucugaaguaugccaggauaacuucaaagucacugugcagcugaguuugaacucuugaucuuccuaccucugccuucugagggcuaggguuacaaaugcuugucuccgcccacuuguaaaugauuuauacagugcugggaucaaauccugggcguugggcacaucaggcaagcacucgcucuaccaaaugacccauauccuagccucaugggccagauuguuuuccucagaaagucacguggguaaaacuaccugcaauggcagugacugaccuaguggcccaucagaaaaggacuucuuagguucaagaucuuaaccugagaggaugagacucaaaagacuggagaccuuuccucaacugaagugaggucccaguugcuaccauccauagcaggugacauacagguggcuucucgggcccauucgagacagugguucucaauccaugggucaagaccccuuugggagcaucaaaugacucuuuuaugggguugccuaagaccucugggaaacauaacuauuuccauuaugauucauaaccguaugcaaaauugcauuuaugaaguagcaauggaaauaauuuuauagugagagggucacuacaggacgaggagcuguauuaaaggguugcagcauugggaagguugagaacuuaugaaaucuggccaucucuacagauacuucauacauagccucagccaaccucuaggaaccugugguuuuuguuguugguuuggagugggaugguuaacuuauccauguagaccagcccaguaccugcuuucccacccacguggugccugcauucuuaggucauggcuggaugcucgaauacccagacaaguacacccguucucaaugaccguggccuucccucucccggagcggcugaagggugacauucgguguaccgcuggacucuucgguucuuuacacuguuguacuuucugccuggggaaccaaacugcuaggcauugauuggcugcagcuugauuaucaacuuagcugaggugggucugagugaaccccagguguuacuuccauuuuuaaauauaugcucuuuaaaucccaggucucugcugcaucggcagacuccaccuuuuccuggguuaagcucacauauaaaaagaaaacacacauuugcucauguauuuucuuucuuaucauugcucucuucuuuauucugaggaaguaaugaaucuucccucauauacaguuuaccuuuauauacuauacaccuauaugccuauauggcuagacaacugagagaaaggggaaccauuuuuaauaaaacccgaugagccuugggugguguaguggcuauuccugguugucaacuugacuauauuuggaaugaacuacaauccagaauuggaaggcucaccagugacccuuaucuggagacuuggagauagaaguuucugaucuggaucuugguauggagaucuugaggcauaguggcuauggauuccagacgauuaaaucucugaguucaaggucauccggcauuuaaggugugguggaacacacguuuaaucugggcuacaccuucugcuggagacaauauaaggacauuggaagaagggagucucgcucuugcuccuucgccugcuugccgugugggacuaaguaacugcuagauccuuggacuuccauucacagcuacuauugaaccauuguugggaauugggcugcagacuguaagucaucaauaaauuccuuuacuauauagagacuauccuuaaguucugugacucuagagaacccugacuaauacagguggguauguuagccauuaucuauucauuucuuucuuugugucacuaagcagggucuuuuuauauagccaugucuguccuagaacccgcuaugcuacauccacuccaguagugacaagcgcaauaggccccgaaaaccugggugcugucccguuugccagacucacagagaccuaucugcaucccauguccuggccuaggguagcccucuauuaaacucugaagaagaccacacaacaaacucaaguuaacuguucuuauugggucuucaaaaauucugacacaggaaaugcucagcccugugugugaaguuuuucuuaagggauacagaguaaaacccaauacaacaacuucuccaacuaauuccaccagcucucuuugccuaacuaaguccaaccugguauuuaauagccaaauaucucuggauuuuuuacccuaacuuugcucauucuaggcuuugaaguuuuugcuuuccauuucuuuuuuuuuuuuuuuuuuuuuuaaagauuuacuuauuuauuauauguaaguacacuguagcugucuucagacacaccagaagagggcaucagaucucauuauggaugguuaugagccaccaugugguugcugggauuugaacucaggaccuuuggaagagcagucagugcucuuacccacugagccauaucuccagccccugcuuuccauuucuuaaaagaauucgauucacaagucucaaacgcuggacccauggucgugaaggugacagcacacaguggggccggcaggcaggguugcaugaagcugggcagaacaguggaagccaucuugcaaaccccgauccccucuuucccuuuguucuuccucucugugcucugaacucuacauuuugguguuucugcuuugccucugguuuuggagcgcuuucauccugggcauuucucguggaaaaaaaaaaaaaagaaaaaagggaaaucuagcaauuagcauagauuauguggcugcaucaaucuggcagacucacagacaugucugcauggcagagcagaggcccuguuuugucuuguuuccuggccugccccgcccagcucacagccuggcauuugccaacuggagaugcccuccccuucucuuccucugcuuuucaguuucucugccagccacuacaaggccuuccuugcuaaguacuuaaugagguuuuaauucgguuuugggucuggaacagggccagcuacugcugccgggggcucacauuucccuuuacgcaucaucugagaauagucauaaagacaagcuggaucauuguuggcuuccugggcaagggguuucggggagagguucugggaaagaacucccugggccuuauguuaucgccaggccuuguugucuuuaggugauaaaggcugaaggaggacccgagggaaaggauguuagguguuuagugaggcaacugcuucaaccuugcuaagguguccacagcucuggguaucagcagagccaggucugguuagaagagagaaaaguacagugcguggaauaagcuuugggccaaaaaucauauguaguuuuauagacacaugccugucauauacuaggauucuagaguguuccucuugcccauaacuaucugagcuauagaggagucugagugcuucucuuaucucccuagacugaucuagcugaugaaaguucagggagguucaaugugcugagauauaacuuugcaugguguagcguuucuuauaguugcucagccauggcuacggugcuguagucuagaauuucagagccugggauagcagccagaaaaccuaaguuaaaguucccuuugccaacugugugaacuuugaaccucggaacaagugauccugagccaaaugaaguagugaccauaaauagugccuauuucgaauggcugguagaacaucagagcuauggaaaagaugcucaauaucauggcccacuggugcccaguuuaaaaauggugcccucuaugguacuucuuggcaugcuugauaccucuucuuccaacaugcucugugagugcaaggguucuuggaagacagagcgauuggaucaccccgaggcuaacguuagaggugauugugaacaaucaaacucaaguccucuguaagggcaauaugugcuccuagucacugagccaucacuccuacccccagagaucuccaucguuuuugguucauuucuugucaggaaugaggucugacuuagacaagagaguuggcacccaugugggaagcagcaccaaggaaaugguuaccacccagcucaugaccuuuucaacugcaggaagagacccagagcgacacuaacauuaguaucauucaagaugucccgaagacucuuaacucacaaugcccaccccggacacacacucugaauuucaaacaacagaugaugucgcgaccccuccuuugcuuaucacugccuuucacgugaauugugaaaugccuccaacuuaucuucuugucuccagguagccaaaccagucuauaagcuccaccaaaagggucuuucuguauaugaauuaacuuguggucaagaguucagguuugcaaccagaccuccuaaguucaaauucaagcucuagggacccgaggaaauagcucagugaguaagagauggagaacugaguucaacacacagguaccuaaguaaaaagcugggcaugcuugcacaugccuccaacuccagcucucagacgggguggugacaaggacuucugaccaccagucuagcuccaaguucagugagagaccuugugucaagaaaauagggcagaggaguugaggagauggcucagugcuuaacagcacuggcugcucuucuagaggacuggauggaauucaauucucagcacccacauggaggcuuacaagcaucuguaacucuaguuccagaugucuucuucugauggugggcaugcaugugguucacagacauggagauaaaacgccuacauacauaauuuuuuuaauuaaaaaaagaagaaaagaauguagagaauaauagaacaagaugucccucuuccagacucugcacacuuaugaucacacccacccauucucucucucucucucucucucucucucucucucucucucucucucucucucuuucucucucucucucucucucucucucucucucucucacacacacacacacacacacacacacacacacacacacacacacacauuccagcuuagcucuaguuuaacuggguuuguugacuccaggaaaguuacuccuuaguaacuccauccccauuuccacaaagugguaagacugauaguuccuauacugcaagguccuguacagaguaaaugccuuuuuaggcaaugugcaaauagaauagaggaaaaauaguaguguuagcacaaugaggguagucaacgcaacuuuagcauuucauuaugggcuuguaguaauuugagagaaaaugacccccacagcuucauagggagugagugguacuauuagaaggcguggcuuuguggaaggaagugugucacugagggcaggccuugaggucgcagaugcucaagccaggcccacuguggcacucucuugcuauccagauguagaacuuccagcuaccacuccagcaccaugucggccuguguccugccaugcuucccaccaugacaauaauggacuaaaccucugaacuguaagccagcucuaauuaaaugcuuuaccuuauaggaguugucucggucaugauaucucuuuacagcaauaaaacccuaauaagauagacuucaacauggcccugcaguuccuagacaagcaaguauuuccaguaccuucaagaugcaguuaaauucuucaguguucaugaucugguccaaaaauaaccaccugaagguggaaacuacugccagccuugaagcugcugucucuguccuuacacauguucagucuagugaacucaugucuuccugugcacuugacugcuugcuuccuacauggcugcagggcuugcagagagaacacauuucugggagguguuccuuggaguacuuggugcuuacucauauguucacagaugccacgcucuguucuucugcucuggggcuggagaucugauugcaagacacugucuggugcuucuuacagacacaaacgcuugguacuuauuuguuauucacuagugggaauggcacuaagaaaaggcuuccuagaugagaauuccggcucgaguuuucuaaaagauuacagcaaacacauggauaugguagaguagaaaagaggcuucucaaagagggugugugugugugugcguauguauagacacaugaauaguggagcccacagaagcauuggaccuucuagagcuugaguuacaagcauccaagagguugugaguugucugacacaagugcuggguucugaacucugguccucugcaaaaauauuaaauucuuagccagugagucaucccuccagcuccuauagucugcacuguuaaauaaccacauaaguacaucccacacaaacuaugauuuauauaaacuuccuauuuauaaauaccugaggaugauuuuuaaacauagauauccgguuuaauuuagauaucaaauaaauugcuagguuuuuaccucaauuuucuguuuaaaagagacaauaucacucuaugaaguuuccacuuuccuggaacucacuauguagaugaggcugaccucaaacucucagagaucugccuaccucugucuccugagugcugggauuaaaggcacaugacaucauacccagcaaccucaaauguuuuuaaaccugacuagcugagaauguuuuauaguucaaaugcacuggcagacagaugaaauggguuagacaucuuaugagggagaguaaaguucuccaagucuagguguauaugaaacccagacuuaguaaucuaccagccaacaaauccagaauggguucugguccuagacacaggacugccucuuaaugacagacauauugcuagaucagcaaccugcccagugugaauaucuugguaugaggggucuaggcaaaaaugggauccuguguuguaaagaaugccaacugccagcuggagggcugguggccaugaaagccugcuagagguucuuucaaauguaaguuucaaauucgucccuauuuggacaaaagauguaacuauccaugugcuucucagacuuguagcuugcgacaauuguaagacaaaguaagaaagaaauagcucucugaaaugagagaagaaaagaccucaggguaagagaaaaccagggaagauggggagccaaaauaaaaaaaaaaaaaaauauauauauauauauauauauauauauauauuauauauaauuauauauaauaaaaaacacacaggaaggaacacagguuaauaggaaagaaaauggacacugggugggagccuuccuuguacuuccucuugguugugacauucaauccaccaaauacugaaggaacuucccucaaugcuagagaguaagggucagcagaaaucacaccauggccaccacccucuggugcaugcacacucugggggggacaugaagcucuuaaggacagaagagaaccaccaugggaggaggacuugggaaagcuuucugaguaagaugccauugaggaagggcuuaacagauagaggguagugggcaaagcuaggcaagaggccagugaugaagcuccagguccugggaagcauccuuuggguuggaguuaggcagugcaaacagaauuccugcagccuaucgcucagaagauggggauguggauggacagacuguucuacagacugcaggcaugauguuucggugcccuguuuaaagguuauccuucuucaaccuugacaucuuguuucaauccgacaagacacuggaauguuuauaccaagaaccucccgucucaagucuauauaaacaauucuuagcauuuauugucugccuugucaauaaauguugaucaccaaacggccgggcagaagagacaauagggccaggcuuccaccagccccgggaaagagugggggguggaguuucagaucaccaggaggagagggucugagaagacagcaaggaaaaaacccaaagagccagaucaauaguaggauguaagaucaauaguaggaugcaaguaucaauaguaggaugcaaguaucaauaguaggaugcaaguaucguggguucaugacuaggaaguagccagauuagcauaugggguuguacagcuugaaauaaaucuugguuuuucuguguaguuauuggggacuagcaaaacguaaagaaauacagcugccagauuaaucuacuccuuauguuaaaaauaauucaguuugccacagacaaagucauuaagguucagaaaggcugguucuccaguggcagacugaagucagguguguguauccagauccucacgguguccagcacagccacugcggaggcuaaggucacuucuacaugaccuggaaacuuuuacccucugggaugggacaccuccccccuaccccugccuucuaucgcacggcaaugggaaccuucaauuagugacagcaccccaagcagcaugaaagaugucuuugauucuuaaucuagauauuucuccaauuccucccuggaagccacagccgggcugcaagagaaguucaaauucaacucuuagguuacuggugugagucaggagggccaaaacaugggcucucauccacuuggcugaggcuguuggcuuuagagcuggccacuugucuggccguucuuuuggaaaaggaacagcuagaaaacauaauugccuacuuucuaaacuauuucaaggggcugaagaaauggcucagcagcuaagagcucuaacugcucuugcaagggaacagaguuugguucccagcacccauguuaggcagcuaguaacugucuauaaccccaguuccagaggauccaacacccucuccuggccucugagggucccaaacauacuagcgaugaacagacauagauacaggcacaacacucuucuauacauauaaaauaaaaauaaaucuuuaaagggagaucuuaauaagcaacuuuuaguaucuuucugugacgcaccaugcuuugguucugguuuucagagacuccgugugacaaucugcaucagauggacgacaaaguaccacacaacucacaagauggcucugagcuaggugacagucuccccucagcaauaccugcugugcuauaauuaauaucccacccaugugcauucguaacagguaaagggucuuaaguggaaagggaggggguuuuuaacggugaugaguucauaucuuuacccaauucagaucacucaccuguaaacaagcaggaaauacccgaggcuugcagaggcgagagaacugacacgaugaagcaaaaauucuauaaacaaaacucuauuuccuuagaaauacgucaaaaugacacccagagugauguagugagcuguagccgcagggaacaggcagcaagguauuuauaaagagcuuuuuuuuguuguuuauuuguuuuugguuugggguuaacuuucuuuuccagcauguaaacgcauuuuauauccaccucuccucugaagagucagagaaauggggagaaagagaaaagggccguccacuggucucagagcccuuacuucaaagauuugucaaguuaguuccuuuaguuagcucugaggggauuuuuuuuccauuuaugugaaucuuuuaauuuauuuuuuaauuagguauuuucuucauuuacauuucaaaugcuaucccaaaagucccccaggcccuccccuccccccugauuuuuuuuaaggucuuuaggggccuagagagguggcucagugguuaagagcacugacugcucuuccagagguccugaguucaacucccagcaaccacauggugguuuacaaacaucuguaaugggaucugaugcccuuuucuggugugucugaagacuguaacaguguacccauauacauaaaauaaguaaauaaauaaauaaaucuuuuuuaaggucuuuaaauuaucacauuaacaaugcuuuucacagggaaaaauugcugccacuaacuuggucauccuccuucuccacacagugugacuagguggccuucagccuuccugaucacagucuauuagugcuccagugccagacuuagugccucagagggcguggcaugcucaccacacugccucaguccagaggcucucugcaugggagcaccagcuugucuggaggaucugagcuccaucucaguucugacaacaccccuccccccaucuucucucacaucauuaacaggaucaaugugagcugaggauagaaaagagggggcuuagagacacacacgcccuuuaaggacaucacaugccuccucccuguucccuucucugucccuucugcuguagguagguaauauuucuaagggccacgacagcugccauuuccugacagguuauuauucucugcauauuguaacaucaguucuacuggaguuucauuguacugauggagauagugagguacagggaaauugagugauugguaaaccugccaccaaaguguuccuuuccuuguggcacacacaagaccacugggccaaaugcuuuggcugacaaaagguuggcucuucuuuuccccugaccuggaguucuuaaauauggagucucaauacuuuagggaaagcuucaguuucccuuacagggccacuguguugcccaggcccaagggcaucucucaacagcugugugauacaaaugggaucugugcuccuggguuuucugacuuaaaaaaaaaucucccaucuuucucagggccaaggcuagaccuguucccuguuuaggugacacugugacaggacaagugagccuucacugauuuucacggucagccugguuuucucauggucagucugauuuucucuuuaagaugagaagacagucucccaggacccuugaccuuguaguagaaagggagggaguccugcugcuugcccuguucucugcuuucagagugcuaagaggucauuucgggggugaggaguacugacacagggcucugcuguguagccucaacagaccuugaauucacaaccacaacccucccuuagccuucggugcuggggcugcaguagcgucaccauacccagcuucaccaguccuugagacgcucuauauuuaucucaaggaugauacagaauaaaaugauuacaucuuuagacuacuacauugauacaacggaacaaucacagggacauugacaaacucuuccuaccucaaaagagcacaaauaaaaauaaaggacuauuucuaaagaguguaaucagggagucgacuccagccuacaaucguuguuuagauaagugucaugauuguuuaaauaacuccagcuauuucuagcugggcaaauaaguauaggcucacagaaaaauauaacauguaguaaaagaccuaaugcuaccacagcucuugauuaaagaugcgauucgcuuuuaugucuuuucaaaaauagccaggaaguggcuacaggacguguuuggguuaaggaggauuuauuuaguuccuaacacacgcugagaaccuccccuugggccucaccccuaauccacaauaagagcaucuuucuaacggcuugcagauucccauuuaugcuggaacuggaacuggaaacagagagagggaacggagaaauugcuaagaugccuucccugauucaauucaaagacacauuuugcugccccccaguaaaauccccaaacucagggcuggagagauggcucagcaguuaagagcacugacugcuugcuguucuugagguccugaguucaauucccagcaaccacauggugguucaugaccaucuguaaugugaucugaugucuucuucuggcguguaacuauacaugcagauagagcauucauauacauaaaauaaauaaguaaaucuuuuuuuaaaauccccagacuuacacuguuguauuauaaaggacaauagcuaaagacaggggaagguuaaagugccaguugaguuuaauucugaaggagccccacccucucccagcugaaacaguuucuuguggacagaggcucugugugacagacaccuucccacaucucaaguuaaaaaucacgaguaaguaccacaucucaucuucuuuagucccaggaaagugauccccuuauaauuagauuccaauuuaauaugaaauacuauaacucuuggggcccccaaaguuccuguugaauccuuacaaagguuuccuuuuuuauuuucaucagcugauauguuggaagcuuccucuaaaauccaccaauggcaaauuuccuggcuaaaggagaaggcagcuuucuccagggcccaaguuaaaucacugguguaauggagucuaccagcaguauaacagcagauggccaaugccaacagauaauugugcacacacaacccagaaaaaaagauggcccaagcuaacaaugugccugccaucuacuggauccuggaugguuuuguucuuucuagauuccaaagaggcuucaaaggacuccaaagaagaaagcaggcauaaaugaccagcaaacuccguucugacuaauuccuaaacucucgugaaagaaaguucacuucucuguugucuuuuaccaagagcugauuugcuuuguucaguucugauuguagaagguuccuaaucgucuguggagacugacugcucucagcucauaucucagugugacaacuugcuagcuaugaucuuggguuauuucaucauucuggcucccagguucuucacuggucaaugguaauaguauuacuucgaagggcugcugaggggaccaaguaugcuccauagggcaaguggcauacagguagcucuauacaaugggccagcuccaaaggcugagauaacuagaccuguguguagugccccaaucucuuucuccagaaaugagcccuucaaaccccaaauauacauuuuuuuuaugacuucauugacuaggacuggcaagauggcugagcagggaaaggcaccucccaccaagucugaugaccugaguuugaccacuaaggcccacacaguagaaagagaaaaccgagucccaaaaguccuccucuggccucuugcacaagugcauguucauauacacauauauacccacaauaaaugaauggagagagauggauggauggauggauggauggauggauggauggauggauggauagauagauagauagauagauagauagauggauggauggauggauggauggauggauggauggauggauagauagaugucuaagaagagcuucuucggaccccacuccuguuuccuccuucagcaaggcuccaucaucauuagcacacuacacacuuguuucccacccaugagcauuuccuucuaaacuguugcagcagucagagugauggaccaaaguuagcagcaacuucuugccugggcuguaccugcuguucauuuccauugagcagcaguuuugcaucucccuuggcaaucaccaaaauugcaagcuguucuuauuuuuccaguccacacagcagcaguccuuucugaacucaaucccccuccaagucaucguugaaaaucuugcucauucagccacguggcagcuuccaucuauguauauaucuccugcugcuguugguaaggggauccagccacaaaguccaaacgcuccgguuguacuacagcuguuuuaacugccugaauaguuggguauaucgaggacaagauggaaggcuaaagcugacuucaguuuacauccuugggagauuccccgccaccccuuacgaauccauccaugacuaagacuguaacggcuacaggcggaggagugaggaagagcuagcaccuacuaacugcuuccagugaccaaggcagcgcuaaagguguuuuguacacauuauuuccuucacuaccauucauuccccacucaccuagaaguaguuacaggaaggugggaauugcuuuuauggaacucauuaagggauggcuaugagucuuaaggugaggguggcuagucaccauucuccauucacagggaccaauaauuucucagggaucuuauuggaaaggugaggguggcuacucauuauucuccauucucaagggaccauaauuucucuuaguucugcugcccaguugccagagagagccacucccuccccuguaguggaaagcauccuuacccuccagaccucagcuggcuguccccaguguuccauuuccaucuugucucuugucucccacacugcacccacaacuacagcugcugaccuguguccugccgcuauuugcauuccaaauaagcguauuacaaacagcgggcgcaauaaugaaauuggagauuuguguucacagcagcaacaaagccuuugauuaauccacaauacgaucggaaagcagcucaaugcaccgcugcuggcccuucgcagacgcagggaaccugugggcgacugucuaaucugggauuuccaaacggaaugaaaacaucuuuggguaggaaagugggucaagacaaugaaaaaaggaaauguguuuauuugcauacagcuucaauuaaagucaggcauccauccauccaucuguuuaacacacauuuuacuaaguacuggcuaagugcuggucccaacccauuggguuguuuugggguugcugauucaaaauccguucccuucuacaaauaaaccagccuugguaugguagagaaaagccugaggucugacccacaacaugccaacucggucuuaugacuugugacuuaugaggucucucucauagauuugugcucacaucugaaaaaaggggugaagacgaugagacagaaguuugggcuggcugcucugagagucccugucaugcuucggcugaagcugccugggguccucuggucuugcucugcgagccuguguauguuagagagaguguugcacccuuaccacgcaauggaacucuugaaguucagaacuacacuugagucccauuuugguuucucuguauucaaaugggaauugggucaguucuuaucuaauuagaugagauuuaagugagauaaccuacaaaagccccauugcagcaucauacaggugugagcuaucacuaacacccugagauuuaacagccuccuuaggauucaaagucaagagcuagucuuuccacuggcccaagcaucucuacuagauuuaugcuuugaaagagagagagaaagaagaauuuauuuauuuuaugcguauauguguuuuucuugcauguacgcauguguacuacuugugugccggguacuccuggaagucagaagaggucucuaacguaacggaguuugaaauggaguuacagauguuauuagucgccaugugggugcugggaaccaaaccagguccucucuaagggggaccucugcucuugcucugugcuccuguguguguguguguguguguguguguguguguaaaauacugaagacaucauguaaggcucagguagccucauuugggccuuuucauaucacaaaucacaagaacuucaaguguucuuaacuacugagcccuuaaccacccugguccccagguuucugguuuuagugccaauuaguguccaauggcucuacuaugggccauaccauuccauucacaaguuacuguuuuagagaacuucuguuugaucuuugguuuuguuuuuuuccuuugagaggauaagacuuagaaaugucuuacccccuucaacugagaccuuuuggaccacaagcaaugcaucacugaauaugcauauauauauauauauauuuuuuuuuuuuucuuuuucaagagaagguuauaaaacuuugguccugaaggagcugaggcugaggagcaggucagugugugucacgggucagcucugccaugcuucgugggacucuuaguauuguucaaaggaugaagaaacaccaguguuucagaaacggaggaaggggaaaucgagggaugaaaaugcuggggcagaaaccucauggagccaggcauguuuaagaggagaaccucuaucagccucuugaacacugcccauaaacugcuacugaaggcuucgaaggcuguaggaaaagcgaaugacgugcuuuagaaaauauuucuaagcgagcauuguggguagaucugaacaucacagccauuccaaacgcagcuguugggaaugugauauggggaggaccaaaucgggcuaucuaagccucccaugaugucugaaggacuucacacacacacacacacacacacacacacacacacacacagaauauagaugaauacucugcccuauuuacagagagauuucaucacgcauguuuguuuuuaggguaacuaccacguacguucccaggacagggacacaccaaaccacagccucaccaagucacacugucagccacugagguuaaaucacaccacguuaagcgccuccaauggcauucuagcucccuggaguaaaucugagcuucucacuauaaacucuuuccccaucuuggaagcucccaggagcaaaauguaaaaacaaacaaacaagcaagggguugugacucccgaggaguuuaccaaggaagucugugaggucacaugaugugcauaaacuguuuauagaaaauaguauacgcccuacacagccaagcccagagccagcgaagggauacacugcaaggggcacacaguagggauaccccuccagucaccagaugcccaggcguccuugaguagcugcuacugucuucaugaacauuuccagcccaccuguucuacauacauuauggaaugcucugcucuuugcagcacacugcugauacccccaaacuacacagugccccugugugacgguuaaccugaagugugaacuugaccggguuaaggacuaacuggagggaaugggugugacgaaggguagucuaaagaggcugguaugugugccacuggacugagugaggaaggcuguuagcugggggacuccacagaacaagccagagaaaaggugaacuuuuccuggauugagauauuauuauuuuccugcccugguuugcugucuuuuuuuauaaaaaauuauuuuauuuuauuauauuuuauuuuaugugaauguguauuuugccugaauauaugucuguaugucacaugcauuccugaugcccacaggagacagaugguuuucaaccugugacucacaaccccuuuggaggucaaacaacccuuucacaagggucaucuaagaccaucagaaaacgcagauauuuaugagucauaauaguagcaaaacuguaguuacgaaguagcaacgaaauaauucuaugguugguggucaccacaacaugaagaacuguauauuaaagggucaaaacauuuaggaaagcugagaaccacugcucuagagugucggauccccuagcagugacauuauagaggguugugagcugccauguggaugcuggcaaucaaacgcaaauccucuagaauagcagccaguaaucuuagccacugagccauuuuuccagauuccuucuaaccuuuccagaucuaagauaccgccaauggcucuuagguauuacacuuuaugccuuggagugagaacuuuauuguuagauucucuaguuccgagguuagcccauaaccaucccaauguccccagcuuguugugggacuacuuaucuuccaccaucuugcaaaucaauuucccuaggucaauccccuuucauagcaugagaguuugucuacaaauauauaagcagguauaguuccacgucccucccugauugguucugucuuucuggggauaucucacaaauucaaccuggauuucucagacaaaaacuucccaaacaagggacaccugucagaagcgcagccuuugguuuggugggaauugguagguggcuuguuaaagcauagggaagguugcucacaucugaaugaaugagccggcuuaguuuuagugaaguccacagaucuagcagaucuggagguggagaguccccggugaacacacuagagcaucaaaacucagguucauggaguggcucugaucaccuagcccaagggucucaucccacuagcccucacucacuggcuggagaccugccuguguccucggggaagcccuggcugacaaaauucaugagcucagccgggcaggguauuggcuagccgaacgguagacuucgcuccuccagcgcugcgcuccaacucuccccugcuccuggccaucugcacugaccaaauuaaccacaacuugugaaaugcccccuucuuguuguggagacacuaccucugugucuguuuauaaauagaugaaguuguuaacagcacacuggaaagggaccaaaaccaaacacucaacugguccaaaaacaugucaggcuaacaucucuuggaggaaugccucuaagcauuguacaugggcccugggaccaucccaauucucuggacccaacucaugcucccuuuggucaugaaaacacuucacauacauaguuuuagacaucugauggugugugcuguacuugcaugugauggaggggugagagggggcugggaacaggagacaaugaugcaguaaaugaauuucccagagcuggaagcaaaaugaaaugguaacaaaaauuuuacacaaacaggauuuuguuuuugcuuuuauuuaauguucuaauguuuuuaaagcauauugguaagccauaaacaaguucuaaccuacagacuaugguuagaaauguuuucauuuuucaaggccuuuuuuuuuuuuuuuuaauugaggcauuauggaguauucauuaguuauucaggcagauucucacucuguagcucaggaugagauccaagaagugagccaccaggcuggguuauuuauuacugcagcaaaagcaugcauugaaggguaucuuguuaggguaugugggaaagguauuauuauuucuuucuguuguuuuauugggcauccuaaagccugaauagugugagccaagugucucugggaagugcugggagcaaggaccccagcucagaguggaaccauuucucucauuucugcccuuugcuguuauucaaagcccagcaguguccaagcaaaggggaagggacacccuuuaucuccuugaccaaagggcaacagaagugacucggggaacacaaagagggaaggagcucccuccaucacaucugcagccaucagccagggaacacugcugugugugguccccccacccccacccccaccccagagcgccuuuccauuguauccuaauaaauagccccucgugacucuaggacuccggucacuugcggcugauuugcuuuggguaagauuaucacaaagauugguauccacagauacugaaaaaaaaaaaaaucuaacaaacuagcuguaaacuuuagccaacgaaagaacucacaccuggacaugagucaguaaaccauucuaaucaaguucacugcagucccugaagaucugugacacaguuuccugcagggaguaugacaugggcuuagcaaauccgcacccucacugccaggcucuccugugagaacuccggucaggcaagcaacacagccuguugcuagguaacagagcacagcuagcauguuaccucauguuuguaaauggccaggaagagaaagacaaaucugugcaaaaagaccucagcaaacacagagggagagcagacgggaggcagcucagcaaaccuugggcuaucgucuggucagacuucacagaagcacacaacaggcauagccacagugcaauuuccugccuguguuuugcuuucuuacguuuacucuuggggccuuagacaagcuuucuucucagacuuuagacggccuugguuuccuugugguucucuugauggaaccacauugcccacuuccuguuccagcaagaucagcgagugaguaggugagaggcaugggggacgcagagcccacccuaccuccaaggacagagcuggaugguggaugcugucuucacaaaacauguuauuuuuagauuaaaguuagaaacguaucucucacaaaccugcuccuggucaacggcucaagggugaggagggaaagaaacaagguccaagucgugggucuguagaagagggaguagcguucccagauucaagagaacgcuugccucauuccagaguggcuccacucccagagaaaaccaaauauucuuuauguagauacaacagccggggacagaguaauuaacacacaccaugucuugauuggcauguaccuuuaagagccauaauccaaaugccuugugggacucugcaauggccuaagaaaaugucaugggcaaagccggagaagucuguacuuuaauaacauccuaugaaggcugauuucuucaaggaacaauagcauggcagagucaaaagccacaguaggcagaggggaccauuaagaacauugucacuacaacugucuauaaguuuaaaauuacucaaauacaaaacuuugaaaagaagaguccaccugaagugucaaaggggaucagccacacacucauauacugguaguuacuuauuauuauuauuauuauuauuauuauuauuauuauuauuauuauuguaguaguaguaguaguaguaguaguaguaguaguaguaguaguaguagcagcagcagcagcagcagcagcaguaguaguguauuaguaauagcacacagcagggagggacuuacaaaaaccagagacagaaguaggauccuggguuucacccauucggcacuaccaguuugauaucauauuuauuucagccucacagcuaagaaguccccuuuaaacuuuuuuaaacuucaugugugcccauuuacgaugucacagaugaagcaacggcuguaggggaguguggccacuuacccaggagcagucucuacagagcuuugagcagguccaucacuucugcacaagggcaguuuucacacagcagacaaccacaucuucugggccuuauuucuucagguaauuucuccgguaaguggcgucccuguacuaacacuucacacgcaguagccucuguguucaaccaagcuccauuccaccacaccugaccuaacccagcgccaagugucacacgguugagacucacagaguuacgaugccacauuauuaccacagagauagcuggaagggauaaagccgccuuguaccuacuuuucucugggcuuaaguuaccucucacugguaaauaagcuggacaugccaucccaugagguuuguggccacaucagcugauagccaguuggugacacuuaauguaaaauauaugucaucaccagaaaagagguuagacgguaggaaagcaaacugaaugauguuuucaguaauacuggugagaaaauauugaauaaagucuugcaucaguaacuaauacauaacaacaaagagagacacggaguccuaggcagccaugaugucggcuuacacaagacagucuguuuguugacauuggcgccaagucagcauguauagucaacuccugaagccaacuuuaugaacuuaauauuuagaaagaugaagugguugcgucaauauuuagaaagaaaagcuaaacucgaagagguaagcuuccagggauaacuuucaguugguacuugaaccacaucgucucacuuccugcuuggucuacaacguguacccauaucgugcuccucccugacgcuguauucuaguccaaacaucccacucucuccaugguuccgaacaaagucuuuaggaggacuguaucauauaggaggcuauaucauauaagccccacugaaucagaugacucuauuaucagcucccuggacacauaacagcaaucuagcuggaaaaccaaguuuuccagucuuagaacccugcacugggaucucacuaaagagauaacaaucuugccagcuaaucacccaucacuuccuguaaaacucagggcucuccagcaggcacagagaauaugccacaaaaacaaaugacuauuuuugaaaagggaaaaaucugagacuuucacauacccucccuccaagcucucaacaggcuucacuaacauguauuuuuuuuuuccuaagauggggauaaaucgguugauuaaaaacagaacauuucuuuccaaguuauuuuugaagaaacugugauucucaggacuuagcagcccccuccacucccuaccuugcagcucugugaaaucuagagagaacaaacaacaauacugggauuuccagggaauccaaccaaaagaugaaggcugaugaucaucuacucggugccaggcacugugguggaugcugguaucgaacuagacgcagccuccgucccagucaagggugacacgguaaucagaucaucacauguagugugugggaaccucugaaaaugccuggcaaaaacaucagggaagugcgcuccggaagauaagaguucucagguacguuaggaccaagguaacauccucagguaccauuuuuaaauggucccauuugaagacugucagacugguggaucuccugacucuaccagagcacaccacgcuuuauguauagcucgucagaaccuuuuucuccaucacccccccauccuccuaccuugcccuuugauuuuauuccugucucaucgucucccagggacauccccugcauccaagguugcuugaagcaacagugaugcuuaagacuuaagccaggcaagucagcuggcaguaagccuguuacaaaugcagauuccuggcucccauguugacacagaaacuccauauccuuacauugcuaaccaccccacugcccugccacaagguucgcuugagcuauccuagguauucugcuguugauuuuaaauggaaauucaaaacuauugggguaaugccuuagacaucauuaacaaagaccucccucuguauucaugcccuacugcgggucccaggagccucaaggcuugaggggcuaucuccuaaccucuuggcagacagggaggagcaagaauucuacagugcuaugcagccucagacugagauggcaaacucggcgggauaaaguuugaagagucuucaaccaucuagguagcuuuaugaaauaacgcauuugacuaagauucccauuguaaaaucuuuauuucacuuuaacuacucuaaaguucauagugaauucaugugaaaucuuugcuauaaaugguguuaacaccuuuauagccaacuggucuuccguuuaggaaaccuacgggucuuugaauuugggugguuuucccuccucaguaaggaaagagaguuuuggagaccaaaaaugaacucuguucugcagacaccaguggaaucucgugcuaacuuuugacuugagcuggcuagaggccuugucucucgcauguaaugcugucagagaugaccauaagcaggaaccucgucuggcgaguccauuccgucgucagcagacuucccagcagcaaagccagcuccacugcacgcaguagccccagcuuucuccccugacaugauguguaagcccuacuucccaccuggccaccagaacacaccacucaucugccaccugugguaggaagaaagagugggaggggacagacagagugggcacagccagcaguguccucugccagucuugccaagagccggucauuugcagccacuacucuccucucuuuggauaccugaugagagugacuggcucuggaagucccauuucccggaagaacgaucgugggagugcagagaauggggaacaggugagcuuugagauguuuagcccguucgcucucaaagccaggucuuccaaugcaguuuucucaccaaaaguaguacuggaagcuuugguauaagcuuggauauagggggaugcugagacaggaacucaaacuguauacagccgaggcuguccuugaacuuguagcaauccuuaauccugccuuggucucccaguguugggacugggauugcagaugugaaccaccacacacaacaggaguucccuauugaagaccuucccagagguaccugagggguucuggaacugagaucuucagagucuaaacuucaucucugcuacuucuuaacugugggaccguggacccgcuacuaaaacacucugugcuuuagguuccucagucaaacaugcccacaccuucugagcacuuggugaaagucacacaaguuuuguuguggcuuccugccaccaaggcugaggacacaguucagucagagugcuugauuaacaugaccugaauuugauacuuagccaaucaacuugauguaguggcucacaucuguaaucaagaaauagaggcaguggugguggugguggugguggugguggugguggugguggugguggugguggaggaggaggaggaggaggaggaggaggaggaggaggaggaggaggaggaggaucaggaaggaguucaagccacagccugggcuacacuaagagccucucuaaacaaacaaacaaacaaacaaacaaacaaacaaacaaacaagcaaacaacccggaaacucaaaaggcugaaggcgcuggcaugggcuucuaaucuuaccaguagguggggcugaagcagggaggagaauugagaguuauaggccacucugaguuguaccuggagacaagucaaaaagaagacacagauccccaaagccuuucugaaagcuggcagcuucacagagcaaagggacaaccagaaucacacagcaccagcacucagugacacgaccucucccccagaaugugacccucucuuaucacacagcaccagcacucagagacacgacuucucccccagaaugugacccucucccagaaaucccuaggaagauggcuggccugaaauuaauuuuagauuuaaugaaaaaggcaaucgacuucaaauuaggugaaugggguaacugugugcuccagccccgggggcacuauucggauggauuccugacuugguuaucaugcugggcugaaagaacuugacuuaaaugagcuaaugaaaaauucagucucccuccucacaaugggcaccccaaagucacacaaguucuguugaaagugaacaaauuacuuucuugugagagaaagaagaguguggacuuaagugcagguagcucuucccaagucccucccugugaguuccuuguuuggaagaucucuauucaaauuuagguguccucuccuacugcucuguuucaaggucucccuagacauccuuaauggauguguuuuaugggucaguacuggacccaggaggaacaugagaacacuuccugcauaagaaaucggugacauuucugcacuugaucuuagccaaaaggccgagaagcuauucgaugacauuucugaaacaauagggauggauauaacccaagaucuagaacaagauccucugcagggaccccaggcacccccuaauucgugagugauucaggaucaugcaaauuuccaccaacacugccugcagccaaggcugguacuccccugcuccucagagaggagcugccuggagucugaauggaaucuugucaggugacaugaggccacuucuagguugugcaacauuucccuucaaaaccuugcugaucgggcaacacugaauaaucgcucugucagaaugacugcacauuagcacugccacugccacgucacugaugaaaccugcaagcccuuaaggccaccauccaucaaguggggaaaagaucucauucagagucaugacaggggcauugacaauggaagcagggcuccccccccccccccgcguggguggaugcuaaagauuaaaaucauucuguauuuaguaucauucccuuuguguuccuccaacacucagcauuuucuuucagcaaagaaauacaaaaguuggugcuagucagcugacucccugcgaccuuucuauaauuucauacaggauugguaaacacuucccacuggaguuucuauggcuuccuuuagaggccaacgucaccccugccaacagacugggagcuuagucugcacaaaaguaauuucucagaaaaaaaaaacacuaauaaauugaacugagaagggaauuugugccaaacagugcccccugccccccacccacccccagcuguaccgagaaugacuuucacccaaacagaauagaauucagaggaagcacgagggauaggcagggacagacccuucagcacgacacacaaacauccacagucuccggcagcuccaauagcaagagaagagagggagcuguguccuacccagaagaagggguccauucuagaccucuccugcacagcccagugagggccuaaaccaccucucagacuaucacgagauucuccccaguacccacaagcccucaaugugaaagaaccaagccuaaugcucaggguaccagaaacucuuuaccuagcugccucagaugcaagaaacucaguuuagaauugaguucuuacguaacaugccaggaugaaggcuuggagcaggccagggacacgccccccccccccccccccagcucaacacucagcucaagucgagcacucuuuucugcuucuucagucaggaguccuuagaagcugggucagcuacuugguuuuggggucuacugcagucucaagagagggucauagaaagaaaguacacuguauugacuggccuuuccccaaagucacauacaucuaccuggaucuucaacaugugaccucugcugaaaguaggagaucauacaagacuagagggagccuuaaugcaauggccggugugcuuaugugaaggaaaaauaggggauuugagagccagcucagugauuaaaagagcuuauugcacuuccagaggaucugaguucaguuuccaaccacauaggguggcuuacaucugccaaucccagcuccgggaggucugacauccucuuacaggucucacaggugcccccacucacacacauacacaaauaaauaauaacaaguccuuaaaaaauaagagagaacagacacacacagggagaagauggcauauggcaucagaggcagacacuagagcaguguuucucaaccuguggguugugacccucaaaagaucaucagaaaacacagauauuuacauaauaauucauaagaguagcaaaauuacaauuaugaaguagcaccacaaauaauuuaugguugggggggcacuacaacaugaggaacuguauuaaagggucacagcauuaagaaggcugagaacaacuugcacuagagggacuguuguacaaccaaagagacaagaccacccaucagaugaggacaggagcagucucccuccgaacccuagaaggaaccagccucgccaacaccuugucuuggacuuucggccucaagaacccaagacaugaacuuccuguccuuguaagccaccugguuugugaccuuuuguuguggcagcuugaggacacaugaaaaaaguucagaaagaaacuucugcagugugguucccagggggaggcaggaaggagauguuuucaaaagacaaaugaauugaagaagcagagcugggaucagucugugugguggcaagccagcaagucugcuggugauguaagaacaucacccaguggacaugguauucauaaagacaacuuugagcuggucauugagaggcuggcuucagugcagagugguccagcagggcaucccugggcugccucacuagaucuccuaaaaaggaagugugcuuguuuuugucucucacugcacugaacacucucauacuuggcagugaguucuauuauuacuaaacucuugagacuaaacuuucacuuuuucuuuuuggagggaggaaucccaagcaagucauacagauuaucuacgaaagauuucucuacacuuuacuaauauugguaucuucuuacucaacacacacccuaagaacaucaccaagaaccaucuaccacuauucagauccaucaaggccacagccauccauaguccacuguggauuucauccagggaaaaccuuauuuccagugggugaacauggaagucagacuuagauugacuauaaguuguccucaaaucacuaacaaccucuauaccucaaccucccuuccauccaguaagaaagaaaacagggagcaagcugcaguagugcauacuucuaaucccagcccuucaggaagcugaggccagagaauggccaugaguuugaggccagccuaagcuacauaagggguuugugaacaaucugggcgaugcaucucgacccagucucaaaacaaaacaaaacagaacaaaacaaaacaaaauacccacccaaccaaccaacuaaccaaaaccacagcagaaaacaguuuccuuaugaacuguauuccauauaaggugguauguaucaguucugcauuggucuuugauucuuccccuuggcagccuuuaccaaagguuuaccucuuuauucauaauauuuuucaauugcauuuaaaauuuuggguauuuuuuuuaaugugugugagugcuuugccuggauguaucucuguguaccacaagcaugccuggucucuauagaggccacaagugggcaucauacaggcaguuaggaggcaccaugucgaugccaggaaucuaaccaagguccuuuggaagauaggacagugagcuuucaguccagcgcccuagaauaacacacacacacacacacacacacacacacacacacauuugccaggagaaaguaugucagggcacauguguggcggucagaugacaacccaauauggguccugggauugaacucagaccauuaggcuugguucccugcuaagucaucucaauggccccaguugaucuuuuuuuuuuuuuuuguuuucagacuaauguuugcuaccucuuagaagguggaagggucacggggucgugcaggcagagcagcccacucacuugugagcccaucacugcugccgccacuuggccccuccagacaguugagcugggcacagagccaaaguggggaggaccaccaaccagccuguugcuggguagggucuccuuugcuuugccuucucagcauuuuaggauuuuggacucggggcugagcugcaggaauaacgaacagcagccauuauggaagcacguggcaagcaguggcuagcaguggccagcacuuggugucccagccuugcagacucucugcggggcugugcugggaggcaggcaggucucucacacaagacacaaggcacagaggacggucgguccgagcagcagcagauggauggaaagcugccaccuuaucucggaaucaaggugggaaggccuggaccgaguguuuucuccuuuaccuaagccucuuaguaacaagguacccacugccucaggcuuuucuuucuucucucucuuuuuacagaacauaaucuucuuacaaaccaaacacaaaaauagccucagaaccucuccauauaaggcauuuccaaacagauggauucugagcguuucuuggguuccguggaggaagcccuggggcguggucagacuugcugacugugacaugggaacagaccugguggcguacauaggacugcgccuggucuuuuagagccacaacaggucagcagcaggaaaggucacucucugcuugucccuggguaacgaucaugauuuccaaagaacuccugggcucagaggccaggugcaacuguuggaacagauccuaaaugguggcccugaagccuccuucuaaccgagcaacagaggccauuacauuccugccgaaaagcugaagagcuaccaaguccugcucaaggaccaaacgccacuaaccaucuggagccccagugaguauugccuagcuccuccagucacacuuagaaaugaccaaggugucaccacaaugaauagacgaaagagaccacugaaagagacuugcaucuuuuuuucuauugaaccaaguccaaaugcgguguccgaaaagacaacauguguaaacaaaacaaaacaacaaaaacuucacaaacaaccgcaagcaggaagggaagcaacaauaacauagaaggacuuguuuuaagagagcagacaugaaaggcuggaguggagguagagcacuugacuuggcauucaugaagccuugggcucaaugcccagcaccacaaaaagauagaccaaauaguuucaaauaaaaauaaugcugauaucucugagagaaggugaaauugugcuucuggaagcaaucauacaccccugcccgcugccgccacugccaccgccaccaccaccaucgccaccgccaccgccaccaccaccgccaccaccaccaugaagaggaaggaaauugccaucaacuuggacaauguggaaaaauaauaaaauaaaauuaaaagcuaagauuugagagguugugguuuuguccugagugucuaucucggacuuuccuuuuucaagucgaucccaguccccggguaggagucacugugaacaaagggugccuaguaaggaacucagcuccaggcagguagcccuggguggaggcagggaugcaaccacucacuguuaguuccuguguggcugcucucacgaagccacugggugcaugcagguacccagcagccugccauguucagaggauuuggcauacccuauuucaugucuuucugugacuuccaaagcaugggccauagggugcaggaucuuguaccccaaacuucacuccugcuguggccuguucuacccaugucaugaucucgucucacacacucaccugccaaagccacuucuuucaaccccuuucugauucucugcaaagaaauuuguagguauuauuuaaagguuguccuaauauauaggcuuuuuuugggggaggggggcacucuccauccuccaucuuuuccaaaggcucaaugcaacggucauucaaaaaugaguagugcaauacuuuagcacaccaauggcucaaccuuguaguaagucuaacaggcuaaaauaacacugaccgcaaauaacauaaugcaucgcaaggggcaggagcagaugcagccaauguucauuugaacucuucccucagauuauguaaauauaagucaucaugugagcuguacaaugguaaaacguuuguaagacauuccuauauaauauauuucugaauguuuucuuuuuguuuugcuuuguuuguuuguuuugagacaagauuucuguguagccuuggcugaccuggaauuuguucuauaguccaggcugaccucaaacucagaggucugccugccucugccuccagagugccaggaugaaagguauguaccaccaugcuuggcccaugaauguuagucuuuaugauaaaaaaaaaaauccuuugaacagagcccuucuaauggaccagcuacaauggaugaagaaccuacgagguaucaauguuaaaaacaccuccaccagaaaugagaugcaaguuagccugagcucuauaaaccaaaacccauuguuaaagcacacaucaggcuugcccagacucugcgacucucugcuuucauuuugugaucaauccccaagagagaauuaaacguccuuucuugcugcaucaacuaugguccuuccaaggauuauauccugguguuuuauuaaucaaaaauaccugggccacuaggugugguggcacuuaccuucauccucagugcuccuucauccccacacucuggaggcagauucaggugcagcucuguggaucugaggacagccugaucuacauauucauuccagaucugccagaacuacuuaugcuuaagggagagagggagagagguagcagagacagagauacagagaccaacagagacagagauagagagacagaaagagacagagagacagaggcagacagagacagagauacagagaccaacagagauagagagacagaaagagacagagagacagaggcagacagagacagagagacagaggcagacagagagacacagagaggcaggggaccguaggaccucagacacacuggauccaagagugggauggagaagcaggcucccuuugccucugcacuggccagucaucuucagaaucacaccucacugugcagggguagaaacaguaccaaaaugccaaaguccaaacaaaaauaaucauccaauacugauaguacagagagucuggugauaugcccaacaucaaacacaaaauguaccuacaggcagccagagcaggcccaacaccaucuacuuugacacagauucaguaaagaggcugcccaaccccaagaucgcagagccugguuuguuuguuuguuuuuuuuuccucucucauugcuguuuuacgaaucuacucgaaccuccuuaacucaggcugacaucucggcuuuuagugcuguaucauuacauacgucugagguuucugagguuagggucugaagagcuuuucaaaccucugacucaaaugugcucgacuuuccccuggacacagcgcucacuacugaaucucauuuccaugagacaaaguggggagugacucccgucucaaaugcuaggcguaucauuuuuaagaaaugcuuacggcuuuucuugauuguaaaguaacagccgacuacugcgcaaaacguaaaaguauagagaaaauauaggugcaaauauccagauggaaacccacauuaaagucuggugcauuuuuguaaagacaagcauuguuuugacuacuacuacauuaggaccaaacuguaacgaccuucaugauucuuuuuuccucucagccaccauguguguacugaugcgugguuugcaaugugggcugagcacugcauccucucgcguagucaucguuaacuaaaccacucacuacuguggagaaucucagggguuucccugaguuuuucaaacauauaaguaauacgacagcaagccauguuuaccugacuauaugcacaucucuguuucuuuccauaggcucaauggcugguauggaucuguuacgucaaaacgcuuaugcacuuuuacuaccuggauuuuacugaaauuccugugucagaaaggucaucuguauccaguaggagaacgggaagaacuuggccugcgcucuucgccaacacugugcggaacgauuuucaaagccauguggauggcgggcaaggcugcaccuucucguaucacuccuauugcuucaucuacagagguucugugguuuucagagguucauaaugguguaauaugucucucucuaccaauagguuuuguguguguguguguaaacugaauguucauagcauaugcccaucuuuaaggcuuuauuuagauauuuguaagagcucucuauaaaacagggaaauugaauuuuuuacuaugaaauucgaggcaaauaccuugagaaccacuuucaguugcauggcgauaugccuuaagucaugccaucugcugguaaacagcagaagaguuggcaacuacucauaaggccaagguaguacguguauuagugcuuuucccacgccggugauuuuaauacuagauaccaaagaugaacagcugacuagaggcuuuuugacuacagauuuucaaucacauucaaauaucagagcuauuuaaguuggguaagagagagaagagguuucagccaaacccaaaggaguguugaguucuaauuccuaaucauacuucuggagugaauauugaucacagauagguaugugagcccuguuuaaagaaucauaguaauucaaauuuugaauuuuguaauaagauacaugaauaaaggugacuucaguauguauuuuuuuuuagaaacaccuccaaaugagauuaaagccaaugcuuucggguaguuaaggagaagcuagggcaaauucuggugaagaugggucucaccagcugaugaucauaggguuucauggaauucaaccaggaaaugcgacuuaacuuggggcucauguaaaacaguagcugugacucauguugacuggcuccaacuccucugggagcagaucuaggagaaguaguguuuuccaagauaaugcagaaacaucaggugaauacaguaacuggaccaauggucacugaucaugcuccaaugcaugcagguccauagccaagcaccagagccaucacuggccuguucggacagacagcaguugaguagccacucucuuuauaggaagcugcacuugggagugugcugagcugaucuuugggggcugugaaucauuccucagcccuugggagaucugauguaaaccaaaugcaagcuauugcaagaaucuggucaacuuagugccaggagcacaagggcagggagguagcucuauccucaggcagcagaggaugugcaaaccugaaccuuucuacaaccagaaaugagcaaaugcgaacacucugagccagguacguagguuucuaacaauaaaacuaaugcgggugcuugagaggguaacucagugccuccuguauguauggaucccuuaacacuggaaagagcugauuuuguuugguuggguuuggguagguagguuugguagguaggugggggaugggauagcaacuuccagacaagauuuucccuguuggguuuguuagcuugaacuaaaugagaacaauaaauuaagaucauaguuuauuuuuuaaaaaaugaaugggugucuggggauaugugaagaaccuuaugugaucauacucaucuauaaucucagcccucugaagguagagacagacauagggagagcaaggcuagccagggcaacauggcaagucgauaucccagaggcaaaaaguaacaacagagaaccaagccuggacgcacccugaugcagaagagcaucuggccagcaacugaaaaaaaaaacggaacaaaguucagccagguuggcucagagcagggucuggcagacgguaauggugaaaugaccgugaaaagcaaccaaggugacuuaucgcuccccagcauccgggcaaggagguccuagcaggcagauucaaccuuaucccagaaacccaagccacggauaagucagaugacagccauguugagaguguagcggggccacaagugggguaauggggaagaugacccugaugucccuacagcaaccugggagaggaggauguggccaucuccagacaguaauuucagcucuccagaacaaguacugacaacccuucuguaacagccuucccaugaugacaagguaggagagcuauccacauuccaagugacccaaggcguauuggcagacaauuggaguggaggcagcaucccaccaaugaagaagaaaguucuggagaaacugaggaugagagcccaugucugaagucagcuuuggugaagcccccacucugcauggagcagaauccagagacagcacguggccaugacaucucccuucuucccacucuacacaggggcaaugugacagguggccuugacaguauaguauuucuagaacccucaaacacaucccaggguccuuccaaccacguagccaacccagaacugcaauugacgacuguuggucaaauuacuagccuucagaaucuuacuccucaagcaccacucaccuaaaagccccgcuugggaaaaagaucugaagagcaaacaaaaggccaggcuugguggugcgcgccuuugaccccagcacuugggaggcaggcuuaucucugugaguucgaggcuagcuuggucuacaaagggacauccagggcuaaacagagaaacccuguuugaaaccuccaccccccuaaugcccccaaaaaggaggaaaaaaaaaaagcaacucagccaccacccucccaggcagagcaagaauaggauggaaagaugagguauauguaugcaauaucaucccugacaagaaaauacggucuggacccaaagaaacuaaauucuaaggagggucucagcggcccaagugcacugcaaaagguuuuaaacacuccaauuuccaaacaacuaacauccgccagcccaacaguuucaaaggaucucuaaugcagguggcucuggagcucacaguccccgugucuccuccacaagaaaaggggcuagacagguuggaggcaguguccuugucugguucugugaaagccugacagaaauagggagagaggcuuuguccuuuaggguagugucuuauucucagaacucuagccugcuaucugaacugauuuuagguuguggaaacgaccucugauacuugccagacuuccccugugagguguggcugcugaggcuaguuagucaaugccauugcacaggugagcaggucgaggcucugaggugcccagggucccacagcuaagccaggcugcacuugggccuacacuaacucuuccaacuuagagcucucagauugcuucaaacaugaaaacaacucgcccugccuauacagaaaaggauuuccuuauuuuuuagaauuauuguuuuuuuuucuucucuauauccaagucgauguuuacauuuguuggaagaauugaaaaagguuguuaaacuccaauccgggcucagaaacucuaugacacccggcuuccaucuugcaccuuaacuuauuuuuccaucugggaagacaagagcucuagccugaaacacaacaaauuggacuugaacauccuccauccccgccaucaugaaaaaacaaacauuuugaagacggaugggaccagcugccugcauccccuuucuacccagcaaccacccuggcuggaccuuguuguuguuguuguugcuguugcuuuuuuuccagggccauuuucugcagcagggacagggccacugugggcucugagaagacugaugcgccccugcuuuuguaaggcaagggggcgauuucccaggcuugcuuugugucccugcucggccacuaagugauagacagagcugcagaugcggccagcagcgccuaucucuguucaugcggccaguguguguguguguguguguguguguguguguguguguguuucugugcuaucaagguuuuuccucuccuuuuaaaaacuucuccuaugaaguaagacagcaguuauucguaggaaaauuuaucagaaccaaauucuucuuagugggaaaaaaaaaaggcaguagaauuucucuccucaugcuaauccccuguuugacaugcaaugacaucauccuauagggaggaggguggguguggacaggagacaauguaaugucugcuauaauuacaggguuuaauaugcaggaucagggagguggaugggagcuacaggcaagcccuucucaccaggccuuguggggggagggggagugaauauaauggggcucaguaaugcacuugagggggucuugcuguggcaauaccaaaaggagcagaaaucaaaggacuacacuggccagccuucauuuucugaugcaaaaacaucuccuagagaccagugaagugaaacugcauuuccccccuaucgaggcccauugaacugcagugucccaaaagacaacaugaacacauaaaaaaaccucacaagcacagacagagaagagcauuuuaaaagcacugcuacaccauacacucauagcacaagauauccacacagcgccuggcauauggaugaugcacugauuuacaugaaggcaacuaauaucaucagcauuuugaauguuaaauaaccuaaguucccuuuuuaaaacacagguuuuugagauguaucaaaaaugauaagacaguagcuagcacauucucuaaccauggcauuuacagacugccugccuccauuagacaggauuaaagaagccggugggcuaccaugguggcagacucaaacagucuaauaugccuuguccaauuuaugcauuuucaagcaauucaugcauagccacuccuagagugacaugaagaauugaugugcggcuucuuuugguaggugucgaggcuauaggaagggauugcuguuuaaacuguaccauugggaagacaggaauuucaauuggucucaaggugggaaagacuuugacuagacgaagagaaguuuaaaaaaaaaagaaagaaaaaaaagaagagaaaagaaaagaaaaacuuggcuccagggaacuuggagcuaauauugugagaaaauuagaagcucaacacaaccacuuauaugaguggcucuacacaucacugcacagaguggccaacgguaugcuaaguuugaacagucaggaugcagcagaggucucagcuuuccugacacuuguuagcauuccccuaaagggacgaaagcucuccucaccacuacagauauuucccuuuuuaagaacauguaucugaaaaccugaaaaacagaagauagcauucuuggugaaauauugguuuauaguucaaaguaacugcauauuacuuagggaagggacacgauggcagaguucaaugugaugucacagcccuggaggaguuaaggggagaggagcccuguaagguaaaggucagcucaguaaggcucacaccaaagagcaagacaaacaguaagaggauauucugcuaauuaccauggagcaagucaaccuuaccgggggacucuuaaauacacgaaaauaaaugaaaugaaugaaaauaagaacgcaacucccucuagaaaaauacggcuuuugaaucaucucaaagacuguaacaugcugacagcuuugaauggcagauuuccgcaaacagagauucugccauacaaugacugcuucaacuugggcugaguuaaagaaguggguuggcauggagacagacaagaagaugcucuguuccaaauucacgagucuuugaagaacucaugaaaagacauagaaccaucacuacuaaugacaacaaacauggccauggugauuuaaaguaaaccggugucaugcaaaaagguacgucgagggggaagccucacgggagaagagaugcauagaacgcaaucaaaguauccauuuuagcauguuucacccaaggaagaaagcagcguauuaauaacaucauuuaauacggccucacuaucuccacccuucacauagcauguagcucccgaauacucauaaauccacuguguguagaacagggucuucaguaaggaaacugaggcacagagcauugacguauaacauggagcuugcauuugaaccugugugguccagcccuaacuguucugcacucccccuuuaccuguucagucagacucaggaaggcuggagaggcucgaacucaguccuuuacaccuguccauaauucuaggcugcaagacacacuuugggggaaaccggucucauuucuugagccuuccuccucuuaagaaccaaagagagccgagucuggaugaggccucugugguuggcaaccuggacuggauagaguuuaggaaaugucccuguaaggggaggcggcauugggugggacucaagagggaucgugagauucccgaaggagaaccuaugcaaccuugccuguugacacaugcugagccuagaagaacauuuccagggagaaaacaaacagaacucaaaaugggaccuuuaaaaaagcucuacagcacaugauaaaaugaguacucuggccugagagucaguggaaaauuauaucuuaaaaaaaaaauuauaaggcuuucuuaaaggaacaaagcagacuucuggaaaauaaugguauccccaaaauuaauuuagacauguccucuaugaaacgauagagagccacccaaaguugagugagccaccaugcaagcaagcggcaucacgaugaccuaugaaaagcaaacgguagagauaaccagccuggcggacgcuggagcacccucacuuccuaugaauccaguaaacaaaggcaggcaggaggaugcugagccucugaggaccucucugagugcugugguuccauuacugcagaaccucaguaacaguuacaaccaaccccugaguucugacgccccuauguuuaaacgcgcugguuucuuucucuggucccuggaguuacugaugccaccaaccaauugucacuaaucacgagucucuagguggucagugaaaacucgugucagccucuagccuuuuuucuuauaucucaacagaauaguguaaagucuucugaaaaauauucauacauuuaacauuuaccaucuuuauagaaagaucuuaaauaauuuccauuucccgcuuccuauuuccuaagccauagaggaucguaagcuuccggugauccucacaaagucuacaacaaaaccaaaaacaacccugcauccucuacaacgaggcagugcagacugcuaacuuaggaaauauaaguagcgaccaucauccuucuuaagcacaaaagaaaaagacuuuugcugaauuucacccgugaaggcccuucccuuguuauccuuggaggaccuguuccucugucauaugcuagauggcgcuacacucuccucuccuccuuagcaguuggaggcacauacuugugugacugagaagugccccugaaucuuuuuuuuuuuaagauuuauuuauuuauuauauguaaguacacuguagcaaucuucagacacaccagaagagggccgucagaccucguuacggaucauugugagccaccaugugguugcugggauuugaacuccggaccuuuggaagagcagucaggugcucuuacccacugagcuaucucaccagcccgccucugaaucuugauggacaguuaguuccaaccacaggagagugugugggaacaaacgucuguuuauuaauuaauuaauuagcuaauuaauuaauuaauuaacuaauauaucacaucguuauuagcccucauauaugacagagccccagacuccacagacaagcgaugcccauuagggacagugagcaggugagugugaagaguuacauuuugauucaucccaguaaguucuccugcucuacucugaaugcccaagaacuucauacaaacacaucuuggcuugacccaucggcuauguucacaguuaacaguuaugacuaccuuuguauauaaagcacuuuaccaaauauauuagugacuuuuuuuuuuacuaugaguugauguuaucaaaaaaaaauagcaggauauuaaguguaaaaggaucuuugagauaaaguuuagaaaacacugaaguucaagaauuuauccauaagagcacacaucuaaucagcagaggugauucaagcccagguuguccaucccaggcccaccuguggagggcucuaucucucucagaaauugguuguuuguuuuugucaagucucugaaaguugauaguuuguaaauaaauauccaacaccuucaugcuaaaaggaaaucuauaacaacaaaaaaaagugcuaauaauguaagcaaugacugcacguuuucauuugucuaacauggcuuauuuuucacucuguaaagugguucuaguuucuugagccagugauuucucaugacucaccaucuugaccuugucugccuagguccuggcauuacccucuaaggcucuuuaacuuaaagccucuuugucucugugguuucucacaaggaaaaggaguaggaucagaaaguuagacuccuggaagguuccguucugaaaucugcuccgugauuaauuuaaggucuugcuuuuacuuacucaaaguauguuuuuguuuauuuccuuuauuuuuuuucuuccugaauuguaaaucggaacuucuguuguuuuuguugcuaacuaauuucaaauuugcgaggagucuguuuaccaggcauagagaauccauuugccguaugaaguuugcuuagguugccagcagcagaaugucuacggagagaagccuauuucuagaugaccccauggagugagcuaauuugacacauuauuucauuuguauuuauacacuggaaugauauuccaaaggcacaaaauaaucucuguucuauguauaaaacaagaaaacaaaaagcagacaggacauaauagcauaaccaaccgugauguaaggcuuauuuaaaaaacaaaacacugaccuccugccuaaaaauaacccaaaccaacaugguuuguaaaaaacaugacugugauuggagaguagggagacacacuauuuuaaaaaaugaaguggaaauaugaaagcaagagagaagcagacaacauggagguugugugugaaugaaugauaugugugaaggcccaaugcaaaaccaagcgacagucaaaugaggggggcucuguuacuguuugcacauagaaaacuuuuuuucuccuagaguauauucugagucacaaugagaagcguauuuuagcaaccacguugaucagugauagcugguuauccuuaucaaccacgauguacuaucaccguagcaugugcuacacuuucguacagguaacaauguagagggguuuucaucagcguggccgggggcaugucacguuucccugugauguuauggcaucccuuaaaaaaacaguguuucccagaucuauuaggaguuuaugcaaccucaauugcuuaugcuccuauaguaguguacaacuguaauuuaaaagugaagugauacaccccccacccccccacacacauuaugaauauaaguggaaauauaaguggcuccaaaauguaaacuuuuaagauauuuugggcaacaagcuuuuaaaaacaauuucacuuuccaugcguuuuagaucagggguucucaaccugugggucgcggccccucucgggucaaacaaucuuucacagggguugcuacaagauauccugcauaucgaauauuuguguuaugauuuauaacaguagcaaaaucacaguuauggaguagcagugaaaaugccuuuauaguugggggggggucacuacaacaugagggaaaauguauuaaaggcucuuagcauuaggaaggcugagagccacugcucuaaaucuugacuggauuuuguguuuaguggcuucuuaaaggauuguggggugaagaaaucaacuacacuuuacauuacacuuucagagaggaggaggguguggcuggggcucugugaccccuucagugaugcugccugugcaucuaguaaaugacaauacuugcuuaaagggugaacuaaaaaagagaaagaggaaggcaucucauucugucuccucucugcuaucuuuaaagacaucacucuggaaagaagaaggaagaauacauuuccaaacccauauuuacuacaaauaucuuaauugauucagggagucuaagugaauucugacguauuugccuaaaacaaaacaaaacaaaacaaaacaaaacaaaacaaaaggacuguaucacugaauuuguaaaacuuggagaagaauaaccccucaaaaaguuaucaacagaaccuugagugacugaccaccauacuguugucaacauacauuaucacuaauagcacuauuacauacauacauuuuucuuucaaguuucagcaugcucuauaaggguuuuguguaaacacacaauaaugucauauaggguuggauacauacauuaaaguaagccuuuaggaaaaaaaaucaaauuagacuugggaaaaauugagccauugccuuacaggccucauauguaagucaggcagcauuggcauacacagaagcagaggcaggcaaaucucagaguuuaaggccagccuggucuacagggggaguucuaggacagccaggaaauaacagggaaacccugucucaaaaaacaaaaaugaauagauaaaugaauagauagauagauagauagauagauagauagauagauggauggauggauggauggauagauagauagauagauagauagauagauagauagauagauagauagauaaugagugagugaauacggccucagauggcaauagccaaucacaagccauauuaccauaaaaaucacuuuuccaucuggauaaccccggcucucugguaacgaucaccugcacacacauuguugguaauaaucugauuugaucauagcuccccaaggguauuuauaucugcacguacugacuuguuaaauuaugccgugcuaauugaugguucacaugacaagauaugcauagcugaucaugcucauuaaaaugcaggcuauucucaauuaugugcaacaaacgaugugccugggacuuuuaacacacucaaaccacacugaauccccgaauuuauaggcuguaauccuucggccuucuuccaaaacuugugcauaaguacuuagucugaggcguaaagcaggaccacaugccagcaugcacguucuuauuuaaaugggaaaagacaaugacauuauuuccuauuuggcauuguguagauagaaacacccaccgaucugagucuugaaauacuuuccacacaggugucugcuguugugcaaauacaauuaaguuggucuggcucacaguuucuacagggagagagaggaaaaggcaagggcuaagagccccuguccugagaagucaaugcucugagcugugacuguuuccugauugacaguccuaguaggugggacaggcagaguuuuuaaauaaaguuucuuucauagaccuuucaauccuaguguuucaaauauguuaaggggcugaaaagauggcucagagguuaaaagcauucauuagcugcucuuccaagggacccagguucaguucccagaacucacaugacagcucauaacugucuacuuaacuucaguuccaggggauauuucccuaccccccaccccgucauacacacacacacacacacacacacacacacacacacacacacacacacacagaguuuuccuccugaacugcaccaucugaauuuugcacugagaagauacuuggaauucuagcugaagaacagucacuccuucaucugagcaggcaugcagugcaucugucuagugcaguuaacuggcagcuugcacugaucuuuugcaaguguggucucccagccgaaagcuuaaaaccugugaagacuccaccagggggcugcagagcuguucaccuaucagcaucauucaccuaggcagcaggacauagcccaucguugauccuuucucucaguuuuuguuuuauuuuggccagaugugguauuuggggcugaauuucaggaacccaaaggcaacacugugaggcgggggcucagggccagguguggugugcugagcacuuagcuacuccauccuacacuagccucgagaggcuuccccaggaaucuaugcauuugggccagacacucggcagugacuguuuucacgacggcugaaaucccauuuuauuaaggaaagacuggcuuaagagcaaagggcagacaauaagggcaguccuuaagguguugguuuuaccucaguccuuccaaauccuguggcaacgguuagcagcaaccguuugaaucuuucaaacugaggugugguacacucucugggcuuucaauccuugcuuugaaucacauacuucuucugaaauccuauacugacugucucaucuuauuuucugagagcauuugucucacuccuucuaagcccuggaagaguuuauuaaagucacauuauuuuugucuuguuuguguuagcugcccaggcccugcagcucauguuuaaggugugucccugggggaaguacucuucacuuucccacaugucuccaggaccaaggaaauaugacuucacacaauagcuaucacccucagacugcagugagaaaacaaagccagcgagagcccugggguaugauguuuggagauacuugaucguugccgcaguagcguuuaauuagucuuggguugcugcugggggcggagugcugguaccugggcaaccuuugucaccacggguuggaacaaucaaaacauagagcuuguuaggguuuucauuucacucccggucuugaggaauagagaauaaaaagcucuucuaugucagucucugugucugucugccucucucucucucucacacacauacacaugcagacacagacacacaaacacacaauuuguagacuaaggaagugcuuucuuuguaaaauaacagugaguuuuaaaggaaugaaugauaucuuuucccaucuagaucaugaacagcgggcauaucuucccccacaguucccuucaccccucuuugcuuauuaauagguacacaauaccaagugccugaaauucaagaagcaaucucuccguuuguguuucaucuguucccucaucugccagucucccuagcacauugcuacaaaugcuggacauggaccacaaagacccaaaugguggccggaagcaagugugggacugcgggcaugaugguucacuacuguuguguguuuuuagaccccgaguaaaaucacaggcacuuuagucccccaaaaagaagaaaaaugcacggaggccgccugugaugucuccuugcugagcagugacagcagcugcuccagacugcacuuagcugcacuuaauggccaguuauuggcauucccuaacacggccccugagcccaggcagaccacuuccugccacggucuugccuacgcuagucugcauggaguaguuccacagugcccauuaggaacggcuugagagccauuacugucggcagacuaaaacauccuuucuacucagguuuuuuuuuuuuuuuuuucaaaagagaagugagaugaauaguuauuucuagguggugugaacaagcugucauuaacucccugggggaugaaggcacccgaacacagaaaugacacggugauguguguguguuuuuuuccuuuacguuggccacaccugugucaaaggagggaacuugccuagugugcuaggcugugaauauaaagaaccccugacacuugaaagccaagaggcaugcagaucuuacagguaucaaaagccucgugccacagacaccacaggacuccgaguccagugugacuuugggcuguuuugacaauggcaggcucugugcugugaucuggacccaucagucugaaggggacaauaggacaggggcaaauauggccaagggagggcaagcaggcugcccucccugcaagcaggcuaggcaggcucgagagggaaggccgauggaagcuagggguuugcaauaaaauaacucuuucccaggcaggcaccauuuaccucagugagccugguuauuucaugaaaauaaggcucgucauuuuaacgacugaguuccuccugucaccuuggacaaugacguaaugacaaaggauaaaggaaccuugugggcacguugacaggggcccuccccugacuauguacauaggucagaggaagcagcaggacagagacuugccuaaccuguggucacagguucccugagugacacaucaucagucccuggaacgcaaagggacgaugcguguaugugcuuuguugcuuaaagaaaggcugagagcaaggcugaaaacugcauccaugacucuccauuguagagcaguggauucacucuaggcauacacaacuaagucauaaucuacgcgauggcuagcuguccaggaauagacacagaaauaugacaaagccuaggguuaugguugagguuuuuuuuuuuuuuucuuucuuucuuucuuucucuuacagcucugcaggcaaauguuagacaggagaccuuaacucacuaacgugaaaggaagggaaagacucgccugacugaaacguaaaauaucggugucaacucucuaaccugagccaaucuccggaaaggauauuuuuagcagucucucagcacagaccuaaagaugcuugccugcgguuugcucaucuuucauccucuacggggaaggcacagguucucaagcagaaccgcccauguacaccuuucagauucaaucacagacagaagaaggcuuccgugaacgugaucuaguagcuaguggcgagagaacuaauguaaauacgcuagaguuguacuacuaauucagcugacuaaggcaguaaaccacaggaaaugugagucucugaaaauuggcagacacuacugucacuugugguugaagagagaagggaagcagugguggauggagcggaugagguuuggagggacugggucauggcaguaagggagacagccaaggcuaucacccuacaucaccauccuuguguccagcgugguaggccauguugcagauggucuaaccucugccuuggcucuacucucgcacugucuucauuuugcccaaagaacugagagcagugcugaaaauauuaucuacgacuaaacuggaagagucuugccaccuccagacaaaagaagagcucugugccuucugaggaugcccauggcaacugcuucuaaggauugucuuuaauauaaauuuaaaaaggauuacacgagggaagccagacauauaucggaacucgguauuucccacagacaauaauaaucaccacacauacaagccacgcacauacagaucuuccuuguggagaugagagcuggcuacucauuuauauuuaguuccccagaagguaggcuaccauguguucauacacacuuauccaacuggccuucauucggaagcagagguaagcauucugagucacaaacaaagagacugagauaugagauguuuaaguguccaaggccacucagagacacccaugacugggcuaaggacaaaugugggaagcuggcuccagaaucuguaacuauacuguaauugucaauuacaaucuguaaauuguaaucuguacugauggcaagaaacuggguuaucaaaaaauuuagccauuuuaaagaacagauaaaaaugacaacgugagauaaaagagacuauugaaacugguguucuuuuccuuuggggaaucucucucucucucucucucucucucucucucucucucucucucucucuguaugagaaggcuucuccccaguccaggggauuaugggauacugucuaugcccucagaagauaaguuccccuguaacuauauacaccaagaucuacaguuaaaccugggaaagaaacaacagaaauggaagccagucaaacucuaugcgucauggcagacuugagcuuccauagaaaguuuugcagauucuuauuccuggagaccugcaacaaugaaugacucaaguccaacaucauuaaggcacaaaaaucauauacacaaacaaaagguuuaugauggugugugcacucagaaauagaagggcauauaagguagugcucgaugucucagagacucagcugcagagagcccucucuugagugaaagacuggguuguucucucaggaccacugugccuaucgguccagcucugacuugaccagaaagcuucggugagagcaauccacagagaauggccuuggugcacagcaggaguguucugagugaccucaaaagccgguccaugcucagcugguuugagagaccgacgcagacuucagugacuaccaaucuaaaaaucacacagucagugcucuccaggauuucaugaucacuggacugacgucuucaagaagucacacugugccaacccaccuacugugcagaaggcaaccuacauuccaggcugaaugacuauucagggugaucuugagugagaccugauucgccucccaaugaacuccaaagccucaguacaaagucuaagcuaguaugagaguuaacuccagauacauggucugcccuuugcaauuuaaggcagccaccaacucuucauauaugaccucugauuccuaagaauagcaaaagaaauaacagccaacaugaauguacagcacaucugauuagcaccugagcccuuggcuccucagucucauaggaugaccaauauccuacugucaugacugcuagcuguaaacuuaccaaaccuaaucaaucaaccaaugcggggagggaagagggaccuguuugaugucuagggugcaggacuuuaugacuuucacaacagaagugugacaaaggucaugccgguucuauuacucagcucaucuucccaguguauggcgcaugcuagcuagcauccauuuaaacaguuuuacagugaccgaaugacuuuuuuguuuugauagacuccgucacucgucuuauuccuucucuccaaguagacuuagauucuugaaacucuaaugagggugacacggcugguuucacuguaaguggcgugagagacaaaccacaugguuuguacugaguuucaagcaaguggggagggaccacuagucucaaacacacuaggaacucuuacauaaggaucaucuuacaaccuucacucaucccagucuguguccuugaccuuuaaccucuuuccaccgcacgcucaagaugcacucugcauugugcuuuugucgaugacagguugaggguuuggcuagcaacaggcuuuagauuuuggaugaaagguuuuagauuuggggguuagagaugcaaaugucccaaacuccaaaucuccaaaauccaagaauuucugguguuaaacauuuuagauaaggaauacucagcccguagcacagucuugcucagaaaacuucaugacuccacaggggcaccacucccuuggcucugcucagagggaagcuggguccugcacagccuggaaaggaauaguccuaacauuaacccgcucugcagcuggcuauaaugcuaaggaugcugaacguccagaagccaguccccaaaccagcacugagcacugcugacaucacuuagauaggugacccacucuuaaagcaggugacagcaagaagauggagagacaggguacuaacaugagaauuuagagagagcucucugccuagucuccaagaguaguccaagcuaggccuuuaggcuggaaagaguuaauucuucugcaguuuuuuuucaaccuuucauuuuugcaaugcacauuugucaucauaggaaggcaguccaaauaugaauguauacaaugaaagccacauguguagaaaugaaaaaaaaaaaaagucuuacaagacagaaagccagaacgaccuacagagaagugacagaaacuuggcauuuaguugcugaaacaagcauacuuguuggcaaagggcacuuaucuccugucagaugguuacggagguuugcaagacagaaaaauaaaacacaauaaugaccagaguaaacaccuuaagcuguaccuagccuuuagcaaauuaugugcugauggucccuagauaacuuccuccccgccccaccccccacccuacccaaaccacacccaccucauccacuuuuuuuuuuuuuuuuuuuuauuagcacauucaguucucugcuggaaagcuacaauagagggucacugaaauggguggguuuuacucuauccucaaagucaaaaggaagacgcagcggagaggugccacggccaucuugcugaguuaagagugacuccagaagucguuuacauuccacacaaguggcuuugaaucucugcacaugggguagugggauaugaucuaguccuguaagagagaccgaccuucaugccugauguucugcccaugccaaucagaacucauagaagagagccacauagcuagcaaagucuugauuuuauguacggcucaagugguagucaagaaauaaaauguaguaucauuuccauggugacccuucugaaaagacgcaccuggguugagagaauucaauaggagccagaaucuucucuuauuauguccaaaugggaccagauaggaggaauucauagcucagaaaggagggagagaugaaucugcaucaucgaagcccagagaggugggcgggacacauccucgcagagggaacagcuuuacauaugaccggugcuugcguccuuaccuuugauucucuuauucugaaagaaaggcuguuuuuacagcagcuuggaacaucagguucuuucccacacuaaggagcugaaaacaucuuuugugucugaaacaccaaguguccuuucucuuucuagugaagggagguggaggauuguaggagcacccagucuauacucagaacuuugaguaaaauuaauauugaaguagucuguaaucccuugaggucagagaacacugaaacccaaagggaaguaagcuagacuuucaaaccucucauaagaacccacaccaucaauaauccacauggugauuacuuaaauucuacuuuuccaaguuguggcugcuggcucaagucauugacauacauacaaagaaacuucuagcaaggagaggaaauucuuuuuucuuuccaugccagaccaaagcuuuuuccagacaacggucacuccccucauccugucaagagcuaggcuaacacugaguagaaaccucaccuggaacuucaggagagaaucuugcagagugucgagauacgaaaaguuugaguuccugguccaaguugcacucaaucagguuugugucccacgaucggaucccuguggaggaaaaggaggacaguuggcaggcuucugggagucaccucagagugguuuggaaagcacccccauggacguuucucucgggccuuuugauggcagguaccuuggcuagcgguggaugcccacaagugggaaagggaaggccccuccccugggacacaagggaggaagaacuaacugugagccugaaguucugccccccucagaaaggguacgugcagcaaggcugggggcugaaagcaaacagcagacucaaggcaggcugggaggcacagaagaugacaguucuggcuaagaggccccagacuaccaucagcuucuucagcuccacuaaguggccaaugucagaugcaggugggacgggcggcugccauucaagccuggcucucuguuuuccaaaggaugcucuugcagugcaugugugugauuuuuuacuuguuuuugaccuugguuucuuccccccccccauaucaaucucaaauugugugaucuuugauaagcagguggaacucaagguuuagacuaggaguccuaucaguaauuuacuuuauuuagucagcuggucagggagugcuuuucauucacaauuguugagcuauacugaauuuuuuuuuaaauccaggggaacuuuuuauacuugauaaaacuucgguaguuugggggugggcaugaacucccaugcgucagccuggaaggagccaucaagagccagcauaacccacagugaagcaucagagugacugugguuuucaguacuggccauaucuccucggucucuucuguacuccucucccucccucuucaacccaaaggaggugucucagagggaacacagagaccaucaaguuaugagaacccuggacagaagccaggaaagcugugagcugccaaagcccagacaacaucucucuguguguucacauguaauauguaauguguguguucacguguaugugcguucauggguaugugcucggacuuuccccaacagacugcgugugauggagccaguacacagcaccaggacuguacacuggugugaacagccucaacugccggaaaccaauuucugagccaacaaguauuuauuaucagacuccucagagagaggcuuaagcccuuagguggauaucugcaagugagcuaucucuaaccaaaaggccaaugauugauugauccauugauugauuaguauuuaugccaucagccuagaggguuuacaugguagugcaugaaacccaccucuaaauccuuaaugucuaccuccauuuaccaccauuguuuuccuaucuuagggauaaucaugugcauuauacuauaguauauacaacacaggucuuaauuauauguaauauuuugauuaaagauauauuagauauagaucuuuuaaaagauuguagaacucaguucacuauacauaaaaagauaucuucaaauucauuuucucucucucuuuuucucucauuuuuauuuuauuuuauuuuuuuuuuuuugagacagggucuuauuacauagccaaaccagccuagaauucgcucuaacuaguucagguggccuugaaauuguaacucugaugccugagcuucuagaccuguuccaucagaggaaccuucucaacagcugggugucccuucaauagagggagaauuucucacaggaauagcaggaaagauucagacaagaaagaguuaacacuccuaaggagaggcuaaauuauaagggaaaauuuuaugagucucccuggaaacauuaaauagccucaguuugcauuugugcuaauggaauauuuaaauuuuaacaagaaaggcauguugagaguuugugggucuuuuuaguggagacaugauaaauggcuucuuuuuguuccccgcagagcuugacagguugagaggucugaauucauuagaauauuuuacuucaacauauauacacucuauacuagccucgugugcaaagccauugaguuccugucggaguggcuuaaucggaaccauugauggagcuccauuuugucuucuggcuugucaagccaggucaauaaguuaauaaugagacauauguauuuaaauucauacuauuuuuccaucuuuguucuaaguaacgucuaaauggcugcacuauuugaaugacuuugucuggggcuggguacccgcuugcucuugcauugauauuuguuauuucucccuugucacgacaccaguggugaauuguucauuuuauauucauuuaugucauuuacauuuauaauuugacaacagaaaaauguuaaacuuuaaaaaaauccauugaguugauguuuuuuuuuuuuuuaauaaaaccaguagacaguugguaaaaauaacuuccgguguguaaacugccaaugaaagaaaaauauucaagguucucucuaagagagcaauuuccagucaaaauauuuaaggaugcauaauuggugcugugguuuauagaaagacuauauagacuucaugguuacuuuaguugggagugaacacucuggagccuuaucaguuuuagaaauaaaacacuuagucacgaguuggucccuuaugcuggauauugcuagcaaagggagacauuugcaaugaaggcugauugcuuuugacugucuuuccaugucucuccuucaugccuaacugggagccaaagcuggagccccugcaguugauaagcccuuugcacauucucccucuggacucugcagccaaagaggggagauaccuggguguuguuaagaaguucugaaagagauucugaaacggggggggggggggggacgugggagaggggaggggacacauuauauuccucgccccucuaagggcaagcucuucauugaggcuuugauucuguagccaucuaagaggaguuuguccuuccuggauuacccaggggcuaacaacuggagcaacugggcguaguuaaccuguguuucaaaugccuggcuagguucaaggggcuaggguucagguuccaggcuguuccgggauccugucucugcccagggaggaaaacacuguccuguguucauuccaggugggcaggaagcaucagaccaucuuuucuuuucauuucucucaccccaugugguagcgaugcacaaagaagugggcgugcacgugguguuuaagagagggggaaaagaaggggaaggguauuucagagcuggucagggugaggaaggaaggugcguaucauauacugggucuuccagcuggauuacguaaagcuuacccugaucuuguagaaacuuuuggcuuaauaaaaccaaaaagcaccucuccuuuaguggaugaaaacugcauuauuucuaaccgaagcagcagaucaaagaaaggaaaaugaauggaccacaccgugcaugccggacacgugacagcuaccugggccuuugacaaguuauuuuccucaaugggcccaauuuaaucguucccuuuuaaaagcaggcuuuugaguauuucuuguaaauaucugaauggucagccuauaauccuaugauucuguuuggaaaacgacacuagaagguaacuugaaccuaggauagacguauaaaccagagaagcagcuaaacggaaaaugcuaagaggcuuuuuagagaaaagauuucccagcuuuccuuugaccuagccuuugguuugcuucucuuuuuacaaagccaguaacuuaauauucgucuuauauucguguuuaaugaaaaugauaucucacauggacagcacaucacuucagagcauuggcaauaauuaaaaaaaaaaagaaagaaaaagaaaaauaaacaaccucaagucuuggauaacaucuuagaauagaagcaaauaguuaucuauaagaauuuauuucuaaaucuaaaagcuagaaauuacuuuuaaaagcaagcuuuuagggaagauuuacaacaaagcauugauuuaaugaccuuccauuuagggacugacucgcuuggauuucagcuaggaucacagagcccuuagugguaacaccaauuaggcagaacaagcaaaaauccaucugccuccugauuuuggaagugugaagaugaauauaauaaauguaacacauucuagcgucucuuuaucuccuaccauauaugguuuucacuucuuuuucuuugcuagaagaaaaugaaaaugaaaucccaaagccuuucuggguucuuuauuuucuugccuacaauuuuggagagaacauuuucacuaaggaggcaucagacuauuacaauguaaccagcuuaacucacaccuaaagacucaaggcaguggauagcacacuuaucuaucuucucauaagcacaucuugcuuauaucuaaugucaccuagagagacaguuaguugcccucuaaucauaauugaaagcaucagacugacacuuaacauucauuagaugacuuuggcuucuuuagaaagaauggcacgaacugaugaaaacucaauuguaccauguuuuaaauuucagugugaccgguauuguuguauagagucuaaauauuaaaauauacccagaugccagcauuuugguaagaauaaggcuaucaggcuaccuccacauuggggacaauuagggaaggacagaugaaucaguuggugguguccacuguaguuugggaucaaguccuauagaacugcaucaguguagcucgaacagugcaagugaacacuauuguuugaagcucuggagaagaaaugaucaacccugauuuugugcuuuucaaaaacagcugagcauuuuucuuccuuggucuccagaagcacuuagcauccauguaggguguuucgggccuguugauuugcuucgguaucuaccaucccucuacaggggucuagauuuauuuauuuauuuauuuauuuauuuauuuauuuauugccuuucuggagugcucuuggguaaucaaucagauggccaauaugccagacuccagggucuccagcuacauagugccucagucuggaugggaaaggaagagggaauaagaaaggcuaacagcugagagaaaugguuuccccagcccucagggagcugaccagccgagcuugagccccauggagcagcuucuucuugccucaagcaacauagccugcaggcaacaauagcaguggcaccauagugaccucuggaggaggcccagcugggaucugccagcugaagcagcagugcgccccgccaaggaaacagagccugacugcccuguugcuaagucaucucagacuguuugaaaagccggggaagcagaguuuucacuuauccuugaaaacccgggcagugugagcugcaucgggagacccggggacccaggagagcacucucuagaggaucagcaacaucuguuacuacccuggaggaaauggcucugcucacacacuugguugauucuuaaugagaucgauacaaccauuucagaaaucuauuccaaaaaaaaaaaaaaaaaaaaaaaaaaaaaaaggaaagaaagaaaaaaaaccugaccaaauuagggaauuaaaaaucaaaaaaagcauggugauugcaaaaugaacauuaggauugguggguggggugacuucugagauucuuguaaauggcuguuucuuagcuggacaacacaggugucuucacuuugugaaaauucagugaacuguucucugcgguuugugcuuuucccucucucucucucaaauauucuuccuuccuuccuuucuuccuuuccuccuucccuccuucuuucccuuucuuuccuacuuucugcuguuaagaagacaaaucuggauuuaggacuaaaugcuaguaaagccaggacauaacgcacagaauuccuuggcugcaucuauuuucuccuccaacagaaagaggcuugaauaaagccuggaacggaucgcauaaggaaugaucaaacccgguaacaaagcgggaagauaaacgugguugcaaggcgauggcugagccuccucccuguaccaagaggugcccacaaguagaugacuuguucaaagacaaggucagaagacugccugcugaaucugugauguuagccugcuggcacuccuaucuagaccgggucacacaaguagugacacugcaguagccguucuccuggcacagcuuugcuccgugaccuugagucugucccucacucuuccucccucaugucuguucucaagcucuaaaaaugggcgugaugauuccucuccuggcaccacaaugggugauucugaacauucuggagaugaaaaagcacuucuuaauggauuguuuccagaaauauuaaguaaaaaaaaaaaaaaaagauuuaaaaacaccuagccauuaauucccacaauagccacacccaaagucaguacuugugaguuuuuccaaggagaaaaacguggaaauaaacgaaguuugagaaacagaucaaaagcccguaaucugaaaaugaaggaugauuacugagacauucagaaaaagcauuccacuuuugaaaucucuuauucuugaucuuccccucaugaaaaaucacgacaggcuuucugaucacuuuuuuuuccuuuuaagcugaaagggaaaauccgugcuuuaaaguuaaacaaaagaaccgggucugcaacuccaguccccacccugaagccuuuuguucuggggacaagugggcauuuccaaaugcagaggcaggugacaagcuuuuguuuauuuauuuauucaucuaaaccaaaaucauuucauccaucuuuuauuggcaugauagggagaaggaaaggagggcuacgugaacgcccuuuguccgccucgggcugccguagagaccgcagugcggacugcaccacgcccaccagccggugucuccuagcagaaacguuucagcaccaccccaagagaauagagcgcucaggcuggagcugcacacggacccggggacuucugccagggaugaagugaagggagggaugcgaggggggcggaauaaagcagaggcuagagcugccaccggggagucgggagcgcaacaaaaccgcucacagccaaaggugggcgcaaggcccccugacagcgcgaggcucgggcagagccagcaucgugccagccgggggcgccgcagugcgggggcaggugcggcuguccagcgcgggcacugcggcagaccggguggggcugaagggcgggccgaugguugcccgcccaaggcugugcccucccggacccucccagccccgcccaggguuccccgggaaccgcuauuccgcuaccgcagagcccguuccuggugcgcgcagcagcgcaggagcugacccuccccugccaccuccuccucccauucaagcuauggcuccugaagcuaagacuuuucaaagaagcccacccacgcaaccuggggucccauuguccuuucugaaagcugcagccaggaccucaggggcaagagcgaggcugggcuucgucuagaaacagagcgcagacggguuccaugccuguauccucgggggcugggggggagggggggggacgggcguggcccaaggacuagccuagucauucccaggaaagaaagaaucgggaaguuuuaagucagaaaaggcauucucuauucucagaggggugugugugugugugugugugugugugugugugugugugugacuggcgggggcggggagcacgaggugacugugauaaagacgauuuccaugcgggccuuggcacaugguguuuugaccccagguuuucggguaaggggaggugggucccagccuuuggcuagggcgagagcugagcugaaagaagagguuuugcuaggcucaccccacccuuucuccgccugcgguugcgguuuuauuauggccuccgcuccucugacaccugcauuucaaagagcacgagaggagguagccaagucggcgguggccacggacccagccaggugaccuaucccucagggcuauuauaaagauccccucucugggucucaaauaaaauaauuuagaaauuagcccagaaaaagaguccagauggagugugggagguggcccggagaggcgugggugcggggcgugcgggagaacaagguggccgucgcgcccuggguggggucgugcuggcgcgucuccccacucacgccccuggggggccucgggaccgcuuacccagcucgauguugccgauggcacgccucaggugcucuucgguuacggucucgccgaccaccaccagcaaguagaacuugcugucuaggaagcggugcgacaggcugggcgagguggacgccgccggguugccgaugcugcccgauggcuccgguucgguggcuuccaccaccacggucgccauccugccggcucugcucaagccugagagaaguguuccucucccgccgcuccucugcucugcggcaggagaaaggauuaucuccgaaggugcugucuccgcuccgcccccugcguccccccu

SEQ ID NO: 7198 - RNA, 4472 nt, Mus musculus
agggacauacaaaacagagucucucaacaucaccuuucauguccuuaaagcacgcuuggcuucuccuugcuucugcuacaugguuucuuaagagaagucuuccaggagaugaggcagaacaguauuccugcuccuccugcgugcuguggaggugaaguuguguuucuuacaauaucacauguaccuaaaauaaauagcaaaaggugagugucaguggacaagaaaagacuuuucagcucaucaauaacuguacccaguuauaaauaggcacccaggagccaccgcagcaaagguucucaaaguuccaggcugugggaggaaauggauucgcuggcugauaucugaaaacaacucagagagacauuuugagcuucaaagaggcccccuaagaccucaaucucuucuaaaugcccuuguguuucagugacugucagcaauauccgcacucagaaccuggaagcgaggcauuucuugcgcgguacaccucuuccuaacacccccaacacugcugcugacaaagauggcugaccccccugaugacagcgcaaagcugaaguucaagugagcuaucaggacuuucucuacaagaaugcaaacaccagcuccccaaaaguugaagguggugggccugaagaccgaggcauuuuacuuuggggauaaagagaaaucgaggaaggaaacaacaacaacaacaacaacaaaccacuccauauucugcuuggcacagcauuaauaaaccucaucuugugcccuagccaccuacccaagugagccauccaaucucugauucucagacuucucauaugaaaggcauagacuaacaggauggaccgagguagugaacacccgugagacgcacagcccgugagugcggcguggcgcaaaggaucugcuaagaccaggguugcaagggaaagagaguugccuugggagacggccaggucagaucguggguuguucuugcuuuguuucauucaaagcccaggcuggucuugggaagauucugucucugcacccugcacucuccacugugagguuccaauccccgugcaucuaauaauucagaugucccugguuaucuguggcuccuacccccacacugucaagcaggcuaugccagagcugauuuguguccaacgaggcuguaaucgacacaguuaucauaucauaaaaccaaggucacgggaaggugacgguggguaaagaaucuauuagguucaauuaaauaauaugaauaaaucaucuugauuuaaaaaaaaaaagaccaugacuacaggaaaacgcauaaaccuaaacaacacuucacauuuuuaugggauuuuaugacuugcuucuugcccuuuguaccucacugccuuuccaggcucuugauuuucagcuaguuggaaguggagucaucuguuaucugcccuaggaauucuauggagaacggucccucgaaaauacuuaaagaaccauauaucucuaaugagucuagggaugacuuucagucagguuauuuuuuuaaaaaucuauuugaguguguuuggcuuguuaguucuuuugagagagggucucacuguguaaccucaccccaccucaccccaccccaccccgccccgccccaccagccuggaauuuacucuacaggcgaagcuggucauaaacaugaaguuugggauuacaggcguauaccaccaugugugcuauuuucguauugcuuuuuaaaauauuuuguuucuauuauuuuuaauuauguauaugugagaguggguaugugcgggugccugcagagaccagggaugucagaucccucagaguuauagcuacaggcgguuaggagcugcugauguaggugcugggcacagagcuuggggcuucuccgagagcaguaggagcucuuaacugcugggcuguaucucuagugccuuguuuguuuuaugugucucuuuguuuuguuucugagacaaggucccauucuggagccuuggaucuuccugcucuagccuuccaaggugcugggauuauauacauaugcuaacucacucaggucaaguaucuucuucaugaacauaagaagcugcugguauggucuuuaugcugauuucaagauucuucccccaaagaaggcuucuagcaguuuccuuuccacaucaugguaaagaugcauucagugcuggcuuggaggaugcgcaucuuauccuggggucagcacagcacuggauccaaaagggaaagguucacacacgcacacacacacacaacuccaacaagaugaaccugcuugagcuguuuucugcuuugucugauuuagcucaaaugauucagcgugagugugaaccaggcaaggagagggcuucccuuguccuuguccuucuguugcaucguaacuagucaguguuuuccaauccuucccgagcuccagucucugagcucaucaucuccuguagacgacagcccguuuuguugguaaacagccgugauuuagagaugacgucuuauuugaaaaaguccgucauuguguaccaagcacuuucguguguguuugugaaaggcuuagaagcauauuauauuuaugccauuauugccccugaauauuuauaugcacagccacaguuuagagguaucuggaggccuuuauaauuuauuuaaaaagcugcucuaaauuaauccaggagaaggccaauauaacaagacaaauagauccuaguccaccuuuggucaaccaugucccagaaagauagcaauugcauaaauauauagcccacaguggcaauugccccgcccacuuacguaagcagcacagcauagacaaaugccuaagcauuuuagcuguacacagcacuuucccuugaauauguaagcaaagaguucagaucugagggcuuguuuuaagggcugauaucuuccugacuccagccuuuuugcuuaucaggauucagacaaaauacauuucguccugugcuaacccgguaauuccaucuuugcaaguaguagcugaucaaucauuaugugucaucuuugaaaggauuuccauuucuuuccuucagggccuagggaugccuagggcaacaggaaggugugauuucuuuuucuccugguauaauuguaggugagaaauaagacaagcagggcaguuuucccuggguggcuaggcaucagaugaaaugucucugucuguuuaguaucugugcagaaguguuuugagaaaaugugagauccugugagagacacaaguccccuagccuuugauaaagcuaacaguuuugcaugcauggccucagucaaauuucaugcaaucgaucugauuuugaaacuuuauuccuggaaacuuuauucacaggaaaaaucaacguaucuauguccuccauuucacuggguauguuagcccccugccucacagcacuuaaagggauacaggggacuuuguuuuuuuaaccuugaguuaaaaaccuugucccccaucacaacauagggaagauauguggugagugucaggaaggaagugccagcaugcucuagguuucugcucacucuuacagaggaaggacuaugccugcaagggcaggggggcagagcaucagcagggacuuuccagcaugcuuagguuaaaagccauucuucauugcuauaguguuugugcuuucacuuaagaaaaauagagcaguaaauaaucucaaaaaaugcaggaacuugauuuugcaaaacauguugagugacuauugaccagugucauuugucaaagaacuuggcaucuggcugccuuacacggugugcuagagcaacaaaaacuacauucagcuuuuguuuugcacacaauguaacuaguagacacacugccugcaucuauuauauauauuuacauauauagccaucuacaucauauauauauaguguuuuuauuacuuauauaaacauuacacauaaaguaucguugcaaauacucaaaaacaggauggaguucccccucacugaagcuauauuaagggagugaggcagaaaaaugucccauguuccaacacaaugaaucaucugucauuucacuaacucuacuuaaccuucgcucugugacuagcacccuggacgcaugugcagugaacauuaguacucugcuaacgacgccuucacuuguucaugcuauugaucugcuuggguuccggcucacuaagcccagcugcucccugcucggagggaaaagaugcugacuaagcagagggaggacgagcucugccacagagacccauucuuuccuguccacucggaggacuuacgugagcucaacaccagcuacucaaacugcacugugagccuccccaugagagaguauuggaaaagcaaguguuaccugcugcauuggcuucacaguaucagaaccugacgacccaggcccugcgucuaucucuggcuccuccuauguucucugggaucucacagcagagcagaagacauuugcuugccuuuguuuucucucagugauaaagggucagagagug

SEQ ID NO: 7199 - RNA, 55409 nt, Mus musculus
cggaguuucaggugaaugggucaccgagggaggaggcuggccacgccacaccucgucgcuagugcccaccucccggccccucuuuccuuaggcgacagcgguggaguugcgggagagcgguccagcgcacggagcaaccggcuaggggcucggcaggugggucccagcgcacagccccgggcggguucggccagaaauuggugcgcaugcccggggguagggggugggggaagcggaggacgguccuccuggcucaguugaacuguggauuggcagcgcgggcggcggcaggugcaccggccaggugagcaccuugggauuccggccgccaaggugggugcgaggcaggugcggugcccggggucccccagggugacgcgccggggcugggaggcgaggcgcggggagggcacgcggagccaguuucgguggcaguuucgcccuggacucggcucucacggaaaccagagaagcgcgugugccugagcgcagcgcgggaggaucuggggggcucccuuucucucucggagucgcgggcgaaaccuuguccaccagaaaugcccgagcuacuuucuacuuuugccgaggcgggagcgucgggggcggauccagcgcucaacugggcgcuggagaucuguggguuacucggggucucuaguuagggcuggugcugggcgacgcagggcgauaaagaucccuguggcccuucugguuuccgcucuuuuggguaauucaucccaggagggaggccggggguccucugcagcguccccagagucguggaguguauuauucuggcuguuuggaacagggggcggugcgugcguccuuguugauuucagcuuuugguguucuuuucgagugaggcuggauuucgagggaagcugcucacgcgguggauucucauccgugaccgcgggccggggaccugccccggggcagggccugcucugcugcccugcucuggccuggcggcucccgagcgcaaagcugcgguggggcgcacggucucggggacccgcagccuguauaggcgguccacuuugcagaccuccugggcaaagucggccccgcgagucuagcggcgaguggccuugcaucagaggaaguaugcggggacaaauggguggggaccaaaauggccucugcaucuuggcgcuggaacaacucugagccccuuucgacccagguggaguaaccgggguuccagcgggagcggagguauccucgggccugcccggggcucaccgggcaaacugccacuaggggaauuaccuggggcggggagaaggcagcuuuccaggcagguuagcaaugcguggcuuucauauacaacagguguguuguugggaucaccggaaaagaggaaugccucucaguaaugcgcuuucuggugacgcuuucagugguucgugcguuguucaacuacauaucccugaguauaacuguaguuccuuugcgccguauguauaaaucuuaaauuuccacuguuggugguuuucuuuucuuuuuucguuuggauuuaucuuaguuguuagugcuuucuuuguuaggcaauggaauggcgagguuggccagauagacuuaaguagggagugggcacaguccacauuccagcagcuuccaggcaacuuagaaaguaugagcaucuuugugaaagguaaauccuaccagaacucuauuuuaaagguuggggaagggggggggguaggcuaagguuggaaucucagcaaagcuucaaaaaucuacagaaggcaggauacagaaaacuuaagcaaacucacaaggaguaguuaacuguagagaauuucagagaaaauaacuacuauagcgagccgaggcaauuaucaaaccagcccauuguaccacuuccaccuuuaaaauagaaaugacuaaguaucauuuacacauugaacaguuuuacacauuggggaauacaauuuagggcucagcucuaaggaccuuaaagcugagcuguguacucccaacccccaagcaaacuuguauuuuuguuuuuuagucuuucuuggcuauugaauuuuggagcaccuuggcuuuguuuauuuguuuucuuuuguuuuuguuuuauucccugagguacuugugucuuguaguuugggacagggucguuuauucugcuuuucuaagaaguuagaaggaaugccucugcuguugacuuuccuccuccuaucugggaauguagcaagcacagacuuuggcugaccucaauuugauacauuuacuauucauuuguguaguuuaagaucuccacugccagacuaagucgcaaguuauuagcaucauggagcaucaaccuuauuaacccagcauguaacgcuaaggaccaguagagugaccagggaaggugauguucaagacauuuaugaguguuuguggagcucucuuguucccccuggggucagguauggaagaaaacuccugaguggucuggagagcaucccugagacuauguuugaacugugaacugaacuuggggaugugccuggcaacaucaagaugcucacugggggcggagcauaguguuucagaacuugggaggcagaggaucucacagauggaucucugugaguucaaggucagcuuggucuacaaaaugaguuccaaaaaaucuagagcuauauaaugagaucccugucucaaaaaggaaagugaagggcuggagagauggcucagcaguaguuaagagcacugacugcucuucugaagguccugaguucaaaucucagcaaccacaugguggcucacaacuauccauaaugagaccugaccccccucuccuggggugucugaagacagcuacaguguacuuauguauaauaaauaaaucuuuaaaaaagaaaaugaaaaguuaaauuuuggagguuggagagauggcucagugguuaagaauauaugcugcucuucuauaggaccuggguucaauucccagcaaucauguccagcagcucacaacugccuguaacugggagauggcuuaguggguaaagcacucgccagcaggccugauggcuugaugcaucccacguggagggaagagaacaccacauacagugagacaugagugcaaauuaacacaaauaaaaagguccucuuuagaagcugggauguagcuuagugguagagugcuugguuagcaugcauaaaguccuagguucaaucucauuuugguggggugggagaaggggggaggggggauccuaccuggguuucuagagagagacuuuuuuuuuucgagacaagguuucucuguauaguccuggcuguccuggagcucacuuuguagaccaggcuggccuugaacucagaaaucugccugccucugccucccgagugcugggaucaaaggcgugcaccaccacgcccggcgagagagacuuuuuuagagaucuguuuauuuuacuuuaugugucugaauguuuugccuacguguauauaugugccuacacaccuaugccuguuacuggaucacugaaaccagaguuauugaugguuuugaacuaauaugguggugcugggaauugaacucugaucuucuuuaagagcaucaaguaauuuuaaccucggagccauuucuccagucccuagagagauauucuguauguauguauguauguuagguuuuguuguuguuguuuguuuuuaagacgagaucucucuguguagcuccagcaguccuggaaccugcuuugaagaccagguugaucucuaacuugcagagagauccaccugccucuggcuuccaagugcugugauuaaaggcguaugcaacuauacuuagcuucacacacacacacacacacacacacacacacacacacggcuagaaaugugagguuuucuguguaacguguucuguaaggaacuguuggagcugccuuauagcugugugucuaaucuuuaugcucugcugaugaaagugaccagugggccccuuaggcuaaauccuggaggucuuuucacuccuuguuuccaccuucuuucaggaagugcugcugggcucugcucuagcugcuggcagugaagccuuguccuagauguuagggaccuugaagucucuaaaauacuaaguaacuucucuagggaagcgggagcucaaaugguuauuuguuauucuuggaagggguggagccagggccuaggaggggaaacuucccaacuuugaaaugaaaucugacccugugguuuuggguguuuuuuguuuuuguuuuuaaccauuucuaggacuacaaagauguucuuaaaauaucucagggcuuuuagaguagucuaaaaggacauuaaaagauggcugguucuccaggucaagaucuccaggacaagcauuuccuuuuugcaauuauuuuuuuuauaaggacaugauuguuuguuuugauuuuuuuuuuuuuuuaaauuaagaaccugaacucucucugggaucuguaccuaggguggaaccugaugcacacguucaggguuuuguuuguuuguuugcuuguuuuuuuucagcauuccuagauacgaacacuauuucugaguacccucuuaagauuuggauauccuuugcuaaaauucuuaccaaaggaaaugcacuuuuuaugcagagauagggaaggcaccuuuaagaacacccaaugaacaucugccgagcaggauccccuuuacccgguauaaucauauggacguuuaugaauuaagcagcauacucauuuuuccagguuccccccacuaaucuuagucccucaguuuucagggaguaggugguggugaaaccucugcuuaggcaauggguuuacggucuuuauuguuuugauucuggguuuugaacucagggccuuaugaucggcagccacugagcuaugccggaaguccuggguguacauuucuaagugacuuauucaugcuucccaacacuucagcguccgagcacguaucucacucaccuuccagguaaccacuucagguaugaaugcauuugcuuacuuucucugcuuuauuuaccucugccaaggugggggucauccccucuuuugacagagacaugaagucaucgaagcccagagaaugugagaagguguaugugugagguaauacuuggcggauagaacaaccacauuucuucaaacucauuuugaucuugcagagaccuugcucguucuagauggauuccuagcccuuggggauauuaguuacucuuuccaguguuuggucagcugcaaaucuggauaaccuugucugcggugaccacuagaguuuucaccccaggugaacauaaaugcuccauucuuugugcuaauuagaugcuguuauugggcuccuugguaaucugcccgguccuucaguuguccuccagaucuggauuccuucucuguguuccugccugguaaccuucuucagaagaggaaccaaggcguggcaggagcuguuacaaucugcuuucugaaauuguuucauaguuuagaagucccugcuccuggaaaaaaaaaaacaugacagccaaaccccaccucuagaaaacaacauuuagaaaagggacuuuguuugaauuucugauaacuaaagccugaaacucaaguaaucuaguuuuuaauaacugauuucgagccuggaauuaggggauagucggcaucaccaucuuucuccuccgucuccucuucuuuuugagucagggucucacuauguaaauguagcugcccuaaacauuguucugaaccagguuagccuuaaacucauagagauccucuugccucagccucuugaucuuaaucuugagggccaagauuaaagaugugugccaccauaccugguuuaccuuuuguauuuaaaaaaaaaauuuauguacuaacgugaaggcaugugugccaaaauacgcuuaugugcaccauguguaugcagguaccugaagaagccagagucugucagaucccugcaguuauuggcacuugcggcuugaugugggugcugggaacagaaucccaguccucuguaagagcaguaagcaccguaaguggcuaagcuaucuuccuggcuccuugcaguauuuuuggacacagucuuaacgcugaaguccauguuggacucaaacucuaggcagucaguccuccugccucagccuccaagugccaggccaguggagaacucacgguauggcccagacggaacuugaccucguggaaauccuccugcuccugccucccaagugcuggguuucagaguugcgugcgccauggugacugguuuugggaauagucuugagugacugaguuguagguguagaagggucugagauuccuuaaguucagcauugucacuguucgacucucagucucagaaauaagguuuuuguuuuguuuuuuuuuguuuuuuuuuugagacaggauuucucuguguagccuuggauguccuggaacucacucuguagaccaggcuggccucgaacucagaaaucugccugccucugccuccugagugcugggauuaaaggcaugcaccaccacgcccggcccagaaauaaggucuuacagucaauaauguuuacaguuuuuccuuaauguucuuuucccaaacgucguuuaggaagccaucuugacuuuuguuucucaaagccuccuuuggguuuaaauugaucauguuuguauuucagcaugagaugaagggcacggcugcguaccuuaggauuuauacauuuguuuguugugcauugguacuguaaaaacagaguuuuuccuccuggcuccaugcucccagaauaaugacucugagacucaaaauauauuuauaaaccccuugccuauaagcuuugccuauaaaaccccugauuagauuguaacuuaauaucacauuuauucuaaucuaagcugugccacguggcugguuaucucuacucagcucccaucuuucccuccuccacaccuuggcucucucuuagcaguucaucucccuaccagaugucccucuuucuguuuccugcuuauaagccaaucagcauuuuauuggcaggugcugcacccuauaguauacaagagauuuuuuuuuuuuuuugcuacccgauaaaaugguuuuaauaaaacaaaugaccuccaggaaacaccuugguugcuuccugguccauugccaauuuucaguguaugccgaaaaccauuugucuuacaaaaaaauugcugagagguggugaugcuugccuuuaaucccagcacucaggaggcagaguuucaggacagccaugacagagugaguugccagggcuacacagagaaacccugccuugaaaaacaaacaaacaaacaaacaaacaaacaaacaaacaggggcuggagagguggcucagcaguuaagagcacugccugcucuuccaaagauccugaguucaagucccagcaaccacaugguggcucacaaccaucuguaaugagaucugacgcccucuucuggugugucugaagacagcuacaguguacuuauuauacauaaaauaaauaaauaaaucuuuaaacaaacaaacaaacaaacaaacaaaauccacagcaugagaaguuaucuuugcuugguauuuguguugcuauuaaccuggauuuuuauuuucgagguuuuuuuuuuaaaaauaagagcauaaucuuuuuuaaaaaauuuauuuauuauuauauguaaguacacuguagcugucuucagacacuccagaagagagagucugaucucguuauggaugguugugagccaccaugugguugcugggauuugaacucaggaccuucggaaaagcaggcggcacucuuaaccauugagccaucucuccaacccucgagguuuuauuuaauauacacagucuuauucugagauucggagucaacuauuuagugauguggaagagaguuacuauguagcuuacacgucacguuuuaaaagucuaaauugauugaauggaguagcuuagaauugggcagaugcuauuugaaagugagagcaaauuuugcuuuaauguacucagaucauagcccucgcucaagugucucuuggagguaccacuuuguuguauuguccugggaguuuuucauuaccgucagccugagagcacacgagguugugcaggcuguauccaugguccaaacugauauucauguaaauguugagcaaauauuugcaccucuaccuugugccaggugcuguuuuaaucagugaacaacauguagaaaaacgccuguucacauagaguuuaccuaguggaucuaaaguucucuuccuugcuaaucaauuacuagaguugccuggaaagaacacauuguaacugccugaauauacccugccugaggggcaggaagugcucaaagggguaaaacugaacuuaacguucauuuguccauucacuugcuaguccguuccuuccuuuguucuuuccuucuugccuuuaucuucugggcacacuugugugcacaccacagcauguguguagaggucagaggacagcuuacagguguuguuucccucuuuccuuuauguagguccuggagauugaacccaguuccucauccuugguggcaagucccuuuaucugcugagccaugccauaggcccuuuuuugaccuuucuuucuuucuuucuuucuuucuuucuuucuuucuuucuuucucucuuucucucuuucucucuuucucucuuucucucuuucucucuuucucucuuucucucuuucucucuuucucucuuucucucuuucucucuuucguucuuuuguuuuuuuuguuuuucgagacaggguuucucuguauagcccuggcuguccuagaacucauuuuguagagcaggcuggccucgaacucagaaauccgccugccucugccucccaaguucugggauuaaaggugugcgccaccacggccagcuuucuugaccuuucuaacguuggauuuucuagaauaaacuccagcuuuuaguucucacugguuaguauuauuuccaaaagauuucucggguaccaucgagucaccuuggaccaggacaggucauguccagauucacagcuucauggacauuaacaccaguuuguccacugcagaaaagcuagcauaugaaaugaaauucacuuaaaaaccucugauaguggagaggacaggaaauaugggucagguuacaucucagugacucacuggcuuugagcauguuacuuccccgcgucuuucugguucuuucuggauuuguaaaguagguaagauaagcaaggugaguuucagucucaauuggaauuuuguggagcagcuggcacauggguggauacccagugccuuggccucuccucagccugugcuuccuuacgucagguucuuugcugcucggcuccuggguggccucuuuugccugucuucuugguccuaacucagucgccuguccacugcugagaaucagacuggcuuucuguuucgccccugagugagaggagaaacucucaguagauguucaaagcacuuuguacucucgugauaguauuuauuuuaauagguuaccauguccauauauggcuuccucacugguccauaaaugagccccaaccccaugcauaucagcacuuaaccugccuggaugaccuuccuuccuuccuuccaaggcacugcuaguuaaugcucuccaucuucauggcuucccgacuuaucccuugcugcucugggucacauaguucagccugaaguaguugauuguguguguguguguguguguguguguguguguguguguaucucuugcuuccacaggcuccucuguauaggggccucuuuaauaaguauguguugauugagugaaauugccuauuagguauucagagaauucuagagcaaaaauacugcacuuuucacucaggaaagaacucuuugauacguguuucauguuuuucuuuccuuuuuuuuuuuuuuuuuuugagaauuggaaacccagauaagagaauguggugggcugcaaucacaccauccacaccuacauuuugaagucacuuuuaauaagggcauacuuguaaauuagagugugcuuuaguuaccucuggagggcugacaggugcuagacacuguuguaucagcagucucaagugcauucucaucuuacaugagcauuuaaagguaauaggaaauuauuuaucuuuuuuaguucggagggauuggaucuaggaccuuggacauucuaggcaagcccuccaccauggcgcuacaguugucagcuuuuugcuuuguuuuugagagaggaaagggucuuacuguguuugugugccuagguuggucuccagcuugcuguucuuuugccccaacuuccugagaagccgggguuucugguauauaacauuguagcuggcaaugagauuauugcuuuuuuggcuuuuguuucuuuauuuuaaaaauuuaaggggcuggagagauagauggcugauagauagaugaagagauagugguuaagaacaguggcuucucuuucagaggacccagauucaauucccagcgcccacauggcaauucacagcaacucucuguaacuccaguuccaggggaucucacaccuucucucucuuucucuuucucucucucucucucucucucccucucucucucucucucucucacacacacacacacacguacacacgcacgcacgcgcgcgcgcgcacacacacacacacacacacacacacacacacacaccacucaggcaagaccaccagugaacauaaaaguaaaucauuaaucuguguugucuccacucccuaugaugguggcucaugccuuuaauuccagcacucggggaaauagaggcagcuggaucucuaaauugaaggccagccuggucuacagagugaguucuggggcagucagggauacacagagagacccugucucaaaccagaaacaacaagaaaauaaacaaaugaauaacuaacuaaauaaaaauauuuuaaaaauuguuuaaaaauuuagacaucucuguguguguguauguguguguaugugugugcgugcaugugugcguguauguguauuuguacgccauggcacacacaugaaguugagagaacagcuuguaggaguugguucucucuuuccaauuucuguguuccagggauugaacucaggucaucagacuugguggcagacacccucccacugugccauuucacugaccacaaauaguuaauuuuaugaauaaauccuuuuucuuuuuugagacaagaucucaugcuaaccucgaauuuauuucuuuuucuuuguaugcuuuuguucuuaguauuggcuaucauuuauuuauuuauuuauuuuccuucuggguuauaaaagaaugugaaguuguuauuauuguaacguuuaaagauaacuugagugccagggccaugcagaaugcaauacuugccccaugagaaaugccagguucucugugcauaaggaauuggcggguuguuacauacaguggggguggagugaguggcuaccuuggagacuccagucuuacauuucucugugcugugaacuccccuggccucgguaauuccauugcuccacuuuuguugcuuagguucgcuuaucuugggagccuggacauuuugcucaucauaaagauuaggugaccagugacaucagccauguccgugaggccuuuugaaaguccaccuccuuacagaccugaugaauuguaaguaaauaaugauuccuuuucuuuuuucuuaauguuauuuuucaguugugagccuagcguuuaauggcugagccaucuuuccaggccucucuuuucucuuuucuacuggggucuguugcauguaaaagaaacuuccauccauuagguguaugauuuuaaaauuuaagcuaggguaggacuguugcucaucagcagaguccuagacccuuccccaguuuugaagccccuuccccaccacuaccuagcacuuuugaccugggacauggcucaguuaggagagcauuugucuagcaugcaugaagcugccacccuggguuugaucucuaauaccgcauaaaccagacacggugaaacaugccuucaucccagcauuugggagguggaggcaggagaaucagaaggucagcuauaugaugagguugaagccagccagugccacacgagauccugucucaaaauaguaacaagacaaacaaaccaaaccccuuaaauccaguaugguggugcuuuuuuuuucucuucacuuuugccucuccacuaccaagcacgagguccgcauaagucagccuggcaucuccagcagccaaccgucaaagaguugaugaaugaaugugcuuucugaugucaaagaggaggaugcuaggcauuguacaggauccuaaauaggcugguggugugggcauuguguuuaaaugcacuuacccugugccacaagggaaaaagaguuugauacauuguucugaagcugucugggucccauucacauacacuauggcugcucccaguccugggaauggaacucagaaaccuuguauuuacuagacagugcucugccauagaguuaauaucaccagucccauuaucagacauuuuauguauuuccagaugaucauuacauggggcgaacuugggagguccuuugcccuuaaauguacuagaacagucauugucaaauacguuucccagagcagcagugucugcaucagcuggaaacuugauccacuucagacuuguucuccuauaaaaucagcaacuccuuuacuguucagcggguuuuaaauaguuucaccuacaaggcugauuuuauuccaagcaguuuuuuaacuucaggucucuuuauuucccuuucagcaaacccaaucauuaugcaccaagcaaugacauguauggcggagagaugcauguccggccgaugcucucucagccagcguacucuuuuuauccggaagaugaaauucuucacuucuacaaauggacgucgcccccaggggugauccggauccugucuaugcucauuauugugaugugcaucgccauauuugccuguguggcuuccacacuugcuugggacagaggcuaugggacagggcucuuuggaggaagccuaaacuacccuuauaguggcuuuggcuacggagguggcuauggaggcggcuauggaggcuauggcuauggcuauggcggauauacagacccaagagcagccaaaggcuuccuguuggccauggcagccuucugcuucaucgcuuccuuaguaauauuugugaccaguguuauaagaucuggaauguccaggacaagaagauauuacuugaucgugaucauagucagcgcuauccugggcaucaugguguuuauugccacgaucguguacauaaugggagugaacccgacggcccaggcuucuggaucuauguacggcucacagauauauaugaucugcaaccaguuuuauacuccuggagguacuggucucuacguggaucaauauuuguaucacuacugugugguugauccccaggagguaugaagaguucuuuguucuuccccuguaagauuagagacgcucaacuagaauauguagacacucaacucaaguagucaguaugggaacauuuaaaaaaaauaugucaaaucccuucuucaaauuaugucaaaauguuggggggaggggcuggaugucauuauuaagccaugaucagcguuccauauguuaauaccuagcuaaaggauagcuugaugaucuguucugugacaucacuacaguuguggaaugucuucacuucuccccaaaaaacuuuugugucuguugcccgugcucugggcagccacaguguuuacuucauauguuugccuguucucugguauuucauagauuuuuuuuuuuuacaagauauggucucuuaugguugacuucuuuuauuuauuauauauaucuguaaagguuuaucuguguuuucaucauguguaauccuuuauuucuuuuuauugaugagcaacuuaagaauauaugucacauuuuauugacccagugguuugugaauauuaagggugcuucugcuucaucucuuacuuaugcuccuaugaucuuugauguacaaguguuugcaugacucuuagcaucucuugaguugugaguaagccuauggguaaaguugauaagcugccuggugacucuccagaaaugugugagggcccuaaccuuucugcuuccucuccagagccuguuacugucagucugucugauucuggucgugcuaaugucuaugaaaugguccuuuauuuuagguggcuuuuucugcguauguuuuuuuugaaauaggauuuugugaugugucccaggccauccuugaacucacagcaaauccugccuuagcauucugaauuacaggcauacuugugcuuugauugguuuuuccuugacagccaaugguacuggcauacuuuaauauauguguuagacauuugucaucauuugauauuuggaauuuuacuuuuaaaauuggccuguuuaaaaucuuuaugacugcuucucggccuuuuggcuaagaccaagugugaaaucuuuaugauaugcacacaaaucuguaucaauaaguaauggaguuuuuguauuugucuuuguuuuuuuuuuuuuugagacaggguuucucuguguagcccuggcuuccuggacucacucuguagaccaggcuggccucaaacucagaaaucugccuuccuacaccucccaagugcugggauuaaaggcgugugccaccacugccugguguuuuguuuuuguuuuuuuaaagauuuauuuauuuuauguauaugaguacacuguagcugucuuuagacccuccagaagagggcaucugaucccauuacagaugguugugagccaccaugugguugcugggacuugaacucaggaccuuuggaagagcagucaguguucuuaaccgcuaagccaucucuccagcccccaaguccauaucaaugauuagcagauacuucuuauuuugcuaccucucuuuuuaacuuuuuuuuuuuaaugauauucuuuauacagaacuuuaguuuugauaggcucucauuugucugguuuuucauuuaauguuuguuuuuuuguuuugcuuuuggugucuuaucaaagaaaguaagggucuuauuguauagcccacauuggccuggaaauugagauccuacuauagcaucagucuuuugagcuccauaauuacaggcacaugaacuaccuuuccugcuccauuaaauuuucucuaugccaguguccaaaaugauuugacuguauggaugauggauauagcucauugguagaaagcuugcuuaucacguaugaggcccuggguuagaaacaucugggguugguuaugguucagugggcagagugugugcacaauccacgaggacuugaguuuggaucccagaaccuauguaaaaacccaagcaugguggugugcccauguaaccccaauguggaugagacagaaauaggcagcuaugagcaguucccuggccaaccagccuagcugaaacgacaaccucuagguccacugagagacuguuucucaaaaaaaugagaaugagaagugauggaggaagauaccuguuauugaccuuugaccuccucucacagauagacacacauguauaggcaaguauacccaugugcacacacaaggagcaugcaacauauacacacauuggucauaaauaugaacauuuauuuauucuuaaagauuuuauuuuuuauguauguaugaguacacguuaccgucuucagacacuagaagaaggcauugaaucccauuacagaugguugugagccaccauuugguuacuuggaauugagcucaaaaccuccugaagaguagucagugcucuuaaccugagucaucucuccagcccaaaacauuuauuuuuuugaugucauuaaucuaugcuucuguccuuauacccauacaauagucucuuauuuuagcauuauaguauguuuugaaauugugaagugugaauucucuuacuuaggucaaaauuauuuugacuagauucuuuauuucuugcauuuccauaugauuuuuaggauuauccuuuaggguaauccuugugcaugguaggaugaguuuuaguuuuugcaagcccacuugcuaggacuuugaagaguugccccaaaucuguagauugguuuuggggaaucuugucauguuugcaaucguuuaucuuccagucagugagcagagagccucucccuguuuucuucacuggauuuggcaguuuccagaguguuaguaucuuuuguccaggugauuccaugugcugcgggguggugugggguguaaaacccaaccuuaggaaacugugauucaucuuaauuacauuaaaccacaaacacugcuccugguuuuuuuuuuuuuuuuuuuuuuuuucuuccuccccuugacucaggaauuccuauucuuuuuccugaaugagucagucuuucggguuagacuuucuccacugacugccuggcuuuauuuugaagauagaguguuuucuuuccuugcugguguagguuuucagagugccugcugcuacuguucagaccugucuguggugggcacugagagcuggcggaguuggugugucuaacucaccacacgcccgucccucuuaauccgcuggcuauuugaaaccuauauucuuugagaaaggaugucacugugagguagacagugggaaggagagcuccugcuccucaggaguguguaacacgcacuggacuccaauucaagugugcccagguuagggcgccaccuaaugcaucugccugacaauggaugagccaucaaggggagggggcugcauuguuacacggguguuucuaguacaagacauugaaaacagaugaacuugcuagaucaaagggaucauucauccauuugcucuaauuuuuagguugguuagauuccucucuuuaucauuuauguuaagauagauccuguauggccccaaaacuuaaccguguaaaaagaauugccaggcaugugucaugaacaggguuguagguaugauuugguaucuaaaacugcuucugaaaauagcagcuuuuaaacucuuuagaagaguuugaggcugucuaauccuagcacuugggagguagaggcaggaagaucaauagguugcaaucaccuucagcuauguauagaguguugaggcuagccugggcuacacgagacauugucugggcuagagagacagcacaguaguuaagagcccugucuucucuugcagaggaccugaguucaauucccaguacccacauggcagcucauaccugucuguaacuccaguuccagggcaucugacugccucacacagacauacaugcaggcaaaauuccuguagcuaugaaauaggguucugaugguuccuagcuaagcaggguuugaguacugagucauguggaauguguccuuuuuuguuuauaugcaccuggaucacucuguauguguuuggcccccuuuaguguggguuaguuuuaugacagaacuaaucugugacaauuuacuuuuaguuuuauuaaaccacaaguacuuaggcccuuugguaaggguuuuugcuccuagaagguaggagcaauuaaaauuaauuaugccaauaucuuucaucuuuuaggcuauagccauuguccugggguucaugauuaucguggcuuuugcuuuaaucaucuuuuuugcugugaaaacccgaagaaagauggaucgguaugauaaguccaauauuuugugggauaaggaacacauuuaugaugaacagccccccaauguugaagaguggguaaguuuaaacaaagcaaaaacacuuuuaaccuuugguuaaauucucaccuuauguucucauuuuuuuuuuuuuuuuuguacuuuguuaaacuucaugcuuagcaucauuguguuuguaugauguguaaguuguuugucuuuuguuuuuuguucuugagacagaguuucucuguguaacagcacuuguuguccugaaacuugcucuguagacccagauuuacagagauccuucugccucugccuuccgagugcuggaauuaaaggugugcgccaccacacugggccaaguuguuuauucauuuguuuguuuguuugcucagaauguuuaaaagguaggucaguggaaauugcuuuauuaaaggguaaaaucaucucuauuuuccgggaguagaucgaggcucuggaaggagacccuccuaaaaaagucacaaagaaagcuuggcuuuugcagaaugcaagaacucuuccccaccccuuuuucuuucuucccaguuuuggcggaaacacuguugccuaugggauggaggcagaugggguccagaugggcagaggcauugugggaauggccacuguugguagccuucucauugauagcagcacggucggucacugugacucacuuguaucccacuuagcuucucagauacuugagugugacagagacagagauuacagaaguuucuauuuuagggagggcaccauacuguaaaucuuacccggcuuccuauguuguguucuuuucugaaagcccaggaauccuuuaaaagaccugagcaggcaguguugcucagcaaguguguggaaagagacuuuguuucuauugggaugcugugaaaagcagcuauagacacuugguugcuuucuuucuuuuuuuuccuucuuccauuucuuucuuuuuuauuuuuuucugaaccuagggccuccugugcuacuaggcaagcacucugccacuaguucugucccuagguuuuuggacuggcuccuuuuuguuuuuagucuuugugaguuuguguuuaguagaucguggaaggcauguguuuugaguacaggcacugccacuggcccuguguaacugucagaagacaggcuggggguuggcccucaucucccaccucaugcuugccaugccagcugggccuggggacuuccuaggaugguuccuguguuugccuccaucuuaccacagaagaacucuggguacagacuugcgagugcaucuagcucuuaccuggguucuggggaucugaacucauauauucacaguuucaagacaagggcuuuacccauuaagccaucucaccauacuucaauacuuccuguuuuugagauagggucuccuuaaguugcccaggcuagaccugaauuuacucuuuaacuaaacaggcuucccaaguagccaggaucccaggcuuacccaccuugccugguucuagccagacugauuucuugccaugaaaacuaauugaaauauuggacucuggcugacucuaggguagggucguuguggccccuggggcugggguauaggagggcuucgaaagagcugaugagaaacugggaaugccugaguuguuaggaaaucuacaagcuuagaugaaacuuaguucuaguuagugaaggggggggggggggaagagaagaagccauguuaagaaagccagaaaggguggguguggcuucccccgcuggagaguggugggugcugugcccugccuucuguuggaagccaguuccucugugaagugugagcuuugggggagaguuuucuuucgaccuuuagcuccaggcgaggccacuuguagauaggcuaggacaguccauuguggaccaugaguaaauguuuugcugagaguuucugggugugucagguuuucccuggcagucaggauuuguuuacuuaugguuucgagaggcuuuaaaaaaauaaacaaauaaaccagcucgagggagaccagcaccagcgauacuagagacacagugaacuuuagccucucacuggguuuacugucuagaaaguuuaaucaguuauaagugguuuugauaauuuaucaacagguauuugcaguaacucaugguaguggugaggaagugaaagauaguucuugaaaaaacaugccuuuuggcugguggcauaauuaggugaguauuucccuaacauguagaaagccuuggguucaaccccgaccgaguauauacccacaaaaauuauuuucauauguaguuaccuuaugauaagugacggguauuucagccucaagcaauuuuuuucuucuacucuuuugccuacccaagcucauuccauugaacucaguuacacauuucagucgaacuccagucuggcacuagagugaugaguguuauucacaagcugggauaggucuaacgguuuauuacuauaauaaaucuugccagcucuuuagauuuuagaaucacuccuuguucccuagcuccuuuugcauaucuaugagaaccuuucugaccugcuaaguucccaguccugcaucuccugugcaaguggauucuuuaccuuaugggggggggcauuguuauuuugagggagguuguacuaaauauaauuuaauaaauccugucuguguuucuuccuuccuuugaccauuuauguuucuggagugaaagacacacacguacacacacacacacacacacacacacacacgcacacacagccuuuauauuuuaauaugccuuaagcaacacaauagccuauucuucaugcuguuagaaucuacuuccuauccauaacccaaguuauugcuuacuguguuucauauguacugcucauagcuccaaccaggcagcgcucugagccauguugucuuggccccuaacccuagcugcucuaucucauggcagcucuccuugcuucucuaugccacggcuggcugcuuuccuccaucccuccaaccuucucuguaccuccuuccuaguggucucuagccugggaaaccuaagccccaccuacgucucuuccacucccccuacuccccccccccccccccagcuaucggcugcugacaucuauauuaaccaaucugaaugaacuggggucccucaggcugugugcagacucagaacccuggaggccccccacuuagcauuauaacaaacaguaaaagacaaaaaccucacaggagaugucuuuucuguauuuguuguuuguaaagugagccuaccuuugccuaccuuguccuuuauagucauuaaguggguacugggcuguuuuccaguguucaaaagagguuguuguguuuuguuuuguuuucugcaauucuagggauggagccuagaauuuugugcgugcuagaaagccacuuuguauugagcugcaucuccagccuucuaauuuguucuuuuaguuacuucuauagcgcuuuaguuguuauuccagguagacuuuuacuuuguuaugcccugaaaucacagauuuuacuguauuuugauugauuagagguguuaaaugauagagugcuugcuuagcaugagagaguccccgaguugaacacccuccccgcgcccccacaaggauaagguauaucagcugauuuuaagcagagagaauucugaaaauucucuuuucuuuuuuuuccuuuuuuuaaaagaucuauuuauuuauuuuuuucuauaugaggacacuguaguuguacagaugguugugagccaucaugugguugcugggaauugaaccucugcucccccaggcucaaagauuuauuauuauauguaaguacauuguagcugucuuuagacacaucagaugaggcugucagaucucauuacagaugguugugagccaccauaugguugcugggauuugaacucaggaccuucagaagagcagucugugcucuuaaccacugagccaucuuagcaguccaaaaaaucucuuuucauuacuguuugauauacuucuuuuaucauuuuuccuaauuacuucuaugucagaaguauaaucauagucuuuuguaaguauaaaauccugucauuuugacugaauauuauaggucuuuuaucauguccuuaaaucauccucaaaaccaguauuaaggaccaacaagauggcucaguggauaaagaugcuuggugccaagccucgcgaccuuuuguuuuuuuagcaacagagauucuuuuaaauuuuauuuuaugucuaugggcguuuuacuuguagaacauguacauaccucauauccacagggaccaagaaaagguguugaauccccugaaauuggaguuacagaugguugugagcuaccauguauauucgggaauuggacccagguccuuuguaagaaccgccaguucucuagauuacugauccauuuuuuuuuuaaagagcccugaugacccuauauuaauuuauagggugaaaggagaaaaccaauuccuaugaguugugugcucaugcauauauguguacacacacacacacacacauacacacacgucuaaauaaaauguaauaaaauaauauuuucuuuuuuggggguggggggauaggguauaaauauguauccuugucuggccuacagcuugcuguguagaccaggauagcuuagaauucauagagauccacuuuccuuagcccccugaaugcugggauaaauggcuuaaacguuuuuugacacuguuaaaauugaaguaugauauauaucuauccauauacuaagugucuuagugacuguucuauugcuuugaagggaugccaugaccaagauagcucuuauaaaagaaagcauuuaauugggggcugcuuuauaguuucugaaguuuaaugcauuaucaucauggcagggagcauggugucacccauggcacugggacaggaucugagagcuacauccugaucuagagagguggagagagugagacugaaccuaguguggucauuugaagucucaaagccccagugacccauuuccuccaacugggccacacccacuccaacaaggccacgccuccuaauccuucuaauccuuucaaauaauucuacucccuagugacuaagcauugaaauauaugagccuaugggggccauuuuuauaaaaaccaccaaacucagaauaaguauaaaauuugggccaggcagugguggcacaagccuuuaauccuggcacuuggaaggcagaggcagggggauuucugaguuugaggcuagccuggucuacagaguggguuccaggacagucagggcuacauagagaaacccugucuuggaaaaaaaauuuuaauuggguggugguggcacacacguuuagucccagcauuuaggaggcagaggcaagcaaaucucugugcuugaggccagcuugaucuacaaagcaaguuccaggauagucagagccacacagagaaacucuguccugaaaaaaacaaaaaauuaagacauaaaucuguaaacuugaugaguuuuuauacaugaguaucugucucauaacagucacagagcacaucugucuuuaguuagaaggguccaugaguucaggcucccggcgccuccuggucaguuugcagaggaugcuaaccugacucuugucucugucagguaguguuggagagauucauuuggauuguuguaucuuucaccuugauacuuugugguuauuuguauauguguuuggugacaaaaaaacuuccugcaugauugcuuuuaagaagccuuuggcugaauuuaagcaggucauuuagggagcucauuccuugcuaucuuggguaucuuuuugguuuacugauacaugguuuuucuauguagcccuagauguucuagaccaugcuagccuugagcccacagagauccaucugccucuaccuccagagugcugggauuaaagguaaucauacauguccugucccauuucuuuuuguuuuguuuuguuuuguuuuguuuuguuuuguuuuguuuuguuuuguuucuuugucuguuuagacagccuuucucuguguagcccuggcuguccuggaacucacucuguagaacaggcuggccucaaacucagaaaucugccugccucugccucccgagugcugggauuaaaggcaugcaccaccacugcccagccugucccauuucuuguuuccuuaagguccccucguuucuuacuuuaauugcuuguuuguucacuugugugcauguguagcacggcacgaguggagaggucaaaauucacuuuucaucaccgagucuuuccuucaugugguuugcagggauugaaaucagguucucaggcuuggcagcaagcucccuuaccugcugaaccaucuugacggccauguuuuaguuuuuaucauuccccccccaacccccccgagauagggucuuguuaucuagcagagguuggcuuugaacucuucauauaucuauccugggcuggcuacacuugccucaaccuuccaaguagcaaggauuauagggacacgcaccagcacacuugucuuauuuuguaaggcccccaccagcugccaugucgaaacuuucugccuucauuuugccuguuguacauuaugagguaucuuggugaaucucccuuaccuucacaguugucugauugguggcacucugccaguuugcugauggauacauuugccauuuugaauugcauaagggagcuugcaaccaagccugagaaccugauuucaaucccugcaaaccacaugagggaaagacucagugaugaaaagugaauucugaccucuccacucgugccgugcuacacaugcacacaagugaacaaacaagcaaauaaaguaaggaggcuggagagauggugcagcggguuaagagcacugacugcucuuccagagguccugaguucaauucucagcaaucacaugguggcucacaaccaucuguaaugggaucugauguccucuucuggggugucugaagacagaguacucauauacauaaaauaaauaaauuagaauugcauacagagauuagaaugaaaaaacaaaaacaaaaaaccuagccaggaggugguggcauaugccuuuauuuccagcacuugggaggcagaggcaggcagauaucuggguuagaaaccagucuggacuauacaaaaugaauucuaugacagcaagggauacauaguaagacucugucucaacccccaccaccacucccacuccaccccaucccucccaaaaaagaauuaaaaaaccuacuuuguauuucuugugugcaugucuucaguucuguggauccuccacaguaguauuaguaaacuaaagggaaaugcacauggagccauuagauauuaagaaaaugcaaauuuauagcagcaccaucugugcauuauacaacuguuaauggcauacgggauuuccacacacuuuuuuuuccuaauuuuuaguuaaucauuuaauaauuaaaauauaaauuacauaauuuuucccuuucccuuuccucucuccaguccuuccuguauauccccauccacacacauuuucaggaagcauucuuuuuguggacauccauuaagccaaaucugguccuaauuuuugguaauugggguuuuuuuuuucuuuucaauuuuuggaauuuuaaacaguggcuuuuguuugugacaauuuguaagaaauucuuaguauaaaaauaauaaaauuuuggcaggcguggugugcaccuucuaauccuggcccuugggaggcagaggaaggaugauauuaugaguuccaggccgaccuggucuacauagugaguuucaggacaaccagggcuacauagugagacccugucuggaaaaaacaaaaccaaacaaacguacguacguacgugugugugugugugugugggggggggggggcgggggggugaggcgcguguaguuuuaacaauugccaccaccuuuucuugggagcuacggugcuaccagccccuccccgcuaccagccucccccagcuuuccggcuuucuguuuuguuccacccaguuuagcucugggaucagccccaccggcccuaaccuggcuuucuuuccuacccgccuuugcucugggggggggucgagcuaccaguuuccacccaaaacccuugaauucauggguaaaagacauacagacagcuuuguuacuuuuuaacuugccuacuaggcacaauugcuggggucagauaacucugggcuggaaaggcuuacccuuaacaauuuacuaucuuugucucuccucccacccuaaacuuaguggcuuguuucaccuagccccuguuaaacaucuuuggccacccacccacaguggaaaccgcaggccuucucugcgcccccccccccaaugugauugcgacauucuuuuuuucuccaaagcauggcagaaaagccccccuugccuuccuugcagcugccuuuuccuccugggacuauaagucccaguuguacccucugcccagcauuuggcuccuggucuucuuuauugacaaauuaagaaccaauuggggagcaggguuagcgucagacccaccccuugugugugugugcgugugcauuccugugaaggcaauaagagaguguuggaugugggugcaggggaaugaaacucagaucuccuggaagagcaggaagugcucagaauugcuccuguaccacauuugcuuuauccauucucuaguugauggacccauagguaauucauauuuauuuuuuuaaauguaucaaauguauucucgggaacuggcuuuuccuggaucacgcuguggcucuguguggaagggucucagucaggaacuggcuuuucuaugacuguacugguuuacauucccacugauugugcaaggauucucuucccucugcaucugugccagcauuugucucuaagcagcuugccuuccgguugccuugguuuuaaaagcucugcacaaucuguuaccugauuacauuugaaauugcucauuuuccgacaccuuuuccuguccuggacauuaucagucuuuaauuccugucaaauuugugaguuucaucuaaagacauuuugugauuaagcagguuugucugcuauuuaugaucuuaccacuuacauagcaggcuuggccgucguuugcauuguucugucuuuucuuccugccauucucacaaagcuugcuauguuacaguuacuuguuacauugaaucuuuuuccagauucccagggucucucuccuuugucuucaguguucuuuuuuuuuuuuuuuaaagauuuauuuauuuauuauauguaaguacacuguagcugucuucagacacuccagaagagggagucagaucuuguuacagaugguugugagccaccauaugguugcugggauuugaacuccagaccuucggaagagcagucgggugcucuuacccacugagccaucucaccagccccaguguucuuuuaaagccauuccauugaaguaugagugacagggcuuuucaguuuuuacgcucuuagauucuccuguccauuccuuugugguuucuguuguuucuggucuagacugucuucuugcugugcucugugagguugggacccaguacauacuagacaagcaccguacaccaagccauucccuagucucugcaacucacuuucaauuacaguaugaaauaaguccuaacuuaacuugccccaaugugaccuugcacugacugaacuuguaucuccuaagagccaucccccacccccacccccuuuuuuuuuuuugguaaagguugacuucuucuguucuuuccuuuuaucaacacauuugaccagagcaauuauguaaaaggccaacaaaccaauuucucauagcgaguuuacaaagcguuagagaaucgagaagauuggcgaugagcuugaauuuucucugcagacagcauuuucauucauaaaaaucgggucacagagucuguggcaaagcuuggcuggaaacugaguauuucacacucucaggcugccuuggguuuguuuguuucuaacugggacuuaggacacacacaaguagauuaaaacaaucucgguucauuacauuguuaucuuugagacaggcauagcauuucuuguuacuuucauugguuucauaaugaacccuuaugaacacacauucccagccaagguuucagcuaaaaacauuuuuagcuucauagaaaauguuggacugagagcauuugccuuacaugugcaaggcccuaggaucaaugcccaguauaugugugugugugugugugugugugugugugugagagagagagagagagagagagagagagagagagagagagaguaugugugugagagagacagggagagagggauagagggagggagaaagacagacagagagacagacagagagaaagaggguguguguauguguguguguguaugugagggggcuauccuuguaaauauugucuuaucacuugccuuuuaaacucaauauuauacuauuuaacuagggacaacagucugauccccuguguucaagaauuucuuuguuuguuuguuguuuuuuugucuugguuugguuuuugaauuuuuugagacaggguuucucuguguagcccuggcuguccuggaacucacucuguagaccaggaugaccucaaacucaggaaucugcuugccucugccuuccaagugcugggauuaaaggagugcgccaccacugcucagccaagaauuucaugagaguucaucuuguuccuguugaugggcuacugaauagcguugguagacuggggcuguauagcucaguuguagagugugugcuuaguguccuggaggucccaggugugaucaauaguguugccacaaagcaaacgagaaacacaauugcuaaucuuaugaacccuuuaaaaagcuuuuuauugauuccucgugagcuucacaucaugcaccccaguccuaaccaucccccccccccccguucccucauaucugccugucacccuugcaaccucuccuccaaaauaaaacacaaacaacaacaacagaaaacaaagcauagaaaacaucucauuguagacacuauagugugucacaaugugucccacaguauaacccucuguccacacaucuucacuugcagauguucauugcagugugucauugaccugguuugagaucucuggcuucugugaugaaaucaauaucagauccucaucaggacuccuccggguuauccuguuguugcccugcaucauggagauucugcagcuuugcaauaguaggaguggccuuucacacaucccaacuguuagcagaugacauagauuuuaggaugggccaguucagagcccugggucuuagcuuacucucaagcccucagggcuggcucaccugcgcccauacuuccugagccaguuccacugugcuguccagucaaggugcagggucucucccaagugcuccaaugaacauggccaccucaccuacucucauaccccagaguuggcucuccugacugccucagguagugaggggcaagggggcagagggcauuccccccacccccaggccaccucagcagagggguggcagggccaguucucccacacucugggagcucaccugcccccucaccccucaacaaggcuagcuaguucuacuaugcugcacagaugggggugcaaggcuugcuuucccaagugcuccagccuacagaggguggggccagcucaccuguccucaugaccccagggccaguucucccaacugcugcauguggcaagggguggggcagcaccucugcagcugacccaccccaugaaaaaugaguggccaggucagcucucccacacucacugucagagcaugcucacccauauccagccccccagggccagcuccacugugcugccugguugaggccagggcccgcucuccugauugcugccauaguugagaaauggggccagcuugcuagagcgccauauucagugagggacugggggcaguucugcacaaccccuggauauccuccacaugguuccaguggcugccucaaucagagacaucaccaugguuaucuauacccacuccugcugcuauguacccacagacucagucauggcccucagcagcagcuggggcugggaccucacuguggccucagguggcagagcuggcugacugcucacagcaggcuucucugcuccacccuggagucuccaguuccaucucucuucauaaugcucaagccacuccacucacuucucuuucucaaccaucugaccaccacauaugggcacauugugguggcuccugcuguaggcuggccaugugcuggugggccccugggugacauccccagucuaugcugcccccacucuacccuccccuccccaagcaguagggagaguugacccuggggucaugagagugggugaccuagcccaagcagguaucuguagccugccugugcugugagcugaaggggagaucugugggggauauggcgguccuuaggucugugugugucuucccccucccaugcuguguugccuggaguugauuugauuugauuuuuaugaguccuagacauaagacagcuuuggccaccaagccaugugccaagcuaggaugaacaaaggucugucacccucucugccucugacugauagaaaaccaccaucaccaacagggugacucugugcccaaggccaggggaauaugagucuccuugagucauccacacuagagcaaauuucucuucaacccguacucaaguguggagcuccuggggugaagaguuggugaauauaccucuuuauaaaacaaugcccaauuguuuuccgaagcuugcccauuaauuaucucagccacaacuccuggaaccguuagacuuuauacugucugucuaucaacaguagagugcaucacuguuaucuuucuuuauguacauuuuuuuuuuuuggucauuggccuaaugcauuuccuuucuacuuugccacaguuguugaguuagcagaaacccaagcagugucucugauaucuugauuuuuguaagaguuuugauggaggcaaagggcaauuuuuaugaggcaugagauagucuaagcccuguuugguguucaugugucaugcacaagugacuaagcaauauggauaugacaagucuaugugcagucauccugucgguccaaggaugugcucccgcucuguguaccagugucugugcgauggaguggcuucucaguguuugugaagagaauggaagccacagcuggaggcugggucgguguggaagucgaugagggaagaaagcuugacuucaggagagaaaggccagcugagcaaccuggggagaccugucucaaagacaacccugaguuuuucugcacaguuaccugaggauauuuuaccacacacaggccagaaaagccggcucuagcgagucuguaucaucaagaggcaaagcaaaacccuuucuugugggcuucaguucuugugucaguggacuagcaugacucuuaggcccccauuucuuccauucuuuauguguaagguugucuuuucuacuuuguguuuguuucucaagacaggguuucauuauauagcccugacuguugguuauccuggaacacacucuguagaccagacuagccucaaacucaaaaagauccccugucucugucuccagaguggugggauuaaaggcauguaccaccaccagcuaaacucugauacuuuaacccccauguuugguugaagagaguaccuggauauaugugaacaucucuggugccagugugaacuagcaagcaggucaacacaucuuugcaucuuaguuccuuugugcaguuauuugucugccucucaagacuagugugagauguggcugauuaaaaauaugugaaaaaugcacauucacuuucucuagauaaauacgaggaauuuuacaccucuaugguaaauauuuaaaaguugauugugaacaugugcuugagauuuguuuuguuuuaacuuuuuggagugugugcuaccaugcuuggccuugggaucaauuuuuauuacuacauuaucugaucaauuggcaauuaaaauucagagcuggaguuucagguucuccugaugugguuggagaaucugagaugggucuguuauucucaugaaggaggauggagaucugaggggcagacaggggucagaggugagaugguggcuugcagugauccauggcuugggcuguuuacacagacuccuucaagugcagggcacucugggacuugggcuugaacucuauaacuuaauuuugacagaaaaauuaaaaaaaagaaaccaacuaaccaaccaaccaaccaaccaaccaugaaaguauagagucagggcaggauuugugcagugugggccuuacuacuugugaccauuccaggauguagaguuugguguccuuagcuucugaugaagugucugucugucugucugucugucugucugucugucuaucuaucuaucuaucuaucuaucuaucuaucuaucuaucuaucuaucuaucuaauguaaguacacuguagcuggcuucagacacuccagaagagggcauuagauacuacuauagaugguugugagccaccaugugguugcugggaaaugaacucaagaccucuggaagagcucuuaaccacugagccaucucuccagccccugaugaaguuuuuaauaaguuagaugucuguaagagucccauccauagucaggcuguugaaauugaaggucaaccaauauaaucuuacccagugauuucuuuuuuaaagacagcuuuauagaaauauauuugacacccaauaaacuguguauaugcaccgaugcuccuggguuuuauauggggguuauaucuugauaaaaucgccguacauugagaucauuauaagaaauauauugaguacacccacacccaauacauuuagaaucacauuuaguuagaauggugaucaguagcgucugcagcuugcauaagaguaugugagaugucaggacguaaaugugccaucaucgaagugugacugacuccugguuacccugcuucacccuuacagugaaaacaugcuuuccucaggaucuuccguguccucuccucagcauacagauguccacagugaugagcacgcuaggcuggagcggccaggcaaucuuggucaucagcauuagacagcugaugagacuccgauagcccuucacucuccccagugcaagcauucuugccuguacuguugguuuacuggacucucaugcuggggaagaugacacgguugucuguggucccugauggaacagaguguggcagaaauaacagcugccuggcugacugucugaaccacccaggaggaagagugcaauaggcccugacuguuucagguccaccgugaguagagagaggcuggaggacagacagaaacaaacggacagacagacagacaaacagagccuguuuuagagaggucugugggaagaggaagaguuuguguuagaaauggagagugcuuucuguggcucucugaaagcugcaauuccuagauuucuggcaccaagaguuaauguuucugaagucagccauguggauagguguaaugaucuaaacauggcauggcugucugcagcccugggcauucugucccacaucaguggcucgacuccauugccaccaucaggauccccuggagccaguguuagagcaguugacucugccacgcccccugguuucugauucagugguuuuagagcugauguugggaaugugcuguucuggggaacaugauuugagaaccccuguuccccaagcuagccacagcuguuacacugcagaccuguuuagccuuugacuuuaaauguagcuaaaagcccuuucugugccauaacacaccauaccguagucaacugaagggcacugaaaggcauuaguagacugaaggguauuugggacagcugaugguggcucagggauauuucuggcccuuuagaggagccauagccugaaauacuuguauacugaaguacagccuuccuugggauuucaguuucugcaagaagccacagauuagaugccgguaagguucacucagugagagugagguucuccaccucuccugccuccaccucccaggccuaagggcuccugacuugcuuccaaaccucugacagaauuugucuuuguugauauacaguuucuuuggggagcacacagcugauacugaacaaaggccuuagugccacugagcaauuuaaaccaguccguuguuccaacuuggucuauggucucuuaauuuguaggauugguccauauaggaacauuucaaacaacucaaagugaaaaaaaaaaggauuggggugaugguggcgaucaccuuuaaucucagcacucuggaggcagaggcagguggauuucugaguucgaggcuagccuggucuacagagugaguuccaggacagacagagcuacacagagaacccugucaugaaaaaccaaaaccaaaaccaaaccaaaaagaaaagcaaaaccaaaaaaaagaacuuuugagaagguauuuugagcuuuuuugggggcugagcuucugcagggauaaaaauaccaggaaacaggaaaaacaaguuggacuucucaguguuagagaacuugugcaaggaucguggcucgugaagguggguugggcagguuguaaaauggagauggcacguugagauuagccugcuucucucugugcugggcuauuucucugcuuuccuuccuccaagcaggcgaaggcccuucuggugaggaauucucagcaucacuagugauuaaauuuugucacucgcugcucuucugagguuagacacguagagguuuuaugauguaucuccgaguguggugagugugaggagagugaucuuuguuucagggacacgugauguaccacagugcacaccuccagaagcugggguggacuuggaagggaacagcuaguugagaggggcacaaggcucagcuuccacaccacuaugucuucuucuauuuuacuuugagcagauuaauuuccucauaugaaaaugcuaucucccuggguggggcuaaaauaaccacacuuagacugcuaggcacgugaucaggcacucaucaggcgacauuucuuuuccuucauaguggugggugacuucugucacauugcucgacuggcuggcugcgaguguagccugacugugcgcaugugaacuuguaaagaaggcagagcagagaggaagugaagaaugcugucaucaaagcuuuuuuuguuuuguuuuuguugguuuuuuugagacagggucucucuguguagcccuggcuguccuggaacuugcucuguagaccaggcuggucucagacucaagagauccuccugccucugugcccugcuccagcuuuuuuuuuguaaauuggaacguggaccuuaguauccauguauccugugcaucccccaaauuaacuauuuuaugcuuuaaacuaguuuguguaagauacauuuuugagauaaacuuuugaauuuaaucucaagagugagucuguggcauuucuugguuggccggacuccaccguguggcuuuccauugcccuuuucuaucaauucuuuuccgugcuggaagaccugggguagagacuuggucagggcuuaccagaggcugcgcugaguggcgaguccagcacuuggcuugggaaugacggcugcugagcuuuucuucucccaagacagauuuuaauuuguguuucgcuuuauauucuuuugcucuaguuucacaggaaaucuuuuuacagcaagcucugggccucuuuuuauuauauuuauuuauuuguguauaugugcguuggaaggugcaccgugggacuuagcuuucuccuucuaccacguaggucccagagauugagcucagguuugugaggguuccuuugccagcugagccacccugaaggccaagcucugggcuucugacuuaugcagacacuguccugguuuugauuagcaaggccucccgcgugaccauuuuuauuaggucuagguccuugggaagguuauccaauauccugagccacagcuuccucguuucugagagaggugucauggcuauaagauugugccaugcucugucagaugagcauuguuagcagcccagucccuugucucgauaagugagcgagccauugcuaugagucagugagugguugcucuggcuggaggauuguagggauagaugcggggagauaagagaggcuuguaccucauccugcagggacuugagugaaaggccucuaggaggugguugcacuugagcuaagauuuggaguucagugagggauuagcagacaaagaaagggggaagggcauuccaggcuguaaggagccagaaggacuagggcucugguaaaguuccuguuggaggggaaaggagggggaguagauccaggagaaaaguaaaacaggcuuucaagaaaaggaagccuuuuaaaguucugaugagaucucuagaauaagaacaggccuuuggcuuggcaaccguuuuggcugagaggguguuuguuguguucaguuguaaggaauucugugggagccaagaaugguucccacccgggcccccugagguggaaucugaguacacucccuggaaacccaccugcuggcuuggcagugaccccgaauuccacuuucagagaaaugaucccgucucucucuaagccugaauaugaaacaaucaaaaacaccacaugcucccauagcagagaacguaagauguaaggcucacguauaguaagaacauacaauguauagauguaaggacacaccauguauagaugcagauaauaauugcaagaguauaaaauagcagaaucauccaguuucaagcuugcaaauuuuguggcagaaaaaaaaaagcucaauuggauccaaaggauugacuuguauccaguauaguaggaguuuguuuuuugcucuuuuguuuuuuuaaaacuauguucagaaggcgugguagauaggauacuucauguccuuuaauccuacagauauucuuaugaaguaauugcccucaauuuaugcagacgggaacacugagacccaaaaagauugaugccauuauucuuuuuaaagauuaacuuguguguguguguguguguguguguguguacacaugcaugcaaaugcccacagacaaugggagauucugcucgauccuuuagaggugcuguuaaagguggcugugaguugcuugacagggguauugggcgcggcacuugguucccucagccaaucaggcagugagcucaggcuucucacguggaaggggugaguguaagaaaguuacuguagcuaauuacuucacguuauucuauaaucugagcuaaauauuauauaguuuauaugugauaacuccccucccacuucugaaugaaaacaaagaagaaaggaaaagacaugauuguuccuaggugagguggaggagaaaguuugugauagagauauuggagaucguagccaguggcagacacaucuggagucgucaugacccuaaaccauguccugagagaagaaggggaagggagagagggaagccaaguagagcacccaggaggccaaagguacaaaaggagaaacagguaacccuaaugucuggaugacauagggaagggccucuguggcugcagaguucagggaagagggugggguaugcagaccauacccuguaacagguagggacugagggauucugggagaaccuggaggccaggcucacuucuucucccagguuugcaacauaacauuuaccccuuucaguucugagugagaaaugacaaugucuccuggguugauuuuuucuuuuuucuuuuuuaaagguuaaaaaugugucugcaggcacacaggacaugccuccacccccaucugacuaugcggaaagaguugacaguccaauggccuacuccuccaauggcaaagugaauggcaagcgaucauacccagagucuuucuauaagucaacaccucuguaaguagcacuuuaauuugauaacauuugucuaaauaugaguauuggccuauuguuuugugcuauccucccuuuuccuuguuagucagaaggcugagaaguggcagugccauuguccuuucagauuuaaucuuuucagaaguccaaaggcuuuuucucuauuuuuuuuuaaaggauuauuuaucuuauguauguguguacccuauagcuguccuuagacacaccagaagagggcaucggaucccuuuacagaugguugugagccaccaugugguugcugggaauugaacucaggaucucuggaagagcagucagugcucuuaaccauugagccaucucuccaguucccaaagugucugaaaccgaaaaucuguuuaaaaauucugucuugcaacuguggacuccuguaaaauaaauaauaaguuaaauauuuacuuaacuucaagaaggaaauaccagggcauaaucauucugaucaaagcaaaaucuaauaucugggauucacucaugauuuucugggcuccucaaagggcuugagucacuucuccagcucuggcuucugcaguacacagagcuugucuuaagcucaggcagaauccacucauaggcucucuucauggugccaagcuucaacuucucugcaugaccccuucaaucucuggccuuuaacuggcaccgagacuguaccuucaccaaugacaccuccuggccucucacggugccaagccucagcugcucuccaugaccccuucaugccuucaaaaccaguaucaccuaggugacugacucuugcacuaacaaguuccgcuaccagugugagguguaccuuggccaccucuggaacacagccucugugugcugacucucaggaagcacauccagaggaucucaccucagcggugcucgucucuucuuagucaucacuaauuucuuagcuucagccaaccagcaucauuuaucccaguaaaacaaaguuuuuacuuuagugguucugguauuuuguuagucacagcugagucuuaauccccagcugaccagaacuacauuuuccucacacaaaugacccacaucuuuucaucccucugaaacuucccaagccagaucuccaucaucugcccugcucucgacaaucuuaguuuucagagccacgacagaauagcucacugagcucucaaacacucaaugacuuuucuuacccaaaaaucuaauaucacaguccuccgcagaacacggucaggucugccacaguaauacuccaccauccugguaucaccuuguuuucggauuacuauugugacgaaacaccaugaccaaagcaaguuggaggaaaggguuuguuuugcucacaguuccauuuguucaucuucaaaagcagucaguacaggaagcugcaggcaggagcugaugcagaggcccuuaaauaggccaaaccauauccaaaagaguuuauaugaagccugccauggugguacuuaccuaccauacuagcccucggggguauggaggcaagaggaucaagaguucaaggucaucuucagcuauguugugaauuugagggccagguuccaugacaaccuugucucaacaacgaacaaacuccuucaaaacaaaggauaaaaacaaaguuugguuuuacugccucaaagcagaaagcacauagaguggcuggcauuguggguagagugucuaagagcugauuaaucauugacacucauguaagguuaacauaaggguagcauaacacauacagcaacauugaagaaauaaauacugcccuccccgguuccccagcuacacaucauuccccaaagcuucagggucaauaagagcuuaagugugguuagaaugcucagcaaaggaggauggcucagcgguuaagagcacagacugcuuuuccugaggucuugaguucaauucccagcaaccacaugguggcucacaaccaucuuuaaaaaaaaaaaaaaaaaaaaaaaaagaaugcugagcuaaggcucugacaauagugaggcccagguggcaccggaaaaucauaaaccuagagauaaaacuuagcuucuggauucuguagauuggaagcaauagagaggggagaaaaaaaaagcuucaguuacuuuuauuuaauacuuggucugaacagaaggcugauaacuuagaaugucucugccauuuuguuguuguuguucauuuuuguucuuuacuguuuacagagcaaaaaugaaacuguuucugcugcucagaaauagcaugugcccgucucagcccuuuuuauugcuguuggguuuuguuuucaugcccagcggcaggaacauuauaugcaauuuagcgucugaugcaacgugaaauaauuacguuaggaacauaacauguguucuguuaaaccccuguugcuucuacauggcuuuaaguucaacacagacggaguuaaaaagaauacuuaauaagcuccgucccuugaaaggugggugucuuagucaggguuucuauuccugcacaagcagcaugaccaagaaacaguuggggaggaaaggguuuauucggcuuacacuuccacacugcuguucaucaccaaggaagucaggacuggaacucaagcaggucaggaagcaggagcugaugcagaggccauggagggauguuacuuacuggcuugcuuccccuggcuugcucagccugcucucuuauagaaccaagacuaccagcccagagaugguuccacccacaaggggccuuuccuccuuggucacuaauugagaaacugccuuacaacuggaucucauggaggcauuuccccaacugaagcuccuuucucugugauaacuccagcugugucaaguugauacgaaacuagccaguacaguagguauuuagauagggccucucgguguagcccacucaagaugacaaugauucuucaacuuuaaccucuugaaugcugggaugacaggcauucaugacuauacucaaaaccaugaagcguuuuaguuuaacacacacacacacacacacacaccagcauuccuggggacuggaagaaccuguagaaaagaacuguccucauuauuuuccugauaagucuuuuguugaguaagucucuggcacagggcagauaaacaccucuuacagcuuagucugaacuuccuaaaaggaagcgugagauccacuuuacuuagaaguuuuaacauggacuccccucccccaaucagaacuuuaaagcugcuuguguguuggaagggucugaauuggugccagacugaaugcaggaaucugugcaucugcucagggugagcgcccuugacugugggugucucuuagcccuguucuugcugcccuuuugguugcagggugguggcagagucaaaguguauucuaucucugagcgauggccuguguuuucacuagggugccugaaguggcccaggagauuccucugaccuugaguguggaugacuucaggcagccucgguacagcagcaaugguaaccuagagacaccuucuaaaagggcucccacgaaggggaaagcaggaaagggcaagaggacggacccugaccacuaugaaacagacuacacgacagguggggaguccugcgaggagcuggaggaggacugggucagguaagcccuucucuucugccccuuaagcauuugguuacaggccagguuugugguuguugccuuggaaacuggggucaugaugucaucucauuuuuuccccuccaggccuggagacaguuuugaggguuuuguuuuccuuuggugcccuuuuauaaaacagaagugcagggcucuguuuggaugguaaccaugucucuuucacacacucuucucccugaaguggcucuucuaccaauugacacucaagaaaggcuuucuaagaaaugaaacauaaguuuaggagaauuguguuggacugauaauaaaauuuccaaguacacagacuuuccugaggcaguuacuuucaaguuaugcuuucaugguaagcccagagauucuuuucaaguuuaacccaaagaacucuggcaacagccuuguaagcaguugagguaacgguuuauugcguagcuaaggugaugguuaagguuuuuguguugauggcuugcccagugcuaacuauacaagugugacagguagccuugucaugccaggaccacagucacagcagauuuuccuuuccuuuccuuuccuuuccuuuccuuuccuuuccuuuccuuuccuuuccuuuccuuuccuuuccuuuccuuuccuuuccuuuccucuccucuccucuccucuccucuccucuccucuccucuccucuccucuccucuccucuccucuccucuccucuccucuccucuccucuccucucuuucuuccuuucuuucuuccuuucuuuuuucuuuuuuucuguuuuagacuagguuucucuguauagccuuggcuguccuagaacuagcucuguagacaggauggccuugccucugccucccaagugcugggacuaaagguauauaccacugccgcccagcucauuaaacauuuuugcagcaugaauggugguuuauaaaucucaaguucuuaggagauauggguggggcauggauauaccuuacuuaugauuuuuuccuuugauuuaaguuuuauugcauuaugaugagaaaagauacauaacuuaaauuuaucugaauuuuuuuaacauuuaaaaacauguuuugaguaaguagacuuacaucacauucuucuuugcuuuuuguaccccgacuccuccaggagggcccuccaaacuugcaauaccuuucguuuuuuaucauauucuuuaaaauuuauaaaauauuguaacaauaaaaaugaguauuauaaaaguuguuugauauaaaacaacaaucaauugaacaguuagguagauaauugucuacagcaauacugaaaauacauauauuuuucucaguguaaauuuuaaauaacuccaaauauauuaacuguaugauauuuuaaaauaauauauuacuguuaguuuuuuuaaugaacauaaauaaaguuuuuuuguuuguuuguuuuauuuuuaguagagcuuaaaaucugggcucuuacugugguacaaacacaaaauaagaacaguguuuggacauuggaguucauuguaauaaggcuguacuucaaugucccucacaucaccaaaggauuuuaccuccauaguagauaagcuaagaguugacaguucugcugcaccaaggaaugaauuguaggcacgauuuuuggauacagauuuccugcuauggucaaagcuguuugacuugagugauugucaucauucucaggcuacagggaacagguuacauucauuuaagaaaugguauguguauuaagauggucuauccaugaagucauucaucaacuguuucaaugaacaaugguucugcuuggaggguggcacagauauuaggugaggguaagauucugguucauuggcuuagaugauuuugaaaagcauucaucucagaauaagaguaacuuauaaaguccucuucuucaaaauugauacaguaauuauaaauaucaagcaaaaccuucagucucacucuuugcuauuauucucuuacaagccaccucccauuucuuuuggcugucuacauuucuuuuggcuguauaaauaauuuugaaauauguaagcuguucugaaaaccauacuauagucuaaaaacaucaaauaaacaauccuacuaauagagaggcugagauaggagaaacaugauuucaagaccauuauguggcacacaguaagacccugauauguacaaacaagcagaaaguauauauggauuguauaauauuggaccuauuucucccauuaccaaauuagagagaccacggaaugacagcugacaaauuucuaauuccucauauuuuugaauuucaaucgauuuggauauguuaauaauauuaauuuucauauuaagagauauuaaggaaaagugauuguuacuuccuguuaauuuucuuguuagagguagaauuauguuuggguggguuuguugucaguuucuugcucuuuuaggguguaguuucacucuuuguguugguguuuuccaucuauuauccuuuguagguuuggauuuguggaaagauauuguguaaauuugguuuugucauggaauacuuugguuuuuccaucuaugguaauugagaguuuugcugggaauaguagccugggcuggcauuuguguucucuuagggucugaaugacaucugcccaggaucuucuggcuuucauagucucuggugagaagucugguguaauucugauaggucugcuuuuauauguuacuugaccuuuucccauuacugcuuuuaauauucuuucuuuguuuagugcauuuaguguuuugauuauuaugugaugggaggaauuucuuuucuggucaagucuauuuggaguucuguaggcuucuuguauguucaugggcaucucuuucuuuagguuagggaaguuuucuucuauaauuuucuugaaaauauuuacuggcccuuuaaguugggaaucuuugcucucuucuauacuuauuauccuuaggcuuggucuucucauuguguccuggauuuccuggauguucuggguuaggaccuuuuugcuuuuugcauuuucuuugacuauugugucaauguuuugcucauuaaaauuuuuugcagcaugaauggugguuuauaagccuugcuuccucaaguuguuaggagauguggauggugcaugaauaaacugcuuaacauaccuuacuuaggauuuuuuuuuugagacaguaucucucuguguagcccugacugucuuggaaacugcucuauagaccaggcuggccuugauuaaagucaugcaccaucuccucuggcauccacacauaugauuccuccuuuuuuuuuaaagaaguuuucauuuuuuucccaucucauccuuuuuuuuuuccuuuuauucgauauuuuauuuauuuacauuucaaauguaaggcaauuuuaaaaaaagauuuauuuauuauuauacauaaauacacuguaacugucuucagacacaccagaagagaauaucaggucucauuacggguaguugugagucaccaugugguugccgggauuugaacucaggaccuucggaagaacagucagugcucuuaccugcugagccaucucgccagcccccacauaugauuguuauaccuuguuuuccuuacccacaagucuuuuugaccuggucaauucaucuaucugggauauauuugucuaacuuaaauaauggaacauuuaacugaauacugagaaaucaccacauuuguuuuccuuucaaucaaaaauauaauuuuccucucuguagaaugaagacaucuuauugacuacuagagcuaagauuuaauuaagucucaugcucuguggaguuuuaucguccugucaaauuagcuucaagaauuuucccaguggacauuuugaggugucagcuucauaugcagggaauagcuggcacguucagacauacacaauccagcacagaaugcuuauuacauuuucuuuauugggguggggcacucugugugugugugagaguguguguguguggucccagaggacaauaugauggagucacuccucuucuggcauucaaauucaugucuucaggccuggaagugaggccuucugcccgcugaucucgauggccucagaauuccggcauuaguucgucagacuuucaugaguugccaguuuauuuacgcaaugcauuuguuuucauaggugugugugauuuaaugcuggagauugaaccuaggguguuacacacacuauacacccacuuuagugcugagcuacgccucuagccucugugugugcauuuuuaaugcauacuuuuauaaugaaagaacaagauaagcucuuuccacuugggaauaauaagaccaaaaauaaauaaauaagcuugucugaagaugguaggugguagcaggaaacagccacucccagacagcuguuuugagguaaucaaaacaggcuauguguccagcauuguuuuaagacuuuaaaccuagguguucuaucacacuguaguaucauuagugagaaucaauguauucucauuaacuaaaaccuuaaauuucaugacauuugccuugauuuguaaauauaugagaaguauuuauauaauaugaaugguaauauaaaaagaauaaucagucuguguguguguguguguguguaugugugugugugugugugugugugugucuguguguguguaugugugucuguguguguguguuacuauggcuuaaacccagaacuuugauuguauacaguguaggaaaauggucugccacugagcuuuugaggucuaaaaucauuccagagagcuugucauuuuagcaagggagcacagaacauuccuucugacaagcauuuggcuuugguagggauguguuuagaggugagggaggcagggaauauccacuuagcuacuucagacugagccccucuguagugaauaggugacaugugaugggcagcguacccuuacuuuucuguaauaguucuuaguagaaauuaauggcaccuuaccuuucuccuaggacacaacagaaaacaagaggauaugauuuuuaguauuccuuaccagugugcugucuuugagagaaaaccacuggcuuuuaauaugugcagaggguacucacaaaucauuuucucuucugauucucagggaauauccaccuaucacuucagaucaacaaagacaacucuacaagagaaauuuugaugcaggucugcaggaguauaagagcuuacaggcagaacuagacgacgucaauaaagagcucucucgucuagauaaagagcuggaugacuacagagaggagagugaagaguacaugguaaguugucugacuuuucaguuuuguguuuuguuuuucaagacaggucucacauacuuccugcugaccucacacuuaauauauaccugaggauggcacugaauucuugagacuuuugccaccaucucccaaauacuggcauuucagacaugggccaccuugucugguuuccaaacuccuaaauguuggaauucaaaucaaucucucucucucucucucucucucaauaaaauuuagauguuacaaagcaauagucuaaauauauaaauguaucaauuucuauuuaaaagaaagugaccauauuaauuuuuauauaucauuuuucuuguaaaaaccucaacucagaacuguagauauggaaguauaucccuugggugggacuuggugucuguugaauacuuuuaaucucugcacuugggaggcaugaguaggcucucugaauuugaagccauucuagucuacauacugaguucuaagauagccaggguuacaugaagggcgggggugaggguuggggugggcuggugggcaggcauguguuuucuuccuuaaauuucuaccacauaccccagaaaaaguuuguuaccaugagugccuggaguguagguaggcagacacaaucuucaaucaggacuuguuuugagcaguuaagagcacuggcuugucuccccagaugacuggaguucacuuccuaaggagccacuacccaaucaguuaucuguaaccccaguuccaggauuucugaugcccucuucugcccuucauaaagaccggacacaagugauaugcagacuuacugcaggcuaagcauccauacacacaaaaucaaaauucaaauuaaggugugcaugucuuuaauccuaucacuuggaaggcagaggcagggggaucucugaguuggagcucauccuguucuacaaagagaguuccaggacacagagaaaucugauuuugaaaaaacaaagaacaaacaaauagaaagggaaggagagggagagggagagggagagagagagaaaucaaaaguaagcaagcaucauuagauaggcacucaaacuagucaccaaaacuugacugggcaagggcaaaguagaguguccucuuguguuagguuuucaaguacaugagcaaauaacagcaggaagguuaucaaauuaggggcuugcaaauguccagcagacacugacuggggaagccucuuucaggcuguuguucccuguugagcuuucucucccacuugcgggcuucccauggcucaacuucagcuccugguucccacugccaggaaagcugacacuuuucugccuugggguaaacagugguagccucuggauucagcucuagcaguuauuaaggacacagcguuguuacucgggcuguuuggcuguucucucccugccuuggaguagugggugcuccaguucuugcuuaggugguaguauuauaggcaugugcugucucaccuggcuuuucuucuucuucuucuucuuuuuuuuuucuucuucuucuuuugcagagauagacaacacuuuaggcaagcucccucccacugcuacuugaacacagugcuuggcacggcuuuccuuccaucuccuuuacacagaaguggcuugugguuauugucugguaucaguaauaaaagucuacuucuagugacccagcgccuggcucugagcacaggcugaccuugaacccuucaugcucaugccucugucugccaaugcugggauuucaaguuuguagcuauaggauuuuuaauuuuaugauuguauguaucauccuuuacugaaggauauuucuuuggaaauaguguaauacggaaaaagcuacuggcaagccuuucagguuuguauuuguguguucuuagguagugaaaauaaaagccagaaugugacacuguugauccagagagagggcgugcauuuaaaauauuucaguugcccaucaggauuguaccagccacauuuccccaguacugugcuagguggcucauuugacugccuuagguauuaguaacuaaaccuucccuccccaucacuucauauacucacuagagaucugccucuuuuucuuuuucuuuuucuucuucucuucucuucucuucucuucucuucucuucucuucucuucucuucucuucucuucucuucucuucucucucucucucucucucuuucuuuucuuucuuuucuuuucuuuuuuuuuuuuuuuccgagacaagguuucucuguauagcccuggcuguccugaaacucacucuguagaccaggcuggccucgaacucagagaucugccugccucugccucccgagugcugggauuaaaggcaugcaccaccacugcccggcacuacuguaccuugauuuaucuauuguuuuauagcuucuaucucauauuuugguaaaccuuuuucaguucauucaacacuuauuaaucaguuuuuguguguuugauaauuuuaugucccucccugcagagaacucaaauucuaaucaggagccugauaucugaauggcuuagacaguaugacugacacugcucacauuaucuguagaaaggacugucugaguaaauacucugagagggaauuaaggcagucagaugccuagacaauugaggggaggcuucauugaguugugacuggauuggggcuggagagauggcucagcgguuaagagcacuaauugcucuuccagagguccugaguucaauucccagcaaccacaugguggcucacaaccaucuguaauggggaucugaugcccucuucuggugugucugaagacagcuacaguguauucauauacauaaaauagauaaaucuuaaaaaaaaauaaagagaauuguaugggaaggguguguggcuuucacaugcccuuuuagguacuuggaaggccacaaucucaacaaccaagcccucucuccagcuccaaagaauacuauucuuucuuuuuuguuuuuuguuuuuucgagacaggguuucucuguguagcccuggcuguccuggaacucacuuuguaaaccaggcuggccuccaacucagaaauccaccugacucugccuccugagugcugggauuaaaggcgugcgccaccacgcccggcuaagaauacuauucuugagggagaaaaugcuucaauaaccauuuucuuucuuuuuguuucuuauccuuaggcugcugcugaugaauauaauagacuaaagcaaguuaagggaguaaguauccaguuuuuuguuuuuucuuuuggugucucugagacaagguuucucgauauagcccuggcuguccuggaacucacucuguagaccaggcuggccuugaacucagagauccauccgccugccucugccucccaagugcugggauuaaaggugugugccaccauggcccggcauaaguauucaauuuugagacucuuuuauuuaauguuuauagugacuauuccuuucuuauguauguacacugauuauagacagagucccugucuuuuaccuaugagcauuauaacugagaaguuaggacuuuaguuuuauuuguuuauaccgauuuucuaaauacuuuuuuugagacaggguuucacuggauaucccuggcuagucuacaguucagcuuuguagaucaagcuugccuuugucucccaagugcuggggucagaugcaaugcuuuaccauacgcagcccuaaaaucuuucuuuaaaguugaaguauaucuguaaauacuguguaaguccuagugggaggguugguaaguuuugaccuuaaaccuguauucuuggcacccagaaaaagaaauacauuuuuuuaguaaccuuaauagcuccucauucuuauuccucuccuguguuaugggaaauauuaaaaaaugaaccuuccaacucuccaagggcaggacuacgcucccgcacuccugccggcccuccagcucucuuccagccaugcugcaccacaaggcuuccccccgccccuuagguccucucacuaccacgcaaugccucaccauggucagccauuucaacaccuaauuaccugguagaaucaagacucuuagagcuuaauuaacccaucagauuuauguaucacuauaauugcuauuuauaagaugccaguacaaggggcuggagagauggcucagcggguaagagcacugacugcucuuccaaaggucaugaguucaaaucccagcaaccacauggugguucacaaccauccuuaauaagaucugacgcccucuucugcugugucugaagacagcuacaguguacuuagauauaauaauaaauaaauaaauaaaagaaagaaaaaaagaugccaauacaauaauuucagagccaauucauaaugauaaaagcuugaucccaaaauuucuaaccuugugaaaucauagcgacuuguagcugguaaguagacauggguucauguucccagccaucuuccuccucuccucucauccccugagaugcugucugugcaacucuuagcucugccucccuuuucacuguccaaccacaggucuccucugcacuaauaauugaacagggaaaauccugcaacauuccuguucuuauaccaucccccaaaauuauacauuagucuugacuauuuaaaauuacuugaauaaaaagaaaugaugggccuggagaaagaaagaaaaacaaagauuuauuugugcuuuuguguguuguuauucauuuauuuuuaucauuauguaguguuauguuguacaaaaauagaacuuaaucaucuauuuuauuuuauuuuuuggcuuuucgagacaggguuuccucuguguagcccuagcuguccugaaacucuuuuguagaccaggcuggucucaacucagagaucugucugccucugccucccaagugcugggauuaaaggaauguguugcugcuaugucugccuauuuauuuuauuguuaacgauuauuugauuccuuaguuuuaagaguucacaaauaauacagcaucagugugcacacaucugagagguuuacaguuuguaaacuguagaaucauuaggcucaugccuguguguguguguguguguguguguguauguguguaugugugugugugguguaggugucuguggguguguuuggguguggguuucugugugugugugucugugugugggugugucucuguguguguaugucaguguggguaugggugugugucgguguggguguaucugugugugucugucucuguguauguguggcuucaguagauucugucauacagccuucccaggagcuuacacuaguucacaccuucacugagaaucuuacuuuguccuugcuaacacuugauauuacaggcacuguugucuuguaacacuuuuuguuuucaaaauacuuaaugcuaaaaguuuuuauuguaauuacagagcauaaugauuuuaacuaagguguguguguguguauguguguguguuuccuacuuuauuuuuugagauaggcucuucuguugaaucuggagcuugcuuuacuauuuuugcuagauugaguggcccaagauccuccuaucuccuccccccagugcuccuuacccgacagugcuccucccuccagggcuggaauuacagguacaggcaucacaccuggcuucuuaugugugugcuggauaucgaacccaguccuccugcuuucaguaauaggcccuuugcaucaaagccccucccuaacccuuuaaaugaguuuaaaggaguauauggggcagaggaccugaguuuguugcccaggggagccagcacccucuacuuacuuacuguguguauguaugaaguuugcauuuauguauguauguacuuacuguguguauguaugaaguuugcauguauguauguacuuacugugugcauguaugaagucuucuuacuuacuguguguauguaugaaguuugcauguauguauggaugcguggaggagcauguguaccauggcacagggguggacuucaaaggacacuugcaggaguccauucucuuuccaccguguggauucuggggauggaacccagaucucagagcucugcagcuggcgcauuuaucuccugagccaucuuacuaguagccccugaaauuuuuuuuuuuaaaagauaauuuauaaacacaaaggucagugaauucucauagugacuuaacauauuuuuuagaaauaaacauauccuuuguaaaaaaucaguuuaaaagauauuauugaggaaaaagggccaucugccuauguggucagugauagugcucaguaccuuaaaccaucugccuguguggucagugauagugcucaguaccuuaaaccaucugccuguguggucagugauagugcucaguaccuuaaaccaucugccuguguggucagugauagugcucaguaccuuaaaccaucugccuguguggucagugauagugcucaguaccuuaaagauacucauuuaguacucauuacuucuuuaugacuagucuuuccuuuuuuuguuuuguuuuguuuauccuugcuuucucaggaggcccauuuuuuuaauuuaaauuuuuuucauauaauuuugauguuuuccccucucuccaacuccucccagauccucccuaccucuguauucacucacccaacuugguguguucucuuucucuaaaacacacuuuagaaaaaaggaagaggcuggggagauggcucagagguuaagaacacuggcugcucuuccaguaagucuggaguucaauucccagcaaccacaugauggcucaaaaacaucuguaauagaaaccgaugcccucuucuggugugucugaagagagcuaccguguacuuauauacauaaaauaaauaaaucauuccuuuuuuuuuuuuaaaggaaaaucagaaacaaaaacccaguauguuaaaacaaaacaaaacaaaacaaaacacccaaacaaaaagcccacaaacaauacaaaacaaaaaaccauggaguuuugcauuggguucugccaugaguguaguuaauauauccagugacacuucuagaguuuuauuucauuuuuaaauuuuuuuguuuuuucgagacaggguuucucuguaaagaccugguuguccuggaacucacucuguagaccaggcuggcaucgaacucagaaauccaccugccucugccucccgagugcugggauuaaaggcgugugccaccacugcccagcuagagucucauucuuuaguguguuggcauuuaugugauuuacucucucugucucagucugcagauuauaaaaguaagaggaauuacugcaagcaguugaagagcaaauuaucgcacaucaagaggauggugggagauuaugacagacggaaaccuuagagagaugccaguugcgggagaagggagaggugcaucugccugcacgaugucucugcaauucucuccagaggcaaacugacuuuggacucuaaucugggaaguuaaaacuuugugaucauuacaaaguuuccguggcuuuaauuccaucaguuuccuaucuccaguauugaagcauuuuauaaauggcuuuugauaauugacugggcugaacacuccaauuaaggauuuuacaguuucaacauugauucuuguauuaagaauuaaaauguugcuugauauuuuaaaugucaagaaagguccuggugugagcugugauguguguugagcuuugaugugaagguucacacgccaggcaguguguuccuccagguagaccgucuaaucaaucuuugcagcagcccucaggugacuguuauuuagaaucagguuguuuuugguuuuccagacaggguuucucuguguagcccuggcugaccuagaacuuacgcuguagaccaggcuggccuugaacucacacagcuucucugagugcugguucaggaguuaacgucguggaccgguaucaucacuuuuccugcggugacuucuccaaacugaaacugcuaaggcaguuuuggcuaagucuguuuuaugacugcaaaugacagcauuccugccuuuguauuucaggggaaauacgauacauuauaucggccacguuccccaccacuguuuuucuuauauugacuuuuaacaaaugaauaggauuauuuuuggcuuuacauuuuuuccuaacacuuaagaucauauaaaauuaacaaguaugugaaauuuaagaauuguaaauauauauuuacguuugaaagaugauuuuaaauccaggguuaaagugcuuuuuaucuuguauaguuuacaugcuuuuuuuuuuuuuuuuugauaacccacuagaccuuuccauuguaucagaguauccaauuacauuuacaauuaugacuugaauuguauuucacaggaaugcucaaguuuuguacauauuuuauaagguauuaaaccugauguucucuuucuauaaugugcucauuugaugucauuaguacuguucuauucaguugugcaaagcuauacuaaaguuucagugugugaacuaccuugggugcugugcuagcaggugauugcccaguccuugggcagugaacaaaacucugacuagaaaugggauaauguucauagaacagcaugauacuuaaacagugucuguaaaucccaggauguucuuuauaaauuaaaauuuuuguuaauaguauaaaauuagcugauagugcuucauagaccacauugacauccagcccaauuuggucuguuuuagcugaaaauguuuuauauaccuuucagacauggcaguacauauucuuguuuauacaauuuuugaauuauuuuccaaugauaaaaauuuaaauaauguuuuuguauaauacugggucaauuuuuuuuucaaauuaaagaaaaauuuuauuuucuacaugc

SEQ ID NO: 7200 - RNA, 8231 nt, Mus musculus
gcgagugccacgaacuggccaaugaggagcgagcggcccgggguuuaaaccuaagcccggcagacuccucccggcgugcugcggaggaacggcuguuaguguuuagcuguggauagccagagguuagggugucuucucgaaucggggaaccucugauuuuggaggagccauggcgcucagggucacuagggugagucgggccaggcgcugcggugaucgcggcgggagaagaccgcgggaucccggagcgggagggggauccgggagggcuccggcgaggccggggagcugaggacccaccuuauggagggugaaaaagaccucuggaccuaucugggcugcaggacuuguggggagugggugcugugcucuuaauggugaaggcccagggugaauucuucgccuucccggagagcugucuacgacggaggcuuuuauggcauccuuuccgauguaaauucaccauguuuaggguggcuuaggacuuaaggggaaacuggauuaaaggugaaagauuuggguggaaacuugcuugucacggcuggaggcuagauccuaccacccuugcuuuccuuaguuaggucccgccuuaauuaacccgugacuuccucggggcugccugcuugcugccguggacccuuuucaaguuguucuuuuacuucuuucagaacacgaaaauuaacgcagaaaauaaggccaaggucaguauggcaggcgccaagcgugugccugugacaguuacugcugcuuccaagcccgggcugagaccgagaacugcucuuggagacauugguaauaaagucagcgaagagcuacaggcaagagugccucugaaaaggguaacuaucgcccugaaaaggguaccgaucucccuagcccaauuaaccugaaaaggcccaucuucuagcugucacccuugggaaaacauucuguucucucccuuucauccacaggaagcaaaaacgcuagguacuggaaaagguacuguuaaagcccuaccaaaaccuguagagaaggugccugugugugaaccagagguggaacuugcugagccugagccugaaccugaacuugaacauguuagagaagagaagcuuucuccugaaccuauuuugguaaacuugcauuuuuuaaaaguuuguuucuucucucugacuucauuucacguugaugcacaugacagcauuuaaauauauuacuuauuauugaguggcuagcaaaaacauuuuacaugcauuaacgacucuggggugaguauuagcacccugcgucaaaugguggcagauaaauaugguggggcuuuuuguuuuauguagacaccagagucucacucacuauguacuccuggcuggccugggacacggaugugggcauaaaucauuuucuuuucugugucucuguagcucaugcuguccuugaacuugagauuuccaccuccaaugcugggaugguauauucaaaaacuauuuuuaaaaagauuucaggcagagaaaugagauuaauuaauaaaauaaggugcuugguagaaucccaguauucugucuggccagaggcagguggggcucugagucucuguaacaagguccagucuagccagagcuacauauagugaaacuccguauuugaaaacaaaaaaagaugauaaugauggaaugauggguuagcauuuaagccuaaaaaugaaguuugccugaguuuguagccuguuagauuguguucagcauauuaggaggcccuggguucaguccuugaguauuaaaaugcaaaagagaaaaaugcaacaacaaaaaaagcauacacgucgaaggcaccagauuuuacuacuaggugugaugauuggugcauguuugugauuugagcacuucugcuaaggcaggaagauugcaaguuuaaggcuagccugggcucucuguaaucaggggcuuggauacaccugaauaaagauugcuggcuuagcauucuuuugaaucaaguucacguggggcugagcugauggauaaaugacuuuauuaucuguuccuuugacuugcuuuaccuacuaguauugagaguacuuuuuugugugucugugcccaauuguguguauguuaggccugaagagacagaguucuuuggagcuggagccggcguugcaggcguuugugagccacccaguguggucgcuaggaucugaauucugucccuccuggagaucgagggcucuuuaauugcugagccgucucuccagcucccaucuucucuuuuguauuuugugugugaggacacaguuagagagguuggaagacaacuuuugagucaguucuuccaccuugcggguucuagggauugaacucaguuguuaggcuuggcaacaggcacccuuaccaggcuugccagccuaguuuuuccuacuuuuaaacugccuuaaucuaaaucggaguuucuuuuuuuaugagaccagaucuugcugccuuguaguuugcuauggagaccaggcuggcuucaucucacagagaucugccucccaggggcugggauuaaaggccuggaucaccaugccuggcucuguuuguuaguuuuugcuguuuauguguacgauuuguuuuucaugagugggauguggguuugcacaugagcgcagggcccaaggaggcuggaagaggacgucagauagccuggagcuaagguugaguccugguuccugaagagaaacuggauuccagcccuuggcaaaagcagcagauguuccuuuacagcuauaacuaucacuccagccuaguguuaaucauuucccaagaagaaauugggggaaagagucugaaaugcuuucccuuuauuagugaaaugaguuacauuuauugagcaugcuguacugaauugcggauacagauacuggcuuuccuucccuuaauguagccuguuucacggagccucucuuuuuuaagguugauaaucccucuccaagcccgauggaaacaucuggaugugcgccugcagaagaguaucugugucaggcuuucucugauguaauccuugcagugagugacguagacgcagaugauggggcugacccaaaccucuguagugaauaugugaaagauaucuaugcuuaucuccgacaacuggaggucaguauugucauugcagucugccuucucucacugcagcuuccuggaucaauauuccugguccuggacuuaaagguggugcaauauacacuugguuuauuuuuuuguguuuuucauauauauauacauagaucaguuagccuggaacucacagaaugcugggauuaaagugaugugacaccaacucaacuaucaaagauuuuuaucaacagcacacgacauuuuuuuuaaacaacaaauagcacucuauuuguuagaaucagaaacacuauuguuuugaaacacuaaaaaauaaagucauuaaccccaugaaguggacuugccacuuugaauauaaaauuucuauauagggagauaaccuuccuaaaauaggcaugucacaaaugugaaagucuuauccuugugggucuaagauggggauagauggcuaaaggacgguggcugucccacaccaggcauucuuugucagugugcauguacuugucagaacgauggaaguugguuucaucaccuucgccuacuuggaaagcuuucuauuaauggaacuugcccuuuucucuuucuaaacaaggcauucuauagcuaaauguagauuuaucagguuuaaacccucccuguccccccaguacuagggacagaauacaggaccuugugcaugcuaagcaagcacuuuaccaccgaacuauauccuagcuuugucuucucagguugucauugguuuuuuugcuguuggguuuuuaucucuuuuguaauaguguuuucaagccuugugugggugggcacaugagggguucaaaggacagcuuugaagaguugguucccuugaagaauggcagcagcacaugccuuuaaucccugcacugaggaggcuaagggaggcagaccucugagcuagaggccagccaggucuacaaagugaguuccaggacagccagaguuacacaaagaaacacugucuugaaaagcaaaaaacaagaguagguucuccuucugccuuucuuuaugucaguccuggggucagcaggccuuagcccaugaagccguguugcucauaccccauucuuuguuaacaucuguauuuuucuuuuaaagauuuacuuauuuuauguuuaugaguacacaguagcugucuucugacacaccagaaggugcgucagaucucauuauggaugguugugagccaccaugugguugcugggauuugaacucaggaccucuggaagagcagccaucucuccagcccacaucuguauuuucuaaaguagucuucaguaagauaaucugguucgaaacuagcugucuucguuuuuauucuuguuaauacugcuaaagcuuuguguucuaacgcucagaacuugguuugguguuacacuguguggguguuuugaguuuauaacauggagcagcagaucuacaauuuauuuuuucugcaucacaaaacuuaguugugagugaaaagaucugaggugaugauggguacagggcgugagcugcaauaguucuggcuaaccagauggucgcucugucaacagucugaagagccuacuaugacuuugcaaaccuugcuuucuuggugaacuucugcccugagcuguuuguuugauguuuguuaacuggucuuuauggacaccgaugguagauguugugauguuucuaaaauaacugacauuuucuuuuguaggaagagcagucaguuagaccaaaauaccuacagggucgugaagugacuggaaacaugagagcuauccucauugacuggcuaauacagguucagaugaaauuuaggcugcuucaggagaccauguacaugacuguguccauuauugaucgguucaugcagguaugugucauucaguaauugagaguuauccaguuguagcucuaugagaaucuuggaggaggggagguggauacuuaagguugaaccucgggucccauacaugguaggcagguaccuuaacugcugagcuauuauuauaccuagccugaaacugaauccuuucuugggagguaaggugucaucaauugagauguuucagugcauucuguugauugaacuugccauugcagaacaguugugugcccaagaagaugcuacagcuggucgguguaacggccauguuuauugcaagcaaauaugaggagauguacccuccagaaauaggugacuucgccuuugugacuaacaacacguacacuaagcaccagaucagacagauggagaugaagauucucagaguucugaacuucagccugggucgcccucugccucugcacuuccuccguagagcaucuaaagucggagagguacagauuccucgagaaauguuuguuuugccacaugagaaaaaacacagcugcuaacuuaaaaugucaaauacauuagacauuauacauuauuuaaaaauaaggcugcugaccuaacuacauauuacgugguuacuuuuaagaccuucuggggacaguugucuuugagaguuuguagucccggcagggcagggcuuuuuaaguuagugcugaaggcuuagagugguguggucuguuccagguugacgucgagcagcacacuuuggccaaauaccucauggagcucuccaugcuggacuacgacauggugcauuuugcuccuucucaaauugcagcuggggcuuucugcuuagcgcugaaaauucuugacaacggugaauggguaagcugucucaccaaacuaccaagcauuggaacggaccacuugguguugagaucacucuccuggguccuaauauggaaggagugugaccauaaaugguaacccaaaugcugcgcugccaucucagugcuguagcuaacuucagucuuuaggauaacacccuuuggagagaggaagccacaccaagugaucuaagaaaccuguccacauccuuggaggugcauuucucuuguacggacagggugcuacccugaccuugggauagagaagccacaguuacaauauugugcuuagagcucaagcucuuccagaaguauaugugggcaaaaagaucuuguuucauguguaaucacacuguucacccaccagacucuuaaauagcaucuagaaaguuuauaaaaggagggcuggugagauggcucaguggguaagagcacacugacugacugcucuuccgaaggucccgaguucaaaucccagcaaccacgugguggcucacagccauccauacugagaacuggcgcccucuucuggugugucuaaagacagcuacaguguacuuauacauaauaauaaauaaaucuuuuuuuuuuuaaaguuuauaaaagccgccgguguuuuaagcauguuuuuguucucuuagacaccaacucugcagcacuaccuauccuacagugaagacucccugcuuccuguuaugcagcaccuggcuaagaauguagucauggugaacuguggccucacaaagcacauggugaguccauugaaaauuuaaggcugguuuauggccuauagucccaccaugcaaggcaggaagaggcaaguuuugaguuuagagccagccaggacucuauagaaagguuguuuaauuucauuuuuuaaguuaaaauauaauuacauuguuucuacuucucuuccccaccccccccccaacacacccccaauggcaauguuuuucuucuuccugauugcagugcuuuucucuuacagacugucaagaacaaguaugcagcaucuaagcaugcuaagaucagcacgcuggcacagcugaacuguacacuaguucagaauuugucuaaggccgugacaaaggcauaacuccaauagacugcuacaucugcagaugcaguuggcaccaugugccgccuguacauaggauaccuaccguguuuacuugcucuucaauaaagguugugacuucucauuuuacauagcuuaacucauuugaauguuguugcuucugaguuuaggcuaacggaaguugucgaauuuaggaguauauuaaaaacugcaucuaguuuuaacaguggauccaacuaauguauauaucuguagccuauaugucuauauacauccuucacuguguguccuuauaucaucaugucuucugccucacucuaguuuaaacucuaaaucuaccagcuaguccuuuguuccauuuuccagugguugccaccuuuaaccacugucucuugguuugucaacuuucagaucugaaaccaaguaucuuuuuuuauguaauuauuuauuuguucuuaauuggaaaauaggauguucaaaauuaaagguguguuuuaaaaagaauuugcccccaagucucacuaucaacagauaaggguguauucuuguauauccuguauagauauaaucaugcauauacucccaaggagauauuuuuauauggguucauuuuaucaacaguauuccuaucagcauuccuuucaaugccuauauugcauuuccuagugugaacaaacuguguguaacauagucauucccucggugggauucaagugcauucucucagugcccuccacaguguucuuaaaugauguuuaaugucuugcuuggcuucauucauaguagcucuuccaggggugugcuuugaauucugacagccagauggguguggcugccaccauaccaaggcgccacuccugucuuguaaugccaccuggaaaagaauccugucucauuugcuguuuuaauuuauacaucugauaucaaguugaauaaaauuuauugguggaaagcuuucacaauucucauuugcccuuuugacuguuuauguugucuuugcaauauggagacuuuauguugcuaauaaacauaguuuucgauuuucagccaaggucggccaacucccaagugugcacaccuuguaauccagcccagguuuuuaaguguacauaucugaucuaaaugguguuauuccccuguaauaauaggacuuuuuuuuucuuuucuuuuuuucucucucuuuuuuaauauauuuuucaaaaaaggauguccaauccccuggaacuggaguuacaguuauaaacugacauuugccuacugggaauugaacccagguuuucuggaagaacagccagugcucuuaaccacugggccaauuguccagcccaugauaggaauuuuuaaaacugaguucu

SEQ ID NO: 7201 - RNA, 1466 nt, Mus musculus
uccucucucucuagggacuggaaccuggcaggcagugcgucccgagcccagacucccgcccgcucgccgaucucaagccacggaccgcagagguagcccgcgggguccgagcaaggcgggaagcuuguccgcaccgccggcggccguggaaucccaccuuaccgggcgcugggcacguccaccggcccgaggccaccgccgggcccgggccgcgcguccccgccguacuucuccuccaugcaggcucaggagccgcugcccgcgccgcgggcucuccucauggcucgccgccgcugcggaagcgcgggcgcaggcgcgucacucccccaugucagcagcguccucgcaagcucggcagucuccgccgcuagcccgggcucggcaagcaggcacacgcacgcugggcgggacuaggccgcgggcuguuccggcagcgccguuccccggaggccguacgggcaggaacguuaccgggccacgucauccgccccggcagcccucacucccgggggagugaccaauccugcgccugcgcgcugguggacacguggcuucgcuucacucaggcuccucccaccgcugggaaggcuccgcucgacccgcccccuccucgcgucuucaagagaagccccuaagaggucccugcagcgccaccuaagguccaucuuggcuacagcguguucuccucgcucgagggauggauggaugguccccuagaaaaugcauauuuguguuaacaaacagagcuuagcccuuugcuucaggguucuucuuucuuaaacggcuucacuuuguagcccagauagaccuagaacucagcauguagcccaggcuagccucauaaaccuggaugaugaauuucaggcgugagccacauauaggcguugcuaacucaagugcauuaacgguuuuuuuuuguuuuuuuuuuuuuuuuuuuucuaaugagaaagcuaaaaguuuuuugaagugccugugacucccacaaagagauuauuauuuuuggauuucugaugauacgauaacgcagagugggaggcuaaaacaauggagaaaggcaacugcuuguggauuuaauuguugggcaggaguacaggcuaaccugcucaagugugugagagggaacacagaaggaaggggcuacaggugugcuauuguaaacaauuuuauucccuuucuaaaaauauugauuuucuucaauccugucuuugaaaugauauuacuuaguguagacauaucuauauaaaagcuauuuuuuuacagguaccugggucucuauuggucugagucucaauaauuguggacaucuuggucagcaugguggcgcaugcuucuaaucccaauuauagccagaggcaguuugaagccagccuggucuacauacugaauucuaagcuagccaggacuacaaggugagauccugucucaaaaggaacaagaaaagaaauaaacaauuguagucacuugac

SEQ ID NO: 7202 - RNA, 1466 nt, Mus musculus
gucaagugacuacaauuguuuauuucuuuucuuguuccuuuugagacaggaucucaccuuguaguccuggcuagcuuagaauucaguauguagaccaggcuggcuucaaacugccucuggcuauaauugggauuagaagcaugcgccaccaugcugaccaagauguccacaauuauugagacucagaccaauagagacccagguaccuguaaaaaaauagcuuuuauauagauaugucuacacuaaguaauaucauuucaaagacaggauugaagaaaaucaauauuuuuagaaagggaauaaaauuguuuacaauagcacaccuguagccccuuccuucuguguucccucucacacacuugagcagguuagccuguacuccugcccaacaauuaaauccacaagcaguugccuuucuccauuguuuuagccucccacucugcguuaucguaucaucagaaauccaaaaauaauaaucucuuugugggagucacaggcacuucaaaaaacuuuuagcuuucucauuagaaaaaaaaaaaaaaaaaaaacaaaaaaaaaccguuaaugcacuugaguuagcaacgccuauauguggcucacgccugaaauucaucauccagguuuaugaggcuagccugggcuacaugcugaguucuaggucuaucugggcuacaaagugaagccguuuaagaaagaagaacccugaagcaaagggcuaagcucuguuuguuaacacaaauaugcauuuucuaggggaccauccauccaucccucgagcgaggagaacacgcuguagccaagauggaccuuagguggcgcugcagggaccucuuaggggcuucucuugaagacgcgaggagggggcgggucgagcggagccuucccagcggugggaggagccugagugaagcgaagccacguguccaccagcgcgcaggcgcaggauuggucacucccccgggagugagggcugccggggcggaugacguggcccgguaacguuccugcccguacggccuccggggaacggcgcugccggaacagcccgcggccuagucccgcccagcgugcgugugccugcuugccgagcccgggcuagcggcggagacugccgagcuugcgaggacgcugcugacaugggggagugacgcgccugcgcccgcgcuuccgcagcggcggcgagccaugaggagagcccgcggcgcgggcagcggcuccugagccugcauggaggagaaguacggcggggacgcgcggcccgggcccggcgguggccucgggccgguggacgugcccagcgcccgguaaggugggauuccacggccgccggcggugcggacaagcuucccgccuugcucggaccccgcgggcuaccucugcgguccguggcuugagaucggcgagcgggcgggagucugggcucgggacgcacugccugccagguuccagucccuagagagagagga

SEQ ID NO: 7203 - RNA, 1644 nt, Mus musculus
uaaaacugaauggaaaacuuuauauaauauuuaggaaaaauccaucauuauuaaccuucccuccagaagaaaucuugcuguaagcacauuuugcaccuuguuaggaucuucaggguuuguaaugagcaagucuguuuuugggccaacgugcguccauguccccagguucaguauaaugugauuuuaaguggcccugucauuaaccuuugaaaaauggaagaagucguagaaaaauuaacugagaaaaaucugugcuauagcaaccgcuguuagcaaaaucugauuuccugcugauaaagucuagaaauuuuuuuuuucaaguuuugguuguagaaggugggggcgggggggggggagguaguguggacuccaccacuucuucauuucucugcuaacaaauaucgugaacuguuuguaagcguggugcuuccuguacagagggugguucagccucucagccucgcuccucuccccguccagguggagccuaugaagugaagcagcaucguuucuuccgcuccuuagacuggaacaguuugcugagacagaaggcggaauuuauuccccaacuggaaucggaggaugacacaaguuauuuugauaguacgugcauuaucugacauccuuuggccuuuccuagauuuaaaaaaagaaaaacaaaaacaaaaccauaguucaucuccaacuucacacuuuccaacuucguaccuacaaauucuagaaagcucccuguuguucugcuccagguccucagaggguaguugucacuguuaaauacagaagcucucugaguaacccagacuguucccaacccuuccuccgcagcucggucagagaaguaucaucacauggagacggaggaggaggacgauacaaacgaugaggacuucaccguggagauaaggcaguuuucuuccuguucacacagguuuucaaaaguaagugggacggggcaucagcaugcaaaaccuugguauccaccucaguuggacuagacuguaaaagcaccugcgcuuuguggggugugaguucuccagcacucaaaacucccaguuaguuggggaaauggucucauauacuuaauaagcagccguuuuccacccuaaagacauggcuccaacuuugggaguugauuguugcuuugaggcaaagaugccaacgcuuuguugucuuucaugagaguugucauguggugaacuugccuaccugcccccuaaggucuagcugagagcuagucuguggaggcuuuugucaaugaggaagggcauaggcgucacugugugcagagaucccccuuauugugacacaguauaacacaggaaugauacucaguucuuugcaugagccaggguucuugggggacacuugacuuugagauaagcaaauauuuugaucgguaauagagauuauaacugauaucgaaaaggcagugggaagacaacgauagaaguuuagaaaugguagaagaaaauaagauugauugagagagaucccuuuuuauaaacucagguaagauuuuaaaacagacaaacaaacaaccugauuuuuuugguagguugggaacccagggauaauggaaauaaacccagagggcacccuaccuccuuucugcuagucucaguugcuacaucuuugugguugcca

SEQ ID NO: 7204 - RNA, 1214 nt, Mus musculus
uacuucugggaucagaguggcuuuugcaugacacguaucagaaguuacuuuaacccaggauguucagccuagaggccuaacauuuugcuuugcugcagcaguuugguguaagucucugcccaccagugaacugccucugauucuacaggcugcugccccugcaacauagacacaaccaugcagggccccucuaaaagggagacuugguucucuucuucaaggcgaaguccuguggcagggcgccagucuccuuccaugcgguaugcuuuguugcuggcugcuccuaauucaguaucuugcaaaaugacauucuguuaaugacaugaaugucaaagcugugauaaugggcagaaguaaaagaaaaccguuuccuaaauggggaagcaacaggaaaacugccaaguggguauuaaaaugaguuguguggcugcccuaugccucagcgcuuacuuagugccuuccuauuuguuucuaccaaagggaaguggcacccuaaggggggaagaauggcucaccucggugugagcacagaaaacaaacaaacaacaauaaaaacaagggguuaaggccauguuuucccuuaauuaacuugacagaugucuuuucuuuuucucguuugcauccagugauuuuuuuuuuucuuagucauucuuuucuuuugccaagaaggaauuggccaggaggagcccguucuguugcugaagacaggagggcuggcgagauagcagaagacccuggccugcaaacugcucaguauucagucuucgugauggaugcucuuuggggcugucaaaugcagaaccaguaaaagaaucuggggucugaaaggagacuggugauguaugaagauaggaugcccuacggagugucaaaugcagccaaagaaagaagccauguggcuccuauagccagggccuuagauaccagguacauuuaaugacuucacaugcaaauguguaauucugcuuucacaggggcccaagagagagcucuauuuuuuauauaauggaguucuuagaagagacucacaaaacaagguuuacaaugagcagauaugguugcuaauuccaagcccaguagaaccucauccucuauggucugcagaauggugauacaauuaccagcuaucugcuggguaugggagccaugaaggcugaggcaggauuacuguugguuugaggucagccugggcuacaggauaacauucuaucuca

SEQ ID NO: 7205 - RNA, 3054 nt, Mus musculus
acagaucccgaggaaaucuccagcuaaaugcucaaaauauaaaacacugagcuaauauuugcgaagaggagcagaauggauggauuuuaugaccagcaagugccuuacguggucaccaacagucagcgugggagaaacuguaccgagaaaccaacaaaugucaggaaaagaaaauucauuaacagagaucuggcucaugauucagaagaacucuuucaagaucugagucaguuacaagaaacauggcuugcugaagcucagguaccugacaaugaugagcaguuuguuccagacuaucaggcugaaaguuauauguuuguucuguuuuuaguggcuuuucauggccucccacugaaaaucaagaaagaaccccacagcccauguucagaacucgggucugcuugcagucaagagcagcccuuuaaauucagcuauggagaaaagugccugugcaaugucagugccuaugaucagaagccacaagugggaaugaggcccuccaaucccccgacaccauccagcacuccaguguccccacuacaccaugcaucuccaaacacagcucauacuccgaaaccugaccgggccuucccagcucaccucccuccuucucaguccauaccagacagcaccuaccccauggaccacagauuucgccgccagcuuucugaacccuguaauucuuuuccuccuuugccgacaaugccaagggaagggcguccuauguaccaacgccagaugucugagccaaacauccccuucccaccacaaggcuuuaagcaggaguaccacgacccagucuaugaacauaccaccaugguuggcggugcagccagccaaagcuuccccccuccuuugaugaucaaacaggaacccagagauuuugcauaugacucagaagugccuagcugccacuccauuuauaugaggcaagaaggcuuccuggcucauccaagcagaacagaaggcugcauguuugagaagggucccaggcaguucuaugaugacaccuguguggucccggagaaguucgauggggacauuaagcaagagccuggaauguaccgggaaggacccauguaccaguggcgaggaucccuccagcucuggcaguuuuugguagcucuucuggaugacccuucaaauucucauuucauugccuggacuggacgaggcauggaauuuaaacugauugagcccgaagagguggcccggcguuggggcauucagaagaacaggccggcgaugaacuaugacaaacuuagucguucucuccgcuauuauuaugagaagggaaucaugcaaaagguggcuggagaaagauacguguacaaauuugugugugacccggaagcccuuuucucuauggccuuuccggauaaccagcgcccacugcugaagacggacauggaacgucacaucaacgaagaggacacaguuccucugucucacuuugaugagagcaugaccuacaugccugaagggggcugcugcaacccucaccccuacaacgaaggauacguguacuaagaugaguaacccgucaagcaaggcaccccgugcuuugccucuuuuuuuucaagaugcagagaaucaccgaauucucuucaauguuuguuuuauuucuguuguuuguacuuuauuuuuuaaaugauaauacaaaagggggauuuuccuguugcauuauucuauggucugccauggacugcgcacuuuauuugcuggugggcaggaguaaucuagacauucauucuuuguaacaggaagauggcggaugagugggcagaaggagcugagggauuccuuuuugcuuaggcuuggaauggaguccuacagguuuucuguaugaugauucuauaucauauuuguucgauuucauaauaacguaagauaauuuucccuggguaucuacgguacaguugauuucacguuguguaaauaucuucuuggagaccauuugccuugggcauuucccccaucauuacugagucucugcagguguacaaaaaucuacuguaaauggcaguuuaauguuagaaauuacuguuuugcaccucuuguaaaaaaaauauuuagcaauugcauuuguuguucuuucuguuucauaaugcuuuacagaugacuuguagaggaaaacccuaaaugugggcaauucucuuugaaguugaguaaucaccaugacuguaaaugagggccaccguuuuggacucuggcuccaacugagucacaggccaguagcauuuuauguaucugaugccaucuugcuguuuugguacuacaaauacugucuuuuaaauauguugaugcccaucucacuuaaauaaugacaugucaugauccuucggaaucuucauuuaaguguuaaagcugggaucacaaugaagcaaaaaauagaaaaagaaaaaaaaaauuaccugucuccuuucacuaucuucaguacauaaauacauuauuuaaucaguaagaauuaacuguacuaaaucacauaugaugcuguucuaguuacagcaagcacucuuuaagaaaaauauccacuacacuaaauagguacuauaguaauuuuuagacaugguacccacugauaugcauuuaaauguuucacugcuguguucuguugauaacauagauaaauauuagauaaugcuaaugcuuccgcugcuguccuuucuguaauauucucucaugcugaauuuauuaugaccauuuauaagcaaugcaguuaacuacagauagcauuucaggacaaaauagaugacucaaaccauuuauggcuuaaaaaaauagcuuaccaccuugcuaugcuauaagcagcuucuaugcacauugacaaaugaagagugagccucagcuugcuaaaggaaacuggggaaacuuuuguaacuuuggugaaauggaacacuguuuaugaacuguuaaagaauaugaggaaguuccugugugacauagugcuggcacugauguuguccuucaucuccuuuggacacgccuguaaaugugaucagauuguaugaaagaagauucaaagaucugaaaucucaaaaaaaaaaaaaaaac

SEQ ID NO: 7206 - RNA, 3054 nt, Mus musculus
guuuuuuuuuuuuuuuugagauuucagaucuuugaaucuucuuucauacaaucugaucacauuuacaggcguguccaaaggagaugaaggacaacaucagugccagcacuaugucacacaggaacuuccucauauucuuuaacaguucauaaacaguguuccauuucaccaaaguuacaaaaguuuccccaguuuccuuuagcaagcugaggcucacucuucauuugucaaugugcauagaagcugcuuauagcauagcaaggugguaagcuauuuuuuuaagccauaaaugguuugagucaucuauuuuguccugaaaugcuaucuguaguuaacugcauugcuuauaaauggucauaauaaauucagcaugagagaauauuacagaaaggacagcagcggaagcauuagcauuaucuaauauuuaucuauguuaucaacagaacacagcagugaaacauuuaaaugcauaucaguggguaccaugucuaaaaauuacuauaguaccuauuuaguguaguggauauuuuucuuaaagagugcuugcuguaacuagaacagcaucauaugugauuuaguacaguuaauucuuacugauuaaauaauguauuuauguacugaagauagugaaaggagacagguaauuuuuuuuuucuuuuucuauuuuuugcuucauugugaucccagcuuuaacacuuaaaugaagauuccgaaggaucaugacaugucauuauuuaagugagaugggcaucaacauauuuaaaagacaguauuuguaguaccaaaacagcaagauggcaucagauacauaaaaugcuacuggccugugacucaguuggagccagaguccaaaacgguggcccucauuuacagucauggugauuacucaacuucaaagagaauugcccacauuuaggguuuuccucuacaagucaucuguaaagcauuaugaaacagaaagaacaacaaaugcaauugcuaaauauuuuuuuuacaagaggugcaaaacaguaauuucuaacauuaaacugccauuuacaguagauuuuuguacaccugcagagacucaguaaugaugggggaaaugcccaaggcaaauggucuccaagaagauauuuacacaacgugaaaucaacuguaccguagauacccagggaaaauuaucuuacguuauuaugaaaucgaacaaauaugauauagaaucaucauacagaaaaccuguaggacuccauuccaagccuaagcaaaaaggaaucccucagcuccuucugcccacucauccgccaucuuccuguuacaaagaaugaaugucuagauuacuccugcccaccagcaaauaaagugcgcaguccauggcagaccauagaauaaugcaacaggaaaaucccccuuuuguauuaucauuuaaaaaauaaaguacaaacaacagaaauaaaacaaacauugaagagaauucggugauucucugcaucuugaaaaaaaagaggcaaagcacggggugccuugcuugacggguuacucaucuuaguacacguauccuucguuguaggggugaggguugcagcagcccccuucaggcauguaggucaugcucucaucaaagugagacagaggaacuguguccucuucguugaugugacguuccauguccgucuucagcagugggcgcugguuauccggaaaggccauagagaaaagggcuuccgggucacacacaaauuuguacacguaucuuucuccagccaccuuuugcaugauucccuucucauaauaauagcggagagaacgacuaaguuugucauaguucaucgccggccuguucuucugaaugccccaacgccgggccaccucuucgggcucaaucaguuuaaauuccaugccucguccaguccaggcaaugaaaugagaauuugaagggucauccagaagagcuaccaaaaacugccagagcuggagggauccucgccacugguacauggguccuucccgguacauuccaggcucuugcuuaauguccccaucgaacuucuccgggaccacacaggugucaucauagaacugccugggacccuucucaaacaugcagccuucuguucugcuuggaugagccaggaagccuucuugccucauauaaauggaguggcagcuaggcacuucugagucauaugcaaaaucucuggguuccuguuugaucaucaaaggaggggggaagcuuuggcuggcugcaccgccaaccauggugguauguucauagacugggucgugguacuccugcuuaaagccuuguggugggaaggggauguuuggcucagacaucuggcguugguacauaggacgcccuucccuuggcauugucggcaaaggaggaaaagaauuacaggguucagaaagcuggcggcgaaaucugugguccaugggguaggugcugucugguauggacugagaaggagggaggugagcugggaaggcccggucagguuucggaguaugagcuguguuuggagaugcaugguguaguggggacacuggagugcuggauggugucgggggauuggagggccucauucccacuuguggcuucugaucauaggcacugacauugcacaggcacuuuucuccauagcugaauuuaaagggcugcucuugacugcaagcagacccgaguucugaacaugggcugugggguucuuucuugauuuucagugggaggccaugaaaagccacuaaaaacagaacaaacauauaacuuucagccugauagucuggaacaaacugcucaucauugucagguaccugagcuucagcaagccauguuucuuguaacugacucagaucuugaaagaguucuucugaaucaugagccagaucucuguuaaugaauuuucuuuuccugacauuuguugguuucucgguacaguuucucccacgcugacuguuggugaccacguaaggcacuugcuggucauaaaauccauccauucugcuccucuucgcaaauauuagcucaguguuuuauauuuugagcauuuagcuggagauuuccucgggaucugu

SEQ ID NO: 7207 - RNA, 585 nt, Mus musculus
uguguacuuucggccgccacagccaucuuccaguaacucaccaaaaugacgaacacaaagggaaagaggagaggcacccgguacauguucucuaggccuuuuaggaaacauggccuuguuccuuuggccacauacaugcgaaucuacaagaagggugauauuguagacaucaagggaaugggcacuguucaaaaagaaaugccccauaaguacuaccacagcaaaaccggaagagucuacaaugucacccagcaugccgugggcaucauuguuaacaagcagguuaagggcaaaauucuggccaagaggaucaauguguggauugagcacaucaagcacucaaagagcagagacagcuuccugaagugggugaaggagaacaaccagaagaaaaaggaagccaaagagaagggcaccugggugcagcugaagcgccagccugcgccacccagagaagcacacuuugugaggacuaacggaaaagagccugagcuguuggaguccauuccauacaaauucauggccuaauguacacaaagaaauaaaauaccagcaccaggaaaaaaaaaucaauguguaaaaaau

SEQ ID NO: 7208 - RNA, 108980 nt, Mus musculus
caugauucauaccagggagaagcggguuagaaaggaagcagagaaagguggaaaugaugaggaugaucgcuccagcgccgagggcaguuuggguuucacauuugucacucuauagaaucacuugucugcucucauucucaacgugcccugcuuuggaagacagaccaucguggucuuagcacuggugggaccgcgguguguuaccaguuuauuuuaaaguugccauuaacucuagcuaacacuccggacucugccauguaacgugcaaagcacucgcacucaacuagcuaguccacuuagcacugccgauccaucuaucgauugaucuauugucaaccauguagucgguauccgaguccccacuccaaagggaacacucaaauuuauguuggcagcuauugaggaauuuggccccaaccacccaauagccauggcucugauucaguccuguuucagaagccacacagacaaucccuaggcacugauuguugucaccucacauuaaaaauauucauagggaucugaaauuuagacuugaagcuuacaaaugaauagaauagaagaaaaaggauuaacaaguguaaugguuccuccccacccccauccacacauucucuuucccaguuucaguuaucugucguagucaaaugugaucugaaaauacugaagggauuucuagaaguggccaacucuuaccuuuucagcugugugcuggucugcuuuguccugaugggcauauaacgcacucuuuugccccguguauucccauaguaugcaguauccacccauuagccacauuagugauuccacugauuugucauggguucucggcgccuguguucaaagaaagccuuacugauaggccaucacugucacgucauuuaugucacuuugucucaucauuucagcuguauguguuggguguucuguuuuguuuuguuuuguuuuuuacauaggguccuauuacaucacccugaguggccuacauccugcuuuugccuugugagucugggguuaugggcguguccugccacacuaggcuaucuugcaggaauuuuaccauccuccauuaucacaaacguaacaagacaauuagaaagacuucauucacauagcuuaaaaaaaaauugcacucuauuugugugccucugcauguguguguguguguacaaaggcccgaggacaacuuuuuuuuaaauuagauauuuucuuuauuuacauuucaaauguuauccccucuccuaguuuccccucuggaaauccucuaucccuuccccccucccccugcuuaccaacccacccacugcagcuuccuggcccuggcauuccccuacacuggggcauaaagccuucacaggaccaagggccucuccucccauugauaauugacuaggccauccucugcuacauaugcagcuggagccaugagucccaccauguguacucuuugguuggugguuuugucccugggagcucuggggguacugguuaguucauauuguuguuccuccuauggggcugcaaaccccuucagguccuuggguccuuucucuagcuccuucauuggggauccugugcucuguccaaugguaagcugaaagcauccaccucuguauugucaggcacuaguagagccucucagaagacagcuauaacaggcuucugccagcaagcacuuguuggcaucuacaauagugucuggguuuggugacuguauaugugauggauccccagguagggcagucucuggaugguuuuacauucagucucugcuguaugcuuugucccuguaacuccuuccauggguauuuuucccccuucuaagaaggaucaaaguauccacaccaaaguguuugugaauuggguauucugagcuucugggcuaauauccacuuaucaccgagugcaugccauguguguucuuuucugauugcguuaccucacucaggaugauauccuccagguccauccaucugccuaggaauuucauaaauucauuguuuuuaauagcugaguaguacuccauuguguaaauguaccacauuuucggcauccauuccucuguugagggacaucuggguucuuuccagcuuuuggcuguuauaaaugaggcugcuaugaacauaguggagcgugugccgagaacagcuuuugagagcuguuucacucaugagucccggggguuggaucggagccaacaaucaggcuuggggacaggcacuuuucccucagagccaucccacaggaccuuacaugguuuucauuguuguuuugucacgauuaacuucuugccccugaucuucuaaugcccuuaaucuauaaagcagacuuucucaucaguaugaauggacaugaaaagcaauacauucaaggcuggugcuguauggugcguguuuuaggcauugcuaagauuuugggauuuugguuuucugugcaugggaggugacugucgcacugguggggaaacuccacaaacuuuuauggaaaccuuuuuacuaauagucuuccccuguaauucauaaaauauuaacaaaucuuuuuuuuuuguuaugggagggggaauucuauuuccaaaguauuauccugguauugguuccugcagguccugagcugccccccugaccuccugcccuugcucuaucaaggagccaagagggaagugaaaaaaggaaacuuaaaucucuauuuaaaaaaaaaaaugucaugagccuagacuuauuuugaccuagacuuguuuuuaaccuacccccuugguagucagaagauucguucuccuaaacucgugauacacacacacacacacacacacacacacacacacucacacagguauguaauacagaaagcuuuggcuuuagauggcuaauucugugucaaaggcugagaaaagcagugcaaggcuucuccuugcacucugcccagugucgcuucuccagugcuugugcauuauaaaugcuggcugauguggcaccauggcagaaggucuuuuaacaaaucaagcaaauguacagauaccagugccagugcccucucucuggcccauuuuucuggugggcuguauaagcauucuuuggaaugcuagagaccucgcaaaugguauuuuaaugaaguggcuucucuccacuaguguucuccuccucagcccugggugcgaagggggaucacaaagaaugucucccuguguuucucugagagugaaauuggggaagcugaacugcuaucaacaggucacccuugaaggugguccuagaggccaguuugccacuacagagccacagcaaggcacccuugcuaagggugaaguuuuaguucucuguuuaaucauaaaugaaaagcucagccagcccuucuuuaguucaagguccugugagaggauuuucaaugaaaacuaagcuaaagcacagaacaagagcguuuaugagaaagcccagauagaagacuuggcuguuucuguguguucuguucauguuagaacuaaacagugcugaguaacagagacuggucauuugucauuacugaauaccugaucauaaacggagcagccauuucacagauacagaacgucugggaaacacuucauaaggguuuauuaaagaaacauuuguccaaauaggcaaaguggaucccgacuucaaacacaugaacuaguagaacauuuuccuuaaaauuaugagcaauguuauuauagcucugccucagcuguacaggacauaguaaaacaugcaccauucuuggggcucauucuccagcauaaucagaacuucgguaacagucgaauggggaccgucugucgccuguauuccuguucucuguacugucuaaggagugaggcucauucucucuucacucagcaucgacauaugcuaucuucguuuucuccuuccacuaaaagcugcuuuagagaucaaucugaugaauuagguauaaaugacuacuguuaaggcuuaaaauauuaccuuuccugcgauuauggcuuugcucuagagaaauaaaccccgagggaauaagugcgacugacagaauuucaggugaguuauggcgacuuuuagucagagugguagucacaauaguccccagcaggaauuuacauuaaaaaaggcuaggaccagggcaaguuuuaaccuagaguuggggguuuccuguuauuuaggcugggguuagguuuguuucaaucuauccuacuaucccuuuccucacauggugcuggagaucaaacccagggcaugguuucuacuacuaaacuacauaggcaguuacauuuaguagggucuaaagcuacaggaugcaguaguacuggaaucccaggagucaacagggaucucacuggauggaggcugcuucauccaggacacuuuaggauagagaccuuuugaucauagccuugccauugagcucugaucaaacuccaaacauuuuccaaagaugguguaaaacaaaacguucucauguccguugaaacagucuguacaaauacaccguuuuuaaaauauacaauggcuaagaucccuauuaguauaaaauagauucccaagaugaaaugaccaguucugccauucccggggcugucaucgaauguuuuucagagaccgcucugaaacccugguaccacuguccucuacgggcuaagaaucuaacgcucguguuaguuaauucuagcaguuuuggguguaguuaaaaugcuuccacuucaauucaaaaugauuugaauaucuuuggaauuauuccaaguauuugucucuggcguagaacucaacuuuaguaaauaauucuuugguggacuucgugaacucuuucccuuggaugcaagccaaaacucaucuguaaggcauauagcuuuuuauucaaaguuggugaugaauaauuaucucugggcuacagacggaagaacugaaccaguggcuugaaggacccagaggcuaauuaccaucccugugcauaguuaauacagcagaguggggguggacgaugguuugcccagaaucuauuccauucccucggguaaaacaaggauguucugucugcuaacauacuuaaagcaguaacuguaaaaacggcaauguuaugguugaagcuuucuaagccauauguguugacagaaugcuuaagucucucucugcaauaaacgcaaacccugccaggcagaacuaccagggccagcgcgacugacugaacgacugcacgcccgaaagcguaggggcuggaaggcuucgcggcgcucggagugcauccaauguuuccucuaacaaaggcaccgucuugaggcaauuucgcgggccacgcuccccgccucccagcaccagcuuugucuccucggaggggcccccggccgcgucgccgcuugcagcaagcucggaggccggcccggcgugggaagaagcugcacggagcagcggcggugguuuccugcaaccugagcgugccauuagaggcgucggagugcugcagcugaaagagauaccugcugccuggaaaucggggcugcacucgaacaaccucuuugcaccaauuacggucguacaaagaaacucgaucggcccgggcggcggaggccucgcggggucguggggggcggaggggagcccggcggcccgggccucgggaggguggguggcgggccucccgccgcgcgccuccccgccggcccgcggcccccggcccgcgccccccgccgccgacgucgaccgcguagaccccgugcgcgcugacuggcucgcgccggccuucgccuggcugugggcgguuggggcgcccccgcgggagcccgccccgcccccgucgccgccgccgccgccgcgcgcagccucggcccccuuagccgccggggcgguggcgcuguugccgccgaggccugugaagcagaaacucccuccaccccggcccggcccggguccgccuccuccuuucucuccuccgccucgccuccccucuccgucucccgcucgagagugaagguggcgcggcggcgcgcgacgcagccugggcccccggcgcgggcccgcgagcucccgaggagaccgcgccgccgcggccgcgaccgcagggaaagaggacggaggagagcgcagggacggcggcgggaagcccggaggguucgagcgcgaguggcagagacagggccggccggucggaccgcccgacggacggucgccuuccagccugcgcggccggucggcuccggcucggagcggcgggggccgggcgggcgcagggcgcggccggcgcacucgagacaauacccgcgcggcgcggcugugggggcggaggccuagugcggcccaggccggccgagcuccgcguccucgccccccgugggccgcgcgagguuccgcggcucggggcgggcgccguccccucccccucggcggcgcggcgcgccaccccgggguuccggguucccgggccccgagcuggagccugcuuuucacccaggcaggaagugaguuucgcacggcaauuccgggcggugucacgagugaaaaguuuuuuccuucggcggagaagcgagccggggcugggaaacuccugacacaagucgcgagcaggaagccagcccgcaccccagcccccaccggagcagccgcacugcugcggccggccgggcggcagcuccacauccgccucguccucacgggagccucggcggggcccggagccacugaggaagggcagggaaccaugucaagccgagccucgggacggcugcccugagacacccugagagguaauuucuuuucuuucuuuuuuuuucuuucuuuuacgggaagcgucgagccaaguucgugggccggaagcgacgguacuuuaguccaccucgcucugcccgacucgucucccuucuuucucccgugccuuggcauuuuagccgccgaauaguagaacugauuucucccccucgccccgucuaccgucuggauuccuuucuuuuuaagacggggauuguaagaaugcggugggacgaaaaguuuuucagccaucggaagaaagaguuccuuuguugagcaggagggccagaaguuuuagugcuccgggacguauacauuguauaucaaguugcugaggcuggcaacuuuuguuuccgaagaaaguugagucuucuggcugcggggagagauugauucccucucccugagauggcugccacauuuguuuauguuggugccgauuguuuugguuuucgcguuaauccuacgcggaggucguuucgguagaacacgucugguucuuuggacuuuagaaaccggcugccugccauucccgauugcuuuuucuggacagcgaaggcgccgcuuguaguaguaguaagucgugcguucuuuucagucaguagcuuaacagugcuuguuugguuacuugauugaagaguagcugcuagauuuuucuugaaacuggcguucuaggaaacagaaugucguaaagauuagggaugaggacggagaaggauauggcuacaaaaacaaaacaaaacgccaaacaccugcaaguaguugauuggucaggacuuguaugcaguuccgaauaggaacaacacuggaagggaagcgaaauaaaacccuuaaaauuuucagaagagucacacugugcggaaaaagcggcgcuguuuugcaguuguauguguguuggcccaucuguuuuuguuugcuucugccuaauaagugauagguacggacuguucgggcaggaauucgugaagcauggcagacauuccaccagucagaccuagggacgcuucugaaccgauggaguuuucuuuauggguagaacuaauuuugguugcaguaaacccugcugucuuuucccuuaguaguguuucaauugugugugucuuuuaaaguuuaauuugcucccccugccuccaaguacuuuugugguaagggaagugacagguaauacuguauuuuaaauaaauauuaacuauagguagauguagcuuaagcuuaaauugguguuuaaucagauauuaccagaauaauuaccagaaaccugaggaaaaagaguugacuuccuuuaguucaaaagaagaaagguagguuuuaaagaucaggaucaagugagcucacaacuuguucuuggcuguuuggcuuucauuaaguacauuucaaaaggagaaucguuccaguauuuauguuguuguguuauuagggccuggucucuagaguuuuuguuuucauuuuuauuuuauuggugagauuugugagccaucaagcuauuccuguuaaaagucagauugcuuuaugaaggaguuuaaagugcaugacugguggacuuuaugauuuggggacguauaauuaggcagcaaaagagguuaaucuugagcauaugaaagagggaaacaaaauaaaugacauugaacuucgcuucccuuuuauggcuucuacuuggcuccagccucaaagccugaauagagcaagucuuuuagagaaugaacacuugcaaagauguuuuugugucauuccguuuuguauaaaguauugucacuugaaaauaccuauuuaacacccccaccccuuaaggaaguagguuauuuuugaaagaguaguguguuuagauuuugacauguuaaaaaugagauguuccaccuuugugaaccuuugauuccauuuuuccucaacaaggcauuuauuuugcaguuaaaauuggguaaauuuagcaucaaauuagcuuaaugaauuuuagguuuuauacuauucucaagccaaauauuuuuggagacuuguuuaaaaugaagcaacggauugaaaagagauuucuucuuacuuacaagacagugcuuugaagucuuucugaauggccuuaaaaucuauauauuuucagcauugugugagggaaaauugugagauaaaauauuuccagaguguuugccugcauugcauagagaggcuugguaaugaagacaaccacaagcuuucaaagcuucuccugguucaguauuauggugauuccuugccauuuaagaacaagcugguuauuguugaugucauguauaaaaugcuucaagagauuaaagaaugcaaacaguuuuuauugugcuguuuuuaaccaaguaauaacuauagggauauuuuacauuuauuauugguaauaaacuucugaaauuugguuguuuuagacauuuuauauauuuuuuuauuuuugacucuucauuuaaaaaaugcuuuguaguaaacaccaucugccaaggaccauacuuuaaauccugagaaaauuagguacuuauuugggcauuuauuugaaauaauugcuuaucaauaauauuauuuuagaguuuaaguuccuuguuauuauaggaaaagaguaggucaauauuuacaaacuauuugggauuauacagaauuuagugaguuggauagcaaaugcauuucuuaauaauuguugauauuuagaguuucuuuaaauacaccuacuuuguugcuuccauuuuaaucuugacucugucuuauucauccauuuuuuuuuucuguuuuguuuguuguugaacaaggacccacaacacugaauggcuuucucacuuccuuucuugacagcaguguuacacuuucuuaacuguucauaauagauuaauucuugaaugcacauuauuuuuguuggaguacaaaauguauauauguauucuguucugagcuaccuacauuugaauuaggggaauuucauuuccccuucacacguauucucuccuuccucagcacuggucucaccuacucucauuguacucccaguuuucagguuuacaguuuaucuuucuccucucuuggguuuccuaauuuuaaagccugccauuacucaacucucucuucuaauuccuuuaauuuuuuuauuuuucuuuuauuaauguacugguuuauccuauuuuuccauguucaucaaaaauuuaguuauauuuugcuuugccucuuuuuuccaaaguuccuuaggccaugcauuucuccucaaaguguuugaaauaugagacaaaagaaucgauuugaucagucuguuuaauucugauauguuugcauuccagcucaguguccauggcauguucauguuuauuaguguaccacuuuguuuuaugcugugucauugauuuucuuuuccugccucagugucucugcagucagacuuuuccaguugugugcauucgucugucucuauccauaauugcauugcuacucuaccacauuauuuuugucacuuccaguuuuguuccacugcauaaaguccuugacaugcauuguaaaugauagugugaaagagaacagaaaacaucugaaaguaaacagugaaauagcacccuacucaaugugagcuguaccaucuaugaguuuaauuguauagcauguuuuaagaaacccuaggaaacaacaaaaaugcauuguguaaucaaaauaagguguaauaaugccugugaaguuuauucauggggacacacauauuccggucuuugugcauagugagcuauucuaggcuucuuggugugccagaaggauugagaaaggcacauugacagcaccaugaaauuaugacugaugaguauuacagcgagaggaugggaaaauggaaagaagaucgaagaacuuagaaaguacagauguucugaacuuaugaugggacggcauugcaugcugacaaacugaucacagcuggaacuaaucaagaauguacucauuuuagcacaccuaccaagugugauggcuuagguaggacuaccuuacccaugcucagaacacuuccuaauccugcaaaaucaucucacacaaagcuuaguuuauagcagguguucaguaucuccuguauugagugccuguaucaaaacaacuuuggcaacccaguuuacuauaggguauuauugauucuccugauacuuuuuuuuuuucuucugagaaauaccauacuuuggauuacugguugaagaagugaucaaaauuagcugggcacugguggcacacgccuuuaaucccagcacuugggaggcagaggcaggcagaugucagaguccagccuggucuacagagugaguuccaggacagccagggcuacacagagaaacccugucucgaaaaaccaaaaaauuaaaaaacaaacaaaaaaaaaaacaacgaagugaucacaguuuuaaauagcuucugcugaguguguauuaguuuuaugcauuguaaagcgaaacggcugugaauugagccuugucaucucagaccagcuguagucugaacugcuugcuuugggacugacuuuacauucauuugcagguuggcugagucucucuguuguaauuaaugcaugauugugagaaauaguagcaguuuuaagauuauuugguauuuugaucuuagaauucccaguacuucuacaaauugagauccucugcaaguuuggguuugugucagcuauagauuacuaaucuuguuagaaauuaaaauuuaaaaaccauugccugcuaacauuguccuagcaaaaaaaaaaauuauuuucuaaaacaaauacaguugugacauguggauuguuucaauucccgccauggauauuuaggucccuuauauuguauauauucuaauuguauaacucaaagcccauuuacuagaaauacuuuaagaugagguuagaugacuuguaauacuaaauccagcguaaauacuaaguaaaugaugcauuguuuaagaaauaacgacaagaaagaaaagucuguauguauucaauacagaugcaauuucccucugaguauuuucaccgugguugaacuuagggauuuggagaacugacuauaauaaaggaaaaauaggauggcuuugcauuuuugcaaguguuuuauguugggcuuaguguaaagcaucucaaaucucauaucagauuuuuccaucuguugcaauauguugcuuugauugaaauauaugaagaaaaucagcccauccaguuacauuuccaggaaagggaagaauguuuuccaacacuuguagauauuuaugggguauucugaguuauggcagacucuuaagacuuacuauuccagcucacuccuuguuuuucagcucauaauaauuuguuuuuguuuuuuuuaaauacaguuccuaagaacuuuuuuuuuccaaagagguugguugcuauuguucagcaguauuuuggucuacauauaaccuagaaucuagaaucucugaguuauuaaauuuuuuauuauuuuuuuuccauuuucuacuugaaauuugaucuugugcuugguagaucuguugugguuuugggcuugcuucagauacuauguuucuuuuuuuuucuaguggauaaaguuuuuauuaauggccuacccuguaccuuauugaucuaucugucuucccagcacaugaauacuugcuguucuugccuugguacuuguuagaggaggagggcuguauuaguguguucagcuucaggacauguggaucgcuuggcuucuugguacagguguuuccuguucuucaggagaugccuuccucuguccagcauccugcuggcuugccagcuuucccacaggacaaauagcuacaucggagcuucagcacauccuacuauaauuuugucuacaaucugacugacugcucagaugcaauucuccuaauccuugcuuaagaaacuucguaucuuuggagauacauuucaugcuuguuuucagcaccugcccuaguggaguggaugccuguaaccacagauaguaccaagcccuguaauuguaugccuuuuccgucuuaacuaagcacuugccacauagugugguuguaacuuuuuuuuuauuuuauuuuuuuuuagugguaaauacuggcuuugagggccucuacugccaggcagguagucuacuaggugacuagccccagcuccaguggcuguaaccuuugcuguuuagggugggauaacaaaacuacuguaaauaucuucacaauuucauagauagaaggaacauuccuuguugcuaacuuggagacaggguguucuauagccuaggcuaacugaauucacugugguagcugagguuggcccugaacuucugauuccucugcuucugcuuucacagugcuugggguuacagguguguacugcuaaccacuacccuggccauaagauggauuuuuuauuuuauuuuauuuuauuuuuucugagacaggguuucucuguguagcccuggcuguccuggaacucacucuguagaccaggcuggccucgaacucagaaauccgccugccucugccucccgagugcugggauuaaaggugugagccaccacugccuggcauaagauggauucuuauuguggaguuuaguauauuuauuaccaagaacuuguaccuuuuuuucugaaaaggaaauguguguguguguguguaugugugugugucuuacuagccuauuuacauuuugagcccauuaaauaaaauagcacugaaauaccucugccauguauuugaugcccuagauggcuaugacgugacugauagguaggguguguacacaguguggaugcacugcacaaagggauagugugccauuuuacuugagaauuguucauuucuggaacugccuaucaaauaguuuuagacuauggcugacuuuaggugacugacuguaggcugugggacuggauaaccaggccuguuugauuuuauuugauguccucuucccuccccaauccuugguagucugauuacucuguagauacauacucuucccagguuuuuaaaauggcugcagacuuuuugaacaauuuucucuuguuugagguuuuucuugagugugugugagagacugaccuaaaacucacuugguagcaaacaugacuugaucuuccggucuccaucuccugagugcuguccuuacaggcacacgucauuacuuguucccaggacugguuuuauaugguacugggaaucaaauccagaguuuugaggaagcucaacaauagucuuugccugaauuauaucccuagucuuugucuuaaguuuugaggcaagacauacaaauugaaucuauuuguucuuuaaccuguuuggcaauaaauagcccaucugaugccuuaucacucugaaauacucccauguuucuuucuuauaaagaaggcgcuuugauaaucgcaucaagacugucagaggucgaauuuaacacuaccugcuaaacccuguuuguugucuuuauguguuacagcggcuugucauucugcuccugcauuuuggaacagugucugccuuucaaggcacugauauguuugaaaacugcaagcuucauuguuuuguugacuauuccaucauuuucagcgucuuauguuuuugcauuaauuucuuacagauuucauaauuagaguuuuaggauuaacucucagcaucuuuaucaggcucucuuguguucuuauggcaucguaccagguaauuguagcuuguccacuacucacacuauuuaagugacaaagguugugacugccaaacuucuuucaaguuuuuguuuguuuguuuuggcguuuugagauggagauucucuguguuaacaccccuggcuguccuggaacucacuuuguagaccagguuggccuugaauuuagagguucuccugccucuucauuccaagugcugggaauaaaggcaugugccaccacugccuacuuuuuucaaaguauuuuuuuuuucuauuuguaauuaguauuuuaaagauagguguuuugaaacauguaaaaauuuuuccucauauuuuaaauuuacuuauauuuauuuagagucaaagcuuccuauuaauaguguuaaaauucagucucauuaauuuuuaugcucauuauuuugugcagggcuggugauccagcaugguaggcuaguucacucccacagagcugugcuccuagcccucuuguuucuguuuagcuagugagaacuucuuccacuuggcuuuuuaaaauauuaauuuuagaauguaacuaugcuuuuuaaaugcuccaaacaaaucugcuacuaucuuguuauuauuguaaagaucuaugugugugugggagugcuuacuugugcaggugcagagaccagaagguauccuuguuugguauccuacucucugaaccggaagcucuuguuuguuuguuugugucuuucuuucuuucuuucuuucuuucuuucuuucuuuuuuuuuuuuuuuuuuuuuuuuucuaggcuggaauccagcaagcuucaguaauccuauuugcaccugcuaggacgggcuuacagguuucaggcuuguguaggauaccugacuuguuauguggguacugggaucugaacuccagcccucaugauuuguguagcaaggacuuuuaauuguugaaacaucucucuagccccuccuugguuauuuuaagaggaaaaugguaguucugaagcagugccuggguacuuguauuuacuucucuagggguacuacccuaggcuuuccaaggagucuuuaugaacacauauuuguauuuauaucuauggacaaaacaaaaauauauaaaauuaauauuauauuaguaauauuaguaacacuaauucuaaucgacacaaacagggcuuuaaguuauuuaaaaauuuuuguuuucguuuuucgagaauagcaccuuacuguauagcccuggcuguccuggaaccugcucuguugaccaggcuggccucgaacucagagauccaucggucucugccucuugugcugggauuaaaggugugcaccaacacugccuggccuuuaaauuuauuuuuauuuuuuauuauauuuuuugcuuuacugggaauaggacuugggucucuaguauuaacauguaucuuuagucuugguuuuaguugcccaggcuagucuugaacucacucuguagcucagucuugaacauucacuauuccugcuucagcuuucucaaagaccccucacccuccagcagcuggaauuacagacuucuguauccuuagguccugaucauuuuuguuucuuuaucuguuggguuuuguccaguauuuguaacucaucucugacaaugaaagguaaccccccccuugguuuuguguguguguguguguguguguguguguguguguguguguguguguguaauuaaugggagcaugugaauguguuggggaagccagagaugggaucucucacugaacuggaaacucaccuucuuggcuaggcuggcugaagauaugaacaggauugcagagcaaguacucucacucauggagccucucccuagcuccuguucacuguguuggaauucuguuguuuaugucaugucaaaguucagagcuuuacaucuaccugauaaggauacccuuggcuuucaaaccauaggucaguuuuaaaccuuggaguagagguuuugcacugggacuuuugugagaaaccuguaaucuaaaaaugaauucccccucaccguagaauuaauagguuggccuuuacuauccuuggagauuuuggacauuauuuaagggaccuaccaagauaaucuuacaugauuagaucuacuuuuaaacuugaaagaaaggccaagcaaguuucuugaaaguauuuuauggguuagguuuccugugaucuuuggggucuccaugaaguguaguuuauuguuuugguacugugugcuaggagggguucauagauagcagauacuguuugauaugucuuagguaagagaaagccauuucuaaaccaaagaccauuguagucaccuuuuuaccccccaaggaaaagagcaagcaagcaaacuuuguucuuuaucuuuacguauaaauuuuacuauuguuauuuugugugggggggcgagggggugagaggguaugugucugagagagacagagauacauagagacagagagggaaggggagagagagagagagagagagaauaugugcacuguaugugcaugagugugucaaacugccugccugccugccugccugccugugucugucugucagcauguaaguaccacagugagcauaugaaggucagaggacaacuuaugggugucgauuccuuucauuuacuauguggcucugguuuugaagcaagugcuaccugccaaaccaccucacccaucccuuaguagucaucuguagucauaucuuuaaucauucuuaucuuaguuauugaaauuguuucuaguauuaucaguuuugucuuucuugcuugcucuuuuuuuuuuuuuuuuuuccaguccuggggauugaacccagggcccuuguauguuagacaagcauuuauuugauuccugaaaugaagggaaaugauacacuuucaugcuuauuauucacagaaacacagugaagacuuuaaaagauucauaauagagaaauggggcuauaggucagugcuagauugcuugcuuagaauguaagaaacguuggguuuaugucccuguauaaauaaaaaaaccuucaaauagaauuuuaguugauaugcuuuuacuuucaagguauauucuuuaaaaauuuaguaauaaucuuucuauuuuugacucauaaauuaaacuauaucuuaauauuuuaugauuuaauuuaauacacaugcuaacaaaacaguuguuaucuuuuuguuuguuuguuuucgagacaggguuucucuguguagcccuggcuguccuggaacucacucuguagaccaggcuggccuugaacucagaaauccaccugccucugccccccccagugcugggacuaaaggugugcgcuaccaccacccagcugaaucuuacucucuuaaaaacaaaacaaaacaaaaccacauuaauugucuauaaacauuuauuucaacucuuuaguaauuuaguaaaucaucaaaggacaguuauuucaguccuuuauuugaucuuuauauaaaugccacuucuuaguguaguuuacguaguauuucacaaaggaccuugguuuauuaguuacacuuuagaauuaauuucugucaauuacauguuuucuugaccaugauguuaacuuucuccuaauguauuucuuagguaauuuguauacagaaggcauguuucuuaggaugucauauuuuccugucucaucauuacugacuuggaacuaguuuagguugaauaagccuuuuccuuucuccuuugauuaacaaagaaacugugagugcagugccaugcuggaggacuuuuaguuucucagugacauugagugagauuagaaauauaaauccagcuuuuccaaaucugcugcuuucacucuuacauuaguguuuuuuaaaaguauguucgacauaucugauuucuuuagcauagugcuaaucucuaaagauuuaaauaagcauuagagaaaaguguuuggguucacauaagucaggaaguuauggacaaauaaaucuuuuuuuuuuccuuuuuggugaaugccaguuuaucauauggcauuuauuuauuuauuuauuuagguuuuucgagacaggguuucucuguauagcccuggcuguccuggaacucacuuuguagaccaggcuggccuugaacucaagagauccaccugccucugccucccgagugcugggauuaaaggcgugcgccaccacgcccggcuuuaaaauuuugaaauaacuugaauacaguucaauuuacaagaaauauuaguauuaauauuugagccaguaaauuccauagagcaguuuaucuuaaagcaguauucaguucugcaacaugguuucagauuuuuguuuuucuaaguauaccuaagcucuuuguguaguaucaggcuugcaaaaaaaaaaaguugcuauuaguuuaaguaccaugcuaucuuuuuauuuccuauguaccagcuuguauucaugugacacauuccuugcaauuaagcuaauacugauacauuguuacuaaccaaagccacaucuuugcucuuuauguuguuccguggguucugacaaauguguaaugacuuugaucuaucauuauugcuaaaaguaucaauaacagaugcagugauguguauuaaaugaaaggaauggcagcauugauauuagagauuggagugaggaaugauaauacucuuguuauaagacaguuaauuuaucagagauccaguugaauuuaacugacucuuacauguaaaaguuacuuguaguuuauauuuauuuuuuauuuuauuuuauuuauuuauuuugguuuuucgagacaggguuucucugaguagcccuggcuguccuggaacucacucuguagaccaggcuggccucaaacucagaaauccgcccaccucugccucccaagugcuggggccacuacugccuggcuuuuuuuuuuuuuuuuuuuaaacuuguaguuuuuaaaaauugucuuauuuauuuacauucaaaauguugcucccucuuccugguucccccuccaggaguucuucaccccucccugucccccacauuacccuucccccuguaguuuuggaagaaagaaaguaauaaacauuuggcaauuuguaucuggaaaauugaaauuuuguuccuuuggucuguugucaguuuuuaugucccuaccauacuguuguuauuacuguugcuuucauauaauuugaaaucuggaaugguaaucuguccaacaguagucauuuugcucaggccgcuuuggcuaucuagggucuaauuucauaugaauuucagauagucuuuuguguauuucugugaagaaugagauagagauauugauugggauuguauugaaugugcaaguagcuuuugguagaauggaagauaagcuggccuuaccaggcagggccuggaguuuagauguguguggggaaggaugagguuacggugguggcuguguucucuguuuauaaaaaugcuuuuuuguuucagauuuugaauuaaguuuuuuauuuuguaauacuuauauauucacauagaguuuuucagugaguuucuguguacuuuuuauccaguuuaccuuagcaauauuguguauuaguguauugaagaacuacaguugccaguuucaucucagcauuuagguuuuuuuuuuuuuuuacuaagguauuuucaucauuuacauuuccaaugcuaucccaaaaguaccccauauccucccucccacuccccuacccacccacucccccuuuuuggcgcugguguuccccuguacuggggcauauaaaguuugcaaguccaaugggccucucuuuccagugauggccgacuaggccaucuuuugauacauaugcagcuagagucaagagcucugggguacugguuaguucguaauguuguuccaccuauaggguugcagaucccuuuagcuccuuggguacuuucucuagcuccuccauugggggcccugugauccauccaauagcugacugugagcauccacuucuguguuugcuaggccccggcauagucucacaagagacagcuauaucuggguccuuucagcaaaaucuugcuaguauaugacaugaugucagcguuuggaagcugauuaugggauggaacccuggauauggcaggcucuagaugguccauccuuuugacacagcuuuaaacuuugucucuguaacuccuuccauggguguuuuguucccaauucuaaggaggggcaaaguguccacacuuugaucuucuuucuucuugaguuucaugcguuuagcaaauuguaucuuauaucuuggguauccuaaguuucugggcuaauauccacuuaucagugaguacauauugugugaguucuuuugugauuggguuaccucagucaggaugauacccuccagguccauccaucugccuaggaauuucauaaauucauuauuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguuggaacaucuucuggauauaugcccagaagagguauugcaggauccuccgguaguacuauauccaguuuucugaggaaccgccagacugauuuccagacaagcuugcaaucccaccaacaauggaggaguuuuccucuuucuccacauccuugccagcaucuacugucaccugaauuuuugaucuuagccauucugacuggugugagguggaaucucaggguuguuuugauuugcauuucucugauuauuaaggaugcugagcauuuuuucaggugcuucucagccauucgguauuccucaggugagaauucuuuguuuagcucugagccccauuuuuuaauggggcuauuugauuuucuggaguccaccuucuugaguucuuuauauauauuggauauuaguccccuaucugauuuaggauagguaaagauccuuucccaaucuuuugguggccuuuuugucuuauugacagugucuuuugcuuugcagaagcuuugcaauuucaugaggucccauuugucaauucucgaucuuacaguacaagccauugcuguucuauucaggaauuuuuccccugugcccacaucuucgaggguuuucccuacuuucuccucaguaaguuucagugucucugguuuuauguggaguuccuuaauccacuuagauuugaccuuaguacauggagauaggaauggaucaauccgcauucuucuacaugauaaccgccaguugugucagcaccauuuguugaagaugcugucuuuuuuccacuggaugguuuuagcucccuugucaaagaucaagugaccauagguguguggguucauuucugggucuucaauucuauuccauuggucuacuugucugucacuauaccaguaccaugcaguuuuuaucacaauugcucuguagcacagcuuuaggucaggcauggugauuccaccagaaguucuuuuauccuugagaagaguuuuugcuaugcuagguuuuuuguuauaccagaugaauuugcugauugcccuuucuaauucguugaagaauugaauuggaauuuugauggggauugcauugaaucuguagauugcuuuuggcaagauagccauuuuuacuauauuaccugccaauccaugagcaugggagaucuuuccaucuucugagaucuucuauaauuucuuucuucagagacaugaaguucuuaucauacagaucuuucacuuccuuaguuagagucacgccaagguauuuuauauuauuugugacuauugagaaggguguuguuucccuaauuuuuuucucagccuguuuauucuuuguguagagaaaggccauugacuuguuugaguuaauuuuauauccagcuacuucauugaagcuguuuaucaggcuuaggaguucuccgguggaauuuuuagggucacuuauauauacuaacauaucaucugcaaaaagugauauuuugacuucaucuuuuccaauuuguauccccuugaucuccuuuuguugucgaauuguucuggcuaggacuucaaguacuauguugaauagguagggagaaagugggcagccuugccuagucccugauuuuagugggauugcuucaagcuucucaccauuuacuuugauguuggcuauugguuugcuguagauugcuuuuaucauguuuagguaugggccuugaauuccugaucuuuccaagacuuuuaucaugaauggauguuggauuuugucaaaugcuuuuucugcaucuaacgagaugaucauguguuuuuugucuuugaguuuguuuauauacuggauuacauugauggauuuccguauauugaaccaucccugcaucccugggaugaaaccuacuuggucaggauggaugauuguuuugauguggucuuggauucgguuagcaagaacuuuauugaggauuuuugcaucgauauucauaagggaaauuggucugaaguucucuaucuuuguugggucuuuuugugguuuagguaucagaguaauuguggcuucauagaaugaguuggguagaguaccuucuacuucuauuuuguggaauaauuugugaagaaccgggauuagaucuucuuugaaggucugauagaacucugcacuaaacccaucugguccugggcuuuuuuugguugggagacuauuaaugacugcuucuauuucuuuaggggauauaggacuguuuagaucauuaaccugaucuugauuuaacuuugguaccugguaucugucuagaaacuuguccauuucauccagguucuccaguuugguugaguauagccuuuuguagaaggaucugaugguguuuuggauuucuucaggaucuguuguuaugucucccuuuucauuucugaauuuguuaauuagaaugcuuucccugugccuucuagugagucuggcuaaggguuugucuaucuuguugauuuucucaaagaaccagcuccucguuugguugauucuuugauuagaucuucuuguuuccacuugguugauuucgccccugaguuugauuauuuccugcccucuacuccucuugggugcauuugcuuccuuuuguucuugagcuuuuagguguugucaagcugcuaaugugugcucucucuaguuucuuuuuggaggcacucagagcuaugaguuuuccucuuagaaaugcuuucauugugucccauaaguuuggguauguuguggcuucauuuucauuaaacuccaaaaaaguccuuaauuucuuucuuuauuccuuccuugaccaagguaucauugaggagaguguuguucaguuuccacaugaauguuggcuuucuauuauuuauuuuguuacugaaggucagccuuaguccauggugaucugauaggaugcauuggacgauuucaauauuuuuguaucuguugaggcuuguuuuauguccaauuauguguucaauuuuggagaagguaccaugaggcacugagaagguauauccuuuuguuuuaggauaaaauguucuguagauaucuguuauaucuauuuguuucauaacuucuguuaguuucacugugucccuguuuaguuucuguuuccaugaucuguccauuggugaaagugguguguugaagucccccacuauuauugugugaggugcaaugugugcuuuaagcuuuacuaacguuucuuaaaugaaugugguugcccuuguauuuggagcauagauauucagaauugagaguuccuuuggaagauuuuaccuuugaugaguaugaagugccccuccuugucuuuuuugaugaccuuggguuggaagaauguuggguccuguuuguguagccagucuguuagucuaugucuuuuuauugggggguugaguccauugauauuaagagauauuaaggaaaaguaauuguugcuuccuauuauuuuuguuguuaaaguuggcauucuguucuuguggcugucuuguuuuagguuuguuaaaggauuaccuucuugcuuuuucuaggacgugguuuccauucuuguauuguuuuuuuuuucuguuauuauccuuugaagggcuggauucguggaaagauaaugugugaauuugguucugucauggaauacuuuuguuucuccaucuaaaguuauugaaaguuuggcuggguauaguauccuggguuggcauuuguguucucuuagugucuguauaacaucuguccaagcccuucuugcuuucauauucucuggugaaaaaucuguuguaauucugauagacuugccuuuauauguuacuugacccuuuucccuuacugcuuuuaauauucuaucuuuauuuagugcauuuguuguucugguuauuaugugucaggaggaauuucuuuucugguccagucuauuugggguucuguaggcuucuuauauguucauggguaucucuuucuuuagguuugggaaguuuucaucuauaauuuuguugaagauauuugccgguucuuugaguugauaaagucuucauucucaucuacuccuauuauccguagguuuggucuucucauuguguccuggauuuucuggauguuuugaguuaggaucuuuuugcguuuuguauuuucuuugauuguugugccaauguucucuauggaaucuucugcaccugagauucucucuuccaucucuuguauuccguugcugaugcucgcaucuaugguuccagauuucuuuccuaggguuucuaucuccagcguugccucacuuuggguuuucuucauugugucuacuucccuuuuuaggucuuggaugguuuuauucaauuccaucaccuguuugguuguguuuuccuguaauucuuuaauggauuuuugugcuuccucuuuaagaucuucuaccaauuuagcaguguucuccuguauuucuuugagugaguuauuaaaguccuucuuuauguccucuaccaucaucaugagauauucuuuuagauccaagucuagcuuuucagguguguuggggugcccuggacugggcgaggugggagugcuggguucuggugaugguaaguggucuugguuucuguuaguaagauucuuacguuuaccuuuugccaucugauaaucucuggaguuaguugauuuaguugucucugguuagagguuguuccugaggugauucuguuagccucuaucagcagaccugggagacgagaucucuccuccguguuucaguggucagagcacucucugcaggcaagcucuccucuuacagggaaggugcacagauaucuggcauuaggaccucccuccuggccgaagacgaaggcccaaaacaggacuuguccugcggcugaguugcuuuggccugucccagaagcuguuagcuucuguauucuacacucucaccugugcagaauacucucgccggugucccggaaccaagaugucugccgcagaugcucaggcaaagcgcucccaggcugggcggaccccuauccucuggccaggaaaguggccggaugucuggggcccaaaaagggggcugccuuacaaguucuguggcucccgccugucccagaaguuguuagcuucuguauuccgcacacucaccugugcagaauacucucagcgggguccuggaaccaagaugucugcugccgaugcucaggcaaugugcucccaggacgggcagaccccuauccucuggcugggaaaguggcccagcauuuaguuuuuaaugucuuagaauauccuccagauugugacaacucauacuuccauuguuuuuaccuuuuuuuuuuuuaagguauuuuuguagugaucauaaguaaauuaaaguucucgauccuccaagcccccuagaaugguguagaacuccuaccauauuaggaaagauacauaaucuugacaugauguaacuuugaucacgugguuaggguaguaucugucaaguguauccauuguaaucaguuguuagaauccagcccaucuucaggggaauuggaaccauuuaaguuccaccuuugggagagaguuaggugucaaguaguauaaauaucaggcaucauacauauuaugaaaaauguuuggauacuuuguagauacuucuucauaaagguuugcccaucauguuaccauacuuuuguaaucccccaaccccccccccaacuuauguaaaagacacuaugacauagcaaggaaggcuuaugucauuaaucuaaaaauguaaguaucuuagccaaaagagacaauuaaauuucaguuuaaacuuuuaaaauuuguuugauccaaauaauguuacaggauccaaauuuuuuucuuuugaaacaagauauccauguagcccaagcugcccuccauuuugcugagacaaggucucuugcugggaccuguggcucuuugcuauggcuaaacuggcuaagcuccagggaaccuccagucuacuuccccauugcuaggaacaugugcugccacgucugguuuuuauguggguucugaggaucuaauucagauccuuaugcugaaggguugcacuuuacugacucaacugucuccucagccuuuaugguuaaguguuuuuaugacauuuuuuucauauaugugugugguuacaaauuccccugagugcuuaugauggucaaaggauacuuuguugguucuccacuuccuguggguccaggggcuugaacucaguucaucaggcuugaucucaagugcuuuuaccugcugagggcauuuugccaacccaguaaguggagauuucaucauggcugugugacuuauguaugcuuuauaccuuguaacgauucuccuaugcuauaaauuuuggauaauacauuuccauagauguaauuuguaguuucgagucuucauuuauguuuuuucuacuuaaguauauucuguuacuuggauuucaacauucaaaauugugaggugagccuuaugugguaguacauuccuauaaucucaacauuccagagccugagacuggaguauuacaaguuugagauuaucugaacgacauagugaacuuccuugucucugcuucugaguuacaugguggguuuuugucuuucucugccucuguccguccaucugucaaucucuuuuacacacacacacacaaacacacacacacacacacacacacacacacacacacacacacgcacacgcagagaacacauccaagacaauucuaccuuugagcuaacuaagccacuuuucauuaaaaaguaccaaucuuauuugauagcaguggaaaguugauuaauauacuuuauuugaaaugaaaaucauagauacuuuaauuuuccaaaccacagacaagguuugaaaagggagggggugaccuauuuuucuacuaacuagaaaaaagaauagaagcgguacuauuguuauaaccauauaguuugccaugaucuuguuagaaaaugucauuaagugugguuuuguuuuuuuguuuuuuugguuuuuguuuuuuguuuuuuuuuuuugcagggggggggaguguuuuaagauaggauuucucuauguagccuuggcugucuuggaacucacucuauauagaccaggcugaccuugaacccacagagaucugccugccucugccuccuugagugcugggauuaaggugcauaccaccaccaccaccaggcugucauuaaguauuuuaaaggugcauauuagguucuucuguggagaacuuggaaaaaauugaagcucacuccuucaaaugaaauauauaccaauugcaguuacacucccaucugcccaagagaacuaaaaacuugccuucaaaauauguugggaacagcuguauagucccucaaugaugccaauucaaauguugauuaaaagaauggauuaaaagaauugagaugccacucugcacuuagauugaauuauugaugaaacacagaugaaucucguaaacauuguuuaaugaaagaagccagacacaaaagaguauauauuguaugauucuauuuauuacgaaguguaaaacccagcucuaauauuagaugugaauagauugccucuggauaguaggggcauuaaaggaauuaaaggguauaagagaauuuucuggguaaugaaaauguccugaaaccucaacauauacucuaagaaguguucauuucauuguauagaaacuuugucagaaacaaacaaaaaccaacaagaaaacagagcaggugaaaugacucagaagguaaaggcauuugccaccaauccuaagaacaugaguuuuuuuccugcaacuuuuucucugaccucugugugauaugauguguucaucuaccaauacaugaauauaguaagaauuuuuaauaacagacaaaauaugcacauuuagaugcugcaugccagagauugugacuuaauuugucuagcuugauggcuugugcauagauucugaugcacugucauaauuaagaacuuggaguucaguaggaagagucauugguuacagacagcuugucuuuggguguaacuccacucugcgugcacuugucacacguguagguugauacagguguauuauacugccaaauaaacuacaguuagaagagacauugcuguuugugcuaagauuugaugacaaaaauauuugauacauuuuaaaacaaaaucuugauauuccauaauuuacuggauuuuaaagucuguuuugaaaaaaaaaaaaaaacaaccuagccauuccaaauaaacacauuuauguuuucccagauucaugacuaaaggaaguugaaaguugugugggaucgacuccuggauuacaagauuaaucacucaucccuggcugacuaauccauuuacuacuauaucugugagaacuacucggauguaguguuuuaccgcgucaguuccuuauucuguaaggaauuguacuucuccauuugaguuagauaauaugugaaaaugaguuuuagguaccuuuacuggggagaguaauuucaaacuuuugauaauuguguguguugggguggggagucugugucuguggaucucuguagagcagugguucucaaccuuccuaaugcugugacccuuuauuacaguuccucauguuguggugaccccuaaccauaaaaaauuacuuuuguugcuacuuaauaacuaauuauaauuauaauguaauaucuguacuuccauauggucuuaggugaucccugugaaaggguuguucuaccccaaagcgguugugcuauccacagguugagagcugcugauguagagguaugcauacagaaucuagaagagggugucugauuucuuggaacuggacuuguaagcaaccagaugacagugaugggaacugaacucugguccuaugaagagcagcaagugcucuuuaaccaagggguauuuguugguauugagagcaaccagccaauuugguacucuugaauuugcugguaucaggagaggcaaugcagaucaguggugaggucucuuugggugucaauuuuuuugauuguguuaacagaaaacuaaugauuuagcauuugaccagugucuuaguuaggguuuccauugcuaugaagagacaccaugaccaaggcaacucuuuuuuuaaaaaauuuuuuauuagauauuuucuucauuuacauuuccaaugcuauuucaaaaguccccuauaaccuccccccgcccugcucccuuacccacccacucccacuucuuggcccugguguuccccuguacugggacauauaaaguuuguaagacgaagggaccucucuucccaaugauggccaacuaggccaucuucugcuacauaugcagcuagagauaugagcucuggggguacugguuaguucauauuguuguuccaccuauaggguugcagaccccuucagcuccuuggguacuuucucuagcuccuccuuugggggcccuguguucuagccuauagaugacugugaacauccacuucuguauuugccaggcacuggcauagucucacaagagacagcuauaucaggguccuuucagcaaaaucuugcuggcauaugcaauagugucugcguuugguggcugauuaugggguggacccccgggugggguagucucugaaugguccauccuuucgucuuagcuucaaacuuugucucuguaacuccuuccauggguauuuuauccccuauucuagggaggagugaaguauccacgcguuggucuuucuucuucuugauuuucuuguguuuugcaaauuguaucuuggguauucuagguuucugggcuaauaaccacuuaucagugagugcauaucaagugacuuguuuugugauuggguuaccucauucaggaugauauccuccagauacaucuauuugccuaagaauuucaugaauucauuguuuuuaauagcugaguaguacuccauuguguaaauguaccacauuuucuguauccauuccucuguugagggacaucuggguucuuuccagcuucuggcuauuauaaauaaggcugcuaugaacauaguggagcauguguccuuauuacaaguuggaauaucuucuggguauaugcccaggagagguauugcuggaucuucugguaguacuauguccaauuuucuaaggaaaugccagaaugauuuccagagugguuguacaagccugcaauccuaccagcaauggaggaguguuccucuuucuccacauccuugcuagcaucugcugucaccugaauuuuugauccuagccauucugacuggugugaaguggaaucucaggguuguuuugauuugcauuccccaaggcaacauuuaauuggggcuggcucaguuucagagcuucaguccaguaucaucaaggugggagcauggcagcauccaggcaggcauggugcaggaggagcugagaguucuauaucuucaucugagggcuucugggagaagacuggcucuuaugugauuaggaguagggucucauugcccacccccauaguaauccacuuccuccaacaaggucacagcuacucuaacaaggccacacaccuccuaguagugccacucccugggccaaguacauucaaaccaccacaaccagagaagaguuuuaaaaccaagagagacagcuuacaaguuuaaacuaauacauauuuacauauuuaaacuaauaccuuaaugaaaugcugagacaugccacuuuuauuuuuaaagucaugugaauggaagaacaguuaauuuguaaauuauaguauaucaaaaaugauauugaagaaacuccacugucuauuugaaugagaaaucagugacuuccucacuugucuuuauuuguaugaaauuugauuagaguauaaauccuguuuuccuaauuacuacuuguagagucuuacugggagaaugaagaauuuaagcuacuaagaaaaaugucgugcccaucuaugaagcuuuaaacuuuaaaauacaguguauagaugaccuguguacuauagauguuguagguaguuuguauguggacagcuuaaagcugauacuaguauuuaaguaguaugacugagggagcaaugcacuugucuacuugaucugcuugagcuuccauagcuuuaguauagcauaacauaugaagguaugucuauguaagcauggucuaaacacagguccuucauaaucauaguuuuagauuuaauucuuuauuucccccuauuuuaauaauguauauuaacugauuuaacuagcggcacauguacucuagguaagcaccuuacuccugagcuauacucuuaaucucuauuuuaaacauuuucuccugagcuauacucuuaaucucuauuuuaaacauuucuauccaagucuacaauuuucuucaaaaacaauccauagugagcuuaggaagauaaacaauacugaauugguaaaauuguuacuacuugacuugaauaauaagagauuucuuauuugcuacauaaccauuuaaccuauuuuuaaaagaguuccacccgaaaugcaaaucuuucauaaaucaaaucaaauauacccacuucaaaauuuuguuacuaaacacaguuuuacauaaacauuauuuaccuuuaaaguagcauaauauuuuuuguuuguauguacacguggggugcugucagauaggggaaagaaaauauauaagauuuuuuaaaauauagaagaauguaaaacuauaauuuauugggauggaucaauauuaaaauuacuaugauucaauaaagggcagcauaaaacaguuguuuuuauguuugugaacacacaugugguauauguguguguccaggaguguacucuuccauguacagagaaggcagagguuggcuuagauaguuuccucuguuguucuccaccuuauuuuuaaaaagucacuacuacucucugccuguuccuuuagagcacagucuuucccugaaccuagggugcauguuuucuaggcuaaaauggaagccaaaaagccacaguaauugucauguuuuuguuuuucaccccagagcgggaguagcaggcaucagggaauacccugcuugauaaguaggugacagaaucuaagcucugguucuccugcuuacacagcaagcacucuuuuacugcugugccuacucccuaacuccuuuacgcauguuuguguggaauguguguauguauacacaugaaugugugugugggugcacauagguacauaugauguagaggugcaagguugacaucuuuaguuuuagcuugaucauuucccaccuuagucauugagcuuuauaguaaggcuugucuauguagccagcuuucuccaggcugucuguacuuucugggcacugaaguggaaaauaggcuacuauauccauuugguguuuaccuagguccugguagaaaauuuaugauguugagucccuuaguguggauagaaggauagagacagugauuuacaaaguaacugagaauauuuauguuagauuuuuuuuauguguuugaauuuuuuauaaauuuugaguucagaaucuuugguauaaaacugucaauaugacagaauugaaaacuagaaaaaugagauuauaugaaggauauaauuggucuuguggguacucaagggcuaaauuguuaguuucagaaaugaauuagaacaaauaauuagaaaguuauuaggaauucauuuuucauuaaugagagcuuuuugauuuugagcuucucauuccaugaauccugucuucuagucuugcguauuuugaagagagaugauugauuagcuucuuggcaugcaugcagcaguguuccugguaaguggauauauggauauaugaagggaagcaccccuucagaugggaggacagugcugagaacaggucugcuuguuauacauaccuaccagccaagccauauucugccguaggauuugcauagaggcgugcuauggauuaguggugacuuuuuagagaagucacugugaaggaggaagcuauucuaaagaggcgugguauguuuuuuugaacauagcauaaugucuccaggcuuuaucccugcuguagcauauaccaguacgcuauacuuuuuuaaaaaauagcuaagugauacgccauuguauggauggggcauuugauuuaucuuuugguuauugauaagucuuugggcugcuugaacauuuugcucucuguauaaugcuguuacacuacuguuguuuuguuuuguuuuguuuuguuuuuugagacuauuuguuuagugugguuauauaguaacuguguuuuugguuuuuugagacaggguuucucuguagcccuugucugucuuagaacucaauauuuuacugggaauaaaggugugugcaaccaugcccagcaguaacuguguuuaauuuuuuaaaucuguuucccaaacuggcuguaccauuuuauaguucuaucaguaauguacaagaauucuaguuucuccacaucuucuguaacauuaauuucugucuugauaauuccucuccuggcauaguguugaguugcuggggguuuugauuuguauuuuucuaaugacuaaagaugcuagcauuuuuaugugcucugguuuuuuuguuuacuuuuagagaaaaaccuguucaaauucucugccuuuuugucucuuugucugucucugucugucugucugucuuugagauaggaguucuaacuacuggucaauauccuuauauagcuaaggauuaacuugaauuuauaauauaccacaaggaugugcgaccaugcuuaguuuauguuguguugaggauuaaacccagggccucaugcuagacaaauacuuuauuaacagagauguaucucugcucaucuugugauuucaauuuguugaauuuuaagaguucuuuauaauauagauacaaauucauuaucauauagaugauuuaaaggcauaucuccaguccuguggggggucuuugcaacuuucuuguaauaauaguauucuuuuaaauuaucaagagugucucuaguguuuguuuuguucuuggaggugauauuugaugguuaaauuaguuucuuaacugcuaagauaguucugccuguaauguuguaaaauuuuuucaagaaugaauguucauuuuuguuuauguauguuauuugauauuuagggagaaaguucauuuuccuucuuuuguaucugguuuugagaucuauagguaauaccuucuucauucaucuuggcacuccuuaguuagacuuuauuguuguugucccaugauguaggauuaaaacaaacaacaaggaaugacaaaucuaaggucuucuguguugcuuagguagcuuuuaacauccgaacucagaugauacuuucaguuguuccucuugaaaguugggauauguaccacaccaggcuguaauuuaggauuuucugauuuuuuuuuuuuuaaauacgaagucuccuugaauaauccugauuggccuugaacuugucauccucagacucuguugaugcauucuugagucugcauguuaaaguaguaguuuaugcuaacuuugauagauaucaguaucagaguuauauugauacuugauauugaauuuauaauaaugaacuagaaaaugagauuuaauguuacauuuuuauaaaaaucuaugcauauuuucaaacuacuauuugaauauagcaauuuacuuuuuuuuccucuguacugauaaaugcccauucucauuucuucugguguguuuguguuuguugagucuucugagaaauugucuaucuuuugagcuugcaagggauccuaagcuggcucaacucaaauuuuuccugcuuuggccucccugggauuacgaguccauaagguacaugcuaccacuucuugcacacacacccucaaaaguauuuguguguguguguguguugggagugcuagaguaaguauucuacuccuuaguuacauuccuggcccuucucucuguccuucucuauuuuugugagcauaguguguguugugugggugaaugggggauggagaauugcuuaugagaccagcggaagauguugcguuuucugcucuaucauucucugccuuauuugaucccaugagaaaggucuucaacugagcuuggacacaggugguggccagcaagccuguuuccaccucccccagcacuagggucaaggugugcauggccaccuggcuuuuaacauggaugcuggagucacaguucuguucucaugcuuuugcagcaaaugcuuuuaccugcugaacgcuucagaaucuccacuucuagucuuaauguuuacauucuccugucuuaaccagagccauucauugcuuuuauucuuuccucuccucuuuccuccuuucauucccccuuccccucccuccuuucuuuccaacagcacuggcaauugaguguagggcuuuacacauucucgucaagugcucuaagcuguguucuuggaucguuuaaaaaauauauauauauauaaauuuauauauauauauauauuauauauaaauauguaauauauauauauauaauauauauaauuuuuuuuaacuuuagacugugcuguuaacuuacacccugacaccauccuuguuuuguagcccaggcagcucuugggccugaguucuucugccucuaucuccugaacaucuaagccuguucucaguacuuucucuccuaauugucuuagucccuuuauuaaauggaaguauuugguagagaguuagauagaugcaaguuugaguuuaguaagugacucacuucaguguaguuggcauggcuguggacugcagucuguucucugagcucuccuuugaauguuuagcuucaguuauaguaauugguacuaugagaauugaggcuugccugagacuggacuaauagucacaagcagucuuccuuuuuuuuuuugcccucgaugacuucuuagcuaugggaggccuucuagacagaaagcaaggaggggguagugaggaauacuuacugcccauagcagcagcucugcuccugucucccacugagaagagcaguggcucagagcuccucauucaucuucuaggaggagcuucagagcagccuuuguguucuucucaaacuccugucacuuacaucccacggaagacuuugauaauauagcauuccuauuauugggauuugcucuaucccuguauuauucuucuuguucuuccagcggauuucucaaaacaccuaucuuuaaacauguccugccuucagucaauuuggcggacaaguuggaacccaaacuaagaugcaucugcuuaucauacuuaauauuguaucuguuuggaaaauuuucaauuacauuucuuuugacugguaccuaaaaacauacaauuguacauguuaauggaauaacaaauuuuugauauggauauacuguauaaucuuuagucagguuacacauaucugucuccaaacauuuauaauuucauauguauaguaaaaacuuuaaaaauucuuuguucuggcuaaauugagcaaucacugggcuagguuuagauguauaaaagaggauuaaggucuauguuacuaguugagaggggcuggacagagcauuaacaagcaaaggggacuagcaugccccguguaaugacagaucugggauguguguauuuccaagggaaauggcaugggggaugacagagauggcucaguggcagaguucuuaguguugugcuagaggaugugaguuuauuucccagugcccacauuggguggcucacaauuagcuguaaucuagcuccugggaucugacauccucuggaccucuacaggcauguauacacauauaaauuaaaauaauaaugauaaaauaaaugaauuaaaaaacacaacaggaagaauaaaugaagacaguagucacuuguauuguaaauuaggaauuaggagagauguuaugaagauagauuuuuauuguuuuuucuuuuuguuucauagaauguuggcucaauuaagaaacaucagggagauaaauucaacucagugguaaguagauuuaauguauuuuuuguuugauuuguuuguuuguuuuguuuuguuucgcuuauccagccuuuugcuugccugaaacucacuauggagaccaggcuaacgucagagaguggccuggcucuacccccuaagugcugggauaaaaggcugcugucccaccgugcuuugcuagauuuaauuuuuguuagaaagcugucaguuuauuguuccuuuccuggguuggcuacuuuucuuccauuaugauaaacaauucuuaacucuaauaucaccucuggcuuauauaguagcuucuccuaaaauucuacuuagcaguccaucaguuugaguguuuuguauuauuauguuugggaagaccuugcuuuggguaaguuuacucuuuaacuuugccuuuguaguauguguguucccuccucucaaggguuaagguuccuuuaauucuuuuaaaucaguuagcagcuuucauuucauacuguuuuaucugcagaccuauguagcauucaggucuauuuuuguauuggcucugugccuacuuuguuuaauuugaggacuaagaaucuggaaugauggaucaggcuuguaguccuaacuuccgaggcugaggcaggaggcucacuugccuccaggaggccagccgaggcuacaugagaccuugucucaaacaaacaaacaaacaaacaaacagaguaaguaaagaaaaaucugaauuuagucugacauuugaauuacucuuuuuguagccuuuguccacaaaaguuuugagugugcaugcuauguggcuuccuagaacaaaucacauauuuaauacuccuuuucucuauuaauuguccuguuauaauuuuguauccauuugcucugugaagacaaauuauuagaaacuuucaauuuuucaauaucauauccaaaauacagugucuuucagauuacauacauuagguaauaacaucccauaccauucauuauauuucuaaaucuagaaugguuucugggaaaugcauuuuuuaaaaagccauaucauccagguucuuauacaccgucacugaacacuuauuuguucagacguguuuguuaauguaugguaugugagaaucguaguuugaaucacugaaguaauucuaugcaauugaacuuucuauaaugaugggaauauuauguaauguuugagccacuuugguauccuuaguagggaauaaggaaaugacauuuuaaauuuuauuugauuuaaccuuaauauuaagcauguauaucuacuggcuaccauaccggacaucagguagcagguuaucuuauuaguauacaacgauaagcuuaaucccuuuuuaucaguuacauuccuuauugaaugaauuguuuauuccuggugguaaaaugugcauuuuuauaaacauuaaguuuuuauaaacacaaaguuuuccucuaaaaucuuuaucuagaaauaagcauacaaaaaaagagaauagaauucuuacucugugugugugaucggauucuaacccaggacaagccauacauggucauguugucauugccucagaugaaaacaucggguguuucacuuacuagauuuuuaaaaaaucuuuaaauaguguauaaauagaccuauugauacuagguuuugaggaucuaguucaaauguauauuauaugcuuuuucaaaaaucuguuuuaugagucuguguaguucuaaaaaagcaacucuuaaguaccauguuaaagaucuuuauuuuugacuguuguuuguaguuaagaaaaucugguucucuauggaagcaguaggauauucucuaaaaaauuguaaugaagauaaagaaaauauuuauaaacauuauccaaagagcuacagcauagugccugaugauugaguaaagucaguguagaaacaguuguacuggguuggcugaaguaucguuaagugggaagcagagccuuuagugccacauuguauccugagguaaggaaaaaccaauguugguuguauacacuuuacuuaaacauucgcauuuuguucauaaaugauuauuuuuuuaaguaauuagaguauuuaaaguauuugccuugcugauuuuuuguuacuuucuuauauuuuaugccugaggucuuacugauuuuaacucuggcuuaaugcuguuuaaaaguauuguuucuguaccuaaggcaagaauuauauucauguacaaagaauuacuaaccaauuggugaucauucucauuuucuuaaguaauuucacugcuaguuuacucuuagccuaguuagaauuuauacacaacuucuuaauaaaacuggccuugugaauuuuuauuaauucaaaguuggcuuucucucccuguuaacugagagacuguauuuuaagugaguuuaugcauauauaaucuuaaacaacuuagaaccuauaagcuaguauuagauuaaaacaaaauuauacuuggaguagaugggacuuuucauguaggagaaucauaagaaaguuaaaugugguugaucucugaugaacgguugagaagaccugaaaaugucugcacagucauuuccuauucagaaaugcacagucagguucuugacuaagagacagaacucuuaguuggaaauuagaggaaaaccuuuuacuguuuuuaacagcuaagcagacuucacaacgcaugguuuuauaaaaacguaggaguauuuuguuuuguguuguauucuuggauuguuuuguaaaguaccagagagccugaguuuaauuugaaguccaguagacugucaacuguugauauuaauaggcucaguuggguguaugugguggugggagguauuguuugucuguggcauguggaauugugcuguauggacggucauuuguuggaaaaguuguuguuauauuauaugcauucugauuuguuuuuauguucaugcugcagcauuuaaaaaugacuacaaaacgaaguuuguuugugcgguugguaccaugucgcugucuacgaggagaagaggagacagucacuacucuagauuauucucauugcagcuuggaacaaguucccaaagagauuuucaccuuugaaaaaacuuuagaggagcucuauuuagaugcuaaucagauugaagagcuuccaaagguauguuaauacuaucaagaauuauauuagguaaugucuaugcauagcaguuuauauucuuauauuguuguauauauguguuccuguuuauugguuuagucuuacuguaagcacaauucaaaaugauguagaacuuuguucaaguuguuuaaguacuuguguggauaauugaauuuuauuuuuacuuauaacaauuaaaauagauaaucaguauauaugacuucuggaaccauuagauuuaaccagacuaagaaaagugaacucuuacuguaauuucuauaagcacuuuauaugcauugcuaacauuguuacuuccauugcuacagcuuuuaugguucuguaacuucuuagaggugggauucugcuguuuuccauuuuguauggaauugauuuggagacagugcaucucugaagucuaguaacaacugguaggggacagauugcugcugugacguucuuucucagauugccacuguguuuauuauuguuauuuuaguaagcucuuuuuucucuuaucuguguuuguuuuccuguguaugaaaagguugcaguagcuuuaaauuguuuauuacagucuguaucccucugaauggcagacagggucuuaccuuguagacuagacuguccucaacucucagagaucugccugcccuugcuuuccaaggcugugguugaagguguacaccaccuugcucuuugaagcuguaaauggagacuugaaauugauggcuuaaaaaacaaguuagacuuuggcauggugguaccuaaaugagaaagauuucuaguucaaggccagucugaccuacacaguggguucugucauggccuggaucauauauauaaucagaccuugguuucaaaaccuccugaccauggucacgaaugaacaauuuaauaugcauuaccagaauucugaaaaauaaacuguaauuuggacuaugagauuuagacgacaaaauuauagaauacuuagaauuucugaugaaaaagaaaucguguaaaugugcaguguguaggauaaacuaaaaaacuguuuaucugaaauucacauuuaauugggugucucguaauuaauccagcaacccuaacugaaauguaacagguaauauaucuuguugcauauagacuuuauuuaaugaaauaguuguuuucaauauuuauguuugugaacauucugaaugacaguauucaaaagcauuugaaagccacugcuguccuagguaaugaaguuuuacaaaacuuuauugagacaggaucucacuuugugaucuagacaaacuucaaacuucauugcaauccuccugccucagcuucccagaucuggggauuauaggcugagccacuaugccugguuuauucuuaauaauguggagaagucuagaacuuucuuauuugugcacaguaaaggucuucaguuaacaugauugugaaucacacugaugcugugauuguaguguuauuuguaauguacuguucauuauuuuuauguacucaacaaucuguuaucuuuuaugacuaguucugacagaauaugaaaaauguagguuagucauaguagggucucagucuggaggccuguaaaagagagaugcugacuguaacagugcaaagaaccuaacauguaccuaacugagaccuaacaauuacacauuuuucaagggaugcucuucaauauggcugucuuuuggggauaagcuugauugaaagacaagcucccgagcuuacacuaugcagcagccacuuacccuuugacagcuucagcugagaacauagucguauauauuuaauauggacaguguuuauuggauuaaaaaguaguccauagaauacccaaagaaaugugaaagauaaucagaucccuuuuucacuuuuuucccuagcaacuuuuuaauugucagucucuacauaaacuaaguuugccagacaaugauuuaacaacauuaccagccuccauugcaaaucuuauuaaucucagggaacuggaugucagcaaaaaugguaaguccucgaaauucuuguccuuggagauacauuucauugguaggauuucuguuuuccaaauguuuaauagucagauugcaauauauuagugucauagaaucuauucuacauaaauaugaaaacauuuucccauuucaaaaguuuuauaauacaauaaaauugagcaucauauccucagcuuagaauuuauuuauaaauauaaaguuuaugauaccucaaaacaccugggggaaaaaaguagauuuuaaauauauuauuacaguccacguugggcauugggccucucagauuucucucucccaacugaaaguuuguaccuggaucaacaucuuaauuguccugcuucccucacccugccuagcuucugcuaacuacuauuuuacauuguuucugaguuugccuuuuaauauucaguguuggggaucaugggauguuuauucucuuguuccugauuuauuuuacuuaacaugauguccuuuagguucuuccauccuguuauaaaggacuaggucuccguuuuuaaaaugaagaguauuucaauguacauauauauacuguguauccuuuauugacucauuuauucauggagcuuuagguuaaccccacaccuuagacuuuguaaacaguacugcccugaguacaggagugcagaccuuucuucucuuucccuuggaagcccauggcuugcaaacauuucucccacucagauaacuauucacuccauccauugcuuguuugguugugcacagcuuucuaguuuuauauaacugguuuauuuuuguauuuguugucuaucuuuuugguauauguuuuuagaaaaucauugucugggcuuccucuccuucuuaauaaguagguucccagcuauccggucucguccuuugaauccuuuggucucuccaggaacaucugcuuucuccagucccauugaauagacccuccucuccauggcauuuguuuguuauaccagcaccagauucuuucauuaguagagcuuucaaguagauuuugaaguuaaaugauaugagguccauagcuuuguucuuuuuaguuaagauugcuguugcuucauagucuuuugugauuuucuguuaggauuauuuucuucuauuuuugugucauuagaaaugacauuaaauaugucauuagaauuuuguuaguacauuggaucaacaggauacuagaugguuaggacauuuuaacaguucugcuucuaaucuggaaauacaggguguuguucuuucuauuuauuuauaguuguaguuuguuucaucagagcuguguuguuuucaguguacuuaguuuuguuuuuuuuuaaauuaucucaaaugggauugcuuuaaaagaaaaaaauugaauauuuuuagcauaaauacauguaacugaguucuauauguuccauuuuaauauggauacuuuucuuuuuguugccugauuauucuaauuaggacuuaguacagcuauuauaaguagcuuaaugaucauauauuuacuuacaacuuccucugagaaauacaucacagguaauuuuguuguaaugagcauuauagaauguagucuuuuuaaaauaauuuuuuauuuuuugaaauuauaauuauauaauuuuuuccuucuagccccaccccuauaucucuucccucucaaguucauggccucuuucucuuuuuuuucuuuuuguuuuuguuuuuguuuuuuuucaagacaggguuucucuguauagcccugacuguccuggaacucacucuguagaccaggcuggccucgaacucagaaauccgccugccucugccucugccucuccagugcugggacuaaaggcgugcgccaccacgccuggcuauggccucuuuuucuuaauuguucuuacauuaaauacaugacuucagggcugaccguuuaguauuggguaaucaauuuggguguucuuccuugcgaauacuauuuuucccacucuccauauuucuuaauuguuuguaaugugcacgugcaugugugcauauguauuugugugugugugucuuaggggauugugacaaggucucuuuacauagucuuggcuguccuggcauugacuguguagacagauuggccucaaacucacagagauccacaugccuuugucucccaagugcuaggaucaaaggccugugccaucauacucaaccccuguacuucuuugucuaggguugaggucucacuuuuuguuuguuuguuuuucccuuuuguguuaccauguuuauuggugauggugguggucagaucuugucugggcagccacauugagacuuuauggguguaauuucuuuuacaugucuaggaacagaaucuuguguuagguaacucuguuagcccucuggcucuuacagucguucugcccccucuucugcaauggaugaucccugaacuucccaugcaggaguuguguuguaggcacauuggaacccgagcaccacacgauggccuuuucuuuaaauuuucaucaguugugguuuuucuauaauggucucuuguaaagagaaacuuguuuugaugaagagugaggacuguacuaaccuguaggcauagagacaaauauuuagaguauaguuagaaaucaugcugguuuauuaaaguggcagguguugauucuccuucaaaagccaugacuuaacuagcccugaguaguuggcuggcuuaccuuuaucuuguugagcagguccaaggagagaguccauaucacugagguauaagugccacuacggcacccuuacgauuaucugucuugguguuugaucuaaucaagcagugguaaauguggaguguaugggaaugcuacuuggauuauaacacaguaaaugccuucuuaguaaguaggaggaaguucugugcuaaguuuuuacuacagucacaagauaccugaggaaauacugucguaaggaucaaagauuuauacgaugcagcucuucuguuaaggauauauaugcaugauuucuugccucauuacuuuuggauggugguggcauaguguagcaggaacauguguugggaaucccagcaucccuuggcagccagcaagcaaacagagaaaggaagacugguguuauaauauuucuuucaacugugcccuaaccaccuggcuuucuuucaccaggcucuaccuaucuaaagguucuacuaacaaccauagaggcugucaauaaaacuuuuaauauaugggucuguggaaauauuuaaggcccaaauaacaagcuuucuuuaaaauuauuacagaaaguaacaguagauaucuaaaccaauaacauugaucuggaauuauaugcuauuuguaauugucaggcuagaguuuucucugauugucagcauagguuaguuuauagcacuuucuccacauauacacgaguaacguguuauacucagacacugaagccuaccagagcauugagagcagagauuucucagcaccuugguaauugauuacuguugcuugugugguugacguggaugguaacaccuugugauguaugacucugcccugcugaguagacauaguggcaggaggaucuuugucuugguuuugauuguaggaggaaagcuuugaacuuuucauuguugaauaugcuguugugauuuuaugggucuuuuuuauguugaaaaauagaacuucuauccauaauuugugugacuuuuuuuuugaagucacaaaaagaugcuaauuguuacugccuuugaaagauuuuuccuuccacacacuacugaggcauagauuccugaaugaugaauuauuaauagauaaggaaauuuuauuuagcuuucuguaccuaccacauaaggcaguauuuuaaauuuuuaaaacuuucagagagaugggggagaagaaaaagugagcucuuaaaauuuuuaaaugagcauauauuuuacaauuacaaaaaaugaaucacaugagaauaacuuuuuaaaugccccaccccaaaauacagcauucaguaagcacuaaauaagaaauaguuuuaaaguauuucuuuucaacacuuggaaaaauaucuuuagaaacaaauuuuaccaaaugaguacagcagugcccacagacaguacacaguaauuauauuucauugcccuaguuucaagaucacucuuuguucugauaggaggauguagauguagacauucuuuguacuggcucucagaaauuuuaggacuuacugggcuuuauuuuaggaugacuuagaaucgucauuuaucuuguauucacauuuaacaguuaacuuuggcaagucaguaauuaaguauuuaccuacacacacacacacacacacacacacacacacacaaagcaaaagaaaagaaaaaacaacucugaaguaaaaacauauuuuuacuuuauguaaauauccauuuauuuacuaaauuuaagcuauauaaaucauucuacauguaguccauaugcauaguccacguaaagcacuuagguucugacauagcaaaagugauuguuauuacauuguuuucaguaauaaaucuauuuuaaggcucugacuuauucauucaccuuagguuuaggugaaguuucuagugguuaaauguccugcaauauagccaguaaauuuaagcuguaucuuacuuauuguugcaguucuuugaggaaaaccaugaccaaggcaccuuaugaaaggaaguauuucauuggagguauggucaugguggggacuuggaggcagugagcagucaggacucuggaguaguagcugagagccuuacauccuggaucucagacagcaggcagagaaaguaacacugggcccucagugagcuuuuaaaaccucaagcccaccccagcaacacagcuccuccaagaagaccugaccuuuucaaauccuuccacuaacuggggaccagacauucaaacauuugauuuaccucuuagagccguucucauucaagccauccuaagcuguacagaaaauauuugucuguguugaggaauagaucagucaguaaauggcuugcuucacaagcauacagaccugaguuccauccccaguaccuuuguaaaaaagccugguccuguggucuaagucccaacacuggggagguacagacaggcgggucgcuggugcucacugguuagcaaacuuagugacaagcucuaggucccagagggagacuuugucuaaacaaaacaaaacaaaacaggcaacacacucaugcccacacccagagugggcacaaaaccauacccauacucacacccacgguagacacacaccuacaccuauauccagaguggagugcuguauauuuguauauuuguuugcuauggaaucauuuaacucuauggcccaaacuuuaauguuccuucuuuuuaaaaaaaugugguuuuuuuuuuauuacuuucuuuucuuuuuucuuuuuaaaaauuauuauuacucuuuuuuacaguccagucguucucucccucccgauccacccuuccaacaguuccucaucccauuucuccuccccuucccucccccaccccuaucccccuacuccaccaccugucuccaagaggacccucuccccuccaaucccaccagacuucuccacucccuggggccucaagucucuuuucucacugaggccagacuaggcaguccucugcuguauaugugucaagggccucauauuagcuaguggcucaguguuugagacaacucauggguccagguuaguugagacugcucaucuuccuauggggucacccuccuccuuagauucuucuagccuuuuacuaauucaaccacagggguccccgguuucuauccauugguuggauguaaguaucugcaucugacucuuuucagcugcuuguugggccucucggagagcagccaugcuaggcucccgucuguaagcacuccauccauagcaucaguaauagugucaggccuuggagccuccccuugaguuggaucccaguuuagccuaggucaauggauauccuuucccucagucucuucuucuccauuuuuaucccugcaauucuuuuaggcaggaacaauucugggugaguuuccccggcccugcagggacaaucagcggggacccagagcagggggggggggggagagagagagagagagagagagagagagagagagagagagagagaagaggagaagaagaggagaagaagagagaaugagagcaagucaaucauacugaucaagcucugaaagcuuuauucaggaguggcaauauaagcauaagcaagagaagucuccuagggaggggggaagagccccggggcucucugaaggucagguggcaaucuucagcuccuggaaccaacggucacaguguccucuuuucccacaaacauucuuacuguuaugaccacggauguucucucaggauuguuuauguaagcuagaaaauauccacaaggcuauggcugaggccauggcuccuggcaggucagaguuuuugacuguggaauggcaaccccaucccuccacuugaugcccuguucuacuggagguggacucuacaaguuacaaguuugcucuccccacucuugggcauuucaucuaaggacuucaagcauguggcaaguccuacaucuuccucuugaggcuagggucacaggugucuggcucugugccaugcccucuccuuuucaucuuuaacugaugccugaaugaagcuacuguuuauuguuggugaauaaaguugaggaagagaugagacugugaaaauguuagagcuguuuccuugcuuaauaaauucuaguuuaucauugcuuaucauuauaagugauguaauuaugaauuuuguauaugggagcuaaggugauuuuuuuuuuuuugauaagccuguaguauuuaacccuaauguguugguuaggguuauuuacaaguccauuuuauuaaggagacaacauguauuuugggguaaaccaguguggcuguuugugaagaauuugaauuuuguuaguuggacuuuugauuacaugauauuuuauauaaaugaaagguuaguaaguauccuaauuugcuuucuauuacuuugauaauuacugugaccaaaaggaaauuuucaguuuaacccaucaucagaggaacuuggagacaggaacugaagcagaggcuauggagaauggcugcuaucugacuugcucagccuucuuuuuuauauaccccaggacuaccugugcaagggcagcacugcccacagugggcuuggcccuaucaugucaaucauuaacaaaaugcccacagacacaccagcaggccaaucugguagagacaguuucuuaauugugagguuaccucuuuccagaugagacucuaguuuguguaaaguugauaaacacuaaccagcacauuauaguaaguaacuaugguuuuuauuaaaucuuaaagcuauuaaaauuuuauuuagggcuuacuugaucaccaagauagauauagauauauuucauauuuugauaaguuuuuuucuguuuuaaaauacuaaaucuuggauaagaaguucuaaacuuuuauauguaagauacaguguucuuuuaacuuuucuaucaguuaacuuuaauauuugauguuauaucuuaacauaccagguaccacuuugagcucauuagcucuuauucccuguuuggaaggauucagaaaacauuugcugggacuuuauuacuaauaacuucagcaaguaguauguauuuauuuaaaaaacaaaagauuuuagacauuuaucaucaaaauuguuggucuuuuacauaguuuuuuucuguuucaguuggccaaguagugguucaugauuaaaguauuugggaguguguuuggggagauggcuuaguuagauaaugugcuugcucugcaagcaugaggacuaucaguuuguacaggacacauuuaaacuagaaaggggacucacguaauuaaagaguuugagcuuuuagugagcaaaauccuauacaugacaauuuaauugaaucucauaguauauuaagacuuaaaggaucugggcuugagauuuccguuuccuugguaacuuagggagggucuaaggacaagauuguuuucuuagugacgugcuaccaggaauaaugcugugauaggcuaacucgucuuaaacguuacuguaggacagacugugauaaggauaaagcugucuugguuagauacaguaaucaagucuucacugaaucauguaugggaugcuugauacuucuuaguuuggacugcucgcaugcuuuguccuugcuaggaauugauugcagauuuguuucugucuugcugugucaggguuaaagaguagccuagucugauaaugauguccugugagguaguuuaacagaacauuaauuucuccuucugaauaccuggcuaguuuuaauaugaccaacaaucuguugaugguugaaacuauaagagaauuaaguagguugugacaaaauuccaauuauuuuguacuuauaagagcaaaaugagcugacucugucauugguagugggguauccugauagcugcuaggcaauucuauauaagaccucuacucaugugaagccccuugguucuucaauguaucccacaauggaauuucauucagaagaacuuaguaugaagagaaaaguuagaguuuacuaagaagaacuugguagcccagugauuguggugcauaccuuuaaucccgcacuuggaaggaagaggcauucaggucucuugaguuucagaccauggaagacuucacagagaaacccugggggcagggugguuaaaccuagauucaagcacauugauuaauagaaagagaagcacucagaaaagaugggaguauacccaaguuuccccagaaccuuuaauugcauuagcaauugccaaauacauaagaugucagugacuucggaaguuuuacuucaaaagguuucagagggacacuccccccccccuuauuuuauuguguauuuguguaugugcauguauauauggagaucagagucagauuggcuucuaaucuuauuuuauaaagacaggguccuuucuguagccuuggcuuccuuggaacuuauguaguccaggcuagcuuggaacucagaaaucuaucugccucugccuccuugaguucugggaauaagggugugugucaacacacuugacugucuuuuauuuuuugagacaccuucuccaacugaacugauguggcuagacuggcuggccaacaaacucccagggggucuucuuagcuccugcucuucagcaaaggauuauaggugugccuacaggguuuuugguugguugguuuguuuguuuguugguuuguuuguuuguuuuacuguuuauuugggaaaucugaacuccagucuucgugcuuauguggcaaaugaaacaucuuccaauucuccccuccuuuucaguaugugagaucccagggugguuucugaagcgccuuggauagaguaaucugaucgggcaaagcuaugggcaaaaagguugcucaagggaguuaagacaugucuuuuaagcaggacauuggucccucccucaugccuguaaucucagcacuuggaaugcugagauaugaggacuuuaugguuucuaagccaguccggauuuaacagugagucuuggacagcuuaaauugcagagugagaccauuccuuaagaacaaacaaacaaacaaaauacacacagagaaaggacacaucuuuuacuauaguggaguuccuugugagauuccaauuuuuuuucuuuuuuuggguuucuaggugugaaaagacaaaggucauacuugguuauauauuuuuaggcuguaagcgugauuuauugauuuuuuuaguauucuuacuugaaauaucuuuauaaaggaaguuuugacuauguugcuagcuaaugcagcaaaucuuaauuguguuagaauuuuugacuugccacugguuaaaaucucaacuauaggaacaacagacuacagaaaaguaaaaguuaucauugucuaaauguagucauugagaaagagauaguugacauuuugagaagcuguggcuucucuccuuugucaccuaaaauuuccccauuuuucucuucccucagacaagauagcacauguacugugaggugagccucugggaguacuaauuagagaaaguaagguuaucccauuggugugaaguaagugcaccaggagaagacaacagcuaguguccuaacuuguguaagauucuacauacauguguguagcauagcagacacaugugaugaacacacaggauaguaaggacagaguaauaagcuaaaugagauuauauaggaguaaagaaagaagcuguaauuuggagaaacaguaaaugaugugccucuugagcauuugugugcacacauugauuuuagccuuaacuguguauauaaagagucugaacacaugguggaaaaaccaaccaauucaaaugcaguuuuaguucuuggagauaguaguagugcagaggcugugggcaaacuauggacauguguucuuaaagguagaacuagcauuucaugaugccuuuuaaaugggguauagucccucgugccuguaaucucagcauuugggaagcugagacaugaggacugcaugguuucuaagccagucugggcuucacagugaguccaggacagcuuaaaauacagagugagaccauuccuuaagaauagccaaacaaacaaaacacagacuagcaugugagugugagaagaaguauaagugauguuguugauuuuaucaugcaacuggaaaggcgggaguauuguuagcugagauggagggcuugguaggcgcugcauuuucaagggacaagucgggaaugguuuucaauuaguuuacuagguaacagguuuccuuauaucauuuucauaaguccuuuuguuuugguugcuucccccaccuuaagauaccuucucaucucuuugcccauccuucuccccaucuauauucugcuguccacacuguuccccuuccacauggauucucucuuguucuguugcccuugcgaggugagggccccguucguucuaguuccuugcccuauucccauauuuacuuccacagguuucacaauuagaagcuaggauuuagcagguuguagcagcucauagaauaugcagcuuagaauaugcugaagaggaggaaauaggaggcucaugaauuaggccgaccuaggcuggagagauggcucauucuggaccagucuuacaacuacuuuuaacugcaaucccagggaaccucuggccucuaagcacuaggcaugugugugguauacagauauacaagcaggggaaagaaacaugcauucacacaaaaguaaaaaggacacuuaaaagaaagcugguaguugguuaugagagagaacagauaguuacaucacuuaaugguuucuaguucuucccauuuccugcagauuucauaacuucauuuuguuuuguggcugaauaaaauaccuuugugucuaugucccacauucuuaucacccauuugcugaugggcaucugagcugauuuuguuucuuuucuacuguuaaaagaugagugauaaguaaagagcccuguggguaugugcccuagguuguguagcagaguuguaugauaauuuuguuuucaguguuuugauuacuauagugauuauaucagugaauacauuuauuauuccuuucccccauacccucccuguauuuauuuucuugaugguaggucauucugacuagggugaguuagaucucaaaguaguuguaauauauguuucucugaugggcaucugcauuuucuuuuaaaauuguuuguuaaguguauugaccuacuuaccgauugcagguuuguggauuauguauguauguguguuuaauuuucacaauucuuuauauagucuauucauuaacuccuuggcugaaguauagcugacgaagauuuccauuuucuaggcucucuuaggaacucaggcuuuuuauuugcuugcgugcuuucuuguuugagauaccaauuucucaucaguuauuuuuaaguauggaguuaaguuauaaaaacaguucaagauguaugcauuugagaauugugaccauauagauacuauguaaugacuaaggcuaagcagauucacuaaggucauaagcaugggagauaagcccaaggaaugaggccugcucaucuuauaccuuacaaccuuaggagaucugagagaguaggaaaaugaacaaaagaugaugagaaugaaccccagugaaguaugguagaaucauuuucuuuucuccgugugugugggggggggaggggggaaggcuauuugucggacuguauuuauacacgugcuuguguagaagccauagauugaagucagauaguguucucaguugcugucuacuuauuuuuuuuugaaauaaggugauuaacugagccuggaacugacagauuuggcuaaaauagcuaguuaggaagccuuuagcuucuuccugucucuaccuccccagagcugggguuagaggcauguaguuccaugcccagcuacucuacaugaaugcuggagaucaaaauucaggcccacauucuuaagcuguaagcacuuuacugacugagccaucuccccagaccacucacuacauuuuaacuguugauaaaguccagguauuuguaguucauaacaugucuuccaauuuguguuugguauguuuuugcugaauaauaaaauaaagauguauuugaauuugagguaccugaacaaaaccuaguacuuaaaaaguauuaauaugaaguuuagaaaagggaaggaauaauagaguuuugaaaacuaaaaagagcucuuacuuuguguauuuuuguagaauuuagcauaguucuaauuuuauuacagcauuacuaguacuuacauagaauguuuuuaccauccucuagagaauucuguucccuugucuaguagcuccuaggcucugguguaacuuucuucuguggagauguggacaacuuuuguugauguuguuguuguuguuguuuguuuguuuuuccacguuagauagagcaucaaggacagaucaaagaaauuauuccaaggucuaguguucugaggcagugcauuuauugggguugcuuauagaaguauagauacuagggcaacugcaucaucaagaagcuggugacagcucaugaaagguucaucaccuggccuccugcccagcuuguagagaaacugcacuggagucuccgcuucuccagugauuguuuacuauucuuacacaaucuuguggagaaacuaugagacucuucaaaguuuggugaggcuucuaagucuaugagcuucaauugaaaguuucaauuuagagggaauagcuacacaacaccaggcaaccucguauuugcuuugcuuuguuucugcagauaagaaaaauguuuauuguggauuguucaaaucaaugaaaccauacacuauauguccuuuugucuggcuacuuucucuuagcauaauauuuucaggacucauucaugguauaucauauauugauauuccauagugugacuauacuauauucuguuuauuaugcuuauauauuaaauuguuauugauggacauugggcuauuauaaauaacaugaguguucauguacagcauuuuccuuaacauauguuuuacgugcucuuauauacauacccaauaguagagaguugccgggucauuuguaauucuguauacauaacauuuugaggaaccaucagauuauuuuccacugugguuauaugcucuuaccagcaauauuuauucucaccauccauaccugaauuuguuacuuucauaugcuauauuuagucaggucucuuaagacagauuucuccaccuaguuucucagucuucccccccccuuuuuuuuuuuuuuuccuuccccuucuugauaauuaacuuuuaccauccuggccauuucuuuaacaguacuuuuaauaugaguuuguuugauacuucccaucauuuaaauucaaguuguaugcuuuugcccuaugaugaggcuaacugguaacuaacuccuacugacucuaaagcaguguuuuuuaaccuggggguuguaaaucagauauuuauguugcaguucauuacaguagcagauuuacagcugugaaguaguaaugaaauaauuuuaugauuggggaucaccacaacaugaggagcugguguuaaagggucgcaguguuaggaaggcugagcaccacugcccuacagcauuucauuagguggugcucaucagggucaguuauucuuuguuuucuagaaguagcuggcaggagcaaucucucugacaauauuacuguuauacuuuuuaaucuaccaauuuuuggaauuugugggugauuuguuuucuuuaauggugcuggggauuaaacccauuagugcacauguuaaguacacucucugccacacacgcuuuauuagugagauuugaccaaaggaauuugcuagauguagauuuugcaucauucauuuuaucacauagaacucugugcuuaguguuacagcaaguguucuauuuuuaauguagaaucuucuugugaugaaacugauauuaucuuaaauaacccuauagugacaacuuuauuggauacugauuuuguguuaaugauugaaacuauauaaaauucauuuaggggggaucuucucaaaaguuuccuaacuagugugcauucagaguagagugaugcuaguacuuaaaauuauucuguggucugcuuccauuucacagauuguuccuauauuuuuguugugauaagcuaaggaaaugauugugugcuuagaauucuuuaacaaaauuugauaauaauuuaaaggucuauuucaaaugcccagguauauagcagauugggaauuaaaaggaaauucuuuaccuuacuuggucugaaggacaugcagaaaaaaauaaaauaaaagcaauuuucuuuuuuuuccuaagggaaaaaacagaauguuaaauguucugcauuuugugucuuuaucauucaccaguucauaaaaaaagguacuaauuuccagaagugcuaagaaggggaaggaaaacuaauuaaaguaguuagcaguuauaaagaggcaaaagaaaggaaguuaaaagggagccgauugcugaggaagugaccugauucacauuggugugucaguuuccugaguucuuccugaguuuguauuuacuuucugaaucuccacaaugacuauuauuauuauuaugaccuuuguaauacaccucuuuaucaagacugauguauuucuaauguauucuauuaauuugguuguuuucuaggaauacaagaauuuccagaaaauauuaaaaauuguaaaguuuugacaauuguggaggcuagugugaacccuauuucuaaguaagucucucagcugacguacagcugccuuuuacuaugacaaaagucuugcagucuagagaauaguucuuuaaaguuauacagagauucauauuuguuuuguguguggaugugugugugaaugaauguauuugagugaguguuaaggucugcauguauguauguauaccacauguguuuacacuuuuagacacacucuguguguguguguauguguguguguguguguguguguguguuuacugaugcuacugguaucucaguuuauacagucuaaguuuauagccuaacauucuacaggaccaguuuuuacaacaaagaaccguuugucuuacugcauuauuaaguguuuagaaauuccuuauauaauccuuuuaauuuauguuggauaagauaaccuacucuuucauaguuauauccugugucacucauuuuaaauguaauauuuugcgcagauuuaugauacuaagacauuuuaucuuccuuuuuacaaagacaugcuguuaccauuuuuacaaguaaguuguaagaaaaaggcagcuuaauuuaaagauaacuaauaguaaaaacauaaauauuauuuguugagaagcuaucuuuauuauacaaacucugggagacaauuuuggcaagagacugacugacaucuuaaauguacuuaauuuaauucuuuuauauuuuauauaggcucccugauggguuuucucagcugcuaaaccuaacccaguuauaucugaaugaugcuuuccuugaauucuuaccagcuaauuuuggcagguaaauuauagauuauuuuaaagacauuuauauuguuagcuucuuuaauaauguucacacaacuuuaaaauaguaacacuuaacuaauuacaguccauaggaauuucuuuuguaaauuuuccaagccuaucaauucuuacaguuucuuugacuuauuuccacucagauuuacaacuucaaauaaauaguaaaugucaguugaauaaaacacuauuuaagcuggcaaggucagauacuucagugugagcagugugucuguguuugagacacugaugcuauauuagcauuuacagaauucuaaagugacuugacaauuagcuguuuuccuuuugagaauuaaaguucuuaagagagguucucuuucugaggucucuuucaugugcccacccucaagugucagaauacuuuuucuuuaugauuuuuaauggucucuuaauuuauuucuucuuagacauuuguauuauuguccuauaauacuagagugguaagcaguuuuguagguauuuuuuuaauaaaaggcauacaauuuauucuagaauugaaaauuaggaagaaacacuuugucccuuugaaaauguauuaaagugaucugccuggggccagugaaaaggaccugccaauaaaagccuugcguccugagcuggaccuuugagaccuaaaaaggguggaaagaaagaacagacugcauaaaguuguccuuugaccucuacauuugugcucuggcacaugagcacacacacacauaaugcacauacaauaauuauaaaauguuuuauaaauaauguucaauaguuguggugguacacaccuuuaauccaagcacuucacaagcagaggcaggugggucucugugaguuugaggccagccaaguucuaggacacccagugcuguuauacugagaaaaauauaaaacaaaucugucucggaaaaauauaaaacaaaucaaaaacaaaaagaaaaggacagaaaaaaaaagaaaaguaaaagcaaaagaaauugugcucaguuauuucucucucacuuuaauuuugaggaacacaauguuacuuguuguuuguuuuuguuuugaucaagaucuuacuauguaaccccuguugguguuggacucuauguaaaucagauuggcuuugaacucgcagauccaucuaccugucucugccuccagagugcugggauugaaggaugcuuagcuguguuaaauucuuuccccauucaacauuacuuuacauguaguaauuauacagugcaugcugcuacuuuacuguaaaaugugacacuuauuaaugcaauuccuuuuauuugauuccuuuaucuugauguguucuuuauuuuacagauuaacuaaacuccagauucuagaacuuagagaaaaccaguugaaaauguugccuaaguaagucagaguguuucuuuuccaaauccaguuuagaguuuuuauucuuaaaacugaaguaguuuuauuuaaaauacaaguauauguuauuuuggaauacauguuuuuauauaauucuuucuauuaaauauaaaaauguagggccuguugguguugaguaugguagcaugauaacacugauuuuauaacucuuugaagcacggucuuauaugugacacagaaaaucuuaagaaaaucugagucucagacagagucuaugcuagagcucaauauacaguauucagagugauucaugaaggguucauguaaaguuuuauaacuacaugccucuucacgguucuguugcugugaagagacaccacgccaaggcaacucucauacauaaaacauuaguuagggcuggcuuacaguuucugagguucaauccaucauccucauggugggaagcaugguaguguccaggcaaagaugguacugaaggagccaguaauucugcaucuugauucaaaggcagccaugaggaggcucauuccacacuuggcagagccugagcauagcaaaccucaaagcccaccuccaucuugacacacuuccuccaacaaggccacaccuacucacagugccacuagcugugagcaaagcaaacacaugagucugggggccaaacguauacaagcaccauaccauagaacucuuuguauggcuuuacagucuuguaaacuagaaaugagugauugguucuguaauacaagcuaacaucaagaacauauggauucuuaagaacaaauuaaagcauuuaaaaaacagaacuucuaauucaaaguagacuguagucuuuggccauuuacuaaauaaauaauagaauuuugaaugugucacuauaaaguuuaguaguuagucuaugguuaaauaaaauuuaccauacauauuuacaaauaaaauuuuaggagaacauauccacaguuguuaaguuuucucuggcuguucuugcuuuaaaauaaauauuaaauaauuuuaauguaucuuuucucuguuauaccguuuuucucugaguaacauguacacaucauguauguauguccccuacaugauuguaugucuuugagagcagagaccauauuugauuuuaguuacaagugacuguguugagccuagugguuugcuuuauuauuuuggaugagguuuguaguugugaugauaaguauaaauuagaaaauuauauuaugauuuuaugagguauaaacuacugauuugguacuggcuuaguuccaagcuuuccuggguaugaagagauuugaaaaagcuuuaaaaaaauguucauaguaauagcugaugacagaaagguagcuuucuuucacugugacaaaaugccugauuaaaagauuuuuuuuuugcuuuauucaaguauuuuaucauagcaaugagaaacacaacuaauacagacacuuuaaacccgaaaacuuugauagaaaguagaagugcaauuuccauuuguugcuuucucuugcucucucucucucucucucucucucucucucucucucuguguguguguguguguguguguguguggguguguguguguguguguguguguguggguguggguguggguguuuguuuaugccaugauuucauuguuuaagucagaaggugacuuaaucagacuauucucuucuuucaucgugugggcucugggacucaaucucaagaucauguguggugcugagugucugucucccugcggacaucguguugcucugaugcagacuuugaggaaagguuuauuauagcucauacuguccuauguuucuuguagcuggcugauuccuggccuuuggccuuguaaaaagcagcacacucuggugaggaagaaaaaagugacuacugugugacauuuuggaaggaaagaggaaagcaggagucaagugguugaguuccuauggucccuucuuuaccuuccccuggccuaucuuucaaacacuggaccucucuucuacagguuccaccacuucugaguauacuacaggcuagggaccaaguuacaacauauguccccauagggauguaggaaaugcaagcuguagccuauagacuuucugauuccauaggcacuucagugaauuuuaacucuucugagguacaugcgguuauauaaaugaauuuguaaauacauuuuucccuuuuuuaaaaaaagcuguguaauuaaaaucuuuguaacuuuauaagguauaaauauagaggccauguuuuuaaauauuagauauauaugugcaguuagauugugugaccagauugauauuuuagaaagcaagcaugcaugcacacauucauauguggauagagugagagggagucaguucucuccugggaauagaacuaagacuguuugacuuagcagcaagugucgucuuuauccacugagccaucuugcagacucuagauuuuuguguguaauuaaaacagugggaaaacuuguuuuacauauauaguuaauugaagcuugauacugccugaaggauucugaagggcacugacgguaaguuugaggagcagucuaaguucuccuugaaguaggcagcacguucuuauucuaggaugcaauuuauccucugagguuucuaaaguguacaauagaaccacagcugcucagaucagcagaguucaaugcugaggacuuguaguagauuugcucuuuugucaccuaccuauaucacucuccauuuuuaaauuugcuuuaaacuguuccaggauacuaucugugauugaguuuuuccaguacuuugcuuuucauuuuguacccugucccaaaaguaguagguuacauuucuucaaacugcccaacuguguauuauguauucaauugcuacaaguaaauuucugccaucuugucaguuugacaaugucaaaacaagaaugugugucuguguucuucaguuauuucuccucacaauccgcuccacuuuucucauaagccccaucuagguuuauaauaguuugaagauaucaaggugauaacacagcacauaacuuuauacauuugaaaaagacccuggauagucuuuguaguauuuuaggaaggaaauuagaacuaauaggcuuuauagauaaggauagacauaaauaagggaaauagaauuauagcuccagagguuaagaacucuuauguaaucuuuaacaaagucacuuuuauguaaaagucauuuuuaucaaguugugaaaugaauuaaagagguuauguuugaaugucauguuuaaaauauacagaauggagaaaagugguuuuauuccguuugggcccaugacauaauuccauuacauuugcuauguguguuguuacauucuuucuuuaagguuuuauuuccaauacaauaauauuugaauguauaauacugaugguagcucaaugaacuugucauauuauuuuaucuuacgcugcaaagucuuaguguguaaagaacauagucuuucuuaucugaaaggugauaguaccucagaguauauaaagagauguuuuucuaauuaagcaauugaagacaucaauacacauuuaaaugaauuuguguuuaauuuuguuugaaacacauuuuguagaagaaauaaaauuauggcauaauuucuuuaauuucagaaucugcaauuuuaauuuauuuuuaauuuguuuuuagauauauuuauuuuauuuaaugcuuaugaauguuuugccugaaugugccuggugccugcagaggucagaaaauggcagcagaucucuugagacuggaguuagguaugauugugagccaucauguaggugcuaggaacugacuguagauucuauaaaccaacuccccugguguuuuaauuuuauuuuuuuuaaaaagaaguauugacaucuugggggaauguugaacaugauauauuauugcuuuaacuuaaauuuuuuucuuauuagauguacccauuucaugugugaguguuugugcuugcauguauguaugugcaccauauguaugucuggugccuguggagcuuagaagagggcauuggauccccuggaauuacaguugugaaugguugugaacuaccacauaugugcugagaauugaaccgcaaauccucugcgggaagaacaaguacuuguaaggacuuuccugucuauaaucgcugcuuuaguuuaaacuuaauaucuaauucugcuuguauuuuucacaaaaccucugaaagguuucuacauuauaugguuauauuuuaaaccaugagauuugaaaguuucugugucauugacauuuuugugugguuaauucuuuguuacuuuguccauagaaccaugaauagacugacccagcuggaaaggcuggauuugggaaguaaugaauucacagaagugguaaguccucgagugucacaggccaugaguccagcauuugauuaggaauacaauguggaaguggaaacauuucuguuaaaaauuaggugaaaccgcacgggugguuuuuuaaauauuaaccugaacucuccaacccaguaaaaaaaaauuaaccaaaggauaaucugacaaaugguuagacaaaauaggaaauugaugagaaaucuguggaagagauaccaaaaauauuuuaguguacguagaaaaucuggcagcuuacacuugggugggaggaaccaucaaaugugccuuaugugacauaguuccaagcuuuacuuacuaguuaaaggaagauuguugaggggaaaacuauuauuuuugaguucgcuuugagaucugucaguugaauuuguuccuguauucuaagugaacuguauuacugagucuaugaggaaucucggaaguaugcaguuuuuguauuuaaguaaguuuuuuaaaaauagcucagaaaauaagccagguaucuuuuuuaaauaaauaaauaaauaauaaauaaauaaauaaaugguauucaacaacugaaaaucauauguaaaguuuguguuuacaauuuaguucaaaauuauggcaguuuucaaauaauaguguugagaacaaaaaucucucuuguggguuuugugcauuucaacuauagucaguaaaguaucgugauauuuggaauaccuuauacuuucucuaagguacuuuugcauaacguauuuuaauuuuauauguaugggugcuuugccuuuaugugugucuguacaccacuuguaugcuuggcaccugaagaggcuagaagagaaugcucgguccccuggggcuagaguuauggauauuugugagccagcauguucuggaaaugaaacucagguccucugaaagagcaguaguucuccuaacuacugagccauccacuuuuaccacuuacccacugguccagccuacuuuuucauauucuauuugaagaugauuucugaaugauuucccuauauuuacaaaguugcacuuaugaaaagugcaugcuuugcuuccuaaguuauccuuuuuguccuuauuuugugaauccuuuuagcuuucagaaucauccuuuuaaaauaaaaacucuguuuuggugucacauucagaauagaaaacaaaagcaaccuuacuauugggaggauaggccaggugauguacacuaguaaucccaccacgugggagggcagcuaaacaaaaaucaagaccauuaaacuuacuacuacacuuugaagacuuaccuauauuuguuaacaauaaauaagaacuauaugaauuuaaguuaugacucuugcuguucugguugaauaugauaguaccccuugccagugcauauuuauaugugggucuuugggcugaaagacauaacaauuucaaggagacauucaaaccuugaacuuaaauggguagugcccaagaacaaguuuaccugaauaccaagguucacagcaacuuaaagggguuagugaguuuagcucuucagugcuuuauauaauuucccuuuacauaaucugauuuucugcuaggaguuuacauaaaguauuguugucauguuccucuuucagucgaaggauguguuuaguucccagcauccacauuggauagcucacaacuguguguaacugugguucuggggagcugaaucacucuucuugccuccuguauacacauaugcacucacauaccugcacauguguauacacagagagagagagagagagagagagagagagagaauaucauguuuugacuuuuucucuuaugacuuuuuuccuaaaguuuucuaaaaggcuaugucucuugcuaauaaauaauauuuaauuacacaguuuuaaacagugggucccauuuaauuguuauauaaguacaugaccaaauuugguaauucagagccuaaacaaauguuaccuaaucuacuuuugaaaacguuggguuucccauuagaaugaccacaguaguugcguacaccuuggcagggcuucccucucuccucuccuuuacugugcugauuuaagguuaccuuggaaauucuaggggcaucuuaagucagauacaaugucaugaaauuaauugacuucucccccuccuguguaaacagccugaaguacuugaacaacuaaguggauugagagaguuuuggauggauggcaauagacugacuuuuauuccagggguauguauaugaaaaucucagugguucuucauuuauuacugucucucuuuuucaguauuugaagcgcacauuuacaaguuauuuuugaucauuuaguauuuuuuuguuuaauuuguuguuaagcaguuugaaacaaauuauaauuuuuaaaaaacaugcacacauucuugauuaaaaucuaaaaacuuccuuaacaaaauuuguuuaaaauggccuuuacuacuaaaaaaacgcauuucuauuaguaccaauucagucuuucuagaaauaguuaaacuaaaaugauuuuugcuuuaucaauugagaaauuuacaugcucucauaucuaaagaaggcauaacagcaucuccauuccauaggaggugaugaauauuuccccaagagaaccauaacuacuugacuaaaauuaauccuuaucuguauuauuaaacaguucugguuacauuuagaaaacauucacauuuaauuauuaacugaagauugauauucuuaucuaaauuuuaaaaaucauuugauguaauaaugguauuuuuuugucuuuuacuuauaguuuauugguaguuugagacagcucacguacuuggauguuucuaaaaauaauauugaaaugguugaagaaggaauuucaacaugugaaaaccuccaggacuuucucuuaucaaguaauucccuucagcagcugccggaaacuauuggucuguauugcuuucaaacagauuuuuuuuuuuaauuauuaaagacuucuuuuuuuacucaagacuuccauagacucucaguauuacuguuaauguuugacuguacugucacauaugaguauuacuuggaauacucgguugugcucuguugcacaacuuaacuacuguuauugcuauuuuuauuuauccuaagcaaaguccauuuuuacagcuuuaguaaauugcucacaauuaagcuagccuccucaguucacaauugcucacaauuaagcuagccuccucaguucacaauuguuuacaauuaagcuagccuccucaguucacaauuguucacaauuaagcuagccuccucaguucacaguuguucacaauuaagcuagccuccucaguuuucuuggauuccuagcccuuauuuagaaacuguaauuacuucacuauugacugacagauaagaaaaugaagaaagauuuaaaaauuugcaacagguccauaauuuguguuaaaucuauuuugaaguuguuuguuugaugaagaauuaggaagauagaucacuuugaugaaaagucuaaaaauuuaaaucuucaaggugaugugauagaaaaacucuucucacuugaaguguaccaguuguuuuaaagucaaguauauuuacguuuuagaauuauauucucauuuaaucaguacuuucaauguucgaauugaaacauuuauuuacauauauuauuuuuuauuuagugauaaacauccuucauacugcuguauauuaauucagaaaauuggaguuaauucuucuauaugccaugacauugucuuuaagaaugugaaugaugcagacaaagugaacaauggagacaaaaugucuucuuguauagcuuguauuuuaguuugggguggguaguaaacuaguuauuauucagguuaaguuaaacaaugcagugggggcuggagagagaaucaguaaagggcaagcauaaggacuccaguuugauuuuaugcacuaacaguaaaagccagccugcuggcagcacuucuguucucagcacugagaagacagaccccuggcucucuagccuaccaguguaaccuaauaugagcucuagggcccaguauaagacccuggcucaaaacacaaggaggacgguuccuguggaaggguacccaggguuuaccucuucccucugcaaguacacacguacagcgcaugcaagcacacacacacacacacacacacacacacacacacacacacacacacacacacacacacacgugugcgcgcaggugaggugcaugaaguuagaagguauugggcaagagacuaaguggaugauguugggguaguaucuccuguaaguagauuuauugauaauguuaaauguaaagugcuucacauugacuauugauggacuugcuuucuaaucuaagcugaaaauuauuauuuuuucucaauagguucauugaaaaaugucacaacucuaaaaauugaugaaaaccaauuaauguaucuaccagacucaauaggagggugaguugugugugaacauguagacccuggaaaauguuacuguuaacucagcaagcaucucagcgugcauuucagauauugaggguucauauaaggaacaucuauagcagauuuucacaaacauuugaaauaaauaauuggcauauaguuuaguuauuuuuauaauaaaauaggcuuauuuauuauugauaacauuuagcacuuuauuaaauuuucuuauguuuauuuucuaagguucauguuaauauguucuuaaauuuugaguauaguacauaucuuaaaacccauguguuuccauuuauaauuaaagguuaaggucaauagaagaacuggauugcaguuucaaugaaauugaagcuuugccuuccucaauuggccagcucacaaacaugagaacauuugcugcagaucacaauuacuuacaacagcuacccccagagguacagcauuuuacauucauuuuagauuuuuaucugcuuuuuaaacaucuucaguauguugguguuuuauuucuuuuuaagauagcuuauuaaucaaguuauguauuaucugaauaauaagaugcuauguaacuuugaagauguuccuaaacgcuuuccuuuuaauuuaaaaagaauaguuaccacaaaaguauuauuuuuguaaauguaaagaauauuuuucacagcuuucagauauauuaauauuccuuuaucaguuuauaucccagguuugugaucugcaguuuguuucucuuucagauuggaaacuggaaaaauauaacugugcuguuucuccauuguaauaaacuagagacgcuuccagaggaaaugggugauaugcaaaaauuaaaagucaucaauuuaagugauaauagguuuguaaucuguaguugcuuauagaauacucugaaugaaguuaaaguuucauaugaaauacuacacuaguugauguuuauuucucuuuacguauauuuaaauuuuuaauuaaaagaaugauuaaaauuuauaucauguuacuuaacaugguucauuuugagccaauauaacuacacaauuucuauccucuuguuauuauaugagcuuuuaauucauaaagucccaaauucaucuuaauacugcugcugaacaaagcaacuuuuaaucuaaucuuggcuuauguuuuucugggcugagauugacucacacagcuugagccauaaauaaccaaagugcagagcagacugaccacugagauugcuagacuggagcagagauugcugaacuugagacacugucuuagugaggguuucauugcugugaagagacaccaugaccacagcaucucuuauaaaggaaaacauuuaguuggggcuggcuuacaguuucagaggcucaguccauuaucaucaugguggaaagcauggcagccugcaggcagccauggugcuggaggaggagcugagaguucuccaucuuggucugaaggcagcgaggaagagggucuggaucacacuggccagacuugagcauguauaggagaccucaaagccuucagagugacacuuccccuaacaccuuccaauagugccacuucccaugagcauagcauguuuaaaccaccacagagauugaaacuaauuaaagaacaacugugggaugcuuuauauuuuauuuuguaguacuuuacaaacuaugaaggccaucccuuuggaauaguacaguagguucccuuauauaaaggggaacuuugaagcucggguaaaaaauguuaaaguagagcauuuagcauaauauucugacuuaucaguauacuaauagcuacauuuauuuaaaaagaaucuaugccucuguaaaaagcuacaacaguugucugcuauguggcugucagauaaucaggugggcauucugaccuauuaaauuuggcuggaauuccaauuguauguauuuuuucaauauauuugaaauuucaauguauuuguauuuauugcuguaaaaagacacugugaccauggcaagucuuauaaagggaagcauuuaauugggcugguuugcaguuaagagguuuaguccauuucaucauagcagcaagcaugcagucagcauggugcuggagagcugaagagcugagcgugcuacauacucugacccauaagcgaugggaagugacauagccauuaggccuagcuugagguucugagaccucagagcccaagcccagcaacccacuucuuccaacaaagucacaucuacuucagcaaggccacaauaguggccuaauagcgacacuuccuuugagccuauggaggcuauuuucuuucaagccacuacacuaauaagcacuuacguuacuuuguuuuuacauauuaucaucguaaaauaaugaaccccuaaaauacagaacugugcaguguuuuuaaaaacaagcucucuaggacuucuuacuacagcuuugguuuuuucaauacaaaacacaagcaguuuugugaguacucaauguggccgugccuuucuuuauggaaugaacaguuuuuauuuuuuuaacagauuugauuuuucaguuuauuaaaaaguagagaagcuacuauuaaacaaguuaaugcuucuguccuagaacaaaguuuucagacauagcuagaaugguuuuguacuaauauuggagguugcuuuucaugucugcuggugacagggguaccccucacccucaggaaggacacccuccccagggcugguguguguaguguuuaagacuagagaauguucuuguccuuucuccuauauaaaaguuugcauuuggcuuuacuuucuuuuuuuaaucuuaugaauauagcauucuacagcauuguucagaugauuuguauuuuuguuuucauuauuuuugaugcuaggaaguaggaagauaggguccaugcuaggcaagugcuauuauaccacuguuucugaugugaucucuuaucauuuaaacaguuucauuuuuaaguuuaaucuuuguuuuuuccauucagguuaaagaauuugccuuuuagcuuuacaaagcuacaacaguugacugcuauguggcugucagauaaucaggugggcauucugaccuauuaaguuuggcuggaauuccaauuguauauauuuuuucaauauauguaguauguauuuuucauauauauauauauauauauauauauauauauauauauauaacaguauguauuguauuccaagaauauauaaugauacucuuuaguuuguauagagcaacuuaacaguuauaccuuguucacauauaaacauauauuuaucuuacuguauuuagaaacacauagaucuuuucacacauagauguauaaguaauaaauuuuauuguauuuuagcaaguuuccaaacacacaaaacuucaaagaugaggaaguccuacuccacucuacccaacuuugugacaugacuuccugccauugucacuucguuuugagugcacauaaaaucgauuuucagcaauuuugagugauaaaguauucugacuucaguuaucauagccuacaguagagcucuugaaguuauucuaucaguuuugugcuugaaccagcaugucccaguacacucccaucccaagucccuguuaaaauguuugauucucucugaguuuuucucucaaugacaucacgugauaguuaucuuccuguguuacaagauaucuuuuccuuuaaagacuuacuuguauuucauuauguguauauguuuagcuagucguucauuaauggacacuuagggugauucuauuuucuuaaagauuuuuuauuuuguguguuuuauuuuuuauuuuaaguguuuugcaugaauguauguaugugugaaugguaccugagaaggucagaagaggacauagguuuaccuagaacuggaguugucauuugggagcugggaaccaaacucagguucacuguaaaagcuguuaaccucugagccaucuuuacggccccauuagacuaguuucuuaucuugacuauuaaaauaauauuacagauuuguagugauguaauuaagcaaaaaucuguaauaguaguagaaaaaggaaauaauacuuuuaugacuaauuuugagacaguccuaaaggucagaguuggaaugauacuaguuugcuuaguuuauuuuauuugauguuuugagacagagauugggguaucucuguccaucuuugacuugccugccacuugcuuauguagacuaggcuagucaugaauuuguagagauccuccugccucugccccugccccugccccucugcuccuuugccuaugccuaugccuccugcaugcugggauuaaaguguaugccaucguggcuggucugugaauaggacugccaaccuagguguaaaagaaagacaucacaggaaggagaucuugguuauugagaagacagugcuugaaaugaaauguuaccacacaggaaagaaaggagcaaaugaaagagaauugaaagaugcuaauugagcagcuuugguaaucuggugacucgcaagcaaggugagaaugauggguuuggagaggugccuguuguccucaccugccucugcugcuacuugaugacucugcagucugcuuuucaagccugguucuugucugaguggcucccagaaggacaucccucugcuuuauuucuuguaaacuauccuucaaauuacuuuguacaucaucacuauuucuaucaauaucuuuagccuaguaccugugucugaaucauacauauagcccaguauggauccaguauugauaccuagauaugucagauucagcucccccuagaacaguauaccauuuucuaccccaaauguuuccugggauccuuagcucacugagaaauguuuuauggagucagacacgggagugcagucuuuacuaccaucacuguacaacaguccaguucaucaccaaguucucaggaguauugaauaauaccucgugcgugucauuucauguagaccuauccuguucagugcagaacccaggaguaucaugugugauuaauccaaagucagaugacuuuaauuuaaauuauugguguaagaaaccggggaaugcagacugacugaguaacaugcuuaagaugauauauuuuggagauuuuaaauuuucuuuuaauaaucacaauuaaugagauaagaaucaaagucuaaauauaaacuuuaauuguguuuccugcauugcuuacguacauauccugaaauaauuuuauauaacauuuaaaaauuaauuuucuguguuuuuaucauacugucuuuugaggugaaauguguucuuuucuacuugugacaaucaugucugugcucaguguuuucaaauuuugggacuccuuuacauuuuuaauuaagcaugcuucugcaugauaagucuuaggggauggaggggguuggugguacuaagaaagagauugaauuuagaaagcagacgaucaugguagugcaggagugugaguuuaugugggguauagaccaggacgcacccaaagcacaguaacugucgucaccacuguugggugacgguagguagaagaaucgaccuagguuugagauuucaagaaagcaagccuuuaggaaagaguaaggcuacuaguuccauuauuugaggaagucaaguaaaaugaucagaauuugaaaaauauagaacaguuuauuuuuuaacaagauggaggccacaaaauuuuaaaauauuugggaguaagaguugaggaugaagucauguuuucacaagaguuuguccaaagaguggcugguagggaaauagaagagaagacugggggcuccuaucuacauggaaucacuucaagcuguuacugguaaaauuugaggugugcauauuuaaaauaggaauugauacuauuuguuaaccguaagaagaaagaugcuaagaaaagaaugaagucuaaaauaccuggcaccuccaacaagcgucuuguugguacuguugacggagaguaagagagaagcaguuuugaacuugcugucuguuuagcgacugacuggaauacauauuuagauaacuaguuguuuggguuuuuuaaacauuuuuuauuagauauuuucuucauuuacaauucaaaugcuauaccaaaagucccuuauacccuccucccacccugcucuccaauccacccaccccacuuccuugccccaguauuccccuguauugggacauauaaucuuugcaagaccaagggccucuccuaguuuaagccuuguaaauauuuuuucccuuaaaaguauuuuugcaaaaggaaauacuggagacagaaaguaauauaagauggaaaauguguuuuauaacucuauuaguaaaauuacuguauaauaaagaauucauaggucauagauaaucuugguuuauugauaucuguugcaguaaaucuccacccaaauauuccccggcaaugaaaacagaacucaguuaauaugaauacaugcugugcgccuagauugggcaggucuaccacuacacuaccaucuuccacaucuaugagacccauuagaacuugcaguuucuccaggccaugugcuucugcucugcuuuucuucuuccuccuccuccucuguguccucuuccucuuccauuuucuccuccuucucucccccaccuuccucuccaccuucccucucucugcccaaucaucagcucuccuuuauuuuacaaauuaagaugggaagcagguuuacaggaacucaccugagugcugacucaguccuuguucacaaccccucacaggagaauggaauuaacaucaaauauaguuagccccuagguuauccauaacagauaucuuuaaaauuuuuuucagugauaauuaggauauauugaauuugucuuuuacuaauauuuaaguugcauuuuuagauuucucugugguuucaaaugaguguucauagcgcuauuguauauauacacaaauuuguuuuucuagcuugcaacuugacguuuuauaaaauugguggugguuaguuauaaggauuuuuagauauguauuuuuguagguuuaaaaagaauuaaccuuuuuuuuuuuccuaguccaaaccucugauaccucuucaaaaagaaacagacacagagacucagaaaauggugcuuacuaauuacauguucccucagcagccacggacugaagacgguaggagccgaagacggcuuucucuccuucuccuucacuaaguaccaagagaguucuuagcuccaaaacguuguauuauuuuauugaggguuuggaaaauggauuagaaaguuuucaauaauaguuggaugauaaguaacaucucugaguugaacuuacaagaguguuuucuuuaagucacauugaaaauguuauuauuucuagcuuuauuucaaauaguguuuaaauguuaggaaugcuuguuaacauagugugauuagaaauuuguacuaaaguauagaaugcccuggaaaucuacacacuagauaaagaucaucugugaaucuauagucuuugacuauauguuacugcuaaguuacuuccugaguuuugcccagcaagaaagaauauauuauuucauacugaccacaaguguguacuuguggauuagugugugaagauagaggaccaaauuauuuuuaguauaucuaauauacaucagaaaucauuagaucccauuauagauuguugugagacagguccucuagaagagcaucuaguccucuuaaccacugaacagucucuccagccucauauauucauauguuguucugugugugugcauaacauguuuaaaauuaaacucaaaaugucuuguauguauguaucgaucuaucuuucuaucuuucuuuaagacagugaaaauggcuaugcuaugaaguacuagaaauuaacucaauauauaauguugaagaaaaguguaauucauuguuagucuuaacacguauuccgugaggggcuggaaagauggcucagugguuaagagcauuuucuauucuuccaguggacccagauucuguccucagcauccacuuggcagcuuacagcuguugauaacuccaauucgaggugaugaauccaucuucugggcagccaguuacuuccaugcugucuaugacuaccucuagccuauucuugagugcuagccacagaaauauuuuauuauauggcccuuuacuaaaauaguaugucaguuugugaauagaacauuaaaauggcggggcguggugguacaagccuuuaaucccagcacucgagaggcagaggcaggcggauuucugaguucgaggccaguacauacacagagaaacccugucucgaaaaaccaaaaaaaaaaaaaccaaaaaaaaaaaaaaaaaacauuaaaauguuaucuucugugaaauaggaaauuauuucauuucuuacaaauauuuuaaguacuaacauucuuuacuaccaaaaggacaauuauuugaucauauuaugcauuaauauuauuuauaagacucucccuaguucuuacugaacaagccaggguuuugcauuguuauggcuaaagaaucgggagaaacaaagaaagaaagauuugucuuaguucauaguuuucagaggucucauuucaucuuaaugaggcagacagaaguagauccagagaagcacaugucagggcaucacaggagcagaggggguggcuggggacauggugcuuuuccugcacagcccagcucuaaacaugucagacuccaaaguagcaccacucaggaacccagaauucaaaugugagccuaugggaaacgguaguguugucaagaggauggugaguuuccuuugaaugucaaagaaguauuuuucuuuguuuauuacuucuaagaaaccagugaaucagauagugaaugauacuguucaguuguaguuuuauaccaacuugagagaaacacaguguuuacauugagcuuacucugguuuugccaaccuaugugacaggugcuaauagagcuaaguaaaaccccuuccauuuuauacucccaaaguagauaauggugaggaaauuugaaagacuaggaaugagaguuucagucuagguggaggguuucacuuugcagcccuggcugaccuggaguuccucaaacucacagugaaucaaguccaucuguuucccgagugcugggguuaaagccgugcuccauuccuguccugguggaguuaguuuaacgggggagaaggagauaccuaguuguuuucuaagaggugcguguucgauauguagcauagguaguauggaaaacaggauggugggggauauuaguguggaauauuacuacagucucccuccauagugacaugaagguaaagcaggaauauggaagaaauuugcugcugguauuggaggaagggcauuugaaggaagugguaaugacuacuguaucgugaaauggaagcuucauuaaagaaggaaguaaaaccuagagaggcuuugcagguuggaaaagaaagauggcuaaaacccugagcauuuaccaacagucggggauguggcuuaauauuuagaaggaggauucaguggcaaagagguggaaaaguuuugagugugaccauaguuaugaaucccuuaggugauaugaacauuaacauuagaauuaaagaugucuaggaacuguaaaauuauacagucgaguggcaucacacauuugaaucauccaggauaugagcacgucuuuaaagagaagcccuguagucagauacuagaguguuaaaugaaugugucucagcauucagauuuguuagacuguacaguaacgguaggaaucauacuaccugguacccugaaccuucuauguuacggaauuuauucaaaauaauaagacauguaauuaaccagaaauuauugagcaugagauuaaugaucaggguuacuaaauguaacuuuaggaaucugaguauauucuuguguaaaaugccuuaacucuuaagcauuuggaggcugccuggugauugcaguugcuaaccaagggcuaucaacaugacucagugagugaguaaaaaauguuugccaccaaagaaugguaaucagaguuugauucucagaauccacaaaccuaagugaguuacugccuggcucuaguuuccucuuuuuuaucuucugggccaggguuuucuguaggccuaggaacucacuguauaugugaggauggacuugaacaucugacgucacaccuuggacuccacauugcugugauugcaggcauagugcucccugccuggcuuacggguucacuagugcuagcaagggaacucagggagucucucucucucucucucucucucucucucucucucucucucucucucucucucucucucucucaauuuaauguaugugaguacacugucacucucucagucacaccagaagagggcaucagaucccauuacaugugguugugagccaccaugugguaccuggaaauugaccucagaaccucgggaagagcagccaguguucuuagccacugagccauucucuccagucuccaucucuuacccucuaaugauaccacaaagaaauaucaacaaugaaccauaguccacauuucuuugaacaaaaauaauucauuaaguaaauacuaaguaacucacaaaguaacuuaaucaugaaaacaaauacauuuuuauagucccaacauucagaaaauaaucaagcagaguauugcauguuagagaggcaucaugagcuauaucaugagacccuguuuugaaaacuagugcauugugcuggagagauggcuuagcauaauaacccucuuuuggagguccugaguucaauucccagcaaucacaugguggcuuaaaaccacuuguaauggcuucugaugcccuuuucuggcaugcagguguauaugcagauagagcacucauaauguaaaauauauaaauaaacaaaucuugaaaaacagaaaaaacuaaaaaccaaaacaaagaaacaaaacaaaacaacaacuagcacacaguggucugggguugcaauucaguuguagagugucuagcauucaggaaaccccguauuacauucucagcacuuagaagugaaagugagaggaucagaaauguaaggugaucuuuagcuucauaaagaacuggaugcccuaucuuuaaacaaaacacauaaaaaaaagucaguccuguuguucuuucuuguuuuguggcauuuuuagucuggacauagcaauuuacaaaggaaaagaaaagccaaacaagggucugauauaaaucauauuugcgcacauacucacaucuuccauguuuguauguuuuuggaacuuaaguguguguguuuugcguguggcaugugcgugugugugugugugugugugugugugugugugugugugugugugugugugugugugagagagagagagagagagagagagagagagagagagcuacauguuaaaacauuuucccucucuuucccacucuauaauuucuuuuauuuugaguaagaguugccaauuuuucauauuuuguauuauauaacuuucauagagugauaaagaguaguugaaugaauuacuuuaagccacuccagaaaaccuguagaaggcuuuggaguuuaacaucauauaucugauuggauaaagaaugauugaguuuauauuaaauauaaaguuuccuuacauuuuuauguggaauauguauuuuguguacuuaguguaaucuauaguauguauaaucgacaccaaaguaauucauuuuauuuuauaacaaaauaggucauuauaccauugaacccuuuuaucccuccaucauguugagcuauuaaugcuaaacagaauucuaaaauagaauaaauuaaugauaacucgaauucuaaaauuggaagaucuagaagcuagccuuauuguccuaaauuuuuaggguccuacucaaaaccuauguguuugcaguguuuaaauuuacaacuucaugaaucuuucuaagaauaaaaccaaaucagcuucuaagaaauaaaaguuacacuggucaugaugaacaaaucuuaaagcuaaaauacacuuguuuucauuuguuuguuucuggguuuuguuuuuuucuaagacagaguuucucuguguaacccuggcuguccuggagcuugcuguguagaccaggcuggccucgaacucacagagaucaaccugccucugccuucugagugcuggaauuaaaggcaugcguuaucaccuccccuuagaauuauuuauauaauaaagaugaugcguaauaguuuucugugauuauuguaaaauauaguagcuuuucuuuuacuuuccucuaguuauguucauaucagauaaugaaaguuuuaauccugcauugugggaagaacagagaaaacagcgggcucaaguggcauuugaaugugaugaagacaaagaugaaagagaggcaccacccagggugagucuguuagcuuuucuuucaggugugcugacuaaauuugguacuguauaaccuauguuauauacuguauacuauguuauauacuguauaccuauguuauacuaccugcaguuacagagaagucuuggcuccauugcuuacccuaaaagcacuuacuaauccaaauuauuucgcuacaaaaaaauugagaucaauauaaaucugccauuacaagguauauuucagagagagauagcgcucaccauggagcucuugucugucauguaaaggcccagaguuugaucccuagcacugaaagaaagaaaaaaagaaagagagagagagagagagagaaaacagccuaauuugaagugagugagugugugugugugugugugugagagagagagagagagagagagagagaauuuuuuaaaaaaccaucaucugucuucacaguucagauggauuauccguuaagugcugaaauugauguuagaaauacuaauauuucauguuucucuuauuucuuaggagggaaacuuaaagagauauccaacaccauacccagaugagcuuaagaauauggucaagacuguucaaaccauuguacauagauuaaaagaugaagagacuaaugaagagucugggagagauuugaagcagcaugaagaucagcaaguuguaaauaaggauaagugugugaagguuagaaaacucaauuccaacuaaugaucuaaaguguuugcaguuuccugauguuuuuuuugacauaauugauaugaucuuaauuauauacuaaauuuguaguuuuguuuucagaugccuaaauugugaacuuucugaauuccccauugcucaucuuuuaucaggauaaugucaagauagcugcuaacaaaaaucauugccugcugagcccuugagaggcagaggcagguagaucuuugaauuugaggccugaucuacagagcauguuccagaauugccaggacuacacagagaaacccugucucaaaaaaccaaaaccaaaccaaaccaaaaagacuccaaggcuuugaacuauaauauuuucugggugauggcacaugccuuuaauccuagcacucaggaggcagaggcugucaaggccagccuagucuacagagugaguuggaacucacucugacagccagaaaaaugggcgggggggcgggggggggauagcuuagcgguuaagagcacugacugcucuuccaaagguccugaguucaaaucccagcaaccacaugguggcucacaaccauccgugaugacaucugacuuccucuucuggugugucugaagacaacuacaguguacuuacauauaauaaauaaauuuaaagaaaaaaagcaaaacugaacuaauaagagaugauuaucagagaguuauucugcaaauauucuuucccacuuaaugauacugaucuacuuuauuucaacuuuuaauaaauugauauuauagacauuugauacuuccuuggaauguuucagaagcauucacaaauuucuuaagcuaugcauuucuuuagugaacuuuucuuagugcuacuuagcuccaaacaaaaguucuguccugucauuagaaucacuguacauuccacagugggcagaaauguuucaugaucuauccuuugucauugcgaacuaauugacgcucucgacaccagccuuccagucuucucguagaaaagcagcuuuugcuaaaugauguaaucaugucccucucucuaucucugagucuaauuuacauguucaugguuucuguaauauuaauugagaacuggaagucgauauauugcuuaauuuuauguaauauuuaauagaagaauagacauaaaacuuaaaugagcucuuuaucuuuuauguagacuucagaaaguacuacaacaaaaagcaaacuugaugaaagagaaaaguauaugaauucuguacagaaaaugagugagccugaagcugagaccaaugguggaaauuugccaguaacugcaaguaugaaguugucuggaaaccugaagcauauuguuaaccaugaugauguuuuugagguauaacuucauucugacauaaucaugagaguuuucuauguagaauuuuauuguuguaaacaacagaagccugauaauaugacugcagaaaauacuaacauguauuuauauugagguauccuugagaaauuucagacugccaaaauaucacucaucacuugaaauuuaauuuuuuuaacucuuuguaaguaaaugacuaguaaguaaauuagauaaugaugugucauguaaagugaauaaucacaguugcuuuuaugucuuuauuuuuugcaguaauggaaaucaaguucaguuaguuguacauaagagaggcucauguucugucuuuugcauccucaguccuugguuuuauuucuguaacaucaaaaugaaaauugaagauguagaucagugguaguagugccucagcuggcauaggcccuggauucuguccucagcacugugaaaaagggggggugggacaagagaaaauaccuauuauggguauacccaaucauuuaacuuacauaagcauucaucauugaauguuacccuuguucagugucuaagaaccuaaauauaaucucuacuauuaaaaguuguagguuuuguuuuugguuuuuuuuuaaggcaggaggccuuuuuaaaaagagauaaacucuaaguguacugauugaaagcauauaauuuaaugacuuaaacaauuuacaaaguuguaaaaccaucaccacaguuacuugcagaauauuuguauagccacagaaagaaaaagaaaugucauccuuuuugucccuuuaaggcuuugcacgccccccccccccagcucuaagcaacuaguaaguacuuugccuguauagauuugucuauuacugcucaguaaguggucuuuuaucguuuccuucccuuggcauauucucuugaaguucauacugugguaauucucagaacugcaucuuauuucuauggugucugaauaguauucuauugaauuauaucucagguauaagugagacugcuaaacauagacagaacucucaguuuucugagacuaagucuccauagcccagauaguccuggagcucacuaugcagcccaagcugguguaacucgugauacuccuccugucuuagccucuugcaugcuagguguauagcugugagcuacugugccucgcugaacuccacgguggcucugguucucccuuaacuccaguuccagaggcucaacacccucuuuuaaccuccaugguuaucacacacacacacacacagucauacauucaagcaaaacauucauacacaagaaauaaaaauaaaucuauaaugauaugaauagagauugaaaacuauuucauuaaaauaguauuuuuguacaccaagaaauagagcuaccaugugggugcuggaaaauaaaccuuuguccucugcaagacagcaagugcucuuaauugcugagugaucucuccacuauccauaucuuuacuguggcacuuacaaacacauaaaaguccuuaguacuguuuguuucuuuuucagaggaacaaguuuuguaaagcauuugcuuuaguuucaucuuaguauguaggaaugauuuaacuggcaagagagcucauuuccugcaugacauaugauauuaaaauuucuauuaauaguugaugacuaacaagucauuuucuuuucugacacuacucaguaguagguaaucugcaacaacuguggcguauuacaggaaauaaacauggaaaauaacaauucuguuuucaaaauagguaaaauauuuauaguucacauuaauaguagucuaucguagaagccaaauauaguuaugaaacuacucaacacuuaggcaaaggcucuguugagggacuccagaaguugaauuuuugaaaaacaggauugugcuguggucauuuuuguuugccaguaaccucacacucuggcacgugacaacuacugauacagugauaaggcuuagagccagaaaugauccaugagaaguuuuaaucugugguuacaguacuacuguagguuuauugcugcacuugaaaaaguugagucaugcagcuuugucaaccauuuccauuaacaggcacuuuuauacauggucugagcaguugcuucguuucccugugauguuuuuaugauauauuaauucauuuaaagaguccaaaguuuaauucucguauuuaucccuuuuuucuuuaaacuaggaaucugaagaacuuucuucugaugaagaaaugaaaauggcagagaugcgaccuccauuaauugaauccucgauuaaucagcccaaaguuguagcacuuaguaauaauaaaaaggguuaguaauaaucaaaaagguuagauguuaagagggggaggcauuaagacuagaaaucaccuaaguaagauguauuaacuuuguggaaguaaauuucauuggaugucacauuuuugaaacauucugaaagcaaaauuuauaacugccuuucuaaaauguuguucuuauuucccauuuuuaaagaaagagauugguagguccucuccacucccaugcagaguuuguuuguaagggcauguacauuaaagggauauaauucuagauuauaauuccauuucuauugaguauuuccuagauacauuuuccuugugugcuuaauuuuauccauuuauauagacaaauuugaauuguagugaggccaaugaaggauuuugcauauaauacauugcauaguuccugauauauacgauuuauacuauauaaacauuauuuuauuccuaucuauuccagaaugauaaauauuaagugcuuuuccccaacuuucgccagcuaauugucaccuaugucaucacacaacucuugcgacuugugccugaucagcuugcgcuaucucugccaaaugcuuauccagacgguugcuuucauagagcuaaugauacuaccaagguggcucuuggccagcuuggguuuauaaggauacuuaaaaacgauugaguacuuuauuuaacaguugcuuagguacuaggcaguuguuacuuagcuguuuaacaguugguuguaguaauagccccauaaaaaguacuucaaaggcugucuaacauuauuuuuuacacauuaaggaacuaagacucaaguaccuugagguuggaguuccuaaaccauuugagcccuauuucuaaaaacaauaaacuaucuuuaaucgauauguggguaugucugaguacauuagacccuugaguuggcuagaguugacuucuuuauaaagagcuuuuuuacaacuauuuucaaauuccuuuuaaacuugugcuuuaguagauaugaacaguuuccuuuucguuguucuaaacaaccaccucacacauggagagauuaccacuuuauaaacaggucuuugagguggagagauacagaggacccacgcuugguucccagcacccacauugggcagcucacucuaacuucagcugcaggggauaugauaccuuugacuucugagcaccuucagucaaaugcacauacacacacaggcauacauauaaaaguaaauguuuacauuugaaauaaaggaaccgacccuugaaauuuugauuuuguuuacauauugauuacauugcucaauuuuauuaucaagauaggcugaaaaauauuacacauucauaugaaauaauuccuugacuagaugaacuauaggagguuguaaauauauauuuuuauuaugaguucuuaaaaucaaaaggacguucauucaccaaaaugaguuaguagccuuugaaaauugugcagaaagcgaagucaaauuuuggguacccuacauuacauuaaaaauucgauuacaacuuuuaaauuuuugaauuuuuguauauuuucggauuuaauuuucagagauaccacugauuaucuuaccgacuuaauuuaucaccucagacauacaaucagugcaaacgcuuuccaugaauucuuagugaauuuaucacugcgcuucaauacuuucuucuuuuuucagaugaugcgaaggaugcagacucuuuauccgaugaagucacacacaacaguaaucagaauaacagcaacuguucuucuccgucccgaaugucugauucagugucucuuaauacugacagcagucaagacacgucacucuguucucccgugaaacagacucccguggauaguaacuccaaagucaggucugugugcauuugaacaaauguauuuacuuauacaauaaauagaaacaauaauacaaauaauaaauauagggcuaaacauaaaugguuucacagauauauaaguggcuuaugcaauaaauuucuuuacuccauuuuuaaaguaauugaguagugauuguuagugucugcuuaguugcaaagauguccuggaauucagaagcccaugaaccacacagcucagaggugugacaugggagcccaggauccgugaagcucugaggggaagucuccugagcagaggcuuugcagcucccaaggaggccaucccggggaugcucagcucagcagccucagcucugcuccuuuucuucccuucuuuucuccuuugcucccaagcugccucugaugagucacaccaggcaguaaaugccauaagauucacugggagcccaggguggaggaaugaauccagacagcauuggcugcuucuguucccaggagugcacagcaaggaauugaacaaagggcagggcuuauauagggggcggagcuuuucagggcagauuuccagagugaggauuguaagcccugauuuggaaagcuggggauuaguggaguucugugggacagggauggaugggucuuccugcucagggacugguggcauuuugugggaagcucagggauugguggguucuccuaggcagggacugguggcuuuuuucccccacaccuuucccuaaaucagucaagggguugggaugggaaaacuccaguuggcuuuggcgaaggugccuugguugagcugcuuggggaggcuggagaggagguggccagcuccugugaugguaccucugcuggcagcaagcugaggaggugucacuguuuucacaaaugucgccauuuugacuguuccuguggcaguacuuuacaguggagguagccacaggcuagggagggagccauagcuuugacagagcuuggcucagggucuacagugauuauaaaguuguuuuaaaaccauuuuuguuugguugagaaagaaacagcaaaauacaauaaauucuuaaucuuuaggugaaaugaaagaaaauacaaauauuucuaggugucaaaacauauaaacagcugauuugaggaaguucagauuaaaauaguuauuuuuauccuuagaaaccauguuaauuacuucucauugcagugauaauacacccuggccaaaaacaacguauggaagaaauagggcucuuuuggcuuaaaggaggccuggcagcaggaagcugagagaccacaccucuguagcuuugcuuuauuuuuucuuucagcuacuuuguguggauucuucuccuaaaugucucuuaacaauaucaucucuagcuuggcucagcuucuccugucuuaaccgucuucucuaacccuacucucugacccugcucuucugucaccuggaaccuacuaaauccaaagacugacucucuuagccucugcuggguuuuuuauauccuuuccuguucccaaaauuccaagaggcaacugauagugaagggcauaggguccuuuaaagggccaggcacacgaaguaaaucaugcuacacacccccaaccacgugcagaaagcaaggaaggcaaacuggaaguguggugagacuguaaauuugcaagcccuuuccucguguaaugcucuguucccuguccucauuggcuaauggccaugucauaauguaaaaugcuuuuggguuaaaaguacucaugaucuuuaacagucuuaaacuauucaaaagucaggucucuucucaaucucaauacagucucuuaacugacuucgcagcccauaagauguuuuaaaaugugugcuuccaggauauuaugguguggcauauacauuaccauuccauauuaucguguggcauauacauuaccaggauauuaucguguggcauauacaucaccauuccaaaggggaagaaugaggacacagugagaaaauacugagcaaaacccaucagagcaaacuccaaauccuauagcuccaugcccagugcccagugcccagugcugagguggcucugcccguuuagcuuugaggccugugcauacaucucucagucgggcugguuccacucuguaaucaguucuuagcaguuaucucauggcucugguaucuaacaguuuagguuuucugcugcaacccaggcuuugcuuuucagguuucacguacuuuacuuucauagcaucucagcuuugccagacauugccuguccucagggacucucugaaaccauauaggaguuuccauggccacagucacggccaaauucuuugccaacauaucaacgaauggcaugcacaauaguugcuaaaaccguuuuuuucuucccucugaaacuuguugaucaggaccucuccuagccucuuuacucgcacugcugcugucuuccaguuuccuacuggaguggccuggaagcucugcuuaacauuuucaguauagccuucaaagguuuuccaaaagugaacuuggucagcaaugaccccgcucucuggugccaguuucugucuuaccuucuuuuuguugcugugauaauauaccguaaccaaaugugacuuuuggggaaaguuuauuauggcuuaugguugcaaagggcgaguuuuuauggugggagggucguggcugcaggcaguugaaagaucacaucuccaacuacagcuagaaaguagcgaacaaauuggaaaugagacaaagcuauaaacuuucaaagcuggccucuagaaauauucuuucuccagcaagauccccaugcucuaaaaguuccccaaaauagcauuguugacuagagaccaagcguuuccauacaugagcuucugugggacauuucucauucagaccacucuggaaaugcugggucauucacgggagaugccauuaaagguucacucacaugcucuuauuuggugcuauauaucuggccuuaauuuuguaggaaaaaaucuuuugagagaaaacuaugcaaacuuuaaccuuuuacucuggguuuaguagaaguuuaaaguaguuuuauuacuaaccuucaaagauacuuggucaccagaauaaggucaaagcaaggccaugcugcgcaugccgucugucgacuaggagucugagggaagguuuaggcugccucugaaccacauacugguuuuacagauauuuuaaacccuaacuagagaaaauugaucuuaaguugcagacuuauuuaaguaaaagcuguuacuugucuuacuauaaaaagaauacuaauuuucugucugaguaugaauacagauauuauacuauacguucucuuaauuuuaugcuauagacuugguacagugcugauuuuauaauuacauguuaaagaaaaugcuuaauuuguugaauuacaaaacuuuccuaauauuguugaaaacugauacgguacaaaucauucuuucguauaacaaagucaagguguuaagcaaggaguauagcagaagcuuuuauguguuguuuuaauaaugaacuauaacuuuuguauaguuucaagaucuagauaugcuuauucuguaccaccacauagaaauaaaauaguuucuguaguuuuauaacgauaaauuuauaaaaauuugccagauugugccagagaguaauguucgggcauaguuucucuuuugaucccuuuauaaacuuaaguguuuaugcaguuuuguuuuaguuuaacuuaauuauauacauauuugugaguaauaaccacuuguuaagaauaguagcuugugauuaguacaguuaauguaaagcuucaaaauuccuugugccauuuacuuauuuacugaaguuacugucugacucucaguauauuuuucccaccuugaagcauuuaaaguuuuagcacauuugugaaaaggcacagaaggcacaucauucuaugcauaguguucuuagcauaguccuaguaaccuguuguguaacaaacuguagugccuauguugauguuaaauuagucuugguguuauagaugacuuuuagcuguuuuacuuguuucucuaacaauaaaaaucucugcuugacaaaagcuuuugauuaacuuuaacugauauuuaacacaaaauguguacauaucaaugggguauuguauugauacuuguauaugguaauaaaggucuuguuccggagcucccacaauucuuuuaccuguguuagcuauauaacuaauaguuacuaaugaucaaaaaaacuugcugguuuuugcuuuuuguuuuguuuuguuuuuuacuuucucauaaaauucucuuuuauuuuagacaagaagaugaaaauuuuaacagccuuuuacaaaauggaguuaauuuaaacaauucaccagaggaaaaauucaaaauuaaugauaaaaaggauuuuaaguuaccugaguaugauuugaauauugaagaacaguuaguucugauugaaaaagacauugauucaaaagccacaucugaugacucucgccaguuagaccauaucaacaugaauauuaauaaacuugugaccaauaauauuuuucaaccagaaguaauggaaagaucaaagaugcaggauauaguacuuggaacaggcuuuuuaaguauucauccuaaaaaugaggcugagcacauagaaaauggggcuaaguuuccgaauuuggaguccauaaauaagguaaauggucuuugugaggacacugcaccgucuccugguaggguugaaccacagaaggccaguucuucugcugacgugggcauuucuaaaagcacggaagaucuaucuccucagagaagugguccaacuggagcuguugugaaaucucauaguauaacuaacauggagacuggagguuuaaaaaucuaugacauucuuggugaugauggcccucagccgccaagugcagcaguuaaaaucgcaucugcuguggaugggaagaacauagucagaagcaagucugccacacugcuguaugaucagccccugcagguguucacugcugccuccucaucuucugaguuacugucagguacaaaggcaguuuucaaguuugauucaaaucacaacccugaagagccagauauaauaagagcugccacaguaucuggcccacagucuacaccucaccuguauggucccccacaauauaauguccaguacaguggcagugcuacagugaaagacaccuuguggcacccuaaacagaauccacaaauagauccugucaguuuuccuccucagcgccuuccaagaucugagagugcagaaaaucacaguuaugcaaagcauucugccaacaugaauuucucuaaccauaacaauguuagagccaauacuggauaccacuuacaacagagacuugccccagccaggcauggagaaaugugggcuaucuccccgaaugaccgacuagugccagcagucacucggacuacuauucagagacagaguagcgugucuucaacggcuucuguaaaucucggugaccccacaaggcguacugaaggagauuacuuaucguacagagaguuacauucaaugggaagaacuccagucaugucaggaucacagagaccucuuucugcacgagcguacagcaucgauggcccaaauacauccaggccucagagugcccgucccucuauuaaugaaauaccagagagaacuaugucaguuagugauuucaauuacucacggacuaguccuucaaaaagaccaaauacaagggucgggucugaacauucucuguuagauccuccaggaaaaagcaagguuccucaugacuggcgggaacaaguacuacgacacauugaggccaaaaaguuagaaaagguaauugaacugaguuuuucauucucuuucuuaauuuauuuuucuuagaaaugguucauccuuuguuuuuauuuaguaaaacaagacacucugaguuaucuacuuauagucuguuuuccccuguuguugggaacauagcucuauauuuaacugaagucaggacaggugagcugguauguaagcugcuuuagaacucuucaagucuucgauggacaugcuuguaugucucuuguagcuaguacacacauacaguauguauaccaucuauguucauugcuuucugcucacuaccauugauuauguaaauauuguaagaaaauagcaguuuaguauauaauuacuaaaauaacagaaaauguauuucuaaguguaaauauuucaucaaaacaacuuuuuucccuccaguuuguauuaaaugaacuaacaucaucacugacacagaugacucuggcauggcauugcucuugacauugcuagauugcauuucugguguacuugaacaagucaguugaguguuuuguggcuguacuacaaauggacauguugguaaaauaacuaaugcuuguguucuucauaacauuauugguaaauugugucuuuugaaaggaauuaacaaacaaaauccuguaaaguucaucuuacuacauugcuacauggcccaaauguauaaaaaacacucuuucagccaggcauggcaccaugacaccuguaacugcagcaugugggaggcugcaggaacaccaccaguuugaagccagccugugcuacacagugagaccuuguuucccugcccacccccucccaaauacuuuuuuauuaagacucagcacacacacacacacauauauauauggauuuuauuuuuaaauuauaauuucuuuacuuauuaauuauaugauaaauuuuaaaugcagcugaacauaucuaaucuauuauuuuuaaauuccuuaaauauuuuugagaaaaaaaaugcauaaaaugugauuacuaccuucuauccaguaacugacauuguuacauuucagcuaauuucugugagcuguagcuacuucaucuuuucucuuugcuguaacccuauagcacacuguugaggcuauguucauuuuguugggaauuuuaaauuuucuuaagcugagaguaggagcaugguucuaauuuacaauaaacauguauugcacauguagaaauggauuuuagaaggaaaaagguauugucaaaggggcuguuucagagacaugaguaagaaugaaugaaguauuuaucaguuuauugagauacaggaugaacucaagagacuuuugaaguagagucgacauccuuagaauuuguuucugucugaauauucuuacagucacuguaaauaagggguuuguguaaguggcuguuaggaauuccacuauuagcagauauaaaggagugguuucuuauguagaggaagguuuuauuugguguaguuuauaguguaaguagcuguucucucacuguuguguuugacaugagugugucuggacuucaggaaauaggaagcaaguaacaccuagcucauuauugagugagcuuuuuagcuuuucuguuuccuauugcauaaaauauaaauuuagaaauuugauacacaguuuuccuagaaaauaugacaguaguuuuguaguugugucuugaaauucaaaaacuaauucagugaauuaaugaaauagaaaacuggugagaacagaaacgggaacacuggacacaaauccauagcugacaagauagcucucuuuccuaagauacauaaugcuuauuuuaaguggagcuguccuugcuguguuaacauuugccauaccccugccucauagaguacuaaaugacuaauuaguaugcuggaguauuaggccagcucacugguuaggaaauauuucuagcaaauaccaaaauagcauugcuguuacuguaggucuucuguguucuuucuagacuguauucuucagauuuuguguuuuuguuuuuccucuucaccuccauucuauaguugaccuagaaccaaccccuguuuccacacccaacugcuagucuuuaaauguuuauaaacuacauuuagugggguguguguguguguguguguguguguguguguacauguacaguggucagagaaaaacuuaacagggaucaccacaacaugaggaacacauuaaaggaugucagcauuaggagguugagaaccccugcucuagaaccuugcuaacacuaaaguauguacugagcccugucuuugugcuaguagauaacgucagcagcauugaacagcaauccuaggacauuaugcuuagcguucaaucaaguuaacauguuaaaaucaauaccuuaaaauccacaaaauaaggaguaacaauuuuauaggguuuuuuccuuuuacgauuccuuaucuguucuugauauuaucaacuucaaaucuaaagaaguaugauucccaauuguaguaacaguccauuccuuaaaugugguuuaccuaguuuagccaucaagcccacaucuccagcuucagggcaucugacucuuccuccuggucucuguggacaccugcauacauagcuauacauacauaugugcacauguacaaacaaaaaauugaaaaucuuuuuuaaaguugcaucuuaaaauuuaaaauauuuuuuuaaauguggaaaauaauuggcugaagcauguaugcuuaaauguugacauuauucaacaagagaauuucuguagaaugaaauagagccuucagaaacuugacucagaauuacuaauugcugguaaauuaaucuaauaauaaaaaguugcuuauauacuacuguauauacauauguauaaauacauaucuggguauguguccaguuucuauuucugacauguauuaggcauaaaagaaaugacaguauuuaauaaauaaaagcaacuauauauuuacacuuccuuuauucuugaacaucugaaugguugugauuauacguguucuucauguauaugcucguuguuauguagccguauguaccaauuucucucgggcucugaaguccaguguugcaugaugauauuuguucgggcugugggugggguuacuuguaaauaaaucuguguauauaaccugucuuguggauuuugcaugcuguacuaaucucuguaaaucuacccucucuuuauucagaguaugcugucaagguccuuuaauuccaaucuuacugcuguaagcaguucucacuauggcagcucuagggaucugcauggcagccagggcagccuugcccugaguguugcagacggaagagguucuggugggcacauuuuucgagugaguaccugcaguaggccaguacuuuagcacauggacaagagaauucagaucgccuuuuaacauuucuaagggaaaauuuucugugacuuagaaaucuuuguauuuucugaguucuuuaugacuuaguucuacaacuucugucccuguuucuuuggucauauguuaaugaucuagccagcuagauuuauaagucuaguaauaagcacuauaugcaccaggguuuaauuauauuucacagaauaugauuaaauacgagacuggggaaguuauaaaaguaacaguguaaaggaaaaaauccaaauacuuaguugaacacauuucaucaugguccuuaguggugaaagauuuauuacucuaguguaaauacaagucugucuuggcucaguuaaggacauagagagguagcacagcccuaaauaaauccucucuuaggcucugaaagcucuuuauucucuacaacuuauuuuauucuuucuuguggguaacuuucaccuggacucuuuugaucuagguucuuuacuuuuuuguuagucccccucugccuucaucccuggcuguguucugcuaugucccagagcaggaacugugucccagauucaguuuguuguggcugcucugagcugauauuggucuguguccugccauuacccauuacuuggucucuuugcuauuuagcaacagcaaucauuggagcaucuuagguuaaaaggagaagaaaagacucagucagccucagauuucagcagaucaugaauggcauucauagucaccuagaacaauuguucuuuccaaauuuguuuuauguuaacauuuugccuuuuauuuuuaaauaaauuuaaagccuauauggcuugaaguuuagcuuuucacuuaugaucugcaugcuguuuuucaagaguacauaagcauagcugucuauuuaggcaggaguuuaaguuucaagcuuugagcucuguugaucauuauguauucuagaaauauguuacagaaagagaagaaaaaugaaauacugguaguagacaaaauuagaucaaaucacacacaaaaagugcuucaccaaguauugaacuagcaacugacuggauaugauauaggucuguuucuuuuuuuuuuuuuuuuaagauuacauuccaaauccuuaaaauuguacauguuccaugguauauuacaauggaguguauuuugaguuauuuuucaauauaaaauugacauuucuuugcugcuaggaauaugcuauuuugaaaguuuaaaaaaguaaaacauaguguguuuuauuuucuaaauuagguaugcuuagcacuagcuuaauguaaauauuaauauuuuauucacauauuuauaguaauaaauauucaaagagauuaacauugagccuuuuuuuuuccuuuaagguuaucauuaaguuaagcuauaaugaguaaauauuuagcaugugaagauauaaauuaauuuuuuaaggaaauauuuauuuauuuauuuauuuaucuauauaaguacacuguugcuaucuuaagacauaccagaagaggauauuggaucccauuauagauaguugugagccaccauaugguugcugggaauugaacucaggaucucugcaaggucagugugcucuuaauuacugagccaucucuccagcccccaugaauuaauuuuuaaagcauaucuauaaaacagugcauuuaaaauauugagcuaauguuaauguggcagaauuacaacacaccaaguuuuauacaguuagcuuacugggauugcaccucauuggaauugaggguucuguguagaaccaugaggucaaaacaaaagcgguucguuuucuuuuaaucaaagacacuuuccuuagugcuuaaaauuugagacaauuuaaccacugacuauguuuauugauuagagauauuaacuuaggaguauaaauaaaaaggacaaaauaugguauauauuaugguauaauuuuucacauuacaggaacaaaugucuugcuguguaccuuugaagaaaguuaaagguguagcaggcagugaugacuacagcaucuggucugagucuuucucauucugcaguccagcaguaccucucuccuccucucaugugucaucauuguuuuguuucacaucuuaaaguauauuauuuguuuacuuuuuuccuuccucauuugaagcauccgcagacauccaguccaggagaguguugccaagaugauagauucaugucagaagagcagaaccacccaucaggugcacuuagucacagaggucuuccagacagccugaugaaaguaggugcucacgccagagaaacgagcuugcugugcuuugcacuguugggauguaaaaucucaugugcuucgacuaaaaauauuuuaugaggcuuucuugcauucauuauguagaauuuuaaaugauucauaaauacaagauggaauuugacucugcuguuucccaguuugcuuuuuuuuuugugauauuucacacuagagaaucauuuuauaguuacauugguuucuguaguuccaccugcuuauuuuaguauuuauuugaucaagaaauuuuuaguguucuugauaauaaaccuacuugggaagcuagaagaugacuuuaucuuaaauucugcauucuaggaucuuuuauuguuaacuaaaaacauuugaaaaucuuuagguaugauuagaaaccgucuugagacacauuuuuuauauaguagagcaggugauuauugugguuuuuaguauuuguagauaaaaacuuacagauaaauucuuuuaacaaugucagagguaauuuucauucucucucagccauucuuucuuguuuaaaccaguuauauaccucuaguguaaugagauacaacuaugagucauguuuauuaucuaaaacucuuaauuugcucuugaagguagccauuuagccauaccauauauaagcuaauacaugcauauuuauuuuaucccuuuuccuuuuaauucagaguuaucauucaguuccucuuucuuuucaacaugcaucuuuauaacuuaguucuuaacuuuuuuuaauuucaugagacauuggcuaaagauagccuaauacauuucuuauauuuaauguugauuagacaaaaccaaauagccaggugucagcagcuucuaagacuaggauaggcuuaguguaguaaaagcacaugugccuuagcacuugaaacccaagacugguggaagaucaagaguuugaggccagcauggguuuaaagucagggagcaagcaagaaagacaacuuaguggauggggcagcuguccucaagucugacagaaugaguucaguguccagaaccuacaugguggaaagagagagcagacucgugacuuacauacgccacggccaugcgugcaccuacacauauucaaauauacacacauaaagaagucuuauuuaccagcagcagcaacgccaggcugugguggcgcacaccuuuggcagcacuugggaggcagaggcuggcagauuucugaguuugaggccagccuggucuacagagugaguuccaggacagccagggcuacacagagaaacccugucuugaaaaacaaaaacacaaaacaaaacaaaacaaaaaaaaaaaaaaacaacaacaucagcaacaaaaagaucuguucaguugucuaggguguggaguuguaacugguacagaguauuugccuggcaugaagaaggccuuaucuugguuuuugucaaaggaagauaaugaaaucugcauauggaauaaaugauauaaacagaaaaaaguaggggcccuguagauuuuucuguaaauaauaaaacaguagcacagccagguagagcaccuuuucauagauuuguagcuuuaaaucuacaguuauccaguaacgaauaacuauaguagaucuuuuuccagacauauaagcauaacuaguacuuaacccaacauaagauuuuacacagaauauuuucauuuuuguccacuguuauaaacuacucauguauuguacuagacuugagaauuaacuaaaauuuuagugugacagugacaaaaaguaguccuuuuauaaugucuucuuacuaaacaacaaacuuuuuuguauuuuuagcaagauaaauuucacaacauacaguucaaacuucuaauucuggaucauuuuaaggaaauuuguuuucuguuacuuucuucuccaaaaaacuuuccuguuagccagcaaggaaauucuaagugauuaaauaauugaagcauuuauuuucucuucuguguaaaagucuuuuuacauaugaacauuuauaauguaggcuuaauuuuuagcuacauucuucauagaauagaauaagcuauuugcuacaaaucuaauccuaagucuaaauccagggucaguuucuuaacacaugggugguauaaaaggugguuucagucuggugguggguuuuuauccucuuguggaaaauaaagugaaacaucaguacugaagccuuggguuuuuaauauuucacaaagguaacauuuagagagcuugaaaauuccugauaccuggcacgcauacauaaacaauaaaucacuuaauuccuguguagauagcugaauugacuuguuacuucugaaaaggaagaaauaaagguagcagauauauucaaauuaagaaaaagcugcacuccugaauuuuuuuuccagaggaaaaacauaaaaaaaaaaaaaaaaaaucuaccuuuuuaggugagcagugaugcuuaaucccagcauuaaggaggcagaggcagguggcucucuggguuggaggccagccuggucuacugagugaguuccaggacagacagggagagaaaccuuaucucgaaagacaaacaaaauacaccuuuugugcauguguguuauaggcuaacaaguuuaaaggguuuuuuuuaguauauaaaaauuuguuaaaaaaaaaaaacuuguuuuauguguaucaauaguuaagguuuuuucaauauacuuguuuccuauuuuaacauuuggucaaaguaacaauagauuuauaucuaacagaaaagcauuuaaaauauagaugaggccuucauuuaaaaguuuguuguuagauucaaucauuaaacauucaaaagacaguaauaauuuuucuuuuggaaaaauaguuuuuaaaaauauaaugguuugcaagaauaaagugguuuaaugguuuaaaagacucuagugaguauugaaugauguagaauguuaaaacgcuagugcuuuuguauuaaucuaaggagaauauuaagauaauucauguuuuucuuagaugccuuugaguaauggacaaaugggccagccucucaggccucaggcacauuauagucaaacccaucaccccccucaggcaucuguggcaaggcaucccucuagagaacaacuaauugauuauuugaugcugaaaguggcccaccagccuccauauacacauccccauuguucuccuagacaaggccaugaacuggcaaagcaagagguaagacucaucaagacuguuugaaguaugaaauuaaacuuuucauauauccuuauaggugaauagcaauaacuccauauagaauuuuaacaguaguuuuuaccauuuuguuuuauuuauaaaguuuaguuuucuaaaguauuaaacuuuguaguuuuuaacuuggcuguacaaucauguaaaauaagauuuaguguuggggugugguuuuuguuuuuguuuuguuuuguuuuuuauucuaaggcuauuccuuguacaaaauagauugauguugcucccguagauuuucuucuaagacuguaaauaguagaccauuuaguuuccauucuacaccagagucuuggcucuuaauagucggaaauucagcuauagucucgagacuggguugaagguuuggucuugaagauguauaggucauaauuucauaugccuuagugguuuauuuaugagaugauggugaugaugauagcauugaacccuucgauacuggucacauuuuguuuugacugagucuuuguaaacaggagcauccuauaacagaaaguuagcuucugucacccacaguguacagcacccugaaggcugaagcuagagaguaguauaucaaggccagaguggaucaucagacaguacagacuagcuuaggcuguuuagugagacccugugucaaaauauaagccagcacuaaagggccagaggcaggaggaucucugugaguuuaagccaaccuggucuacacagcagauucuaggucauccaggacugcauugugagacccuaucucaagaacaugauucuggauucucauuuuacagucguuuauaaaaacuucugucaguugaucugacuuugaaauccuaacuccccugaagcauacaaacagagggaaugaggaguugauuucuucaauccagcucugaacgucauaaguaccuuauuaugacauauggcagugacgguauagaauuuagauggucuguaagugaaaacugaugggagggaauaugucuguguguucuguagguaugcaccaugccauugaaauucaugcuggcuaaaaguuaaaauagggccaacauuaguugauugauuaagcucauauaagucguaaaguuaggagcuacacuuuguaaucccacugugccuuuaacucacuaacucauuaacauuagugcuguucuguguugucaugucaccucaucugcccaaauguuuauuuuucaugaauccuugaauauucugcuugaauuuaauucaccaggauacaaauagauaaauauaguaauauuuccuuuauguucauauuaaaucagauucgaguaagaguagaaaaggauccagaacuuggauuuagcauaucaggaggugucggcggcagaggaaacccuuucagaccugaugaugauguaaguugcuuuuuaauaugucuuugaacauucauaaggugucauuuauuaaucccauaguuaugugaaaauguaaaucuauauggcucucauucuuuuuauuuccuuugguuuuugaaauuugaugauuccauguugucugaagcaaagaauuuaaccaaaaaugugaauauugaugauauuaccaaguuauuucuaguuuuguuaucgcucuccaaaaagccauagaagugauacugcuacauugauagucagaagcagaaauuauuuugaccugucagagaguuacucugaaaagucaaggagacaguuuccacgauauucacauauuagcauguguugaagaaaagguuuuccuuguuauugauucaugauuucaguuuguauuuuggcaauaaauaauuauuuuuuguuauuguucauuaaaggguauauuuguaacaaggguacaaccugaaggaccagcaucaaaauuacuacagccaggagauaaaauuauucagguaauuaagucaaccaccuuuuuauuauuuuuucauuuuauuuuucaauaauuuuauuuuacaauacuuacuaguguuuauauacuuuuuauuuuuaaauaguccuaccuuauacauugaaaaucaugauuauauguuugauaugucauuuuaaguuuagaaauguuaauguuuacugauuuagaggaucugcuugguggugaguuaaucaguacaucaaagaguaaaauuucaaaauuuaagaaacuuuuuuucauuugcacuuuuuuccuuuguuccuucagucacuuguuuuacaugagcuaaagcuacuuccucccucccacucuaccuuuguuaguuccgauagcaacaggaaguaaccuucaaaccaaaaaugauggaaacauuagaguuuaauaacugaaaguagagauuucagaaugaauucugcucaacccuucuuaaauguuaacuuagugccuguaucagcaguacauagaauaaaauugaagugauucaaacaaugacaugcaaauucauguuaccauaauuuuuuaauuuuuaauuuuuaaauaauuuucuaacuccaaaaacucacaagaaccauguaacaaggugacuguagccaggcagugguggugcacuccuuuaaucccagcacuugggaggcagaggcaggcggauuucugaguucaaggccagccuggucuacaaagugaguuccaggacagccaggacuacacagagaaacccugucuugggaggggaaaaaaaagugauuguguuuuguuugccauacucaucuguaguauccacaauuauuuucuaacacacacacacaugguggggagagaggagcgauuauucugauggaauucugugguuguagaauaagagcucaauaaauaacagcuagcugaccagcagaaaagagcgacaacacuauguucuucucaaagcaguuuauucaggaaccuuucaacaucaugcaugaaucucucuccagaaaucaaucucuccaggaaaaaacaacaaccacccugcccccaaucgcaaucccuuauauauucucucaaccacgccccaucagcccaguccacguaacagcaguccauuggccagaaucaucacuugucauaugguccgaucuuggaucguggugcaccugugcaguucucacgauggaugcagcuuauuuucagguguaugaggaagucagguggaagucauaagacuuggcugcagucccgggcaccaucuugggacugcugccacacccgcuccucacagacauugccuucagguacccucgcaguuugguaaggcuggguguaccuuaacacacacacacagcaccuugucugauccugucuuagacaaguacuucccaacaucugaucacuguacuaggauuaccuaaggggcugaguaggaggcucauuggcuaagaguccuggcuguucuuccagaggaugcaggguggguucccagaaacagccaucagugucagggcaucugauacccucuucuggccuccuuggguaccagaaaucuagacauugccuuuaguuacccucacaguuugguaagccugacacauuugaaggcagaauccccauacauauauaaaauacaagcuccuggguucuucagagauuguauuuccauauguauacacuguagagaccauuagucuauuugugguuuuguuuuguuuuuuuuuuuuuugcauauguauguguaaagauaugugcugcacuucaugaguguagaggucagagaacaacuugaaggaguccguuuucuccuucuuugauggugguccccagaaugaaacucaaggcuuucuacgugcaauuaaguggccuuacucugagccacuucaucagccaauguguucuuuuaaauugcuagaauaguucuuuuuuucugacagguuuaugaacuaucagaaaaugacaucuagaauuacaaauacauuucuaaaauuuuucuuaaaaguuuuuuuccucuuucuucuaggcuaauggcuacaguuuuaucaacauugaacaugggcaagcgguguccuuguuaaaaacuuuccauaaugcaguagaucucaucauuguacgagaaguuucuucauaagcacuauagacaaaaacaaugggggaagauagcaagauuuauggaagacacuugcaagggaaaugacuauuuugcuuauuuuuauauauaaagaagaacucaaacuguugguuugaaacuuguacauuacugaaauaauggaccuugugguuagagggaagaaccacuguacagaagaugaaaaagacuguuggauucaaaucagauaaaauuuguuguuagguuuuuuaacuuagcaaaucaaggcuacaaaaacaaaauuaaguuguuuuuguauagauuguagguuuauuuuuggauuucauacacaugacugacuguaugcaaggcaauaguuagccuugauguagccccgagacagauggcagagcugucuaucucauagcuuuuguguccuuacuuuuauccaacugguauuccuguuuuuccuuguggguaagagauuugaaguguuggcuuugcuaugugcauacugaggaguggguagaugaaguugaugcugguggguucacuuuucaaggccagauuaaagcauuauuuccuauaaaaaucugaggcaaauggugaaaaaaaaaguuaucugauaauguauuuuuauuaauagaauaaugcaauaacguauguaacgucuuuuuaaaagacaauaauugcauuuuaugagcucuacaagaucaagucuugucauagcuguugacuauacauuugcuacuggugauucaauuuuuaauauuuuuaguuacugaaguuuuuaacucuaauguagaugcauguccacgcauuucucauacuaugaagucccgauacuuuuuucuuugauaaauggugguacuugcaaccuaauuuuuauaauuagcgcuccaucauaaucuaauuuauaauuuuuguuuuaagaagcaaaugaaacuaaaaagccaguuuuaaguuuugugugucgcccauaauacaaaaugucagaagguuuuagaaagccucuugguuuuguuggccugguguugccuugguaaagugagaggaaaugugagugugcauggagcuaggaaaccaaagcaagucugugagacuggcacagcgauggggaagugcugcagagagugcagagcccaggggguccccgaggccugccagaguguaaaguguucagauaaagggcuguucuacagauaacauucaaugugaacuccacacuucagagucuuuaaaggguuucuaaauggaccggugugauagcgcuuuaccaccaauugccuuuguuccuuguuacuguaacaaguauugaugauagaaguuuauuaauuuuguuuauccaaaccauuaauuuuauuugcuuucauucuguauaaugaaauuuggguaacaugcagugguaagaaguaaugcauggcuauuuggacugagaaaagugccauaggagaccagcaacuguuuuuaguugaggcuagucugaaaacuuauuaaagcaauacucaguucuuuaauucauuuuuuuuaauuuccaagaagcauaauuuggguauuuuuaauguuuuaugcucuuuucuucaacuuugauuaguugagauucuuauaggacuagcuaaagcaccaccuacauuauuuuuacacaaugaguuggacucauuuccauuucuagucaaaauagucagcacuuuuaaaaauauuugaauuuaaauauugcacuucuuucaagcuguuaucaauuggguauuguacuguauaguuuuaauaauuuugauugaaacccuuuaacaacucuuuguaaauuuuaacucauuuuuaguugauuuucaguacuauuuacauaggaauugauuuuuaugaauauaguagaagagaugugcuguauuuugauaaaauucacuuguauguguuguaaucucuuaaacaaagaaugacaaacagcuucuuuaaugcgagucuugguguugccuuuauucuuacuucauguuggugcugcaagguagucacauucucccuuuacuggccccacauuuucacagucacuuuaauuaggaauaauuaagacacauauaacugcacaauucucagugaucuuaacuugcaucgcugauuauaauuuuauagaaggaauuaggcuucacagagucggcuuuggugauccccucugcaugguccauugagauaaccacgcgugcagcagaugugugcuagaauucuggcccacuguaguucaguuuaggguuuggaguauucuugaaagucagguaagaaacuuugcuguccacauuuggaauaacauagaauaaaaguaaaauuuaaauaguaaaaugcuguacuuaacaccccaaguuuucuuacagaauauuagaggguggaaauuaaaauuucuuugugagaauuuugcuaacaauauuauaguuugaaugguaaucuguaccuuuugaugaaaugcagaagccauuuuuaacuuacauuguuuacuaaauuguaauaagaccauccucaaaacugauuuuagcaccacuguguagcagguuuucaaaaccagcuccaucuuguuuguaguaacuguuuaaaugucacugaggggcucaggagaugcucagucaggaaggugcuuuccacauaagcaugagagccuaggacucacaugcaaaguccaugcaaaacagcaccuguauccccagcgcugaggaggaagaccagccacagaaucugaacugcaaguucagugagagacccugucuaaaaaag

SEQ ID NO: 7209 - RNA, 31714 nt, Mus musculus
cugcuccgccccuggggcggauccagcaagcacugucguccgagagccuugcgagcagccgggugggcugagggggcggcggcggcggcagcauuggagcgggggaaguuugggagccguggcccccucugcgauccagaacaccgcucaagccccgaggaccgcggggacaggcggacccgcuucccgacgcccccgggcccgcagccgucaucucguguccucucgugguaaggggcuucucucuggaaagggugcgucucccgcagccccagauggaggccugcaccgcgcacccccugcaaacacugucugggcugaggcaaagccgggguacaacggggagggaaccaugggggugggagguggaugugauuggagauguaggaggggaagcuuggaggagguuggacagcucuccccacccccauucuguuucccucuucugccccggguccuuagucagagagugaaauaaccucucuggccuagggaguagauucgccuuuaaaagaaguacaaagcuaauaaacauccuagaagcggguaccacacccuggcugugaauuagggaucccggggagcagauugcugauacgauuuaguggaaauaagccauuaaugccaccuggcccugcgccacuguuuggaugcauaguauuccaugugaaugaacgcggccaggagcuuccagcuuguccacgagagcacagcuacugcaggcaggggcagaucgguuuguacuaucuaucggguuagacggugauuucugaccaguguacugauuaaauagaaacgccggguuuuaacaauaacacucaaugguugaauaaccuuuccacagagccuugucgucagcaagugacucuuaaccuacaaaaguaguagaguauaaaugauuaauacauuaaaaaaaaucucuuggaauaaaggaagaugcucucacuauggcucacauucugagucagcaguacgagaucucccucaacuuagaagcgaggccuuucaagggugauucuccauaugucugcacuccuauacuuucuuguaucuguaucauauaugcuguuaagacacggugagcucuaggcguugcuacacauguuuugaaaaucugucuuuguuauuuuuauuuuuuuacugaugcaagcuuuaacauaguugaauagugcugggucugaaugagcauguggaauacaugacuauaaccacuugugcuuucuggacccuuuaaagagagaaaaguaaucaagguaaugaauauuuuugcuuuuauugcuuugaacuugguggaugacccuuguuauuuucuucuucuuuuuuaaucaaggagauauuuaagcgucuaaaaugucaucugugaagccccuaguuuaugcaguuauucguuucuugcgggaacaaagucagauggaugcauauacuucugaugaacaagaaaguuuggaagguaggcaccuauuguuuguguccuaauuuuguaaagaaauacuaaaauagcuacaauccaaagcuuaugguuuuuaauaacaaaaucagaauauuuuguugagaggcuuaacuagauauguuauuuccauuuuuugagguuuguuuuaacuaauaggaaauaggacuauuugucuacugaaaaauuacugucagaaguaugucauucauauuuuagggaaguuuuucaucaugggaacauuauccccaaugaacagacuaggaaauuagauuguuuaagcagcagaacggcuaccauguaacaaagcugauguuuacauucaaaucuauacuucaaagauuucccccuauuuuccuaauagcaaagaaucucauucugaacauacgaaaauaccuuagucauggcaauagcaccguguuaaaaacaaaacaacucaguaauuaauuaguacuguuaccgaacucuagcaaacggugcuuuggaggaugagagaauuucgcccuuguuuuccgugagcuuuaaaucuuggauucaguaaagcuaagcaggacuggaggagcaccauggcauuuccuugacgccaucacuucauguuuaugcauuauaaaauuuuaacucgguauagccauaagaaggcaaaacgauauagacaggcuggugaaaguucagugagccuagcuuccuuguggucugcagacuuaauuaucacaaugggagcacacuggggagagcuuaauaaauagcaggcagguuggaauucccuucuccgagcugccucuccuauagaggggaucaucuauuaauucuguauacuuccuuugucgacaugcuuuaaguuagauguacaucaaaguuggguauuuguuccucuggugagaugaugucuuuccaggcgacaaugagaggagggggugaggcacagugggaggacauugcaaauucgcccauuuaauauuaaggucuuuguccucucugaucaucagaccucgggaaagauaaagguaguuuggcuaucaaaggaaagucuugauugcaguugcucuguagcaacagaggaaggcaaucacauaauuaaaaaaagauauuucucuucucgucuaaggcaguaugauguuuuuuuuaugaagaagaaagaaaaucgagaguauuuuaaaaaccaagauguuauguccuauuuuuagaguggcauucagccaaaaauaugugccuucagcuguuuguuauauaugaagucagaaauggugccaauuguuugugacugaccccuauuuuugacucugugagucuaauuuaauugaacaugaaaucauguggaguugucugcccaccuucuagacauuuaaaaaagccuuagggaaggauggguuguuggagcagcagcuuucccacugugcggagccccguucuaccagcuuugcuguuuguccccagaguccugauuguuguccucucugacguccucucuguuuguugugguuucagcauccugucagucacucucgucagucacgcuagaaagcauuacuucagucgucaguaacuccuuccaaucccgacaaacucccggaaaauucuugucuuucucuuccacuggccucuuggguuuuucugcuccucugaucucaaccgcuugguuguacagcagaucaguguuucugaauucaggggaguccuguaaaguccggagacauguuugcaugucaccaccuuuggagaggcugguauuauggcuucucauggguagaagccguagaugaugcuaaacacuugacagugcaccagacagcucuugagaacaaggaguuaucugaucuaaagugucagggugaugagaguuagaaaccuuuuccuagacuguaucauccccaguuguauuccacuggccaucucugcucucagcacuuuccuccuggcuccuacugccugcguuucuagcacccuuccuccgcgauccgucguaccccaacaauucuuugaccaaccucuccagucugcugaucccauacuuuccccuaccucuuucuuacgugucuuaaauucuguggugcauaguuaugauauuuucuuguauuauuucuccugucuugaaauaacugaaccuuauuuaauuuuaacucucuaccgacucagugucuauauccgccugacgauaaauuaauggagcgaaauguacaacuuugaugacuggcuauauccauucaugacuguguaccucaagcagaccuuuaaugcugcugggugaucagaguauuuguuacucauucauucauucauucauucauucaucccuuacugcccuacgugucauuuuaauauguucuuucaucuucugaauccccagacuuccuuuucagccuuuacccuuauaugcuuccuucaccauaaaaaaaaagaauaaauaauaauaaaacaacaucuaccugcuucuauacucugcauaucccucgcugucaguacccacaugcuuugccuagcugccugccuguugccauagguggacuagcuguauucccuucucagagaaaucucucuacuggcacauuuugucccauccccucucaccauccaggacuucacuguaguuucuucuucccauuuguccuacgucaucaaauuuucacuccacugaaccauuuucauuaaaaaaaaaaaaaaaaaaaaaaagccaaagaaacaugagcagggcuggagacauggcucagugguuaagaggacuuguuguucuucuagaggccccagguccuguugaaaaugguucacucucuucaauagcccuaucugaugcccucuucuggucucugagcgcacugcauucacaauugauauuuuuacacacaaacauacguaagugaaaauaauugguggagggggccuggagaguuggcucagugguuuagugcacuggcuguucuuccagaggaccugaguucaauucccagcauccacaugguggcucacauccagugcucucuucugaccucugggggcaacgggugcacauuugcggcacagagauauaaacacauacacccauauacauaagaauauuuuaaaauggauauucuuaugguucuguucaaucccgcuuaucguuuuuuuuuuuuguauuccuuuguaacaaaacuauuugaaagaguuguuuauacuuauuuuuacaauucucuuauuacuuaauuuaaaaaaaauaauccuuuaucuccauccuuucugcucuuauuaaagguguuagugauuucuaugucuaauuaaacaguucuuauuccuuaucugacuuuuuuuuuuuuuuuuuaagacaggguuucucuguguagcccuggcuguccuggaacucucucuguagaccaggcuguugucaaacucagaaauccgccugccucugccuccccagugcugggaugaaagguguguauaacacugccagcucuucagccuguuccuaaguauuuuccuucuagaacaccuccuuauuccuugcuuaucuucucauccaaucucucauucuuucucucuauggcugaaucucuuuuuuccugacaucaugcucagagucgacugcuuggauaguuugucugucugucugucugucugucugucuguuuguuuuuaccauuaucuacacucauuucuuugcugagaauuuguagcuuauuugccugaacccacauuuguaugcugauaguucucagcacugugcccccagucgagcccuuucuucuauauccagcugccuuccccacagcucuacuugcaugucuaguacgcuucucaaaauucacauugccaaaacugaacuugcagucuucccaccuaaaaucuguucuacccacaccuccccugucuuagagagagcagcuccaggguuuccugagcuuaggccaaaaacuugggcaucauuccagggucuuguuuuucuccuacucuagaucuagcuguugguaaaucuuguugucugugccuucaacagucagucugccuuucuuucucaaggucuccuuguguaacuguauacuggaacucucuguauggacuagguuggcuuuagacucauagacgucugccugcuucuacaucgucaguguuggaaauaaaggugugugccaccacaccaggucuaaaagucuuuccuuucaaaaugcaucuugagucagagguuggggaauauaguucagucauagaaugcuugccuggagugugcaaguccccggcacugcaaaaacaaacaaacaaacaaauaaacaaacaaaaccauaaaauacauuuugagucuaaacacuuuuaccacuuccaccugauaucucccauggcugaaacugcuuguugcuuguucuacugugauaacuccugacuggucuuucuucaccugcucuggcuccuuggacuauccacauucaaacaucucuuaagucuauggcagauucuguucuucuuaggcagaaucuugccaggacuccuuguguuacuuagucauuguauaaagaaucuauauaauuuggacauauuguccaccuacuguuuuucauuuagugucagccaaauuagcagauccuugugccuaaaggcguuugcgcuggcuguuuccuuggccugggauagccucuccucaucucuaccugcugcagugauaacacuuccaucuccuccaagccguugccagauuucuuucucaaggagaccugcccugaacucuuaaguuaaaucugcagucuacauuccugcucagcucuugcccucccuagccuccuggccucuguuucuuauuaugguucucaucucaaucccuucuccaagagguuaagcgcccgcucacugcuauagcaaguaucuagaaagaggaccuacaugugauagguauuacauauauguauguguuggauuggacuccauaaucuuggccuuuuacuuaguggguuuguaucuugguuucuaagucuagugggcagaauacaucaaccccuccacauagcacuuuugugaagugaauccauccuguuuguuuagcuuggaaguucuggggucugguuuuuugguuaauaacuugcuuuuguucucuugaucucuucuugugucugugaacuuauguuuggguuuggcuggcuguuuagguuuuggcaggcaggagaaaugcucucuacccugggccugaucauuuucgguuuccuuguuugauguuugacuguacacagagaagccaacagaucccauuuguugaccauccauuacuugccagacuccgguaaagugaaagacaaauauguucauaggcccgguccucaaggagauggccuaacaugagacacauacgugcagaccaucugacauagagugaucuuuccaguaauggaacccaauaaacuacacagaaugauagucuguggugggggccgggggggggggggugggcaggggugcaagaguaaaugcacaugcauuuuuuauuauuguauuuuuguauuauuguaaguaagugccugggcaaggagaagaccugcaguccaauauuuuaaaugcagcuucaucaguuugggagaaauagaaaaggagaaggccacauuguuauaguucuagcuacugaggagggcaaaauaucaaaacacagcugggaauagaaggaaguauaagaaaacauuguuuucucccuaaacuauacuuuuacuucuuauccugagaacucggugcuuuauucaggccuguucuuuugguuguuuuguuuuguuuuguuuuguuuuguuuuuguuuugacaggguuucucuguguagcccuggcuguccuggaacucacucuguagaccaggcuggccucgaacucagaaauccgccugccucugccucccaagugcugagauuaaaagcaugcaccauucguucuaaggacacuuuuucuguggcuacuaagaguaauaguauuuauuuuaugacagggauacuuuccucaagacuacaauuaauauauaaggcaucuuuuaaaagucucacagaaaguacuugcaucuauucauaguguugggagggcagugguagggcugguucuuaucugggcuccucaguccaguguaucauuugaaugggagccugcccaccugguuuccugcuucucucuccaggcuguucucaacauucccaccggccguuuaguucuaagcgcagacaguuauuuuccuucacuagauccuugaaaaccauccauuucccaguagcacagagucccgcucuuuaaaaaugucauugaagcugccuugugaucugcugucuuugauucuuacauaaucuccacuugugucuuugcaucagucuguaccuugcacccuuccuguaccaaccaguuacuuuguccuccaccaaaaauagaugaggcuacggucaucaaugagcaugcuggauauuuugcuucauaauauggacagugguuuguuuuuccuguuauguuuauugcugucccucuaacaucuuggaacagaacuuuacacauaguaggcucacaguaaauuugcauaugugaaugaauauuuuaaaauagacuuuuuuuuuuuucuuugagacaggguuucucuguguaguccugguuguccuggaacucacucuguagaccaggcuggccucgaacucagaaauccgccugccucugccuccccagugcugggauuaaagguaugcgccaccacugcccggcuaaauagaccucuuuucauguuacuaugccaggauuaauauuuagugccuucuucaggccaaauauuacuaauguucaucaaguugaaaucuuguuuuucucauauaaaagauguauaacauuuaguuuguucaaugcauuguugguuaauuagacauuacuauugcaauguaagaaguuaauguuauucucuucuuucugguaaccuucaacaagaauauaauguacuauguaucuucagaaauuauauucuggcuaacauuuacauuuuagagagagauaagagauuacugucuuucugcaguagcucaucuauaaacacaaaucuuuaugcagcuggaccaauuaguuuucuuuacguucuuugaccauaaacacuaauuuaccaaagauuacauuucuauaaggaaacccagaaggcuccuuuguaaaguugcuaaugcucacugcccuuguuuuauuucuaguugccauccaguguuuggagaccguuuuuaagaucaguccagaagacacacaucuggcaguuucacagccuuugacagaaauguucacaaacuccgucuguaaggucuguaggcauuuuuucuuucucguuaguauuugaugcaaauaugacacaauuuuaucuuggguucuuacuaguugaggggcuggguccacaaauagccuggguggaaagaaauagauguuauggauauuauuuaggaacuaaaauauaccucacuucauaugcauaugcuuuagauggucauauuagcagccuuucuuacauccucaccuugccuacuuugaagucuuuuauaguuuauuuuuauauuuccaagaucuacagugcuggagagauugcucagcaguuaacagcacauacugcuuguucaggagcccugggcuguguuccuagggcccgcuuugggugcuguuguucuguguugugguugagcuuugcuuaaugaaggguuuuggaaugaugcuguuacaagaaguguaagcucagcuucaggugggugcugcugaccgcacauuuagccgcagucccugcccucuguuucuggaacuuguccggaaaagacucuuugaguacuuguaaugaagaugggcuuugauaguuuuagucuuagaagagaugagcucguaugacaagauguagggagcuacuuugcucuuccuuuugucuucguacuuugauuaagaucgaacccuuugucuuuuucauuguguuugagcuugugacuuccugagguacucugcuuuggucaccaaauaaguccauggccaaagcagaucuuuacacucagguucccaagggcucuguguccggcagcacuugaaauuugcuugcuccuuagcuagugucuccagugacuuaggacugaccguaucacagccgaugaccauuauuccugucuuccaggaaccuccaguugacuucuacacucccuuucacgaaagcucuguugcuguaguucucugauuggacuuaauugugagagaguuguuguauacuguuuuacaauguaaagcgguugagagugaaucccuguuacuucuucaggguauuaauugugguagcaucaucccugcgugggucuucgggcugugcuucuccuccucauguuaacacugcagcagagaaagucugaagugugccugaggcagccuugacaucguuaugauuaguuuuucaagugcacuugaauauggaguuaaugacucuacuuuuagaauucugcuuguuucuuucagcagggaccaugucuuggaaccacaguuaagcagugaaggaguaugagugguguuccucucuguuucugugucuugugccccauugaaaaggcuuucugccaaucuuugucaguaauuuuacacuuguggguauuugucuaauuagcaaaguacuuuuccacguuccauuuaucacuuucagaugaaggauuaccuuguauguuaagugccguacauuggcacaaaagcuacaaguuacuccuuuuuuucccuucaguauugcugacuuaacuucagagugaaguuaaaaaaaccauauaauuuuuccaagucuuccauaaauggaaagacacagauguucccauugucccucagagcacaccagaauguucagcuuacuguagaggcgccuuugguuugaaacuucugccuaggagguuugaggauggugguaggugcuggcaugcaagcucaugcuguugcucaucucaccuaugauuuucuauaugacuauaguuuaguuuaaaauacuggacaauacagaaagacauaaggaagagacuuuauuuccaaauauuauuacuguuaacuuuuagaauacaccuuccuagccuuagugcgugaaucaguguuuguguguauguguguguauguguguguaugugugugugugugugugcacgugcacgugcacauuuuuguaugccuuuaagugagagcauuauagaugcucuuuucauugauaaacgguaucgagauacauguuuuaggauaauaaacacacuucucuagaaguuucuaguucugauauuguucuuuguauauuaauuccacauuucauuccuggaaugggauuucuggcuaugggcaaagaaagcucgaucuguaacucgagcuccaaggcaggaggaucacaaguuugaugccugccugggcuaucaaguagauucagagguggccuagacauucuagugggaaagaccuugcccugaggucaggugaaagggcaaaaccuucacucuggugcuccagccaaacagccagcagagcacuggucagcauuucugagguccuagguugaauguccagcacugagaggaaaaaaaaaaaaaaagaaaaagaguugguccuuaggcgcccguuauuaucuagaaaaguucaaccgaucauauuucuaaucaaaguacacgagaggaccuuuuccaauuucauguuagcacuuauucagguguuacauuuagugagauaaguuacagagacaaaguuuggagcugagacgaaaggauggaccaucuagagacugccauauccagggauccaccccauaaucagcuuccaaacgcugacaccauugcauacacuagcaagauuuuaucgaaaggauccagauguagcuaucucguaugagacuaugccggggccuagcaaacacagaaguggaugcucacagucagcuauuggauggaucacagggcucccaauggaggagcuagagaaaguacccaaggagcuaaagggaacugcagcccuauagguggaacaacauuaugaacuaaccaguaccccggagcucuugacucuagcugcauauguaucaaaagauggccuagucggccaucacuggaaagagaggcccauuggacuuacaaacuuuauaugccccaguacaggggaaugccagggccaaaaagugggagugggagggaggguaugggggacuuuugggauagcauuggaaauguaauugaggaaaauauguaauaaaaaauauuaaaaaaaaagaauuacaggugaguugccgaaacgugugcaguuuauuacuauuuauagauuugggaugccuuuucguguagcuauaaggaaacacuuucugguuccauuucagaaugacauacggccgcuuucaaacucagugcccgaggaugugggaaaggcggaccagcugaaggaugaagguaaauacgccacguugcucuggaggugacaacucugagguggcaguaugauaguuuccgcugaugaggacugcaccauccucaucccuguggcuuuucuggagcggaugugaaugugauggguaagaggccuggugacacagaaugccugucaauaccaaggccgucaagacuagccaguauccacuaagccucacugaauaaauaccuuaugggcuauuuacuuugaacucugcuugcuauuugacucaauucuccuuuauuuuuuaaccaaaaagagguaauuaacuuuaaguguuauuuuaacuuucauauucauauuaauguuuuaaaaggauuuugaaguuuauuaaugcaugcauauggcaucugucuuguuuauuuuauuauauuucaugacauccuuguucuucagucuuaucuuaggauuacauuauaaaguagguuaguuucuguuuucaauuuuguuuccucuaaaaaugauauugucagagugccuuugaaaucuuaaagugccaugaccucauaauuuauacguuaaauaagcaacgcccaaugcuuguugugcuugcgcuguguuucccagagcguuuauaguucagccauccagaggcaaauuguacgcuuuguaauuggagcagcuucuucggaaguuuuccucccacucgggcuuugcauccuguggacacuccugugaugguauauggucuccacugcccugcauggcagcagcuguuuuagcucuggugguagugcucaguacaaggcaaacugaaaugguauuuuuguucuguaugcuacuugcucugcacggcagccuugggaaaugguaaucccugcggagcguuuuguuugguuuuguuuugacacagugaguguuaggaaggugugggcuagagggaggggcagcaugagacuccuugaacacaacagcuggggagacugggucacucccgcuuucuccuuuaacaaaagcuucuggucuucguuucacugagacgugucauaugucagacaugcuauggacaaagucuaaaugauggcucuucugucuugugcgaaaacaaauggcccuggugggucgucaaggauccuuccaggcuggagguguuaaucaaggcugcuucauagcuaggacccuccuggagcauggcuuucggaugucucaccugcuucuuaaaagcggaaggaggcagcaagggcugccagcugccguccccugguggggcugugagagaggaaggagaauagcauguacugcuauaaagugucacaccaaugccuuauugcuguguuauagccacagauuucaucuguauccugaaucucccuauuuaccaucuuauagauggaagcuuucuaaucauuagcuuagguuacagugcuugcuauauuuguaauacacacacacacacacacacacacacacacaccacacaccuacacauuuaaggugguucguaggaaagacacaagaauguuuuaaugucaaugauuguaaaaugcagccccaaaguacaaggucccacagcagcagcagcagcagcagcagcaacaacaacaauaacaacaacaacaacaacaacaacaacaacaacaacaaaguugcucuuuuauuauauacaguccauugguuuauaacauucacagaccuuauggccaaaucaguuauuaaccauuuuuacccauuagcagucacucacauccucaccuacaguagcuuugacucuggaagccuuaccacugccuuucuuucuuuuuuccuuuuuucuuuucuuuuuggcagcucuuacaguuacuuuauuguuauuguuguuguuuuuguuuuagaauuaucuauuuuuaaaaaugugaguauacugcugucuauguugcugucuucagacacaccagaagagggcaucggaucccauuacagaugguugcgagccaccaugugguugcugggaauugaacucaggaccucuggaggagcagucagugcucuuaacugcugagccaucuaucaagccccaguuauuuauuuauauuuuuuagcaacaauuuuccaucccuucccccuuccaaaaccaaaacucaaaacaaaaccaaagacaaaacaacuuuaagcuuacaucugagaguauuacugaagagggguccguuuuauuaauuaaugaagauaaguuuuuaaaacugggcguauuagcugaguugguuuggccagcuaacuucuagcagccguccuagcauggcugcacaaagguguguguguguugaaaggaggagcggaagguccgguccagcucaaggugguagcuaaggagaggggaggaguauggccagcucuaaaugggagugaggaagcaaacagggagagaauacauaucuaugaccuagcggcaugccugccuuuacucccaacagcugaauuucaugugaugcaaauauuaauucccgugacuccauauugucgaagugauucaaucaccaggaaacuaaggguagagucucugugguauaagauaaaacugaccccgguucaauuuugugauugaaaaacacugcgugugaccuucuucguguguuuguaguuucuguggcugagccgcgugggucagacuuugcacuuuuucacacucugcugacagagccuggcccgaucugauugcaggcaauaaccacaugaaagaagaaaauuacgcugcggcaguggacugcuacacgcaggcaauagaacuggaucccaacaaugccguuuauuauugcaacagguaacgugguuccaugucaaccuguucauccugaaacgcugggauucacagcucugaaaggcagaugucuuaugugucuggagaaaaauuugaaagacagaaaaauaagcugaaggagaaaaaggaaagaauaaagcccuaggcuucauucagaggccaccaaucuuuuuaaauuuuaauuucuuuauuuuuuacuuauuuacuuugcaucccauucaauaccccucucucaggcacccccuucauaauccuucuacccaccccccuucuccucugaguaggaguggcucuccuagauauccccucugcauauucucuuaugugcccacccaucucacuuuaaagucuuuguuuuguguguguguuaguuugugcgcaugaguguguuuaugugugucugugugugaguaugugugugugugugcuugugugugcagguacucaugagacauuaugacaagauauaaauauuacuguaaaauugcuugauuauagaguaauacaugaaaaaugugagccuaaguaaauaauuaauuuuucaagagauuagaauucaccaauacucuuaugucugcuaauacucagagauuuuuggugauauuuauucuugcuuuuaaucacuguuaaauugaaauuaaugaauaugcuucccuuucucauuuaaaugggcucuuuccccgaggauucagccauaggacacgcuguuaaauauuaaauaaacaguuagaaagguuuauuugccuuuuucugcuugauaaccagagagcuagugaagaaacagaaggcauuuccagugcuagugaaucagguagauugucguguuaacagcucugcccaugaaacagcaagugacugaaugugggcacauuacgcucugccuccuguuucugcacagacuugguguucacuuuucuuccauccguguagccucagugcgaagucuguuacuuucucucuaggaggcucuugccacugggaugggugggugaaucaccuaaggaauagggaggcagggaacugguauggacauccacaggugauuuggaaagaguuggaagugguuuggaaagacacggaauuugaauagagugaggaagauggaagacauuucagguuggagaauguaauuuaaaauggagaauugggccgggugugguggcgcaagccuuuaaucccagcacuugggaggcagaggcggauuucugaguucaaggccagccuggucuacagagugaguuccaggacagccagggccacacagagaaacacugucucgaaacaaacaaacaaacaaacaaacaaacaaacaaacaugcagaauugggagcuggggagagcugaguugguaaaguccuuuccacgaaagcuugaggacacgaguuuaagccccagagcccauacuguuuaaaaagccaaguacuguguuguaugauuguacucucagugcuggggaagcagagauagguagagcccagggucucgcuuggccagucagcacaggcuccuugauaagcucuggccagugagagaccaugucucaaaaggaaggucgagggcaccuuguccucuggccuacacuugcuauguauacacagccacacguguaccugcgcacacacacauaaaauucagaaucaucaggccauuguaagaaaagauggcucguaccaccgucuaguugccuuagcucccaggaggaugggaaugagggccuaugguuuugcauuuugcuuuccuguuuuccuagcagauuccuaaagucaguugacugagauugaacuugaucgaugaaucucaguucuacuaccuuucuucuauacaaccuuuggacagucacguauccguuguaagaaucuauuucuugcgaaauaaacguaauacuagccacuucagugugcacuuggagggguggucguacguacaaagagccuagcuaguccuagacuaaaaguaguucuuucaaaauacauugcugcucugugaguuccaggcuaaccugaccugcuuguaaguuucaggagagucagggaugcauagugagaucuugucucuaaauaaguaaacaacaguguaacucuggugacacacaccucuaaucucaccccagugacaguuuaguuauagauguauaauaaaguuagaaguucaaauggauacguagcagaagauggccuagucggccaucacugggaagagaggccccuuggucuugcaaacuuuauaugccucaguacaggggaacgccagggccaaaaaguggauaggggagcaggguguggggaggguauaggagacuuucaggauagcauuugaaauguaaaugaaggaaauaucuaauaaaaaauugaaaaaaaaaagaacguggcagggggcaaaaaaaagaacguuaaauggggcaaaagcauguacagacuuuauuuguuuauuuauuuauuuauuuaagacaggggacuguccucgaacucacagaaaucugccucgccagggcugacauuauggcaaagauuaaagacguacaccacaugucuggcaaaaguuugagucuuuuguuguuuuaaaauccacucucuggagaacaugugugccagccauuaaugcgcacauuaguugugaaagcugaucuucaaaaauuuuaucagagcuaaucuacacaugaugugauauuucuuacagaaaacuggaaaaucuauauuccugguuccaguguccaggauuaucagugucucuucuagcugccuuucuauaggauugguuuuauagaauacuguucauggagagccaacaaacauuuuggccauuuacuuuggauauucagugcugaugggaugcaauaauaguuguauuaggaauagaauugauagaaugaaaaauucauccuccccccccucaggguguguguguguguccauccgucuauccauccggccagcugucugucugucuguguuugucugagauuuauuaaaguagcuuacaggcuaugugcuaaguaguccaacauugccugucuccuaauagaauuccaggauuccaguaguuguucaguccacaagacugggugucucaacagucccaaucuagugcuggagucucagagaaguccuagagagccacccauuuucagucuauguugaaauuccaaagaagugggcucuuagcccaggggaggaguaccucaggaacagaagagaugaacucaccaccgagacuaaggcaaaagcuagcuuucuuccuucgugcccuuuuguguggcucaugucuucugauguagcucagauuuagggucaaucuuucaucuucaaauggguauguauucuacuuccaaaaucccacacagaagugcccagcuguucugguucaguuaauuccagauguagugaaguugauuguaagauuagcuaugacagaaguagauucuccuaaucuguacuuugauggccagaggaaaugggaacauuuaaggcaugaugaggucagugaggaacacaguguuuucauccucucuaggggacugucucagugggcacaacauuugcuucacacguuuggugaucugaaugcauuuucugcaaacccaagcacccugaguucagaucucagaacuauauaguguuagcagcuguaauuccagcaugccucuggggaugagaggggaaggcaggaggcuuuccagaggcucagggccaacuacccugcuggaggagacccugucucaagguggaaaggugaaaacugacaccugaagaugucugacugccauacacgagcacacauaggugcacacacacauacacacacacacacacacacacacacacauuuucuuauuuugauauguguuacuggagaguccaggaagucucugaaagaacuuauuguugauuaguuucaacgaagacagaagguugacuggguaguuaaacaaacaaacaaacaaacaaacaaacaaacaauuugggcaauuuagacauggcuauaagagaauaaaggagaagggacugacgagugucucucagucugugggcaagcuuagcaagcuggagaguguggggcacauuugucaugggcuuuugucuguugaucauaaaggaaucuaagucaaguuuuggguuuguaacuguuuccuccaagggcuuucugccuuuauuacuagaagggaccucaaguuugggagguaccauguuaggaguaguggguacagcauguccuuggcggggguggggugggguggagcagugagaaccuaagcuguuacccuaugcucuggcccucacgccugaccucaugcagauguuucuggcugcugaugcucccuuguuggccuccgaguacgaauucuagggcuucugcuuuuccuccccuuuccuccccugagugaacccuuccaaguuggcaucauuaucagcagguccuaauugcuaagauguuugcauaggcaaaugcuguuugccuagaguuggucucuucagccuucuucugaaguagauuccgggguuugcugaagaugaugacggccuuggagagacugaaggaguaaagcuuaggcuaugucagggguaaaggaaugggagagguugucauggguuggaaauuuuugguauguuuuaaccuuacuauuaaagugaccaauucauagcagcugccccucucuaugccucccuagcgcuccaaaagucuccauguuuucaguuugcaucucaggcaaauugagaggccauaaauaggauuguaauaauccacacaucuguauuuucuaaagcaaagggaacggaaaagggagccuacuuuuucuuccagauguuuuaagcuguuuuuaaauuguuguauaaucagacaguuugacauagagugaugugauguaaacauagggaccagaaccaugcaguuuugugccugaaaagccuggacugcugccuuauuguaaugucuccccccucagggcugcugcucaaagcaaauuaagucacuacacagacgcaaucaaggacugcgagaaagccauugcaauugacucgaaauacagcaaggccuacggaaggauggggugagugcccagacaacauccaaagcauugccacggagaaucauacaugcugugguucaggccugaugguggauauccugacuaacauuguucccugugugauaauaagacaaauuuaauagaaagaaauauagcaaaauggagcugacuacacuugagguccaucauggguguuucaggacugacugggcauuguaaggaacugugugagcaaacucacuucauagcuuggaccauaaaaacacaaguaaguuuaguuagaucccuaacuauguauuuucccuggaauccacuguuugguauuuguuaguuccgaguucauggagacuuuaugggauuuaauuucugugagugagaaccgacugcaugcccuguuggaacucuuuugaauucuaugucugaacuccauccucaaauauuccauuccauuuuaucucuguuugaguauuuaauagacauguugaauuucauguguuucuaucagaacucacguacccauugcuuuggcccaaagcugaggaguuggucuguaucuaucuaaucugcuggcauaucuggucuagccucguuuuccucuuguaucuuggauucaguuguucacuagcuugcuuauaggauuaaccuagauugccauuucuuaccuacucugcuuuaguuaccuucuaacuagucuuuaugccucaauucucuaccucaccaauguuaauccucugcagagaagccagagugagcuuucaaaagucuaacccagaagaguugacuaucuaaauagacagaaugauugccuagcaugcugguagcucuggauuggagcccuagcauugcauaaacaguguguguguugcaugcuuauagucccagcacuuuggagguagaagcaagaagaucaugagcucaagaucaucuuuggcuacaaagcaacuuugaggccacccucggccacaugagacccugucucacaccuguccaccaaacccuaaaagcauaacucaaauagucauuacauugcaacuguaguuuaaaagucuaaacuauaaagaagucccauaugacccaguguagccagcugcccucucugcuuuguuuucugggacccauccucaugugccuuuguccuaugcuuuaagcuuacaagaccugcauguuucuuagcgucuuuguguuugcuucugugucuggguugauaguacucucccaacuucucuguaauuauuuucugccauucaugucuucuugcauguggcaauuuuugagcaaacacuacugucauuuuccuuaauauuacccauucugggugcaugcuuguugccugugcuccucaaguggaaggagauuuucuuaaacuuaggaacuuuuuuuuuuuuuaaauuguggagugcugaguauuuaaaguaguaccugguacauaguaagcuuucaaucuuuaugaugaucaauuaggaacucuguugaggauccuucaagguugacuaauagaaaacuaguuggguuauaagaauuucuaauuuuaucuauguaagaagucugugagguaauacagaaaagaaaggauuaauuugucuaaaagacaaaucuagaacaaacaagacacuuaauacuaucuuuucauacuuaguuauuacuguuuaauucugauguauuuuucaagcaaacuauagguagggaaugauaaacauuacaauuuagguauagucaggcuugugccugggacaauaauuuauugaguuacagaagacccuuauucugucuaacaagucacguguuguucagaacuggucaccugauagcuacauucugcuuuucauuuaacagaugagaaacuagaggccagcaagauaggucagcagguaaaggcacaguugagccugacagcucuaggucaacccccaaaucucauguuaaaguggaaggaaaagacugagucaacagaguugcccucuggucuccacauguguccccuggcaccauuuccuccaauaaucaaucaaucaaucaaucaaucaauuauuuuaaaaagcuauaggaaguaaaacaguaaaaacaaaauuaggaaacuaauauuauuguucaaguguuuuaagaaggaagauauggaugcucucaaaugcauagcauucagaugcagguaugucccaccugaggccugugggcugcaugugucuuaggauaguuaugaaugcagcccaacacaccuguaggcgacaguguuguuauaaggucagaaggucugacacuccugguuuauuaggguccuugaaaagagugucagcaucauggauuuacaugaucacaggauugcaagcacaaagcuugguuuagcucagccuagagauucguaaagcaagcuacuucauuuacaugucagucuuaaggaaaauagaaaggugaguagucugagcuuucaguguaugaacugugugggacacgcguaauggaacagaaaggagacgacugaagcuuacaggaucuuggaguuggggaaaauugauuguacucucucugaaccauaacauaaugaggguuagaauugaaugcuaggucccugaaugcucugagcaugaccuucugcuguucuguagcauaacccugcucccuuuccaaaggcucgcccucacugccaugaauaaguuugaagaggccguuacaagcuaccagaaggcacuggaucucgauccugagaaugauucguauaagucaaaucugaaaauagcagaacagaaguugagagaggugucuagcccuguaaguugccucuguggaacagauccugucccucacaauugacuaacaucacaguggcuggaaugaaucucagcucuaacucuuuuacagacgggaaccgggcugagcuuugacauggcuagcuugauaaauaacccggccuucaucaccauggugagucuacuucuuucccuuuugaucugcugccugcuguccgcuauauauuugcucuccuucucugccauucuuuuuagggagauggaauuuuucaguaguugcuggagucgacccauagcucuugaacacaagugagucuccugccuuagccucucaaggaacugagaguacaggcuccagauccauauuuuuuuuuuuuuuuaaagaaacaaacacagggguuuccagugagugaguggcagauguucauggcagaggcuaagacaggagugccucaacucggaggaagccaggguguuuuuagaaagcccauaccuuccuaaacuagaauauaaaagucaguguuuguguggauauguacacuuuauaagacaaaacucauacuuuuuuuuuucauuagauugucaguuugcaaauaugaaaguuuaaaaaccacugucuugggcuagugagauggcucagcaguuuacagugcucgcuacauaaaccuggucaucugaggucacacaugguggaaaaaaacaacugacuuccacaauuuggcuuuugaccuuuacacaagcacuguggcacacauucucucucucucucucucaacacaagcacuguggcacacauucucucucucucucucucucucucaauucucucauaaauaaaugaauguaauuuaaaacccgaaaguuguaucaaacugguccuaggaagauauaucuaccaacugcugucugaggauuuugauuauagccauuacccaaacuuguuuucugucuuaagaguuuuuaaaaacaggcucucauguagcccagguucaaacuugccucagcuagccucaaacuuaguauguagcugaaggugaccuugaguauuuuguucuucaggccuccuaagugcugggauuacaggcaugcccuacgaguuagccaguuuaugcaaugcuggagacugaacccagggcuucaugcauccuaaacaacuaagccacaucucuagucccgccaacaaucucuaguucuucaagccaaccaaaauaacuuacaguucuuugaaaaacaaccaugauucuaugaucuggugggcauaggguguuaccugggucuacaguaccccuggaguuacuaacggcauacuuuguauguaaacguuccacugccuggcaugguggugcaugucugcaauaccugcauguggaaggcugaggccagccuuggguacacaggaauuugaggccacccuuggcuacauggggaaacccugucucaaaacaaaaccauauacauucuaccauaugcuguguuccuaaaauggcaggaaucuguuccuguucaucuuuguucaaguaaauguguuuuacaauccuuaaauccuuaguucaaccaaaagacacagucuuuuuucaauuugguugcccuucuuaccuacucgcuggcaaauagauacuccuuuguaagccucugauguuuuaaaaccuggcuugcucauuucuagcccucauauuacuguaauaugaaauggaauuuagcuucagauuaaauuuagucuguaagcuacuauauacuaaaauaaauaccauguaggagcugcaaaagaggaggguuaaaggcacaucuuugacucuuaaaaaggggccagugugggcuugugggugggccacacugucagaguacuuggaaagcauucuugacaacuggaucugauuucucagcacugcuauaauaaauaaacgaaugaauaaauagauaaauaaauacagaaacacguaaacaaagugaggacuaagacuguaguucagugucgggacauaugcauuguguucaacccucaggacugccaaaaaaugaaaauagaaacugaugaaaauuauaaagaggauaaauaacaaaaggaccggggugaucaugcuuuaacauggaguucugagaucuaucaaccugccguuguuacucugugaaggaagcagggaggccucccuccaucuccagccugcuggaaagggcuggucuggucuccauaacagaaucagucacaaauaucucuuuggcagugucuuuuaagcuuuacaucuuuauacuuuuaaaguuuuccuuuuucccuuuugaccuguuggucugaccaguaguggcaauacccuccauuaauuaguuuaucuauuuuaauugucuauaaucucauuucccccauugaugacaguuucuaguaucuucucuuuuguaccaucccauuuccuuuguacagcacacuacaauuccaccccguguucgguugggcacuguuagguuuuauuccucugcccuuacagcaucucuguaacaucccuaugcauuuuaauuuuuguugucauuuuaaugggcaauucuauuuuucaauuauaggcugcaaguuuaaugcagaacccucaaguucagcagcugugaguauaaagggcuccuuaugccuuuuuccuucucauugcagggccccuaauuaaagcacaccauuagaauugauaaaaaugcacugaauuccagucacucacacauuugacccagucccuugauguauuucauugacauuuucuucccaugaggaauacaugcugaucuccauggugugucucuuguuacccuagaaugucagggaugaugacaaaugccauuggaggaccagcugccggaguuggaggccuaacagaccugucuagccuaauccaagcgugaguguuugcccugcuuuguguccuauugaauggguuaaggcaaggugaccaaaagcagccuggggaggaaagacuuuauuggagcucacaguuuauagaccaucacgaagggaagcgagaggggcuggagagauggcucagugguuaagagcacugacuuuuuuauuuuuucuuuuucuuucuauagaauuuugacauuccagcagaucuuuagaaggagucauuagcaguagaaguaggcagaacucugguguggugggugguacacaccuucaauuccagcacuugggaagcagaggcagguggagcuucuguuaguugcagaccagccaggucuacauauugauaacuccuagcaagcaagcaaacaaauaaaacaaaaacaagaaaguagguaguuugcauccguaacugguagcuggagcugcugaggaacaugccuuaaguucccgagaccucaggacauucacuuagucuuuugagguccagcuaaauuuuuguuguuucuaguauggauuuagggucauauaggaugccaggacugucaucuacacuuacagagggucccugggaugucaggacugucaucuacacuuacagagggucccuaaggauugauucccugcuguacauuuagagagggucccugagaauugauguccugcuguacacuuacagagggucccuaaggauugauucccugcuguacacuuacagagggucccugagaauugauguccugcuguacacuuacagugggucccuaaguauugaugcccugcuguacacuuacagacggucccuaaguauugauggccugcucauugauacacacucacaaugaucucauauguaaagcaauuaucauucaauuucaucaaugaguuuauuuuuuuaaauuuuguaagcuugaauaacuacccugggauuuaagugguagucauauguuuacugaaaauauguauuaauuaggugcagauccauauuuuaaaaucgguuuuuuugagauauagucuuacuguguagcccuuguugccuuccaauugaaggugaucuucccgaguguucugggauuacaaacaugggccacaaacuuggcuuaaaaucaccuuugcuuuaguuguagagcccucacuggguuuaaucucuagcacuacaaaagaaguaaagugaguuugaaggucauguuacauguuacaucauuaauauuaggggcacuucggaaaugcagucaagcuuccggggcacaggaaacugacuccacacacgcaagcacguuacuguuacucuccaucagaauguccaagacacugcauuucgaauaugugucuacuacugccaaguuuauaagaagccacaguuccagcuucuaauuuguucucaaaaccaaucaccaccuaagauguugaacuuuuagagugacccuuaaguggcaugauuaucaugcuuaauacauguaauugagaucacaaacugaagaguuugugauaaacuuauuuuaucguaauuucaaggaccaucuuauuagaguuuaaaggaaaaaaaccccaggacaggcaagcuauaaaucugagccauugcccagagaagaauggaaaagugaaguaaaaauuagaacaaaaauccaaacaaacaaauaccgcccccccccaaaaaaaccaaacccauugcuguuugaguuaagccagcauggaggucagccacauggccguaacaccauaggcaaaugguggggaguccagcuucagagcaagacuagggaaguccaggguuacagaaaaauugugcagaguuucugaccagcauccaaaugaaagaggcagaaagaacaggagugucaucaggacucaggaaagggagccaaggaaccucaguggcuccuacaaacugucuaagucuucaguuucugaggcaggcucuuaugaagaccacauugaccuugauuuuacuacguagcuggggguggucuugaacccuugaucuucuugccucuucuuccucagugcuggaauuauagauaugcauuaccacccuguuucaagguuguguaugacuguuuaaugagguguugggacugaagcuagagccgugggcaugcuagggaaguguucuauugggcuagagagauagcucagagauuaagaacacuaacugcacaauaauaagaauaauauagccgggcauuguggcgcacaccuuuaaucccagcacucggaggcagaggcaggcggauuucugaguucgaggccagccuggucuacacagugaguuccaggacagccagggcuauacagagaaacccugucucgaaaaacaaaaaaacaaaaaaacaaaaaaaaaaaaaaaaaagaagaagaauaagaauauaaucuuaacacucguguaagaaccugggcaucccauacacaccuguagcauuagcuccaaaggggaggagacagggggaucgcugggacuugcuggcuuccagccuauuuaagaaaaugcaaguuuagguucagggaaagacagggaaugacagaggaggucaccugacccuucuggccuaggcuugugcacuugcacaccaugcauauaaauagauacacacacagaaacacacacacacacacacacacacacacacagagauacacacacauacacauacauacauacacauacacacagacacauacacacacacacacagaaacacacacacacacacagauacacacacauagacacacacauacacauacauacauacacguacacacagacacauacacacacacacagacagacacauacacacacgauuguaaccuuuaaaagaaguccugccauugaaccucauucccaggccuuuaaaacuuugucuuauagaauauucacuuuuugaggccagccugguccacagagugaguuccaguucaaggcuacacagagaaacccugucuugaaaaaaccaaaagaaaaagaaaaucccuuuucacugaccccucuaaggaucccagccugggaguuguucuguccuguccagagaaacuaggaagacuggugcauuguguuuuggacgcacuguuaggagcgugcuguagagcucuuugauuacauaguggacaaguagaucacauccaauucaggcauuuauagcuuaucuucaggguuugguuuuccuccucaucuucaacaagagacuguuuguuucccaaggagaaaccuuuagccugggcuggagagaggguucaggugguagaauuugccuugcuaccaggaagacaugaguucaauucccugaagaaauugaaaacaaaaaaccaaaaaccuggcagugaugacacaucuuguaauuucaggguuggaaccuagggacagaggaucccuggggcuccaggccugugagccagccuagacuguaacaaagccuucuggccagucaauaaacccugucuuuuuuuuuuuuuuuuuuccgugcggcuuuuuaaaaauauuuuuuuuacuagauauugucuucauuuacauuucaaaugcuaucccaaaaguuuccuauuaccccccccccccgcccuccuucccuacccacccacucccacuucuuggcccugguguuccccuguauuggggcauauaaaguuuguaagaccaagaggccucucuucccaaugauggccaacuaggccaucuucugcuacauaugcagcuagagacacgagcuccagggguacugauuaauucauauuguuguuccuccuauaggguugcagaccccuucagcuccuuggguacuuucuuuagcuccuccauuggggucccuguguuccauucuauagaugacugugagcauccacuucuguauuugccaggcacuggcauagccucacaagagacagcuauaucaggguccuuucagcauaaucuugcuggcauaugcaauagugucugugcuugguggcugauuauggaauggauccccggguggagcagucucuggauaguccauccuuucaucuuagcuccaaacuuugucucugcaacuccuuccauggguauuuuauucccuauucuagggaggaaugaaguauccacgcguuggucuuccuuauucuugauuuucuuguguuuugcaaauuguaucuugggcauuguaaguuucagugaguggauaucaagugacuucuuuugugauuggguuaccucacucaggaugauauccuccagauccauccauuugccuaagaauuucauaaauucauuguuuuuaauagcugaguagaacucaauuguguaaauguaccauauuuucuguauccauuccucuguugagggacaucuggguucuuuccagcuucuggcuauuauaaauaacgcugcauccaauauauacaaagagcucaagaagcugaacuccagaaauucaaauaaccccauuaaaaaugggguacagagcuaaacaaagaauucucaacugaggaauacugaagggcugagaagcacuggaaaaaauguucaacauccuuaaucaucagggaaaugcaaaucaaauaaacccugcccuaaaacacacaaaacgcacugcacccaaggaccaauacuaacaguuguccuuucacuuccaugggugcacuugcccucaugugcaccaguacacacaugagauguacagaaacgcacaccacacacccccaugggaacucucuguccugcaaaauaaugcuguguagaacaguggugauauuauggcucuaaaacuuguguucauaggaaaaauucccucugaaaguccuacagcaucuccaguucaguuuauuccgcuuuuguccugcagggggcagcaguuugcgcagcagauacaacagcagaauccggaacucauagagcagcugagaaaccacauccggagcagaucguucagcagcagugcagacgaacacuccugacuugaccaggacccucgccccaguacaaacauucugacguguacacuuguagauaauagccaaaaacaaaguaacaaaacccacccuauacagagucugaacauaacggaggaaagucuccuguguaaaccugagagaauacaucuguuuagauaauaguuuaccacaagcagacuugaacguaauccagacagacuccuuuggaaagcagugaucaguagccuuguuaagggugaauacagccuggggacaaggguccauccauuuuaaaacuuuuaucaucauauuuguauauuagacuuaguacagaguauauuuauugaauaguagggcuauuuauuggaaaguucguuagcugcagguuucccuaggcaguggucuugagcggggcgaugcugguuuagaagacacgugcuuggcagcacgucagagagaagcgcuggcacgcgcuaccaucagugacgcgugucuaucgagaguggcacuuggaagauacugugaaugcccagaaagcgaaggcagugugcucagguuuucugcauagauuuuuuaaacuaagcuugucuguagcuucguguuuauagcauucgcauggccaguuaaguacauaaugaaacauacuuagaaauccuuaaugaugcuggucaggucagugacauuacugccccauuuaauuaucacagcuuaaaugucacaauuucauugcuggaaaacuuaccuagggcaguaucucguuacauuuaaagaagccacugacguguccccagauuccggguuuccuaagugggauuuaauuaugugcccaucaaagacgacgacgacgaugacuauuuuucuugaccauuauuugauggcuaacagaagcauccaucucuaacauugcucacuuguguaauccuuuggugcaguuuggcuuggcaugucgguucuuaugcuuaacuuuaauuuauugcaauuuaaacguaacaggagacuucaacugucuuauuuuaaauuggaugccacacugugcaucuggcgugugcuuaguaggaagaaaugacacgagcuaucgaugggaggacucuuagugcacugauggauaagaaggcucauuucaaauggaacuggcuuauuaaccaaaaacuugguucguaucccaucacugcauuagagaggaaauaaguaggaacagagaguagaugccccauggaacagauccuggagcuguuaaaggacaaccagagcgccugggaacacagaucagugcauagugcuugcccagcaugugugaggcccuggguuaccccuucccuaguacugcaugcaaagggaauggcggugagucccagcacgugggagguaagggucaggaccaggaauucagcaucacucuuggcuacacagugaguacaaugcuagccugggcuacaggaccccugucucgaaaacaaaaacccccaaacaccccaguagaaaaaaaacccgacccaaacaacaacaaaacagacaauuagaaaaccucaugacuugcucuagauuucuguauuuaacaacuuugggaaacaaaucuuugugaagaagauaagcugaauaggccugucuuguuaaaaaaaaaaaaau

SEQ ID NO: 7210 - RNA, 38908 nt, Mus musculus
ccacauccggagcagaucguucagcagcagugcagacgaacacuccugacuugaccaggacccucgccccaguacaaacauucugacguguacacuuguagauaauagccaaaaacaaaguaacaaaacccacccuauacagagucugaacauaacggaggaaagucuccuguguaaaccugagagaauacaucuguuuagauaauaguuuaccacaagcagacuugaacguaauccagacagacuccuuuggaaagcagugaucaguagccuuguuaagggugaauacagccuggggacaaggguccauccauuuuaaaacuuuuaucaucauauuuguauauuagacuuaguacagaguauauuuauugaauaguagggcuauuuauuggaaaguucguuagcugcagguuucccuaggcaguggucuugagcggggcgaugcugguuuagaagacacgugcuuggcagcacgucagagagaagcgcuggcacgcgcuaccaucagugacgcgugucuaucgagaguggcacuuggaagauacugugaaugcccagaaagcgaaggcagugugcucagguuuucugcauagauuuuuuaaacuaagcuugucuguagcuucguguuuauagcauucgcauggccaguuaaguacauaaugaaacauacuuagaaauccuuaaugaugcuggucaggucagugacauuacugccccauuuaauuaucacagcuuaaaugucacaauuucauugcuggaaaacuuaccuagggcaguaucucguuacauuuaaagaagccacugacguguccccagauuccggguuuccuaagugggauuuaauuaugugcccaucaaagacgacgacgacgaugacuauuuuucuugaccauuauuugauggcuaacagaagcauccaucucuaacauugcucacuuguguaauccuuuggugcaguuuggcuuggcaugucgguucuuaugcuuaacuuuaauuuauugcaauuuaaacguaacaggagacuucaacugucuuauuuuaaauuggaugccacacugugcaucuggcgugugcuuaguaggaagaaaugacacgagcuaucgaugggaggacucuuagugcacugauggauaagaaggcucauuucaaauggaacuggcuuauuaaccaaaaacuugguucguaucccaucacugcauuagagaggaaauaaguaggaacagagaguagaugccccauggaacagauccuggagcuguuaaaggacaaccagagcgccugggaacacagaucagugcauagugcuugcccagcaugugugaggcccuggguuaccccuucccuaguacugcaugcaaagggaauggcggugagucccagcacgugggagguaagggucaggaccaggaauucagcaucacucuuggcuacacagugaguacaaugcuagccugggcuacaggaccccugucucgaaaacaaaaacccccaaacaccccaguagaaaaaaaacccgacccaaacaacaacaaaacagacaauuagaaaaccucaugacuugcucuagauuucuguauuuaacaacuuugggaaacaaaucuuugugaagaagauaagcugaauaggccugucuuguuaaaaaaaaaaaaauaaggcucagaugauuucaguggucuugggagagaaggauaucccuucucuuuaacucuuucgggaagcagacaaggaagaaacagcccccaacucaugugagcaguaggacucggauaagaauucccagcuugggaacucuaucuucaugugcugaugccccuugcugaaggcagcucuucuuaggugggacacaggaaccagugcaucuuucacugcacguuucuaguuuuguuucuuugggaaggaaggaccagacagccagauguugucucccauuuccacagauuuucuuuccagucaggacacccuucacucuucgggucuguccagcacaucggaaucaucacacugcaagccauuucaauaauuuuuuugguauggucugauugugcuagcugucuuaaaaguuuaagacacuuccccaguauucuuccccuucuuguugagaaacagggcacugaguacuuccauguguucugauuagggaugccugacuuccacguguucugauuaggaugccugacuuccauguguccuaauuaggaugccugacuuccaugaacccauuucaaugguguagcugacgcugugaccgugcuaugcaaaauccacuguguccuuucuauggaaauggaauuuucauuuacuauaucaaauugucaaucuaguuuuuauaauaguugacucagauccuuuauaagauggcauuaucuguccuuuauuuaaaguaugaauaguacacagcuauguuguguauacacagaagagacuuuguaaccuaaagaauauagcagaauaaguuguacauuccuacugacugaaacagugguucagucauaagaagaugcugauaaauacgacuugaccagucugucagcccaaaggaacggaccucaguucucacugcuuauauuuuguuuugcacagacauucaucaaucaugacuaauguaugugaggggcaagucuucugaauauaccuuucauuuuggaccaaacaauuugucauggcaauaaauaauuaugcauuuaagaaaacagauuuugucuuugacuuauauuuuuuagaacuuuuaauuuuuuuauuucauguauguggauacacuguugcugucuguagacacaccagaaaaagacauugaaucccauuacagauggcugugagccaucaugugguuggcugggaauugaacucaggaccucuggaagagcagucagcgcucuuaauugcugagccaucucuccagcccaagaguuauauuuuuaauauauaguagggauuuugaacucgccaaacuaggaugaaguuuauuuaacagcauggguuuuguuucccuaauaaacagggaagcguuuugaugcauaccuauugcaaagcuguuguaagccuuaguuuucuugcugauuuguuccugacaugaaugguuguaauuuuuuuaaagauuuauuuaucuuauauaugugaguacacuaccauugucuucacacacaccagaagagggcaucagaacccauuacagaugguugugagccaccaugugcuugcugagaauugaacucaggaccucuagaagagcaguuagggcucuuaaccucugagccgucucuccagcccccgaauguuugugauuaaacggacaaauaaaucuuuuauauuaguacaugauagagagcuaaaagucacagcugggcgugguggcgacgccuuuaaucccagcacucgggaggcagaggcaggcggauuucugaguucgaggccagccuggucuacaaagugaguccaggacagccagggauacacagagaaacucugucucgaaaaaccaaaaaaaaaaaaaaaaagaaagaaaaaaaucagaugugaaguuggaaucauuuaaauguauauuaugaaaauaagcucuuuauucuucaguagggaagaccccaggagucuuuagauuaaagugaaauaauugcuaacauuguugaaagcuaauuaaaucagucaauccuggccugcucucgagugucuguuaacguguguugguauguguacacuaagacagacaugcaaccauacaacaauuuugaaaacaacugaaauguuucucuggcugaauuguuuuacacaggccucucuuuguugacuaagcaccuaggaaagagaaugcaguugaccaugauuaguucaacuaacuuucuauauuaaguaucauggaaauucgauaauccuaaagcaaauggugucuuccagcagaguuaguguguagccuaggggccuuggcaagcagguccaucaaccacggauacaccugccugccuacucagauggcagaauucaucuguucaccgagcauaagacaucugauacccagcccuuuacaaaaagguucgcugacugcuuuuuauauacuuguuagacaaaaagccucaaagaugagcuuguugaaaacaaaaaaaaugacagguaucuuaaaggacacaaaauauauacagaaaauaaagaaauguuuuguuccucuagaauauaauuugaaagauaaaaguaguguuuuuacaacaaacguuuaaaauugaacuguuuuacaagaaacauuuaaauaacauauacuuguuuucacuacugaucacugcacaaagcugacgaaauacagagagcauuucugugauuaaacaagaagucuaacauuaggaauuuucuuuaggcuuccacuuccacggcugcugagacuacgcagacuugcgcgaugucaucauauucguauguucucuuuagaaaugugucagugagucuuaagccagagacacucuagagagagagagagagagagagagagagagagagagagagagagagaaaauaugagaugcaccucaguguucacucauugauaauuaccauggaaaauacagcuaucagaaaugaugacuuagcccacccgguugaaaucacugaacagcacguacuuggagccccuguacugaggacaggagcgucagggccaggcagagcgaggagcuggggugcaguuuccccagcugucguccugagaucccacaccaguggauggaauugguguugcacaucuccagcacgagguccaucauccucucacugcugaaacaaucagaaaccaggauaaaucuguuuauuuccuaagcagauaccaucacauuccuaaaaugagcaugucauuacucagccuaagauagaaugaaggagcgagggaccacuugggaguuaaaaguagauggauuagaaguuugaggcuagccucagccagugugaggccagccugggcuacaaagagguacugucucagaaagcaaaaucaaccaaaaggcacgauagggaaaaugaaaggacagcaucuuccaggguugcaguagcugcacagcugccggcugcugagguggguuucccguuguuaguauucgcgggcucccugcugccgccgaugcuggccuugucuuuugucuagacuaaggcauuugaaucucaucuuacugcuaugucucuuacucguucuacugagaacuccacaggaaagaaggacaacggaugggugcuuaguccuugucaugaaaaaucucuguccuuuuagcaugcggcuaacuuaggaaaugauugacaggggucauaaggagcagccauucacgcuugcucacugaguucccugacaagacuugacgagcagcacuucaucuuacccacuuagcuaacaggcucagaacauuuuucuagucucuccuuuacuuuuaguuccuuggcuucugugugccuuaggauuuggcuccaauuucaauauugacuuaaaauuuaacuuacauacugaaauuuuauuugcuuuuaaauguuucgaucucccuaacaauuaaaaaugcucuuugcagcccggugugguggcacacgccuuuaaucccagcacucccagcacucgggaggcagaggcaggcggauuucugaguucuaggccagccuggucuacagagugaguuccaggacagccagggcuauacagagaaacccugucucaaaaaacacaaaaacaaaaaaaugcucuuuguguuagagagcauguacaacaugauuuucucagucaauucuauaacaacguacuccguguguuuucacauccacuuguuuugcgugugcucugugcagauguguaugugcuacacggugcacguggaggucgguggacaagcagcaagagcuggucuucuuucacucuucagucacucuagcagauggguucugggacucagacucaggucuucaugcuuagcgccaagugcuguaacccagcucgcuccuaagacugagucucuuguacucuagacugcccucagacucucuugguagaugaagguggccuugagccuuuggucucuucccucgguuucucaauugcugguauuacaaauucuggcuagagaucaaaaucagggcauugaaacagcuuaggaagacaacagcugggccacaccccacucucucuucucugcugcuguaauguuuucuauugcauguuuuguaucuguauacacauguauguagauugggucagauuuuuauacaugaggaaauugaaacucuuaaguaaguuagaaaacuuaguugaauuauuacauuaaaaugaacaucaaaaaauuaauuaaaaaaacuuaacaaugcuuuguuaguuaaugagcuuauuugaaacacucaaaacccucaaauccccuggacauacccuauauuugcauauccuugccugcauguucacagaaauuuuaugacuugcaagcacgguauggaaaaggugugagaucugcccccugugaauaacucccaggccagucagagaugacgaggaacagcaauacauggacgcuaccacaaaacuaaagucaaauugucuaugaaaagucugaggggcugggaaugcggcucaguugguagcguuccccuagcauccacaaggccuggguuugaucccagugcuucaugaacagcgugguggugcccaccugugauccuaccuagcaccugggaagugcgaguaggaaguucaagggccuccucggcuuucgagaagcuuagugccaggccggauuggagacacugucucaaauaacaacuguagcaguaaauguagcuucacagagagucaggccuuucuguauuugaaggcuauuuccuauuuccuuaaaucuaagugcuugacugaauaugagagugaagugaucacacggguauucugaaagagcuguaguucauugcuguaauauuacugcaagacccaaacuaacaguauacugcaaaucauauaagaaccaucaacuugaccuggcugggauguaauucuaggcuuuauaucuuuuaaguuauauauccuuugcuucuucuguugacugccaaaacugcuuaacagcugggggagggguggaugucuuuaaugccaucacuccaggagacacaggccauuggaucucuauuaacaacaucagccuggucuacauaguaguuccaggcaagcaaggauacacagggagaccuugucucaaaaacaagggcagggccagccugggcuacauaacaaaacugucuuagagaacacuaccaaagaaaauaggcaaaagguaaaaaagucagaaucaauuucuaaccuauaugcuuuuucuuguuaauauuaaagaaauuaucacagaaguuaucagagaaauguaucugucaccgcggaagacccugcuggcucauucuuuaguacuaugacaugggaaggaaguauaaacagaugcccaucuccacgcauuggcauuaccugcaguuugugauuuuacagguaauauggaaagguucuucuagguuuacagugucugggauggccucuaaagacagccuaacauccccauaaccuggagccugugaaaaaaaguaacaguaaaaacacauaauuagaaaaaccuuucacgguuaaugaaggugucugcaccuuuacucaacagacacagcuggcgcucugagaacagaccgcggcucuggccuagucucucacucuaaccucuuuugcugugaccucagcuacaaggacccugcaggccuggacuguuuccgauacaauuacuccagacucaguagaauuaagacgaaucuugccucuagacaagaaaugaguuaggauuuaggggaucugaucucaaaguguuguccaguuccagaccaaccagggaugcacaugacagcccauuuuaaaacaaaaacaacagcaguguggacugaguugguaagugccauaauccuacgaaguucaggacaucucccagaaugccucacuguaaugagcaucaaaugagcagugagcauggcuuagagagauaagaauaacucauacgcaguuaucuuaaguccuguuuggugaaauuaccaccaccaccaaaaacaaccaaaaaaaaaaaagagacaaaaaacuuauguacuaaauagaaacaaacaccugaacgcguuuuccauuaaucucagcacuaguuuucuaccuauggaucaacacaacucuuaggauuuucuagacaugagugauucauggccucugcucuucaguguugagguguaagacucaccugcccucucacaccaacccacacucaauguuuucuggacucaccauccuuugaagcuggcuggucuguaaccguccccuuucaccuagauuuguuuuccacacuauauccaguuucccaauuacugucacucccuuaauuaugccggcuuuuucugcaaauuccuucuugggcuuuaggcaguauaaguauuggcguguauccauuggcugcaaauauccucuggacccaaauguagauaugcuggccaguguagaaauagacagaaaaauauauuaaguaucuuuuugaaggcaacacuauucauacaguuaauucuuuugggcaauuugcugcccagauaccuaggaguggucagagguuucaacccaaaugaaaagaaacaucugccuggugagacaguguuuucaaagagcgugggcaacuuaauaagacucugucucaaaagugaaaaagaagcugugcuaucacagugaucagcacuuguccagcauaugugaggcgcuggcucuuccccagcacucucucuccaugacaaaggaagaaagcacgggauagagagaaaacagcuuaaacaccagcaacauguucuuucucuguguggagcugggacagagcccagggugcugaacaugccaggcaagugcuguuccauuaucuacacugccacccuugagauacacugcccuaacuuuaggaauugcuuucaaaaugaagaaagaauggaaacuuguuuucucagugaaagucacggagaggauuaacuuuucaguaucuaaccaccauaugaggaugucauuacuaagagaaucagccacccacccagcuauuacuuccucaucugcauuaauaauacacuuauuugucccuuauuuuccaaaauagcaauagaaagacauucuacuuuucauaaaucauuaaaucauccacugugauguccauuucuucuuauacugagauauuuuuugucaaauucacgcucacccuaacauuaauuccuagcaucuuuuccacugcccuucccauguuuagguuuaucacuugcaggguaacaaucauuagcuucagauggaucuggaugaagucugaaagguaagaggaggaguacaaccgggcgauggggcacacgccuugauucccugcucaggaggcagagacaggcaggucagccugggcuacagacaggcaggucagccugggcuacagacagagacaggcaggucagccugggcuacagacaggcaggucagccugggcuacagacaggcaggucagccugggcuacagacaggcaggucagccugggcuacagacaaagugcaacucaagaugagggaaggugggcucuuuacuuuuacagagggauguacaagcaggugugaggagaacucuuuaguaauggcagacaugugcuacuauggacuuggccaaucuuacacuguguacaucacacacaguagacuucaacuauggacuuugcuuguguuaggaaucgauacuggcccaaaggaucguaaaaugugccacauuaacacaagacaggagagcuggguucauggagugugaugcacccugggaagauguggcagaagcuagcuugagccuagccuggcaacguggagggagccuggcucuaaaacaaaugcacucgaggaaacaaaaaccaagaggagaaagaaacugacuggcgaggagggcuugcuugugggaccucugcuuuuuuuuuuuuuuuuuguccccgagacaggguuucucuguguagcccuggcuguccuggaacucacucuguagaccaggcuggccucgaacucagaaaucugccugccucugccucccgagugcugggauuaaaggcgugugccaccacgcccgggggacuucugcuuucuuaggaagguuuugauuaaucuaaaauuucucuaaaacauuuccaucaauuauuauaaaauaaaucuauuacacuagaaaagccugcaucuuuccaaauaauagcaaacauuucguacucaccauucuccagccugggucaccgaguuuaauucuguuacauuguacauuauugauggcucuagugaaacuuucuccauaaacauuggugagguuguaauauucugaauuugugcuucaagaaauacuucaucagucugaggauauggaaaaaaaaauccaccaaaaugucaccauauuuaaaguauuaaccuuaauaaaaauaucuuacuuauauaaaaaguauuaaccacaaaugugauuaguucaugccugcaaaucaaaauuaucacaauuaaugcaagaaaagaaaucuuccuccuaacauaauaaacaggagcaaagugagguguuaguccacagaugcccugucaaacaauggaugugggauaacuuggauauauuguauucacuccaaaagcaugaguuugacuagcauuccugugacaacagcaaaaucuaaaucugaccagaugcuaagcuguuaucaggaaguucagcguaauggguguacucagauagcgcugaggaaagacaaccaagucuucauuugaguauucuggaauaauguaauaacaugcaacuacuucaauuuagauagagaccacuagcuauaaauaauccuuuauuauaccuauuaggguguaauuuuuaaaauuaaaguaacuuauguguggucuuagucacuucuggguucauguuauacggauauuuaagguuaaaacuagggcacguaaauagccugaugacgguauggcuucuaaaccugucacagaguauucuuggacuuucaacuauuucagaaugaugucauucauuuuggucaguggguaacuuaaauauucaauuuacaaaaacauugaauccccugcuuauuucuguuaaacagcuuuaauuuuauacuucuuagguucugggucuccuuugggugacuaaagaauaaagauguuauaccaaggguauucagaaauuauuuuuccccaaaaguuucaguuauagaagucugaaauuaacuaugcccucaaauugaggaauuaugggcuuuuuuaaaugccgaagaaaagugacaaaucauguaaaguauagugaaauuauaaucuaacgugccuaaaacagauucuuuagccuuuagacauggguucgaauuaaaacaauguaccuuucuuuucuuuuuuuccuacucuguucuguucuguucuguucuguucuguucuguucuguucuguucuguucuauucuaucccauuccauucuauuugagacagagcaucucuauuagcucuggccguccuggaacgacacagccaagggguaacucacagaucugcccgccucugucucccaguugcugcugauugcaccugugcaccaccacagcuggcucaaacaacgcaccaucuaaacacaucuuucuaucacccuuucuugggaagaaaagugaauauaucccauaaauccauugcucuuaaaguaaccaaagcccacacuucaauuuuuaaaaugcauuucucuguauaacaugaugaacagcuuagauaaaaugaaaggaaagcagcauaauggaaaaucaaguuagucugaacaguuaguaccaagucauuuaacgucuggaaaaugaggacaaggcuuuagugcugaggcugcugaggcuguuauacacagggaaauaauaagcaaacacugcuuauuguaaacagaagguggaaaauaugaauucagccacugugggaaccuugcuuucuuuugcuugcuuuuguuaaaggcacagauguacaaccacugugcaccucaaaaugaauuucaaguguauauucuauguaaggaagggaagauaauuagguauuucacagcaagauauuaaaaaucccaaagauaaaagagaacgcgauuauaggugucuucuauaaaaagcacuaaagacacuacaaaugagaaugcaaucaugucaaagugacaauuuaaucucacaggcgaacaauugaaaagguaugcucaaauuguguacucucuuuuggaggucacagauugaguauucacaacuaacuguuuuuccacuauguuuuguagagagagauuaauuaggcagagucaaaaaggggugagaaaagcauauaaauuuauaauaaaaaaugaaauuaccacagaacugaggucacucuaauggaaaaauaaaaaagaaaaauuagaaaaaucagaguuaaauguuaaagaaaaagaauaacuuuaaaauaaaaugcauuucugcauuuuuuuacuuacuaaagacagcauuaguaaacaagaaaguaaacaggaagcaacauacagaaauaugagaaacuacuuuucuaaaaggcgacauggcuacaguuaugugacaaugggcagagaagaggacuaggcugaggacaucaauggccaccaacaggaagggcagccugagggcagagcgugccugccgaucugccuuccacacuggcugaugcuguucuguugcacacgcucggcacccagcacccguccugccacucuccuaccucaggaaguacacucuccuccacacuuaggacagaacacuguaaagcugcucuugaauuaaccuaaugcuggaauccuaaccuagaggaggaucaugggugauuacagucaucauaaaguuacuauaggccaucuguaaggaaaugcugagauagaccauuccagacgauucaguucaucuucuucuuauuguuauuagauuccagucuaguaugcauuauauaaauauauauuuaaaauuagauuauguucaaugucaaaugacacuuccuucaucaaauguauagcugggagucauuugucaccgcuaugcuccuagaguaugaauacacaucacaguuuggaauguagagaauuacauaucuuauggccauauuacgcaguccccaccaccauaguagguuucugaggcugggaaagccguacacuuauguuuacuucacuuccccaucugacacagggcuuugaauucagcaggugaccaaauauuugacuccuaucuacuaauuuguauaucucccuguaagacuuuccuagcuuaaaaaacugaagcaaaaucuuucgugaaaccaguuucacauuagcaugauuaaaaauaguaacaaaacauacucgacgaauacaaggcccagggaucauagagaacuaccuaucagccauucccgaugaugugguuugccagcugcuucaaguucaccaucugccugaccccugcuccuggcugcggagcacuugccuaaccuguaauucugaaaaccuuugccaucacagugaguuguccaggcuuuguuucuauuuaguuugcuucaaccuuuaccccauugugacuuugugaauaaccgugcauuuucccuuuucucuaauauguaccuacaggguagguuaguuacugcgccugcugacuaagucuaacuaccaugucagcuuuguccugagugagaccuaggacauggcugcagguuucugaucauagaaucuucaggacccaaaacagcaucugagcaauucucaaguuaucggagggcuaaaaggacuuuucaugacgagagccucacuguacaucccagggugagcucuagcccacugggcaucacaggcgggccuuaacucaccauccaccugacaucauuucucuacagccauggagguaauuuacaguuuuugagaaaauccaaacaauaaaaucauuacuguuaggaugaauccuacuugacuuuucucuaggcuaaggacagagcauguucuacucuuugggucccguuuuucuccaguuuugccuuucgaggcucucccaccuuucuagcuuucuagcuuucuagcaccgggggccuggcucuacuugggagauggacuucccgggggcacugcugcccuucuuuucccauggacguuaagucuucacccaucaccugaaucuagaaacauccaggaagccacuguaaguacucagcagauugcuagugugugaaagcacccuccucaccaucauguggacuguagggcaguuguguaaaaggguugaaugucccagaaaaucaccagaacagaaauugagacauacugaucacauguagguugaaacaagcagaauaagaaacacuuucaacgaaagccaguuccuacuggaauuuaggcucauuaucgcaaauccuucaguccuaguagcaucacuucgacaagacaggaaauagcucugacuuucaguggagauuuucauguuuaacuaaaaucuuauuacaugccucacacuuaccucugcauuguaaaauuugguuuucacauccaaugguuugagaaccuaguucaaacaaagcacauuggucaggaaacgcugauucgacgauuuuuauuuguuuuaaaccacaggcuuuaaugacucaaagcuaugcuuuaauuuuaauuguuaaagauuuuguaguguuuaugaaauauucauguaaaacaaucuauuuuuucauuuaaauuauuccuucaaaauuuaaugcuauucuuaauaauccuccuuaggcucugcauucacuuuaucccuuuuuagauuuuuauguugccucauuaauaaaacaagauuuuaauuuucaauaaaaugcuucauuuuacuauaaaaauauuacauuggugauaauucauuugaacuuaaauuagucugacuuuugaacacuaguuuauaaaaugaauccaagaugugagcuauucguucuauuuaaaacauuucucccagagaaacgaggaauaauuauacuucuaagaaaauaaaaggcauuugagaacaacuuuagcucugccauauucaauaccugaaauuugaagaauuuccuaaaguacauuuuuucuccacccugcguuguguaacucacagcacacaccaagcugaaacagaaagaugucuuaguaauaaaucuaacaugcuucaguucuacuuauaaauguaaaaaaaugugaaguuuuaguauauauggauauaaauacacaugaaugcagagaaauggcauggcaugaagagauggcucccagcuugcugcugcugggcaaagcaggauuccugucgaucucacuaugcuucccagccuccacugccacugcacacacuccauguacggacucuauuuacagucucucucucacacauuaaaaaaaaagaaaagaagaugccuauccuuuucagaauaagaacgucagaugucuuccuuuagaaguagaauacaugccggcucuuuuacagaguaagcguaugagcaaggagaagaguucaucugcacucgagaacuaugcaucuuaaagggaaugccaggaagaaauaugcaucuuaaagggaaugccaggaagaaauaugcuucuuaaagggaaugccaggaagagguaacauguuacaacggagaauggugugcaaguuuccauaaaaaccaccgggaaaccuggguguggaggcccaucccuuaaucccagugcuugguaggcagacacugacugaggcacagugguucucugcgaguucuaggccagccacagauacacaacgagacuaugucucaagaaaacaaaacccacuaaaacaauuaaaagguugggaaaaaaauacuucuaguaacacacuaagauggcuagauuguuaacauacacaggguuuuucuaacucaaucaggaaagcaggaauguauuacucaaaaugugaaagaaauacaucaugauuuuaugaaaagaauacacagauauguuacaguccuguaacuaguuaauaaaacugugaaaugguaaguuacacaacauagucaaagaugcuaaaacaaugagauaauacuuuuaaucugacaagguuuggcaagaaucccuuaggcuggugagaauuauagaaacuuauguguuuuuacauugccagacggugaaaggaauuuagaaacauucuugugguuuaagccuuaagacuguugauucccacagaacaucuacuucaaguauucauaggaauauggauucuauuuuguuuauaguaacaaaaaaaccugaaaauauucuguaaacaaagcacacugacuagacacauaagaggcagauauuuagaaaagcauguuuuuaaggauacugacugauguagaaaaauauucacaguaaauugagaagcauaaaagcuugagaaauauaagcauagaucauacauaugcauguaaaaugaugggaaaauacauuaauuuuuuaauaguucuauagaacuuaguaaaauuggguaauuuagcuucuccuucauacuggugccuuugauugauaaugggguagacagugaguugcuccacuaauaccagaguuguugccaugcgccucaaauacugguaggggaaggggaggcuggagaaucaucagcuacagggcggcuucucuguguauuaaguuuaagagcaacuugaccaaacagugauaauccaucccuacaaaacaaaacaccccaaacuauaugcaaacaaccaaaacccaaaccaauguguacgcgcgcacacacacacacacacacacacacacacaaaaucaaaaaacccagcaauaaaaccaaaccccugcacaauacuuguccuagaaguguucacaggagaagcgcuauaucuccuauagguuuugagacuagcaucgaguucugggucuucuaaagugguuuaauccauuuccuaugggauagggcuacacaacugcccaggagguucggcuucagugaagaugaaccacugaauucugguacuucacugggaaacacuggcuacauagacuuuauauauuaacccauagcagcuauaaagacaaaggauagaaaacccacagguucuacaagcuauauacaaaugcaggaaaguuucucugagaaagucaccuaguucugagauauaagaaaucacacaaaggccacagguaguucuuuguaagcaaacacacuucauacuacagaaugagcuuggaguuaaagaagauccacgugacuacagugcaggaagagaagcaagacugacauagaugguggauuauguuauagacagcuuuguaaggcauagauaaaucagaauuucuaaaggcuagugugcugcagacccuuuuuggucccugucuguguagaacgggucucugguugaaggugggugaaggaguuggcgaaugaaugacacucagauucuacacacucuuucauguuguaucuguuuguuuucauguuguaucuguuuggcgccuucgaucagggacaccggggcagguuagucuuuauuucuuuuuccuucuuuuucuuucucuucuuuauuuucucaggcaaggauaggaucuggucaccaugcugcagacgggcugauagguagaucaguuaaggaccaguaagucuuaucauggggcaaucagaaucgaaagggaaaagauuguuucugucagucuuuaagcacauguugucuggcagaggccuaaaggucucugauaaauccuuacaagaauguuaugauuucaugcaaaaaaucagucccugguuucuagaggugggaagauugacauuggaggauuggaagugaguagguaaagauaugaggaaguuccaugaggaaaauucaucuagggaaauccccaauaaugcccuuauucuguggcaacaaaugagggauuuauugacugagaaaacagaauuccuugcagaggaagcuccuucagagcccucugaugaucagaaagcgaaacugucugcuuguaaaaagaaaucgugcuauacaggcaaaacagagaaaaggcuagaaaaaagugaaccagagacaacugaugaugaaggugaugaugaaugggacuuuacugagggaauggcgaagugugaacuaaagggaagaagagaucguuuucacagccaccaagacagcaguggggaggagucuuuaaucguggcacuugucacucguaaaccuguaccaaaaccacguaggcuucugccgccgguugguuuugaugcugccguggcagaggcaaaaagacaaggagacuuuacucucacuugcccaguaauuugcacagaaggcagugagcagcaaugggaaccuuugccguuaaaaacucuuaaggaauuacagucagcaguaaagacacugggcccuacagcaccuuauaccuuacagguuuuagauguaguagcaagccaguggcuuacuccuuacaauuggcaucaaacggcaaaggcuacucucgcuccuggagauuucauucucuggagaagagaguaugaagagagggcuaagaaguuagcacaggaaagaucuucaucaaaacguggaacuaagcccacgauguccaugcuucuugggcaaaaggacuaugcuaaaccagcagugcaacugaaaauuucaaaggcagugucggagaaaauuaaucagauagccguauccagcuggcagaguuuacccccgccugggacuaaguccacaguccuuucaggaauuaggcaaaagcacgaugagucuuaugagaguuuuguggcuagauuggaagaggcaguuucuaggaugcuuccucccucggaagggacugauauauuaauaaaacaauuggcuugggaaaacucgaacaccuugugccaagaccugaucagaccaauccguaagacagguucccuacaagauuauauuaaagcauguguagacgccucaccagccauaauucaggggauagcuuacgccgcagcaaugaaaggggagaaauucagcgccuaugucagaaauacuuauggaauuacauguuuucgguuguaaaaaaccggggcaccugaggaaaaauuguaaaaaucccuugggaaacaagaauggccuuucuccaggugucugcccacuuuguggugaagagaaccuuggagaaaugauuguaaaucaaagucccauaaagaugggacuccgcucacuaaagaaucggguaagacaaaaaacuacaggggcagucucuuagccccauucaggaacuguguggagcucauuauaggacacagccccaguuauaggaaaaacuucaaguuguggauucugauacuuuagguaaaauuaaaaguuaugguuagauuaugguuaaaguauaaaaagagacuucauaaaggucaaaauauaggucacuucuuacuguuaccuuauuuacaacuccccaauccuacauugugccaaaaauucauagauaaggcuuuauuggaaguuaggaaaucauuucuucaaacauauaugauucauuuuuguugguugcagaaaaugaagagugggcagagcagguuuugcaaauggcuguaaaauguuuaaauaaauuggaaguuuuggaugcuugccaaaagcuguuagagaauuuuggguuuuaaucuugguuugauaagcugccucuuacaagcaaggaaaaaaaaaaggaaaggaaaggaaaaaaggauagaggaaaauggauuuuggaacucucccagggacagagagaaaucaggagacacccuguuuuauucucuauggccccuacaggagaaguucucuacccucuuuguauugucuauguuuggcgcaccaaccuguccaugugucaauucauguauguuuuuguuucguugucugaaugacugacuguuuuguguuucauguuggaaaauaaaaauggcuaaaacuuuaucugcugauuuaguggagccagagaguggcccauacuuuagccaagaaucaagcacagcgggagagccccugcugaaaaacuguuuuuaaaaaaggagccugcaaccagaaacccguucuacgcagacagggaccagaaagggucugcagcacuagugggggaucucuccagugcuaagcgauuaauaaaugaagguucagaaaacucaccucuagggaauucuaauccaaaguucauaucaaucucagaguauacaguaaaaaguaccuucaauagagcugguggaaaaucgcugaucaaauagcuagguacaaguuuguauguaaaauguuucugcauuccaugcguuaauggauacaaugaagagaagcacagucgaugguggaagcagagacaggaggaaugaggaauacuuugaagagacagucggcuucugggacuggcuuuaggggucccugggagcuuuggaagccuaaauaguuucagaggguugaacugcuccaacuugagacccaucccauggucaagcacaaaucccugacacuauuaaugauacuguuaugcuugcauauaggagucuaacauggcugucuucugaguggcuccacccagcaucugacucagacaaaugcagagacccacaaucaaacaguggauggagcuuggggacucuuauggaagaagaggaggaaggguugugggcccugaaggguauacgggaagaccaacccgggaaagaccaacagacucaacuaaccuggacucuuggaacucucagagucagaaccaccaaccaaagaacguacagggcuggaccuaggccuccccacacauauguagcagaugugcagcuuggucuucauauggauccugaacaacuggagcaggggcugucccuaaagcuguuaccuguacaugggauauguucuucuagcugagcugccuugucuggccucagugggagaagaagcaccuaguuagucuaacagagacuuaaagugccagggcaggggaauacacaggaggugaggggaaguagagggaaggauugugggaagggaugaccaggagggggcaaugugaaggauaaaaagugaauagguaaaacacaaauaaauaaauaaauaaauaaauauuuaaaauauauaaauauacuucaauauauugcacauucacguguuauuauagauauauuuaaaauauauaaauauuaaaaauaugcaaaagacaaaaagaggaaaaaggaaaguaaauuaauaaaugagcagaaguuuuugagaagcgguaaacuuuucuuacaugugagucccaauuuccuuuacuucaugguguaugacgucaucaauacagcagucggguuuaaguucagccacagcagcauuggaggcugaaagguuuaaacgcugagaacucgucugcagauccgccuugaaagaaagagguaaggaguccaugaggcuguuagacauuuacagggaauggacgggcgcuguggagaggaguggggauaacugacugguuaucugggaagaggaagaggaccagggagaggggaggagagagggcuaaugagggguaauggugugucauaugaaaaucucguaaggaaacccacuacaauauacaauuaauauauguuauguuaaagaaacugaaaaaaggaucaagggaggaacaaaaaguaggaaguugggagaaaggaagggcaucguauaucucucaugcucagaacugcugcaagacuacacauacuacacauauacacacauauacacauacuacacauauacacacauauacacauacuacacauauacacacauacuacacauauacacacauauacacauacuacacauauacacauauacacacauacuacacauauacacauauacacacauacuacacauauacacauauacacacauauacacauauacucacugcaauaccaaacaucaaugaaaucaaccagaaaguagggaacauccaacaccaauaaaacagcaccauacgaacguaacagugccggagugcagaccacaagcacagcuggaggaaaaguagggacacacccaacacauuugaaaaacagaaucgugaccacugucuaugucaaaagacaaaacaagcuauugaguucaugcauuccuuuucauggggcuaugaaauucauuuuaauucauuuuguguauaugccgugauuagacaaguauguacauauguauacauauguguauaguaugcaugaauguauuuaagcauugauguaaauaggcauauauguacauaugguuauggguaacaaaagacucaaguuuucaucccuggaguaaaaaguuacaaacaagaaagcagggaaguaagucuacacugcaguaugaauaucugagaguuuuuuuucuccuuugagacauagucucauauagcucaggcuagccuucaacuuuguguguagcuaacuaugacuuugaacuuuuggccuuccuguccccaccucuccaguacuggagcugcagucacaagucaaagugcucagcuacaacaugggugguuuuuccccuuaagacuuuguuuuaauuucauguguaugcguguuuugcccggaucucauugaaacauuuccucagcugaggcuccuuccucucugauggcucuagcuugugccaagcugacacacacaaaaccagacaauauacuugcuggcagaccuagcacucagcagcaacugcagccaggugagccugggugaguggaagcccaugcugucaagcccaugcauaauuaauucccuucuaugcugccauggccacuuuguucaugggcccaugaacaaugacagggauggcuggggaaagagguugacugucuacagaacagguaggucauccuaccuacuuuauuauugaacuccucagcugaagucaccuuuugauaaguauuuacauaagacacaagugucuucacauccuuugccuauuuggagagaucuaucuacauacuacuucuccagaugucuuuuucagcaacuuaaaaaucacgcucuuuccaagucccugagcauccagcuaauccacugacauagcucaugaaucaaugaacaaucacauaucuagccauugcucuuuccaaacaaaaauuaugaccauguguacugacuggaauucugccauugugaagauuucccuucacuggagacuuuccgguugucccagaaaggagcuguaaugcugcagcuguccacuucuggauggugcauaaacaacacgcagagccaucaguuaaaccaggcccuagucucuuccucaguuagcugauuauuauuauagggaacaccccaugaggcuauaggugccuauuugacugcggauggcauuguaaaaggaguagaaaucauagggauuuggcaaauucaucauguaacuugcuugugccuucaggaccugcuuggucccaaucacguaaauaccacuuccauuugauaauagauugcugcugugcauguccuacuuuaugacuuggugggucaguaacaccuagcucaugaugggcagcucagguuucauggugacuuggugguccauugucaaacauucugauuccacuaaagccaaacagcaggugaagagcugccuuucaaagggagaaucauggucugcagaugacggccuuguuccaaaaucucaaaggucucuucugugaugggcaugccaaaggcuccaaacagcaucccuaucugucacugacaccucaaguaccauggggucugcuggaucauauggccccagugguagagcagccugcacagcagccugcaccugcugaagacugugguucugguuuuugcuccuucccuugguguguccaggugcugcugcaccccaagcaggacagaugggugauguucuccaaguauguuaguguuacagcucuuuuagacggcauucaaugaaacagcucucuuaauggauauucaacgaaacagcuugugcccuuuauuuggggugaacaagcacuauauaaaccuuggaaagugggaagggguuguucuaaggguaaaguuucauuggcugagguuuaagguucuaggacaccucauuugcuuggagauggguuccaggaaguugaucuguaauucugucaaggacugcaugacauuccucagguacagugcggggguuguggcuccccagauaagguagaaaagaggaugccccacuugcuccaggcucaugggagcugucuggacauggcagacuucaaccuuaguuagcaggguuucccaacagaacagucuccuccuguuccaggccccacacaaagcuagcagcuuuccaagccacuugguauaugggcuggaguaacccaacagaguguagcagucacuucaccaacugaggcugcucuggagccccuaauuuuuuuuuuuuuuccauuuugcaguuaauucuaaccuaacuuuguuagugcugguccucuuuagguggcauauuuauuaaugguaucucuauuguuauguucaguuaugaaauaguaguaacucacaauuauuaggaacuugccauguacaagucuuggcuggucgcccauuggucauuuaauucucacaguucugcagaucuaggacuaccuaaguguauagaugaugaagaucaggcauagaaaaguaacagcuuccccggggucagcacagcucacauaaaaugaagcagggguucaaaaccuuguauacacuuugacgugggaggggacaucacucagcuggauuucugaccuauauacaauaugagaucaauggcuaaguucaccuguuuauuuauuuaacuauuauuuaccacaaccaccuuguauaugacuucuuucucuuuuuugacauuauuaauaaugguauacugaaaauuuauuuauaccuaacaccuauuacaugccagagccuguucuaggaguugaaaaaucuaucagacaauaaaucagaccaagaucccuggcuccguggaguuugugcuuucuggagaggugcuaaggaagacuaauauacaggcugggaauguucucuuuaugaggccauguagcacauauuuuagauuuuucaagccacggucucuauuccaacuacagaccuuacauugcacuugggagucagucauggacuacacagcaacaaaaagggguggcccugucaagaaacuucauuuacagacacuugaguuugaauuucauaagguuucuacauauuauagaauguuguuucuuuucaaugaauugauacaaaaaaaaaaaaaaggcccguucucaguuuaagucuuauugaacaggcuguguguacucuaucaaaccuuaauuugauaaaaugccagacccuguccauaucugacacacauauuugcaucuaccuucugaaguuugauauacgaggcuuggaauauuuauuuucugagauccuuuauaacuuuaaacccgcugcagcuaagaguuuucuuuagaaacgucugaugaugauaauccagauuccccaugaaagacagcuuuuaaucaacuucucuccauacacuuuuacauuuuuuaaaaaugaauuuaagugaggauacaaauaacagggauaugugauacuuucauacauguguaccagugauuuuguuacuaucuacucugccaucaacucucuugucccucuuccccugacaauggucuacaauaauaguucccccauucccaugucucauaugaaucauuuaaaacccauguucaguguaugagaugaaaaugaagucugaaacuuucccuuuuucuauuguccuucugcuuccucucuccuuccccccuccucaguggccugucuagauucauauuauauauagaugaucgcgcgcacacacacacacacauacacauacacacacacacauacacacacacaccauuauaauuuugaagucuuaauucugcagaaugaaaacauguaguuucucuuuuaacaugaugaacucuaguuccauucauucucuugcagacgauagaaaucucuucucguuacagccgaacagaacucuauuguauauauaaaccacauuucucuacccauucauccacauagcaaaauuuuaauuccuuuaucuaagcucuuucuugaaaacacuucaaguugugaagggacuugcaaacucuagcuuuuuauuucucaacaucuucaagagucuuccaacugguccauuuccuaucaaguauucuacauggugaugcugccagccuuucuaacacaagcugagugacuacuuacuucuaguaaaagcucauagccuguuugaaacuguuugaaaaaguuuuuuuuuuuuuuuauuuuuuuaauuuauuuuuauuuuuugcuaaaaagucuuagccuggcuuucaagauaucacaguaaauaucuuucccacccuaccuggcacuugagucuuuguuuuccucuauccuauacucuuccucugaguccugcucaucuucuaagacucucuugucuuccucuccucuaccauaccuuccugcaacucgagaaugacuuuuggcaaguuuccuaagccucucaaguacuguaauguuagucacacaaacacuuuaacuauuauuuagccuaguaguauuuucucaucuaagcuaccagaaaccuugaggaggaaaauguuucggugaauucucuaaguaugggucuguuagcuaaucaucgguguuuguuagugacauuucaaaauucuaguauugggggccagagcaagcggggccggagugagagcuggagagauggcuuagcaguuaagagcacugacuacucuuccagagguucugaguucaaaucccagaaaccacacgguggcucacaacuaucuguaaugagaucugaugcccucuucuggugugucugaaaaauagcuacaguauacuuacauauaauaaauaaaucuuuaaaaaaaauucuaguauuaaccaugcauuuuaaugagguugccaaggcucaacagaaauaaaacuucuguggaccacagacauaguuacaggcgaaacacaaauacacauaaaaguuaacaagauacagaaaguuaauacaauauuuuuuaaaagcuauguaguguaaagccaguaaucauuuuauuaggaaaauaaugauuucuuauuuuauccaaauaaaaugcuuugcaaauaauaauguugcuuaccuucaccaauauaucuuuuacaacuugauugcugucauugugaacacugauauaacuggaaaaggucucucccaaaaauauauuccuacgaaaugaaacagcauuuuaaacagaaacucauucaguccuuaaggaaaucaaguaaguuuucaaggaagaccuucagguggaagacaguuuacugaagggccagggaacucuuucuuuuaggguccuuuuuuuagggucgaggaaguauuucuucagcauccuucauuuuccuuaggcugcugauucauuaccuacugcgcuucaacgugagaguguaaucacacacaacauaauacagcuaucaacugcuacccaaguuucuggccauccuggaaacuacggucacuguaaucagagcugcacugucagaagaucuguaucugaauacgcuagaaaaugucauuuucaucuuuuaaauaacuugugcucuaaaucuagagguuccaaguucauucaucucggagaacuuagucauuauuuuccuaauaaaaugauaacuggcuuuauacuacauagcuuuuaaaaacuauugucuuaacuuucuguauuguauuaacuuguauguguaugcguguuucgccuguaacuaugucugugguccacacgcaugcagugccuguggaaaccuaaagaaagacucggauuuacuggaauuugagguacaggcggcugugaacagccauguggcuguuggaaauugaacuuagguccucuggaagaacagccugugcuauuaauggcugagccaucuuuguagccccuuauucuauauaacuuuaagaguuuuacauccauacauuucccaguuugagagacacugguuuaugauuacacccuguaagccuagcauaacgcaacaaaaauacuauaucaaacccugaaaaguuccuuacuuuuuuuggcucaaacuuucucaguuuuaauucauugauaauauaggaaaagaagagaaauaaaaacacuuaagaguuucugacuaaggccaggcgugguggugcacgccuuuaaucccagcacucgggaggcagaggcaggcggauuucggaguucaaggccagccuggucuacaaagugaguuccaggacagccagggcuacacagagaaacccugucucgaaaaaccaaaaaaaaaaaaaaaaaaaaaaaaaaaaaguuucugacuagcuagcaagucugauaucuucuguaaagaguugggugugaaugaggcccauuaagagcugcucugaaaaugacagccacguugauuaguguaacuaaagaugcauagagucacugcccauauaagaccuaggccugggggccauguugauaguguugugauagaacacaugccuggcauguacaaaacucaugccuuuaaccacaacccaaagaacaaaguucacaugcuaucaucauauuagaaccauuacugacucuguucuacauugcuuuucuuaaaaaggagaagagcaaauuguauaucuuuuuacuacuuauugcacaagcagcacuuuccuacucuguagacaaacaugauauaacaguuuucagggacugcagaacaucuuauguaaaucuaucauucuuacccgaaauuuugggguaaagucaacauuucucccaacauuaaaaucucugcaccauuuacaguugaaggaucaucuuucauuaacugguuaaagagaucaccugcaggaagagaaaaacaaaacucuuaccaccuaccuuuaaagaaauaggagccagagggcagcagcucagugggagagcacuugcccaguauucauaaugugacugggcaaaguuucuucuagcuugucuuaccuggagccaucuuugauuuaaccugaaaugaaucuucccuuuucuacaccugcuguggaaagucccaugggaaggucccugaaccugcucuggacacucaggguugaacugcuccagcuaacuuuguguuuuggcuucuguuaaacugcuugcuugcuuaguuccccuugcaauugccuuauuacaucuucucaauucagauuuggcugggcugaguggucuuuuugucucuaagccaaaacaauaaaguccuggguugacuccuagcaccaugggcaauggggagaggaggguguaagauuucuuuuuaaucucaacaaaaauaguauuaauauuuuaauuucuaacuuuuccaaaacagauacaacugaguguagugauacaagccugaaauccuagaacuuauaagugagagacaggagguuuuacaauuuaggaucagucucagcuacaugguaaguuccaggacagucugggauauauggaucugugucgaaaacuaaaacugagauauaauauuuacacucauucuugaguuauaauauuaaaauucaacauacauuacaauguaaaaugcccuuucuuaucuguaguaucacagaauucaugucagaaaauucugguuacauggugaaugccuguaaucacaguauugccagguugagacagguggaccaagaauucaagacaccuuaggauauguauagugaggcccuguuccaaaaaauaaaauagcaaacaagucuccccccgccccaaauaaacaaaagaaaaccaaaacugaucucacagaauacuucaguuuugaaggucuuaagacauaaauacauuauagaaacaccaauaguucuaaacagaauacuaaugcauuuuugaggacucagagaacacugugauagugauagaaauacaaauguaucuuaaacuaaaaguuuucuuguuaucaaaagauaucaucuugaauugcagauuauaaaggagccccaucuuucagacgaccaccuucacauacucgaaauacacacaacacaggauucaacaaacgguaagcacaagacuggcaaagguacgcaucuuccaaaaucguguggagagcccagguuucaccuuuuccuuacauaccagguaaguccuucucuucacacguuacaggaauauuggugaacaaaguagguuuagucaaucgcaucacugucaacgaagagagagagacaaaauguucaaauuguuuaggguuaauauucaagucaagugcacaguauccaucaaguucaugcuaagacaacugcguuuucauacuaaauaaaagugcuaacaguauacauauuaucuccauuacacauacaaggcugagaaagaaaaguacuaacauuauaaauaguaucuauauuacacacucaaggucgagaaugccuguugaagguaauuuugcacauuaaagauuauaugcucacaugauauguacucacugauaaguggauguuagcccagaaacuuagaauacccaagauauaagauacaauuugcgaaacacaugaaacucaagaagaacgaagaccaaaguguggacacuuugccccuucuuagaauugggaacaaaacacccauggaaggaguuacagagacaaaguuuggagcuaagacgaaaggauggaccaucuagagacugccauauccagggauccaucccauaaucagcuuucaaacgcugacaccauuguacacaccagcaagacuuugcugaaaggacccuaauauagcugucucuugugagacuaugcaggggccuagcaaacacagaaguggaugcucacagucagcuauuggauggaucacagggcccccaauggaggggcuagagaaaguacccaaggagcuaaagggaacugcaacccuauagguggaucaacauuaugaacuaaccaguaccccagagcucuugacucuagcugcauauguaucaaaagauggccuagucggccaucaguggaaagagaggcccauuggucgugcaaacuuuauaugccucaguacaggggaaugccagggccaaggagugggaguggggguguaggggaguuggggggaggguaugggggacuuuugggauagcauugaaaauguaaaugaggaaaauaccuaauuaaaaaaaaagauuauaugcagcaaaauacaucaguggcagaaccuaggcuagaaccagggugacuucauacugcuuaaagcauauucuccaagcagcugaucguaaacuuggggucacaagggugaaaugucuuauuaaaaauaucccagggaauucaagcaggacuccauuuugguguuaaccagcuuaagauaugguguuggugucuccaaccuucaguuuuacuuuuuuuuuuuuuuuuuuuugugggggggguugguaugaguguuuugccucaugugaguuccuggucggaagagggcaugaggucuucuggaacuggaguuauggaagccuguaagcgcccagaacagaaucugguuccuaugcaagagcaauauguaagugugcuuaaccucugaacaaccucuccagccuccauucuuaguuuuuuuuuuuaaauauauauuuuuaaaaaauguuuauuuauuuuauuuauaggaguacacugucacugucuacagacacaccagaagagggcauuggaucccauuacagaugguugugagccaccaugugguugcugggaauugaacucaggaccucuagaggagcagucagugcucuuaauggcugagaucucuccagccccuccauucuuacuuuuaaguagagaauuaaaaaaaaaaaguuaaaauuaucaaauauaacaugaagauagcuacccugagagagguacacaaaagguacuuuuaauuuaaauagcuaaaguucaaagcccauuuuuguuguucuuuuguuuuuuuaaagaucugacucuagagauuguuuuaugaggccuagaugggcucacauccucuaucgcccagccuuggcugagcaugggauuacaggcaugugcacagcuguauguccugccuaagugcaaaucugggagacacguacugggcaagcagaauuauauaaacagcucauucugccaacguuauuguucuuauucgaaguuuuaggacaaggucucauaucacagcucaacaugaccuagaaugugccaugaagcucaggcuagccuugaacuuuggcucuccugccucagucuuucaagugcuaauaucuuaaccacaagucacuacccucagcucauuccuuuagugcuugagguaugucucacuagcagcccagcuguccuggaacucagagaucuaccuaacucugucuucccaguggugagauuaaaggccugcgccaugccuggcucuccucgagcuuuuaaacaaacuaggguuucaauauacuuuucuagacaacaaaaucaaauauaccagcaccaaaggcauauuuacaaccaucuauguccuauaaugaauuaauggaucucaaaaacugaaggcgcuagguauaaaagagcaaacuaccuacaaaagcaagauuuaagaaacucuggcagugggcugggagaugggucauuugguaaagagcuuguguaccagcaagaggcccucagaaaccauguaagaaacgcugggugugacaucuggauacuugggacuugcuggccagcuuacccagccuacacgacaagcuucagguaagagacucugucuccauaaaagcaaagcaaacaaaacaaaaacacaccaagguagcugaugccugaggugccuaggcuggccucuguaugugcauacacaagaaacauugacagagaaacuaaaacuaaguacuagguauuagguaguaaucuuauaucuaugcuugaaugguaaaguaaguuauugguucaacaauccaaaacccacaaaacccauaccuauuauuuguuaaguugggcaauaaaguuggauuuguuuaagaccaggucaaaguucaaacaaaccacagcuuaucacuuggaugccucugcaucuuagcuuucucuguguaucuccugucugccucuuuccuagagaguaagugcuggcugcauuuuuucaaaggcucucauugauuuaucuuuccacacuuauuuuuguuuuccuagcauguucuaugugugauuaaacagugggaucuugaaaggggagggaggcugaagguagcagccaauagcgagccacccagccccagggauccacauguagcacuacguucaaagaucugacaucuuaaaaggcuucuagagggcuagauaaggaguucaguggauaaaagcacacggugaccuuaguucaauucccaggacuuacaaggugggaagaaauaaccaaccaaucccuucaggcccuucucugaccuccacauaugcacgguggcauguguguucacgugcaaacacacaauacauacauguaacuaaaaaccaaagacuucuaggaacuaacaguggguuuuaaguugucagaucuugauaaugccuuacguauuaucuaggugagugggaaaugaacucugucuuuagaaucacuauacuauuugaagcaaaaaacuuuuaacuuuuucuguuuuuuugaaacagggguucucugugcagcccuggcugucuugguacacacucuguacaccgggcuggccucgaacucacaaagauccaccugccucugcuucucaagugcugggauuaaaggagaacacuaccaccgcugccaauuccuaugcuuuuacuuucauuguuucucagagaauucugagauguagcacuucauguggaauacaucagaaaacuucaaauuuuccacauaugaaaacauagacgcuccuuuuaauucuuggauuuaaaaacuguuuauaaucucauugcaacuuacacuuuuuaguuguuauaauccuucuaaaauaacaaaacuaucacaaaagugauaugacuuccaaacuuuuaacucuugauuggcaaccaaucaugaaaaauacaaaaucagacauacuuugauaagacuuuuaauuuuacaacacagcucauauuauauuuaaaugaauaaggauuuuuaaggauucacuaaaauaaaaucauucauuuaaacucaaaucauugggauaaagguuagaacacuuacguucaauuuuaauacaaacaguaauucaucaaagcucacuuaacagaaggcuaauaaacauaaucuggaauguuccugaauugacugacaagccuuggaauuaugugauauuuauauacuggacacaaacuguauccauauuacacaauuauuuccucauacuauaaagaagcaucaaaauuuaagucauuaaaaauguaaugaucaauaaaauuuauucauuucacaauuucaguccauauucauuucauucagaauucuuuuccugaugaucaaaauuuauuacauacuaaaaauaacaccauauuuguguacaaauaaaucaauuuucccaauaagagauaaucuuucuuuaaggagauuuccuacauauucacagcacuuaauaucacagaacacccauauuuggccuaacugucucuggaugguagcguuacaagaagggaguucaucgcgccugauaaggcgauugaguuuuguccaaaugucuuccagagucugguuguugcaaacacuguauucuaaaguccaucuugcucuaugaaaggagugcaaauguaguguccuuaaacuagcuugcaauuuucuagacaaaggaaagaucuuuucuggacaguggcugcuggcaagcgaaacacuccaggaucucugcuugugcuguuuuucuuuuccugaauuuuuauccaaaugugccgcauuggucugcuccuucacugugugugauuggauaaagugcugcaguuuugagcuaggcugaaacuccaagagaucuacugugcagucauagcucugggauuuaacaccagguucugagauggcuaaguacugcuucacgcucucagcagccucuucagaaauuacuggugguaaucuuucaggcuugaguggaaguuuggacucaucguauggaaaccaaggaauaaaucuugguagugggugaguaggaaagucuugaauuacauuuucugcaauuuuugccagcuguuugggaucguuuucauauggucgauaauguaauauuacuucaguggucauucugcagcuauccauuaacucuuaaugaagauaaaauuucuuagcugaauucuucagagcuagaauguaauuuauuauuacaaaauugucuuucuugucaaaucagaagaaacaggaccuaaaguagaagcauugcaaacaguaagauuugguagggacagccugcacacggaugggcagggaggagaaucagaauccauucugcauauggguuuuggguuuguuuuuggucuuuucgagacaggguuucucuguagcccuggcuguccugaaacucacuuuguagaccaggcuggccuugaacucagaaauccgccugccucugccuccugagugcugggauuaaaggcgugcgccaccacgcccggcuugcauaugguucuuuaauuaagugcuauggcagaugggacuauaaucccacacuugaaaacuuucucacacaauaaaguaucugaaugagguuggaaugaagauuacaucuagccugaaaaugcugauagccagcauguuuaacuaaguggauauauaggauuuugaaauauuaucaugaagauguuugguauucauaguccuaaaaccauaaaagaaacaaaaauuugguaauucguaucacaucacguaauauuucaaaaaaaauuuuuggggggugggggcuggagagauggcucagugguuaagaacacuuccagaggacucuaguucaauucccuuacccacaagaugguucaugaccgucuauuacaccagcuccaucagacagucucuucuggccucaaugggaaacacauacacacacacacacacacacacacacacacacgcgguauacauacauaauacauuguacagacaaacauguagguaagacauccauguaaauagaaguugucuucuaaaaaacaguuuuaaaaaaaaucccaguacucgggaggcagaggcaggcggauuucugaguucgaggccagccuggucuacagagugaguuccuggucagccagggcuauacagagaaacccugucucgaaaaccaaaaaaaaaaaaaaaaaaaaaaaagauguuaguuuacuggacgccaauguagaauaagagcacaacacagaaguucucgugauuucccaaauuaaagcagugaccagaaguuccagcacacaaggccucaagaauggagccagucaggaucugaucuacaaguugugguuccuaaccaggcuaaagguaaauauaauaaagguucuucuauaucuacacacacacacacacacacacacacacacacacacacacacguuuagucuuuuacuccccaaacgugagagaacuaauuuauggucuuacacacugcuacaaaaacuaugacccugauuucugucgugaugucacaacaaaaccagucugauucuuaagaauuaagagguaacuguauaaugaaucauuuuacagccuuaaaauaaccauauuuuuccuaagauuaaguuuuaguauagacuuaauaugugaugacauagucuuuaaguacuugagaaugaucacuucuugaccuuuucuggcuuacaaucaaggaugaggaauuaaugagcuuauuuuuguuuucuuuaccccuuuucaguguaaagaaggacaucaagaauucuuuuauuguugucugaacauauucagugauauacuaaagaaacaagugaaauuuugagagcucuuuuuaggucaaauguaguuucaagaaaaacaaaagggagugaggauguagcucagucaguagagugcuugccuagcaugcacaaagcccuggguucaaaucccagcauaccauaaacuggguauaauggugcucaucugugaucugagcaucuggaagguggaggcgagggggccggggacacuuggucauucucagccacacugagaguuuaaggucaagucacuaagugucuucucuuucuacaaaugaagaauaauaacaaauacaacucccuaccacugagauuuuugguagcuucuaaguugugugaaaucacacuuagcagcucauauaauuguuuuaaguucauauagaaaucauaacgauccaugaaagagcuguuucauuuucuaggaggcaacaauaccuuagaaagaugauuuuugaauuauugcccugaucucuuacuagacauguuaucuuggaaaagcugcuagaccuuaaaagauaaguuaucuuuuaagcccacacacuagauguaagacggagauaaugaauauccaguaaguuccuuucaaacacauauaaucuauuuuagucuagaucguguggaagucuacaggucucauuguuguauugauaaauauugcaaaccuucuuaguuccacauucauagacagucauauuaacugcagacaucaaaacaggauuguagguuaggaauggaacuggcgagcuucuggaaugcaagauguguauggagcucacagagaaugagggaggaauguggaguauaucaaaagggaugccuuaaagaagguuaagugcaauucaaucuaguuuaaaugucuuguaaccauuucucccuaucaguugaagucacuguuaacuuuauaaaugcacaucccaaaagcaagaaagugcauuguggcaguagcaaacauaaaaaagaggcugaaaauguuuuuaaauaaaagguuaucgauaagcaaauucaaggaaaaucugaccucuuaucuuuuuuuuucugaucaaauuaaaucauuaaaacguauucaaaacuucugcguauagacaguuaaaguuguuaagauagucuagucaauuuucccacaaacaugauacuacaguaugaauuaauuuguaguauauuucaacaaaucuaagaaguauuagguguaguuccacuuauuucaaauccuugguauuaucgugcuacacuaucuacagauaaguuaaauucugguaacuucaucccugcgccauggacagauuuaggagcaauuuuugaaaaaaacauaucaaaugccagcugaaauuuaugcugguucacagagaucucugcggcagggucgaggcgcgugagcuucaguggacaaaacgugguggcugcgguagcagagaccucucagagcuuggguucgcauuucauuccaggaagagcaggaaggcgaguugccgggguuagggacaaggccuacuucggggauccuucgcacaaugaggguacaggcaaacaacagagugaggagucucagguuagcaaguuuaccuuuuagcgccagcaggugcuccuguuuggggggauucacuuccaucuuggcgggcacuucugaccucagccuacgcaggcugaaguuucaccgggucuggaaggaaagugcaaagcacaggucccggaagaucgggcuucaaacgcacgcccgacuucuuucugcucgugaggacuuaaauucucuugucacuaaauccuuuacggccccagugaaaucuuuguaccauggccauuccuuagcucagaagcacacacuugccucaaccacuaaggcugacuacaacgauccacuucuugcugacaauucgcggcuucccaaaagcuuucauugcccggugggggugggggagggcgcuacugucauggcaugcugggauuuguaguucaucauauacaaauuucgcaguguacgcggggcagguggcauguagcucaguccuuuauucugauucguuucaguucuagagaaaaaauauuguuacaggaaugucauuuucaccauaaaauuuuauuuauguuccauacuuaaaaaaaaaaaauuucuccucuccauuacucgcagaugcuuucaugaaaaacagugcgcacgcgcaa

SEQ ID NO: 7211 - RNA, 25657 nt, Mus musculus
caucuauccugcgcaugcgugagggcggcaugcgccgaggcuucuggguaggacgcucaaccccuccucucaguaaaaggcucuccugcagcuguggcgcggcuccauccaggauggcugcccucgcuguaaacaagcccggagccggaguagacagugggcggcagggcagccgggggacggcuguggugaaggugagggaacuugcgugcucuguucuccaccugcggccucccuucgguucguccuggagaccuggccgcgacuguguggcccaggcuuggccgggugggaugcgcggccucuggugggcguuacaagccuuuccgcccuuccgcgguccuugccccgcggagcugaaguugccuggucuucuaccucaagugucaacguuguccguggggcuguuugugaaaagcaucgcgugaaaguugaccuggauuuauuuggucuuuccccuagucuucuguuucuagugaugccucaacaggcguuacuuacuugacuugguuguauuaaacacuuauugcaauagacaaguacugucguagaugguucagcucgcaaauaucuacuuaaaagguagauguuaaaucgcauuuuacaugggaggaacccuagguuuaaguuaauacaguaugugcuaagggcucagaguuuacugguugucaacgucugccauucaacauugcccugaacaguagagacuggaaacuucugaacucuccaacugcagcacauuugggcuuuaacacuagauguauggaguuuauaacucucugguuagaagauucuaccgucuacuuauuuacgagcuacauuuacuaaaaauuaagugcaagugugaagaucauuuuccucacccacuguaaccuagaucuaaaaggggcaggcguuuuagggagucacucggaaagauuaucuguugccaagagauuaaacaacaacucuuucugaguguguugacgacaggacauuuuuuuaauucccagaaguaauuuuaauggacacuuggauuuauaacagugaacccaagucugguuggacauucuuuuaacucguuaaaugguagauaucucuuucugucucugucucucucuauagcaaaggucugcuuuugaggaauauaugccuacgauguauuaucagucguauuuuauugguguugaaucaguuaacuuuuuauauuaaugaaauuuagagaagcccucauuaagcauauuuugugcuuauugagauuuaauauuuugaauuguguuuuugccaaaugggaauacuugcagaauauuuugucauucuuuuccuauaauuggaauaucaugucuaauucuccuuaacacuucguuuuacuuuacucauaaaguauucugcauauguacaugaaaaacauaacgguuguaguuauggcauaugaaugcacuauaauuucccuuucaauuuaguauuuauauguaucuuuccuuguuuuuaauuaaugauacaaauagugcuuuaaagaguuacacacugguuuugucauaugugggcuggauguuauucacuaguagaccauuuaccugcuaugugcaggaaccugagauuucccaguggcagaaacagcaauagcaacaaagaagaaagcacuuggauccugucauguauguaugacgcaguuuagaguaaguuccauaaguacugcuaaauuguguccaugaaugcuauuauuagucaauagacuuuuuguauuagucagugaaauuguuuuccuauacuucuauuaauacaaaacuuuaacaacuuuuugaaaaaaauaucuugauguaguuauucuuuguucucuaaugaguuagacugaaaucuuaauauaaaguuuucuuuaacauuuagcagguauuuaucucuuuuuuuucccuaugaauuauaccacauuuaaguuucuuuugaauuauuaccaguaugugagguaacuacaaauuaccaguuuaauuguaguaaaagaaauuuguaucucaguuucuaagucuaaauguauuagagaaucaaguugucuucugaccuccauacuuguucuguggcaccuuauauaugugugugcacacacauccacacauagaaaauagcauaaacuuguaaaagauuaauggagucauacuauaugucaaaaauugaauaauuuaucuaucuauagaagaaagcaagggugucucuauuuuagguuuuaaaauacuaagaaacaugccuggcuuggucaauuguuuuuaaaucuaaaauaugugaauauuguuucaguaguguuuacagggcacauguuucuguuuuauauacagguucuggagugugggguuugugaagaugucuucucuuugcaaggagauaaaguuccucgccuccuccucuguggccacacagucugucaugacugucuuacucgcuugccucugcauggaagagcaauacguugcccauuugaucgacaaguaacagaccuagguaggaaaauuauaugagguuaaagugaaaaauuauucaaacacaaaugucacagaaaacaaauuuuuacaccugacuuuuuauguuacguuccaaagagcuuucacaaucugagucucuacuaagguagaugagguccacucuuaacugccaugggaaucugaaacuuccauagcuaugcuuaacacaaaaagcuuuaagaaguaucagaaauauaugcuacccuuauucaaagaaaugagacuacuuuauucaucccagguuaaguccuacuaaugcucugaauacagaacaugguuucuuuuuuuaaaugaaagguaaucaaaauauaaagucauucaacucucaguauuuccucccucccucacuccuuccuuccuuuuuucucuuccuuccuuucgucgagauaggguuucucuguguagcccuggcuguccugaaacuugguuuguggaucagacuggccuugacugagaucugucugccucuagcuccccaguccugaauuagaggugugcaccaccauggccuccuagguccuugcauguuuuuacaacuacuugggaaucaguguugacauauuuuaaauguaaaaguguguguguguggguuuacccaaauccaguuagguuggcagaagaugccuuuauccaaagaucuaucucacuggcucagguuuagaaaguacaacauuaacauuugaacaguuauuucacaguuuaauguaaauucuuaauuuauucuguaagauaaaagaauuuuucccaaaauuuuuuaaggcugacuuuuuuccccucagguguuuaucaguacuuaagaccagggcucguggaaggagugaaccgacuccugaccuccauacuugcucuguugcaccuuauauaugugugugcacacacauccacacauagaaaauagcauaaacuuguaaaagauuaguggagucauacuauaugucaaaaauugaauaauuuaucuaucuauagaagaaagcaagggugucucuauuuuagguuuuaaaauacuaagaaacauggcuuugacauguuuucuuaagguuguggcugucuuuauuuccuagaaagcuaaugaaaaacacuaaugauauuacacagauaauauuaauguacuauaagccauaaaguaauagcaguggaaacugucaauuuucagauaauggucuuuaagauugacgaugaucugagguaaaucuuccuuuuugcaacagugagguggucuacaugaguggaugcucaguguuccucagcaugcaucgugaggaacagagcuuucucagcugcccuaaacccugaggauuugcagggacaacacaagucuguauuuugguuacuuuuaguuuuuuuuaguuuuugucuuguuuuguuuuguuuuuguuuuucgagacaggguuucucuguguagcccuggcuguccuggaacucacucuguugaccaggcuggccucaaacuuagaaauccaccugccucugcuuucugagugcugggauuaaaggcgugcaccaccaaugcccagccaaguuuguguuuuuuaaaaccauaaaguuguagaguuguauuuauuuuuuacagcuacaaaauuguuaguuacuccugggaguuuguauguucccuacauaaugacugaauuuugggaaauucuucaaggccauauuuuuaaaugauuguucugaaugcuuaaauguuuauauagauggaguagaugaagaccaauguuccaacguguuaaaguaagggacuguccaagugaucaguggucucuauaaauuggcuaaguuuuggaagcuguguuaggcuuccuauauauuuucaguuaauaucaguuguucuuggauuucugaugggauugaaaaacuacauagucuccuagccagcccaugcuuuuugcuuugagagggucagauuugagaggaugguuuucagaugguauucaaucuaaagccaagacauagccaggugcagaacuauaguuuuuaaaguaaggauagaugacagagguucuauuuaauuaacaaagaugauggaauggauguuaggucucauguacuuuauaaauuacaaaauaauaauaguuguguucaguuauaucugagauaaaauagucuuuuaauuagacagaagggggggggauguuguggauaacccuggggcaaauucuauuugauguuaauucuauucuccugugagugguugugaacaaggacugagucagcacucaggugaguuccuguaaaccugcuucccaccuuaauuuguaaaauaaaggagagcugaugauuggacagauaaaagggaagguggagaggaauguagagagagggagaaggaggagaaaauggaagagggagaggacgcagaggaggaggaagaagaagaaaaguggagcagaagcacauggccuagagaaacugcaaguucuaaggggucucauaaauguggaagaugguaguguagugguagaucugcccaauguuggcacacagcauguauucauauuaacugaguuguguuuucauugccugggcauauuuggguuggagauuuaccgcaacaaaauggcacccaaugugggccauuuuguaaaauacaugggacacacagaaauaaggaagagaccuugcagaggggcagcaaagcugaggaagacuugcuugagugcucagauuacagagaaaggggggauaaacauagcuucauuuuaaaaaaacagaaugauuuugguuuguuucuaaggaaaaaaggaugagaaacaggcaaggacccugaugaccuccguccuugaacauguuaaguacauacucagcuacugagcuaaacuucuucccccuauaauaucuuuaaaaagaaauagaguaaaacacagcauuauuuucguuuaaaaaaaaagucuauuaaugcauauguggccuucauucuuguauauguuuucuuauguguggcuguuuguguguuuuuauuggccuguaugcaggugcccuugcuacugcuugcuucagagauccccugucuuuaacccuuaauaccagaauaaaaagugagccaccauacccacuuucauuuauguggauuugagggaccugaacucugacuaagccaucucccuagccccuaguuggugggacuuuauuuuucuggugugugugcgugugugcacacacaugcauguauaugugugcacauauuccuggauugugauauaaaauguauuucuuacuguagguagcuguaaaguaguauuugaaaaauauugaaauacucguuuucauuuauauagcaaaagugaaauagaaagcuuguaagguaugugucugcuuguagggcugagguuuugguaacauuaacaagcccuuuuccuggcaccuuuuagacauuguuaaugacugaacugugugaguuagaaauuacucucuagguaugagguaacuugaauacauuuccauuuuguuacauuuacuuucauauuuguucuaggagacucagguguaugggguuugaaaaagaacuuugcuuuacuggagcuuuuagaacguuugcaaaaugggcacauuggucaguauggagcugcagaagaggccauugggacaucuggagagguaccgagggacuuguugaaauauuuauuacaagauuuuuuuuauccuaaaauauuuccaauauuuguacaauaguaccuuauuugcugugucugugagguuuuagaaacacaaguuuuuuauuacauuucaauucuaaaguggccacuguuuucaaaaauaaaacagaaauuaaauuuguugauguucuuugcccaaugugcuuuaugagaaacucuucccuuaucacaauuuaguuauguguaaggaaaaaccuuuaagguagggcauuauaagagaguaagagaaauguuuauauuaguacagaaaauuuaaaacugaaccucagcagcaaaguacaagaaaacauagacaaacuuuauaagagaccauucuguuuagaggagaacuaguuuaaauguaacagugaagucugaggaaguuccuacuauuaaauauuguuuaaacaauaagaaaaaaguuaaauggucugcuugauguaugcuaugcugacaagcagacaucugguaaggauugucaagacacucccuuaacaagugacaacacauuguuagcguuuuaagaauugccugcacagcuuaauuaacaaauggaagauuucuguauagaagaauauuugcgggcuggugagauggcucagcagguaagagcacugacugcucuucugaagguccuaaguucaaaucccagcaaccacaugguggcucacagccacccuuaaugagaucugacgcccucuucuagugugucugaagaaagcuacagugugcuuguguauaauaauaaauaaaucucuuuuuaaaagaauauuugcaguaaauaacuguuaauaguguuaguuuuggacuuuaaaaacugcauauuugauuuaagaagaaaaagcuccaccagacugauugcacuucccuuuggugguuucuuucuauuuaaaaugagcuacacaaaugauuuuugaauugaagcaucacucaucuauuaaagcuuugccggucuuucauauauuguaccuucuaccuuuauuuuaaaaacauuagaauauaauguacuguugauaucauaaauuauuuguaaagucuagaaaacaagauaugagaaguuuaugguacaaauauacauuauuauugcaaaauaaaucauuucaaucuuuaggucauuuuaaaauuuaauuugacaauaaaugauaucauuuguguacuaucuaauuauuucuggaaaaauacacaaaauauuuccuuugccaacuacagcuuucuaauauaccuagguuuucaaagcauuccauacuauguaaaaguuauuuucacacacuuacaaugucuuauaaagacuuuggacacuguucagugcagaggacuugcuuacuauggaagaagcccuggguuagagcaccaggaucacaaacaaacaaaaugcuucuugauacuuaaagaaaauuaaacauaauauuuagcagcuuacuuaaagaacuuauucuucuaaaucugugguuuuuagucgugauuguaauccauucaccugugcagcuauuagaauguacuuguauauguucggggaaaaauauauaauaucucaaaaucuauugagaucagaacuucacaucuuaugucaggguaucuuguauuuucaaaauuuccauagcuaauuccaugccuuaguaucagguuauuuauacagcaagugcugcuuuucuuuuuaugcacacucauggcaaguaacucaagcaaugggaauuuaagucugucuuaaagaauaagguuucugugcuucuucuucugaaaauuagauggaagagaucuuuguucugucugugaaucuaugagauguuuuuauauguaguucaauggcagccuguuugucuggcauuuauaagguucugguucaacucagcacuggggguaaaaaggguauucaugagaauaaauuuauuuuugccuccaaaucauaucccaugauaauaauuagucucagaaauagcuucuuacuuugcugaagaaaauaguuuuuagauggacagguagcacauggccuuuauacuuaccaguauauugucauuguuaaauaaaaucugugugaggccauagauacugaaugcauguucuggggccaacagaccaaaccaauaaaggguuuaagcauaauuuaguuaauugaagaaguugaacuuuaguugguuaaaggacucagaugaccaacuagcuaagcuguaucccacugauucauugaacaagcuguagcugguuauuuucuguaccuuccuuuuguauuaguuaguaauguguuguugcaucaugguuuaaaguuuccagaacuccauuuggcucuagaagccacauauuuugaagaccauuuugcuuuguuuacuuugguuuucuucguucaguuccuuaguucuuugcuucuauuuggagugauugauuuaaccuacuuccuuuuuaaaucucauauauaagccugggaaguuaaguagaaaagauugugggguuuuauaguuaaaaauuugccauguuuuaaugaguggauucaauuuuaaggcauuaauuuuuuauuuguuagagcaucauucgcugugaugaagaugaagcucacguugcaucuguauauugcacugugugugcaacucacuugugcucagacuguucucaaguuacucauucuacaaagacauuagcaaagcauaggcgugugccucuagcugauaaaccucaugagaaaaccaugugcugucagcaccaggugcaugccauugaguuuguuugcuuggaagaagguugucaaacuaguccacucaugugcugugucugcaaagaauauggaaagcaccaaggucacaagguacgagcuuaauucaguuggaugauuaguuauuuuaccagccuuucauuuguuuuuguugaccugauuauuuauucaaagacauaaauaaacuuuagcuuuugaagaaaguuaagugauuaaugaguuggucucaguagcauggaaaaguugaggauuuuaauuucugaaugguguaaccucagcgaggcuucaugauagaucucuuaaaaaggaaugaaaauaaauuaguauuuuugucuucuuacauugugcuuguuugaaauguguuacgaagccacugugacugauguucauuuauauugaaaggguuuuaaguaguuguuguaaaucauuauauaccacuaggaauucuuuucuauaauugcauuguauuuauagcauucaguacuggaaccagaagcuaaucagauccgagcaucaauuuuagacauggcucacugcauacggaccuucacugaggaaaucucagauuauuccagaaaauuaguugggauuguucagcacauugaaggaggagaacaaauaguagaagauggaauuggaauggcucacacagaacauguauggauucuuuuuuccccucuuuaucuuuuaaccuuuuuuauucuuaucuuucaucuucuaguccuauacuggacacugcacauaaaaugcuguccauaaucuaucauagaaaguuuuaagcuugauaauuauuuuguguuguggguagggaaauauacuugguaguauauaggagguguaacuugugguguaguuuauggauguuuaaacucagauuugaaggaauuccgucaaagagaagaguggguugggaguguuuggagcuuugagccagauuugacaagaagaaaaauugaagaguuaaagaccacguagucacugcagaacccauuagucaugcuggagacuuuagcacuucagcuucagaguaauugugagcuaugaaaauauugacagaggaacaagauuuacauuaaaaauuguugcuguuaaauauagaaagugaacuggaaggaaguagcguggauacaggaagaccuguuaagacacaguugaaaucaucuaauuuaagaugcuuauguccugcaguacuggaguaggaguaacaaagaagagggauuugagauuuuaaagaaaagcauuaauugucaguauugcuugguggguaauuugauuggucaggaaguuaagagaaaugagaaauugaugagccauuagaugagaaauugauugugaggaccaguuugcuggaggugguggucauauggcuagauucuggaaaugguuuauagucaccagaauuugcuaagacuaguuauggaauaugaaagagauguuaaggauaaauuguuuucucucucucucucucucucucucucucucucucucucuuucucucucucucucuaacuugaaugacuuggaugaaguuacuauuuacugagauagagguaauuagguuuggagauggggaaaacuggagauuagauuccauuuugcuuuagauaugauuuauaaacaguuaaauauucgaaaucauaguuaaacagaaaggucuaauggagagauuuaaagucuauauggguguagaugguguuuaaauuuuaauauuuuacauauaaaguauuuaagguuuaaauuguuucagaauuuacuugugggggcuggagagauggcucugcaguuaagagcacugacugauauuccagagguccugaguucaauucccagcaaccacaugguggcucacaaccaucuguaauggggucugaugcccucuucuggugugucugaagacaacuauaauuguacucauauauauaaaauaaguaaauaaauauuucaaaaaaaaaagagugaagcuagaagugaagggacagaagaguuaaggcuugggaguuugggggaucaggcucagggacaguaaguuggaaagcaguaaaguuuaaaaaaaaaaauaugcucgugucuucacaggucccagguacugcagagaaugcccgaucaugugucagagcuuauuuuucugauuuacaugaaacucuuugucgucaagaagaaauggcucuaaguguuguugaugcccauguucgagaaaaacugauuuggcuuaggcagcaacaagaggauaugacuauucucuugucccaggucucaacagccugucuccacugugaaaaaacucugcagcaggucgguaauuuaaugugguuaggcugucuucuaaugucaagcauacaauuaucagagauauguucuucucuuuuuucaacuuagugacuggguucuacugaauguguuagcauuggucuuaggacauggccucuaacuugaaauuguuccaccaacccuaugaguguccuucuguccauaugcuuuuccugucccaaagcucaugaugcuaggacucuauaaugucauucuucaauuaugccauggccauuugcacauguucuguuuuucaguguacauguauucuuucuuucaguggaaggcuuccuucugcaaggucuaccuuagauguuuacucuuggggucuuuaauucauuaccuagcuuacagaugguuuccuguuuuuaauaaaugagauucaggguuguccuaacaaaaguguaacgugagugauuuagggauaauuauugcuuuagggauucuugaaaaacugcaaucuaugucuuaucuuuacugaugcguugcuaauaauuaugcugauuucaaauuauacuuuagaacuuuaaccaaauuuucuuacaagucucauuauuuagaguguugccggccuacaagcucauucuuagccauguuucuuguugagcccuugucguauugacuuuuagagauugaugugguucuagcuuguucucuauugcuaugauaaaaugcuuccagaaaccauauuggugcuggaaagagguuuauuugucuuacagggagcaguccauuguugagggaagccaaggaaagaagguagagacaggaauugaagcaaacauacacuguggaggaaugcuacauaguagagugguagauggaugauugauggauagauagacagacagauagcaagaaaaauauuaauccgggugcucaaaacauccagcagacacugacuggggaucccguuuaaggagccagcagaaucuuuagcagagcagauggugcuuucagagaaaucaagucauggugagaauguaacagucucaccugggacuuacacuuaguagaaacugacuggggaagccucaggaaggcagcuagcugcaguuguugauagaccucugagcaaagcaaagugucuccuugggugaggguuccaaguaaaagaacaaauagccagagguagagauaacaucagcagauuauguguucacaauauucagcagaaauaaacugcggaagucaaggcaggcagcugaguucccaggugagucuucccuucauggaugagcuuccugugguugaauuucauacuucugucacacaucacaggguuaccauagcaacaugcucagaaggguuugucuucuagcugcuccuaaggacaugaugugugcuggcuaguuuuaugucaacuuuacagagacugaagugauuuuggaagaggggauagcagaugaggaaaugcucaguacuggaucggccucugggcaacccugugauacauuuauuugauugaugauugauguggguguguccagcucacuguagguaaugccaucccuggguucuguaacaaaacagacugaacaagucauggggagcauuccaguaagcagugccuccccccagccacugcaucagugcuggacugugaugugaaacuagaagcugaaagaaacccuuccucuucagguugcuuuugguuaugguguuuuaucacagcaauaggauccuaacagacaugauguuuucauucuugaucucuuuugcuuucucuuucuuacuugucacagaguuaagguaccaucccauucccagacaagggggcuuggaagacacuuaacauaaauagacucggcucugaaggggggaagcagccugguuccugagccagucucucaaugagcucaaacaacacaugacaguuuaccaauguaauguacuuuacaccuucccagcacuacgagcaaguaccacguuaccuggcuuuuuacauagguucugggaauugaauuuguguucucaugcuugugaggcaggcuuuuuaccaacugcuaagcuccuaaacuuuaguuuuaauacuguaauguuaaaaggucuuuuguuaaaaguugauaaaaauccccaauuuuuaaaagaaauacuaugagaaauaccgucuucuuuucuaggaugauugcagaguugucuuggcaaaacaagaaaucacaagauuacuagaaacacugcagaaacagcagcagcaguuuacagagguugcagaucauauucaguuggaugccaguauuccagucacuuuuacaaaggugauguacuguccuuuguuuuuaccugugcuuucugcaaacugugaguagcaggaaauauaaaucaacuuaaagagaacaaacacuaggaaauucaugaguugaagaauuucaagaaaaacuguaaucaguggagaauagaaacaaaucagacuaagucucuuccugguuuuauuggaauuguacccaaagcauauuaauuuuacauuucuuucuuuuuuuuuuuuuuuuuuuuuuuuugguuuuucgagacaggguuucucuguguagcccuggcuguccuggaacucacucuguagaccaggcuggcugggauuaaaggcaugugccaccaccgcccagcucaaaauuuauauuucuaauacauuauugguacuaucagguguucagcuaauaauucaaauuucucaaauuuuuuuccaaaguaaaagaauauugagacaauaucauuuaacguugaauuuucuguauagccugaaccuucuuucucuaacucccaauugcugguauuaugugugugcaccaccaugccuggcuucuaaucaaauuuuuaguuguuuuuguuuugagagagagagacuccaaagaagguucauauaugugguugaaguguuguuaucuuuuuauaauguguuccagugauuuaaaaacauuaaugagcuggguggugguggcgcacaccuuugaucccagcgcuuggaaggcagaaagcagguggauuucugaguucaaggccagccuggucuacaaagugaguuccaggacagccagggcuacacagagaaacccugucucgaaaaaaaacaaaagaaaaaaagaaaaaaccauuaaugaacucuauuuuguuuccuguuuuucggaaugauuaaaaaauaauuuugucacguaauuaugcaaaauguuuauacaguugaaaguuaaaucugcagugcagaauucauucaggacuucugucucugauuucugaugcuuuucacucuguuuacuauaaaaaacacuuagaguuuucuuaguuaaucaucuuuaaaaaacuagacaaauguuuguuuuauauacuuucuccacuuuuaaagguggagugccuuuuacuaaaguguacaucuuaaaggucacuucauaucaguugauuugacuuuaaugcuucgauaaaaguuauuuuucauaaaaaauuaccauaaucuaauacauccaaaacauguaauauacagcuuuaccguccuaucuauuauguguucauguuugggaugggggugugugcagaagccagaggcggaugucguguaauuuuuuuuaaugauucuuugguuugaucccuuuagauagggccucucacugaaccuggagcuagacuacgggacaguaagccacaguuuguccuccacagcacuaggauuacaggugcacacacaaccauacccugaauuuuaugugggugcuaagggcaaguuccucauagaaccacucuuaacaguuacacugagccauugcuccagccuuaaccuuaccccuuuuaaaaugaugguuucauacuguuaaguauuguuguaaacagaggugcagaaacuuuuuauuuuacagaccugaaacacauacuuuuucuucuguuugaucccugcuagccaccauucuccuauuuguucugugaauuugaauaguuuagauaccucaucuaaguggaacaauuguagcaucuuucuuuuuguggcaggcuguucaagauuaagguaauauccugaaaguucauguuauaguaugucaagaauuacauuuuuuuucuuaagacuggugacuguuucucuguauguacacaucacaacuuaauuuauugguuguugaauucaguuuacuagaauuuuauuuucuagcuuauaucuugauauauuugguaaggcaaagaacaaugauggguacuaagaaugccucaacuuaucuuuguuugcaauacuagggaucaaaguuggucuuguccauuguaagaaagcuuuucacuagucccagccccaguucucuucuuuuauacugacuagcccaaguccuauggcuucuuagcuaaaaucuaggguucuuauuggauuuuagucuuuacauuauuuugcuucugagaugugguauagacuacacuucagaacccauauguagaugaaggugaugcuuauggaacauuacauaaguagaauguaaaggaacaucucauaugguucuaaaaaauauuaacauuuaaaaagaaaguaagauucuaaaagggggauuaaauccaggaaauuuuuuaaucaaaaaaguaaagaaaauaguacuuaaaaaggaagcaaaauaauaauuucuaacaacauauagcacauaugaguuaagaaggauuguacagauuuuugcauaaauuuaaaacauaaucugguaaauguuuacuuuuuaaucuucauuuuauuauucagaggagguucgggccuuauagcuuugaauguauauacauauuuuauuuuagaauucuuuguaaacaugaaaaagucagaaauuauuuaaaauuaacagacugguuaaauuguucagaaaucauaauuaaacuaucaguaguuuggucagcauauauuaaaaugaaaaaagcuugccauaauauauagaugugaaaaauaauaguauuuaucuccauaaaauauuguuuuucaaaaguguauuuggaugguugggauauacuguuacagguuuaugcccugaguuugguuccuaccaguagagaaauaacaaaaaaauuccuugaaaaauauauuuuuucuauucuucuuauccaauauggaauguaucuggaaaaauauauaucagcauuguauuacuaacacauuuuucagcaaauuuaacagcaggauuuauuuuuaguugauuuaucccuuuuugagguuuuaaucuguguaauauuuauauguccauguuuguacauauucaugugugugcaugcaccuggaggucagugucaagugccuuacaguuguuuugagacaaggucugucagucaacauggaucucuagggcuccauuugucuuggcuuccugguuccccucaguacuggguuuacaaccguguauuaccacauaaaguuuuuguacaugcuggggaucuaaacucagguuuucaugcuuacauagcagguccauugcugauauagcaguuucuccucccccccccccauuuuauguauauauauauauuuggauauuuucuuuauuuacauuucaaauguuauccccuuuccugauuuccucucacucccuauccauucccccuugcuugcuucugugagggugucccucuacccacccauccacuccugcuuccccacccucaauucccucacacuggggcaucuauugggccuucauaggaccaaggacuucucccgcugaugccugacaaggccauccucuguuacauauacagcuggagccauguguacucuuugguugguggcuuagucccugggagcucuugggguggggagucugguugguugauauuguuguucuuccuacgggguugcaaaccccuacaacuccuucugucccuucucuuaacuccucuguuggggaccccauuuaguccaaugguuaguugcgaacaucccgccucuguauuuguaaggcuuuggcagggccucucaggagacagcuauaugagacuccuuucaacaagcauuucuuagcauuggcaauagugucuggguuuggugauugcauaugggauggauccccaggugcacagucucuagauggccuuuucuucagugucugcucuacacuuugucuacauauuugcucccaugaguauuuuguuccccuuucuaagaaggacugaagcacccacacuuuggucuuccuucuucuugagcuucauguggucugugaauuaucucuuggguauuugaagcuuuugggcuaauauccacuuaucagugaauauacaccauguguguucuuuugugauuggauuaccugacucaggaaguauuuucuaguuccauccauuugcauaagaauuucaugaacucacuguuuuuaauagcugaguaguacuccauuguuuaaauguacauuuucuucauccuuuccucuguugagggacaucuguguuguuuucagcuucuggcuauuauaaauaaggcugcuaugaacauaguggagcauguguccuuguuauauguuggagaaucuauuggguauaugcccagaagugguuuagcugaauccucagguaauacuauguccaguuuucuaaggaaacuccagacugauuuccagggugguuguacaagcuugcaaucccaccaacaguguaggaauguucuucuuucuccacauccucaccagcaucugcugucaccugaguuuuugaucuuagcaauucugacuggugugaaguggaaucucaggguuguuuugauuaaaauuucccugaugacuaaggauguugaacauuuguuuaggugcuucucagccauucaguauuccucaguuucuuugagaauucuuuguuuagcuuuguaccccauuuaaaaaaaaaaagauuuauuuauuauauguaaguacacuguagcugucuucagacacuccagagagggcaucagauuuuguuacgguugguuaugagccaccaugugguugcugggauuugaacucaggaccuuuggaagagcagucggcgcucuuaaccacugagccaucucgccagcccccuguaccccauuuuuuaauaggguuauuugguucucuggagucuaacuucuugaguucuuugcauauuuuggauauuagcgauguaggcuugguaaagaucuuuucccaaucugcugguugccauuuuguccuguugacaguguccuuugccuuacagaagcuuagcaauuuuaugaagucccauuugucuauuguugaucuuacagcauaagccauugguguucuguucagaaacuuuucuccugugcccauguguucgagggacauagcaauuucuuacagacaacuguucacccuauuguaauuuauuagcacaguauaaaaaauguuauuaagagaagauucaguuguggauuugaacaaauaaaaguggguauauggcugggcagugguggugcacgccuuuaauuccagcacucgggaggcagaggcaggcggauuucugaguucgaugccagccuggucuacagagugaguuccaggacagccaggacuacacagagaaacccugucucgaaaaaaaccaaaaaacaaaaagaaacaaaaguggguauauguauuucaauuuauauaagacaguuauaauuuuuuauuuuuuuuuauuuuuuuauuuuuauuuuuauuuuuuuuuaagauuuauuuauuuauuauauguaaguacacuguggcugucuucagacacaccagaagagggcaucagaucuuguuacaggugguugugagccaccauaugguugcugggauuugaacucaugaccuucggaagaacagucggugcuuuuacccguugagccaucucaccagcccccaguuauaauuuuuuaagaacacuuuuguucaugaggagaauuuauuuugaugagacuguucgauuuagagcucacugauuacagugagcugaagaaggaauaugaggcaugaaaauaauaaagguacuuuauaacuaaaaaugaaauucuagcauaguggccuaugacuguaaccuaacgucaugaguuugaggcaagugugggcuguaugggaaguuugagaucagccuggguuuacacauggguuaaaaacaaaaagaaaaagcauaaauauuguuauauucugacuuccaauuuuucaaauccacaggacaauagaguucauauuggacccaaaauggaaauccgaguagucacauuaggauuagauggugcuggaaaaacuaccauuuuguucaaguuaaaacaagaugaauuuaugcaaccuauuccaacaauugguaaguuugaauauugauaggcaacugacuuauagcuagcuggguucucugaugaaguuauugcuauucaggugacucuuuucuggcgcuaagacauuauuguuucagagggggagaugagaucaugguugugaggcugaaagaugcauggugacauagcaaaaaggacugaauguugcugagacagucagagggaaugggggcuuagacaaucugacaguguuaggagugaggagggcagcaguacagagcuggcagguguuugaaaggauuggggaaauuguagacagguagcagcuauuaaaggcagacauccccagagacuagcaguagaguuuauuuggguucaguaguuauugcuauaaggagacaacugcuaacucaaaacuaugaauagagauuuucuuaugauuagugugucauucauuguuaaacuuaaauacaauauaaaauaauguuuugacaaaauaacagguuuuaauguggaaacuguggaauacaaaaaucuaaaauucaccauuugggauguggguggaaaacacaaauuaagaccauuguggaaacauuauuaccucaauacacaagguaagagucaagauugauauucuuuauuaaacuuaaaaauauucuuaaaaugaguauauaagugcucugauuuaauuagcaagacuguuauuuaaauuguagaauuugagagggaggaagauauaaauguauuuuauuuuaauugaaaaaauaacagaacugcaauauguacuuuuaguauacucucaugauaggccauuauuauuguuauuauuauuauuauuauuuugguuuuuucgagacaggguuucucuauauugcccuggcuguccuggaacucacucuguagacuaggcuggccucaaacucagaaauccgccugccucugccucccaagugcugggauuaaaggcgugcaccaccauuauuauagaauaaaaaacagacuuagcuucucuuggcuguuauuaauguugaagucuauuaucaguauuccuauugguguggcugcugacaguaagguagcaugaaguugaauuuguggaguacauguguacucugaggucaacauuuaaucuacuauaauuguccaagaacacuacaucaugauuuauaauuaaugcacucccagaggacuauugaggcuuuguuuuggcuaggcaccaaggggcacauaucccaguguuccaucuagacuuacuucacaccuggcuccauucuacacuuuugugcccccucccaugaaguauuacauacaccuauuuuauaauaauggugauauuucuauuccuuaagauuauaguuuucuaugcuacuauuuuuuuucacguuuuugagacaguauguaggcuuaccugaccuugagcuugcuauguagacuagguuagccucaaaucauaaagauccaucugucucugccucuugagugcugggaauaaaggugugggcuaccagacucagcaguuuuguuguuguuuuuaacuuuuuaaguuaacauacacaguaaugaguuucauuauggcauuuuucauauguaugcaucauuaacacuucuccuuccuccuagcgguuugccuuucccuaaagagcucucacucugcuuuuguaaagaacaggcagccuuaagggagaucuuaagcacauuuucaggggacagguucugagggacagguguuuuuuuuuuuuuuuuuuuuuuuugguagauucaguuuuauaaaaccugucagaggaggagaaccugugaagcuaucuaaacucuuccugaauuauugcuuuaaggcuuuaaguagugacauuaaguagguagguagccuuuaaaugaagauaggguaaauaagauuuagcaagaauaaugaaagcaauuaauacuuuuuaauuuacuuaaacuuaauaaauaacuugaaaauuucuguguacuuuuguagcuguuguauuuguuguugauaguagucauagagacagaauuagugaagcacacagugaacuugcaaaguuguuaacggaaaaagaacuccgagaugccuuacucuugauuuuugcuaacaaacagguaaugaauuuuuauaucaacauuuauuacuuugguaguuuugcauauuccauaucauaagucauuugagaagauaucaaagaaucaauagauacuuguaaauuucugcuguggaaaauguuaccuucgauauuguagaguauaugcacauacaaaucaaguaaaugcauucuuguguguucaugcuauauucuaauauauauaaauuaggacaucacuucaacaauauuaauagaaugcugagacguaaggauagaccuauucuaaauuagguuguaucuuaaaguauguaaaaguggauuuagguagaucaggaguuuagauuggccuggcauauauggcaaucucaaagcuagccugaguuaugcaucaagaccuugucucagaaauaggaaaagcuggagcugaguggcagugcucccauguaacauguaacaugucccauguaacaugugcauggccuugguuuugauccuuugaaugguuuauagugggggauucggucauaugauuggaguuuaaauuaugauaggauugaacuuacagauguauuugaguuuauaugugaaggaauaauauuaacaggaagagaaacaguagcauagcuaguuuuagggagcaucaaacuaacuuauauauuaaauucaguuaaaggaugaagaaaaccuagauuaauagaucuggucauggaauagaauaaaaaaguuaauacuuuauuuuguaacauuuuuaaaaaaaaauuauuaaucuacauuccaaguguugccucccuuccugguucuccccuuugcuucugaaaggugccccgccaccuacccuaucauagcugugauugauuucauuauuuauuccuuaauauauauagauauucuaaccaaaacauuuucuuaauucuuuuaguuaaucuuagaaucugaaaaugaauuuugguuuuguuuaggauucaaucacaguguuaccaguaguuuucuauacaauugguaagaguuagaaaaaugauuccuugauugauagaaaucacucuauguguuuuuuaggauguagcuggagcacuuucaguagaagaaaucacugaacuucucagucuccauaaacuaugcuguggaaggaguugguauauucagggcugugaugcucgaaguggaauggggcucuacgaaggguuggacuggcugucccggcaacuuguggcugcuggaguguuggauguugcuugauuuuaaugcagcaguuguuucaugcuuaugguuaacaguuacuuugcaugugaugcauucuaagaaauucuacaucucaaaugugauaauuaauuuaguauguguauauaugaauccuggacugagaaauguaccauuguuuuuaaaaaguacucuguggcaaauuuaaaugacccuguuacauugguuaaauggagguuucuuggauauacacuuuuaaaagguacauuaggcauuggaaacuuucaguguauauauguccuuauauugagagagaaguggucacagacaaugaguagaagguccuuuauuuuagugaaaaaacagccaguggagugccuaacagagcuuaaggaaguauggcuuuaccccaccuuuuuauuguuuuuggccauuguguacuagaauugaagcuauauugggguaauaggauugcuuuacuuccacauuuagcauaacauccuuagugcugggguccauaaaacauagaaaaucauuuuuuucuacaauuuuauuauaacucucuccuaaagcauuuugcauaacgcacagugagaaugaaauguuaccuaaguggaccugaucauuagaccagaacuaaauuaagaacaauaaaacugugaaaguuguuugaucuucacucauaagaaccauuuccaggacugggccuaaguuuauuucccaggucauagcccuaaauugcuccuuuauuuguucaacacauuuucuuaggcuaaguaaugugcauccuuuguugguaaagugucguaagucacaugaaaaaccugucaccuuuacauaaacacauugagaccuaaauaggaaacuaccuauaccuuaggaaagguuuuucaaacagugggaaugcuaauuucuuuaacaugguuuuccaaguuaagugcauuuacuugacaauaaaaaggaucaaggcucuuuaggacaaggucucaguuaaaaggaagaacaugucuaaaguaaaagaaacuuuuauaaaaaguuuacauuuacuauggcaguguugugaauaaaaauuaaauuuuguguucuuacaguuuauuuguaaaagauacucuuauuauggaagcaugauuucuuauauuuaaauagguagaucuccuguuacuaaugcucuuuaagaugaaguugagagcuaaaucuuagugcaauuguuacaaggacagugauuuuuagguggcaauguucugguucaguuuuuucaaauauacuuuuuuuuuuuuaaacuuaggagccagcacuauaaaaagcccaucaaauauuaugggcaguauguaaauaaaaauauaauaauuugccauuuuucaagaaaguaaccggucacgcuguuacaaguaguuuguaugcauauguaauacuuuguaauuaaauuauuuaauauuugacugauuuuaguaacugugaaaaauaaagauguugcauuuauuugugagacuuugaauuguuuucuguaguagguaacugaaaauauguugacacuaagaugugaacuugcuuuucuuguaaauuaagaacuuuauuauuucucuaauuuuguuaaacuuuguaguucuuauucuuaaaauauaacuaaacuaauuuuaaaauugcuuaaaucugacugugacguauacauacugugguguuuguguuacuuuuucuugggugggcuccuaauacugugcauaauaguuagauccuuugaguagucauuguuaagacuguauuaguuucuucagggaaauaucaaacucgaagaaucaacagauguuuuaaguauaauaguauuugccuuauaucucugaaguucuauauuacaucuaauuauuauuguaugaaauauguaaaacagguaugucaaguguauauagcucuggucuguaauucagaaaugauuuauagccuccagaagccauuauuugcacuuacauauaugaucaguauagaaagcaauaaaauguuuaaguuauaaggaguuguuauucuaaaaauuguuuaauaaaccauguaucuaguaucaugcuaguuaacaauuuaagucauuauuaaaauugggcauagcucaauagucgaaacacuugucuagcaagguuaaaguccuggguuugauccuagcaaaggaaaagugaaaaacuucauuugugcuaugccuaaaagaaacaaacacauaagaauggagacugacugacuuauguuugagagagguuuuauuugcuaaugcaaagguuuagaaauacguuauuuuauauauaguuaacauauauacaaaagguuaaaaaaaaaaacugaagggaaauuugaauuguugacauaaacaagagugaaaauuccugaguuuuucaaugguuaauauacaagguuaauuuaaccuuguuucacaggaaaauaaagaacauuuuuuuuaaagauuuauuuauuuauuuauuauauguaagugcacuguagcugucuuuagacacuccagaagagggcaucagauuucauuauggaugguugugagccaccaugugguugcugggauuugaacucgggaccuccagaagagcagucggcacucuuaacaaccacugagccaucucacgagcccaauaaugaacauuuaaaaugaccauuugcauggucaugucauuguaauuaauuacugugguuuuauggccuaggcuccauuuccauccccaccaagaaaggggguugcugagcuugaaaaccuaguguauguacuaaagaauaauaccuacacaacauuagaaaaguucucauuuuacaaaaugguaacagugaagacugacguacaccuguauagagaauccaggagagcacagauuaagaaugggaucauguugguagaauacuuggugacaugcacaaagcacuggguucaagcaucagcaguacagcauaaacugggcaugaugguaugugccugugauaguaucacuugggaucacuagcuacauagagacuuugagguuagacugggauauaugaguuccuauuucaaauaaaaugaucugaaaaca

SEQ ID NO: 7212 - RNA, 24313 nt, Mus musculus
caaaagcugcgccgcggcucggggaaaccuaguucacucggucgucgcgucucuucuaacgccucggacgacauggcgaccgagagugggagcgauucgcagcugaggaggagaaggcgccgagacccagagggaucagaaaaaacggaacugagcgagcgagaaccggcccuggcaguggcggggagcgaagaaaaugaugaugagaaugaagagcgcugggucgggccuuuaccgguggaggcaacccuugccaagaagaggaaagguagcagcggagagcccgcgagcaagcuggacggcuacuccggccgagugggaggguugaucucaagcacgcccacgggcgggagugagauuguggguuugugcacuuagaacggacgaucuucacugcauuuccucccuaaagagugaauugguguuaguauggcguguuaaaaaaaaaaaaaaaaaaaggaacaccguugauuccugacugucagagaugauacaaacuagugcuugucuguauuucuguguuuggaugcuuuuuuugaccucauagcugcugugugaaguuggaauuccuaauauugauugagcaggugugggaaggagcucucagaaucauaaacacuuaagcuuucaacccugacucgucuaguaaugaauuuucaaacucaggggaaguugcuuaagcuagcuggauaugaagccauacucgagacaauauaguaaaguuuugccacuaacgugaauaauaacaagauuuuauaauauuaaaguuugguaaagagauaauauuuacuguuuuaaagacuguucuaggaacuuuuucauaaaugucuuaggguuguguguguguguguguucguucgcucacgcguuaaucucaauucugacuguggaacuauuuaaaaaucuuuuauuuucagaacaaagcccaaacaccuuaacauggauuaugaggcaguuugucucucuuuauuuccccaagcaggacucccaauucuguccauucucaaaacccuaccuuguccuugagcaagggcuccucuacguuccuguccagauacugugaagugucucuaucuggagucauuucucuccuuuaaccaugcuagcuuuuuaacaggucuagguuuuaggucagugcuuuuugaacauuggauagugacacccuuuaguuagcuccuuacuuuuucugcccaauccugcuuuugccuucgaggcacuuacuacuuuuuguaguuguguguuuacucaugugacuuccugaacacuacuagccuaaucauguaagaacaaggaucuuguacuuucggcuccaacacuucaauacaguguuuugcauacaaguuuaaaugaauauuuuauaacauuugugcuguuauuauuucaccuaaauauuacuacaagaacugcuuagguggaaagaauggaaggauaauuuaggaaggaaaacgaaacaaaaugaaaaagaaaaaccaaacuuugaaaugcugacauaggaaacaagugucuuaugaacaauagaguugggacaggaauagguauaucaugugaaaaaucuuuucccuuagccagauuuuuuuuuuaagccaaccaauggaguuugaguuugagggaggaugacaggugcuuagugauuuaaaauuuuuggaaauguaggcaagauuagacuuuuguguguauauguucacaaugauauaugguuguuuuauaguacuuugaguuaagcuauuuuuuaaacauuuauuauuauuauuacuauuauuuuauguguaaggguguuuugcaggcauguauacuaugugggugucagguauauuauguguuggugggaccagagaggugggaacgcuuauacuuaguacaagaguggagggcagaggacaaugucaccuuguagaguugguucucuacauccaccuuuguguggauuccaaagauugaacucagguugccagaggcaagcauuguuacucggagccaucuugccugucuuaaaauaaacuauuuccuaaggaaaauaauuaugucuuucucuucuuucugugcauguucccuugaauauauuuaaaugaauuagugaacaacaaaagcaaucuggaauauaggaaaauauucacuacagaaaauuccaauaaacaacagcauuaaaaagauacuggaguaccacuuuuaugaaauaagcagcccaggauuggugugacuccaauguuccuaggcacguccugcccuaagaugacugguauauggcccucauuuucauuguccugggcucuuagaauuaaugcuguaauccuaauuaauaccuagcuccaagcugaaaaacugaagaagggaagaaaggaaaacuuuuuaagaauguguauguauauauguguguguguuuauauacauauacguauauuaucacaaaaugcuaauccuaacccuuacuauacaguuacuacaagaacccaagaaaggccauuuuaagaaaauuuuacuaggcacacauaaaaauggggauucuguuacuaaaaaaaauuugaaaagcaauuugucauacauaauuuugagugugccacauagcaguaacaagaaccuaauaguuggucauguuuaauuugcuagcuuuauauaggcaaguuugaucuuuuuauuuggaaacagugcauuuucuaaaaauugaucauggcucaucauaaaauuaagauuuuuuuuuugaugaucaucgauuuuccauuuuucuagguguuauacuuuagaaaacuaucugaaaggcacucaaguagauuugcuaggauuuucucaacuauaaacagcuaaguguuuuguuuguuuuuauguuucaggucuuuauacugacucuuuaauagaggaauaaugucuuuaaacauacaucuuacaaauagcugucagcuuuuguuacauuaacacuuacuacuaguuucuauaugguuauagaaaucauuuccguaaagcuuuauauuucuuuacacauucauauuaagccagaaccauucacaguuaucaaaaacuuugaaccaggagcuagaagcucaguugugagaagacuugcugauccugcaaaacaccuacauuugguucucaggacccacaggaaacagcucauaaaccagcuggaauucuauuucagauucauucaccauccucugcuggccucauuggguuccugccuguacacaccugacagacacugcagcagacauaaagucuuugaaacaguuuuuauauaaucccagggaaccugacauacuaacuucugaaguaauaaaaguuauaacugguauuaacaaauacuggauuuucguaucccauauguuuauugaaagaaauuaaaauguagaagguaauauaaaaauuuagaaaauucuaaauaaucauguuaauuucauucacuaaaaauacuuuugacccccucccccaguucuggaguucgaaagagucuaccuugauaaucuccccagugcauccauguaugagcgcaguuacaugcacagagauguuaucacacaugugguauguaccaaguaagugugucauacuuuguccuuuacauuuuacauuuaucuuauacgcaugaguguuuugaauguguuucugcaccaccugcaugccugauaccuacagaagccaaaagagugcaaugaaucucucagaaucagcauuacagaccuuuguaaaguguaaacugccauguaggugcuaggaauuaaacucagguccccugaaacagcagccggugcucauaacuacugagcugccucuccagccccaaguauaucauaguauacauucucagaaaaaaaucuaaagcuuaauuaugaguggacuuacagaaguaauuuggggauuucauagauuuaauuuugcaaauucuauaauacuuaaacaaaacccugcauguuuucuuauuuaaaauaaaauaugucagacagaacauccuaguauguguauguauauuuggugauaaaagucaguaauggcugaaucauguuaucagcuuuccuaggaagaaaguguauuaagauagaaaugguaauaaauuggccucuuugguguuuauagagaagauaauguaacucaaaccuccuggaauuaucagaggaccuucaaaauggauguauaggaaauuucaaagaaugguaauaacaguaaaaaugguccccugauuuuuuagcucaugauauguauagauccuauuugagcuauauuucauuaauuaucucauuuaucuuaauaguuuaagaaucuuaaaauuuucuuuuuauaagugagaaaacuggaauagaguaaggggcagaagaagcuaaagcaaaaaauuaauaugcuaaauucuagcuuucuguucuuuauuuggauuuuuggaccugugagcaaguaacaucacauuccuauuuuuaaaaggagcacguuggccauacuaaugcauuaaaauagggcaaaaauaggaacaaggagaacaggcagcuguuguagaaauguggaugaguuuuaauuagggcuuagauuauauugacagugauuaucaacguuggagggaauacuuuagaagagucuacucuugaucucuuaaaacaaauugcauuugagauauaaagcuuuaauaguauaauaauagaauaauucugaccaaacgcaguuuagacuuguuacuguauaaagcaaccgguagauacuagcacugcuuuucuaacccgagcugcagaguucaacaagaaguuauguguuucauuguuguuguguuuuguuugguugguuuuugguuuuguuuuuuuguuuuguuucugguuuuucgugugugugucugucuguguuuguauaugucucugugauuuuugugguuaaguaaaucuaaagcuauucaccguguauggaugugguguagugugaauaaauguaguugucaaaguacuaguauauauaaaauacuuacuauauaugcacugugcugaauaaaugguuucaguuuuuauaugugugauagaaaaaauuguuaaaucuuuuagauucuuaacuaaaauacauugaauaauaugaaauaaauuuauguuggacuuuuuuauaugugaaaguaguuuggguguuuauagucuucugaaauguagaaaauuuucuccuuaaaagacuguguucaguuuagcaauaaauacuaaaguuuaaugauuccaacagagauuuccauuuuuguuuguuuguuuuguuuugagaugggaucucccuuguuaaguugugaaagcuggcuuugcacccuguuuauggccuaggcaaccuuccugcuccagccuacuguguagcuggguuuacaccaccaggcccaacucaugauuuguuuguuuaaugguaaauccuuuuucaguucugaaaccuaccucuugggguucauauuaguugcuuauaucccuacaauggucccuguaaaggaaaauuuaaaaacaaagucaaaauaguuaaagccaaacuggaggugguaggauauaccuauaaauccagcuccauagagacaggggcaggcaggagggucagaaauucaaaacuaguuagcuuagacugcauagugagugauaacuugucauaaaaaacaaaaagccuauuauugaaguagccaaaugcugucagucaauguuugcuuuaacauuacucagcucuauuuuggaaguuaacuuuaaauuuuuuuauguauacagaacagauuuuauuaucacugccagucaugauggacauguuaaauuuuggaaaaaaauagaagaaggaauugaguuuguuaaacauuuucguagucaccuugguaagagcuuuauaauuuucuaagcuguacuguuuuaaaaugucuuuaaaauauugugcuguuuuucuuugagucguggaucuuuauguuauuuguauuuaccagaauguuuuaauuuuauuuuuugaaauaggaguuauugagaguauugcaguuagcucugagggagcguuguucugcucugucggugaugauaaagcgaugaagguguuugauguggugaacuuugacaugaucaacaugcugaagcucggguaagauuucucuaaagcacgugucugugugugugugugugugugucugugugugugugucugugugugucugugugugugugugucugugugugugugugucugugugugugugugucugugugugugugugucugugugugucugugugugucugugugugugucugugugugugugucugugugugugugucugugugugugugugugucugugugugugucugugugugugucugugugugucugugugugugugugucugugugugugucugugugugugucugugucugugugugugucugugugugugugugucugugugugucugugugugugugugucugugugugugugugucugugugugugucugugugugugugugugugucuguguguguguaugugugucugugugugugugugugugucugugugugugucugugugugugugugucugugugugugugucugugugucuguguguguguaugugugugugucugugugugucugugugugugugugugugucugugugugucuguguguucaauuuaguaaaguaaguguaaacuaaacuuuaccauauuauaggcuauuuuugagcagaauauauuaucuuaccauuugugggcuuacauggaaaagucagggaacauccuuguguuguuuggaggcuucugauuuuuuucauucaaguuuuucuguuuguuuuuugagacaggguuucucuguguagcccuggcuauccugaaauguguuugguugaucaggauggccucaaacucagagauccaccuugaaauuuucaaguaguaucacaacagagauucaucauaucuagcuaauaccacuuaguaaauggaugaagacccaucaugccuaacugccgauagaauaacuuccuugcuauauuauacuuacuuugaagauacaaacuuguguauuuauauugauuuuaaacuuuauuguguagugauacugauauucaaauuauguggcugaauaguacagaaauaagacuuguuuuaagcaugacuuuuuaaaagauaacaaacuaucuauauccaaauuaauaucaacuuaaaagucauucuauuaucagaauguuugggaacuugcuuugcuugaaagaaauaaccacagaccuuaagcuacacaacuuuaaaaaacaaguuuuuaucccacaaauccaagguucaaugcuagcaauuucauuucuuaugagggcucucuuccugcuucuuggcauuuccacauuugguuaaagaagacaggaguuggcagaugaggacaagggcucauuagauuaggcacccauccuuaugagcuuauuuaguccuaaauuuggaaagauguagcuccuuuuaauaguccuaaagacuauauaaaaaguccugcuaugaacugaauuauuucuauaaaucagaucaaaacuuuggcauauguuuuguuaccagauuuuaugagccacagaaauagccaguguugcuguacuucuagaguuaccuaacucgaucuucagcuuguuuccccagacauuugcuauuuuugaaaauaacaaauaauugagcauuagcucuuugagaauacucaaaagagucuauuucagaacugauagaaguucuaaaggaagaguucaagaaagguuuugagcaucagcaccauggugauugguauaacauuguaacuuuaaaauugacuacuuugcaggagacaacaaauauuaaaaguuuuuuauguagacuaaauacgucaaguucauuuuugcacauuguucgucauagagcauguccaguguuuacauuuuuaauaucaagauaaguuuucuuuugagaauagucagaaucuaacuauuuucauauaaaugucccaagcauggauuuacaaaguauacuauuacaugcuaaccuauuaaaaagguuuacauauaaacuguuagauacucaaugccucagaauaccuuacgacccagauaugauuaaguuuccuaacuacccaaccaaaauaaguauacaauucucuugugguuucuugucaucauaguuauuguuacacugaugguaguagaaagagggaauucaggacuggguauaacucagagguagagcgaauacuuacuaugcaaaaggcccuggauucaauuccuaguacugcaagaaaaaaagaguaaagagaaauuuaguaucuauucugaguaguuccucccugacuuuuauauuuuagcaaagaaucccaaacuugcuaaagguaggccagagcauuuugauuugaaagauagucuauggagggaugcuuauuguacugaucuuccuuuuucuccuucucaauuuguaacggcuuuagcuauuuuccuggacagugugaguggauauauugcccaggagaugccauaucuucaguugcugcuucugagaagaguacaggaaaaauuuucauuuaugauggacgaggagauaaccagccacuucauauuuuugacaaacuccauguauccccucuuacucaaauaagacuaaacccaguuuacaaagcaguggugucuucugacaaauccgggaugauugaguacuggacuggaccgccgcacgaauauaaguucccuaaaaaugugaacugggaguauaagacagacacagacuuauaugaauuugccaaguguaaggcauauccaaccagcauauguuuuucaccugaugggaagaaaauagcaaccauuggaucagacagaaaaguuagaauuuucagguuuuuaacuggaaaacucaugagggucuuugaugaaucauuaaguguaagugcaauuaaaucagauuuuacuuuucuaauagucuuuauguuuugcuguuucauaaaggauauuuuucuacauagauacauauugaugauuauuuucucuuaucacauuaaagauagaauucaguugucuuuaaucuugcauugaugcucuucucuacacugaucgugugauauugcuucauuaccucucucagcauuuguugaggugauaggacugagugacaagcagagaugaaaaggacagcugugacagaaguugggauucagaaugagaauguggcagaagaaaaccgugugucaguaaaacuaaugauuugcaacaccaaaccuaaguauaaauguguguauagagaugaguaauuccacacuccacggagggguggcuuuggauuugggagauggcugccuagagugagugaaagaacugcagugauuuaagacuguuuaacuagucuaguauaacagauugaaugugagauuuuaucuguuaguauuuauuagcugagauauucaggaucauugcauguaucagugcaguugugaaucacagaggccaagcugugaaugccagaauauuguaaaaagauucuaucgaggcguuuaccaaauuggauauuuaugaaauguauuuauaugaauagaugacugucuguagaacuuauaucuugaaagcuaaguaagucuucagcaaaaauaauuaugacucucccacuacuaaaaaguaguccagcuuucuaggcaaaugugggcacauaaauaagcaguagcuagagacaugagcgcugaacuguaagguccuguagucagacucaggcuuugacgauaucagacaugagcgcugaacuguaagguccuguagucagacucaggcuuugaagauaccucuuguuuuuguaguucuguauauuuauuuuucuuccuuugucuagaaaaagcugagauuuuaguuaacauaaacacgaaacauauauaaguaaaugagauguaagucuagcuuauuaucauccauaauaaaaguguuagcuacugucugauguuccacaugucugaaaugcugaauaauaagauccuaucuucuguaagguucuuggaguacuaacacaaaguauuaaugauguaacccacaucuugaaaauggugcauuaaauaucaaaaguaaaccaaauucccaagcuauaaaggguuccccuaaaaaucauuguuuucuaaacacauccaucuaauauuaauuaacugcucauaucaaaauaacuugaaacaguuucugauguccuaauuuugauauagcaagauagaguuacucaacagggcuggagagacuccucaguggucaagagugcuuuacuguucuugcguaggacccaaauucaguugccaguacccauguuagacaguucauagcuaccugugucuccaguuccaagagauauuccguucucuuuuggccuccacaggcacccacauaaauauacaugacacacauacagacauaacuuuauugaaaaguuauucaacaaaauuuaauauuuaucauauauuguuuucaugauucuuauacaagauuuuucaggcuauguguagcugaauugccuguuaugaauugcuacuauucaagugauucacuuuguuugcuuguuugugggaggugaggaaagggguuuacccugucaucucugcuggccugaaacuuccuguguagcccaggcuauucugccucaucuuccgaaaugcugagauuacagguauagacuagcagguccagcugccauguaacuugacuccuuguuuuaucuagaccaaauagacauaagccaaaaguacuauacauagaauauuccaaagcaguaauagaaaaauguuuuucuauuuauuaacuguuauagaaauggugauuuuuaaaaauauuuauuuauuuauuauauguaguuacacuguagcugucuucagauacuccagaauagggagucagaucucauuacggaugguuguaaaccaccaugugguugcugggauuucaacucagggccuuuggaagagcagucagugcucuuaaccacugagccaucucuccagccccgaaaugguaauauuuuauguuuaguagguugaauuaaaaaaaaaaaaacuugacuuauauaauauaccuacuaaaaauuuuaauuguuuauguaaauugcauuauauuucauugaaagugcuacuacucugaggcuucuaaagggcaggcguaucauuuuuguaaagaaagcacuaguuauauaauccaacugguuuaguguguuuguuucuucaguuagaaaaaucaaugacuauuaguauaguguguuugaggguagggguugauagggaucaaacccagggccuugagcacuuaacccuuaaguaagcuacacaccugaagcacagauuugcuauuuguauguuguuuuguuugagacuggauuacacucacuguguagccaggcuagcauagagcucauagugcugcugccuuugaauuuagacugaaggaauuacagccagggacaacccacauugggcuuaaacuauuugugauugaagucaacaauugaagucuucuuuaacuuucuguucauaggguuuagaaugccucuaaaauuaugugacuauacaacuucuuacuggcucucaauguguuccuuuucuauuuagugcucaguugaaauuuauauauguacgugugauuauauauguacguaguuauguuguuaaugcguaguuuauuuccuagauguuuacugaacugcagcagaugaggcaacaacuaccagacauggaauuuggccgacgaauggcuguagaacgugagcuggagaaaguggaugcuguaagauuaguuaacaucguuuuugaugaaaccggacacuucgugcuguacggaacgaugcugggcauuaaaguaauaaauguagaaacgaaucgguaaggucuccaugauuuauguauuuuaaaugcaguuauugggaucuuucacccaucgggggaacaaugagagucuuguuugcuccaaagagaguggaaaggucccaaaagccuaaacuuaaccaaauguuuugacuggaucuuucuguggucucucaguuguuuauaaucuuauguaaaaaguuuccacucguguuuauaaaauaaauggaaagaagauaugcauaauuucaaaguuggggggggggaagcgcaguuuuucuuuuuuuucuuuaaaaaaaaaaaaaaaaaaaacaagguugagucuguguuuugcuuauugauuuaaauuauccaggcucguguuaaauguugccaaauauuuuaaccacagaauucagcauuacauccugcuagacauaaaggcagggcuaaaaugcauaaaaccacaguaagucuuuugugcaaauaacccauuugguguuaguacagaguaucuacaaucagauacuaugucugaauagaaggaaaagaacuuaaagaauauuuuaagaaaauucuuguuccauacauuccuagauauaaauagauuaaucuuguaguucuuaguaacauaaaaucauugaaagcuuguaaaagaguuauaauaauaggaacagguuaaaacuuuacacucaacuuuuggugugugugagguuuuuaccaggauaccuugugauuccaaacucuaaggauauucaaguagucccucauauaaaguacaucuacuacuauacuuaaaucauguguagauuacucauaauucauauuauaaauuuuaucuaaauaaaauacuauauuguacuauauuguuuauggaauaaggacaaggaaaaauucuauacauguucaguauagaugauuuaaaacaaaguauuuuuagucugaaguuugaaucuaagcuguagaacccauugguacagaggaauaauuguauuaauguugauuuggcucugcuuuauuuguggaugugugcaugugccagaaaucaaguuaacugucuuuauagcacucuaccuuaauuuuuuuugaaacagugucucuugcugaacuugaaguucaccuauuuuggcuagacuugcuagccagugagcuccaaagaucugccugccuuugccuuucccucucucucccuuccccucagcagaguuacugaucugugcuuacaaggcuguggccuuaggaacugaacccagauccuuuuagccacuaagcuaucuucccagccccaaagucuguuuuaucuuuaauaggacuuuaaacgcaguuguaggcucacaacaaaauaggggagaagguacaguuuucccauauauucucugacagcucuuacagcuccaugaaaaguaauagaaaccuacauugacauaucacaucaccuaacgccuacccauuguuuacacuaagguccccucgguauuauacauuauaucaaaaguguucugcuucaacuguuccuuacucaaucuuguaacuucuggcaugacuacuacuaacuacuauagcuaaucuuucuauuuauuuauuuggguguuguuguuguuuuauaacaggaucuuacacuagcgaggacuacaugcaggugugagccccgugcucagccuacugcuacuguucuccucuccugguuucucugcuuccagaguaucacguuagucacucgacaauuagccuuuucauacauguucucucauuccuuuucuuuucuuuucuuuucuuuucuuuucuuuucuuuucuuuucuuuucuuuucuuuucuuuucuuucuuucuuucuuuuucuuucuuucuuucuuucuuucuuucuuucuuucuuucuuucuuucuuucuuucuuccuuccuuccuuccuuccuuccuuccuuccuuccuuucuuucuuucuuuuuuucuuuucauuucuuucaguuaauaauagcaguugaaauucuucuacaucuuucuauauccugauagcacauuuuaaaaccuaaguaguaucccauugucuuuacaaaacaacuuaauugucuguuuagcaagccaguaagggacaucuugcuuucuuccaaguaguggcauuuauacuaaguaaagcugcucuaagcuucauuuacgugcgugcgugcgugcgugcgugcgugcgugcgugcgugcguguguaaguuuucaucucuuggaaaacuaccaaggagcugaauugcuggaucuuaugguaacagguuuuuuuccuuuuccuuuuguuuauuuauuuuuuuauuagauauuuucuuuauuuacauuucaaauauuauccccuuuccucauuucccuuccaaaaaucuccauaucccauuccucccucccccugcucaguuuauuuuuauaagaagccaucauauugucuuccaaagugcuaccuuuugcauucccaccaacgaauagcaauucuuguugcuccaagcauuuaguauucaucaguguucuggguuuagcuuuucuaauauauucuagguucuuguuuguuuuucuaccugauauaugauauggaacaucuuucauguacuuacuugccuuuuguauguaacugacguauuugcuaaagucuucgaagcaauucucacuugcuugguugccuuuauuguugaucuuaagaguccuucguacgugacauguaacuguucuuuaucagacucuuuauuagaauuccgcaaguauccaagucuguagccuucuguuuucuugaugauuggauuuuuuuaaccuaguaauaccuaccaacauaaaauacuguggggacgauuagguagagagagauuuaagauaccuuucaauaguccuuuggauauagaaaacaguugacugaaauuuuuacauguuucuuuauuuugggguaggggagcccaugccacaguguauucauaaaagucaaggagacaacuuaguggauccaacucacuuguucuacccugugguucuuggggauggaacucauguugucagguguagcagcaauugccuuuauacacggaaucaaauaucucaucuaggauaguugacuuucauuuucauaugucaagcuguuaugauuggaauucuuucugggucuuuuuuccuugcacguuugcauaguacaaaugcauuuguacagaugugucugcacauguaugcagggagucagagguugauguuaaauaauuuuacugccaagucuagcuacccaguuugcccuguggauccugucaaaagcacugggacuaugguaagccuaccugguuuuuauguggcuacugagcauccaaauuccauuccucaggccuguaagucaacuuauccacugagcucucuucucagucuaauucuggcaguuguauuagauuaaguuuauuuguauuuuucaggugugugcggaucuuaggcaagcaagaaaacauuagagugaugcagcuagcuuuguuucagggaauagccaaaaagcaucgagcugcagcuaccauagagaugaaagcuucugaaaauccuguucuucagaauauucaagcugacccaacaauagucuguacaucuuucaaaaagaaucgcuuuuauaugguaugugauccucuuggagagauggccauuacauuaguguuuuuucagccuugcugggaguuuuauuuucuuagagaauguaggcaaugauagcaaacuuccuaaacaccugaaacaccagccuacagcacuaauauuguagaauuuuaaacuaagaauugauuucuaaguauuucugcauucuuucccuuuaggcuuaaauuuuuuccaaucuuggcuucuauuacuauuugugcuaagaugguaagaaacuaauaauuauguucauaauuguauuuacaacagcuuuuacuuuugguuuguagauguuuuguuuuuuaacuuuucacuugaacauaauuucccagaacuuacacaguuacuuucucuuuagagguguaugcacauaugcauaucuaugcacauauggaauacacuuagggauuuccuugacuuuccacucacuguagcaguacuagaguagagcaguauuuuccugaaagaucuuccccuccucuggagaaguaagcugucaguuguggggagugcugcucagugaucauuuacuuucccagcagacacagagcccugggaucaggcccuagcacugggagggguaaacucagucuucugaauuacuuaucaacagucccucccguuaggcagacagcguaaggacagagucugcccucgcaucauauccuuacacgacaaacaacuuucucagaucuaauaggacucccaguugucuauagcuggcuuuuaucaccucuguggccuuagccuuuuuccuuuuuauuuacuacacuaacuggacuagauuuauucuauuuguaguaauuauuauuauuuuaacuauuuuuaguuauucuuucuuccaaucacguuucuuuucaacuucuacuuaaaggcucagcuucaaaaucuuuuaacaugaguacugaguccuaagcaccugccuguguucuuccgacgcucucucaucauaugcaacauguuuuggggguacaaaucaauaaucuguguugggcgaaguggggguauuuaagacacugcuuucuuccuccagaugauuuaaaauuaauaaauagagacuccuguggcuucacuaugugcauaaaguuuaaucaaauggcugaccuguuggagugugcacucugaugucucugaauuguaagccucugugaggaguucaagcuaacauaauugauaaacuuauuagcaguuucccagcccuaguuaaucuuuuaaccuagcauagauaaauucuuuaacaugagaauuuuucuuacacuuucagaaucauaauuuaaaccucauuaauuaugcuaaauaaaaagaguugaucuaguuuugaccuauaauuuagcuacuaaugaaguuaaaauuauaaaagauaauucuugauauauacuaauguuuuuauccauuucauaaaaaauuuugguuauuauguuauuauuuggcuuuccccaguuuacuuuagaugguuaaaguauguaugcucauuuuuaauguuugaagaaguagagaaauuuuuauucagaaguuucauuuagggaacauuaugaauuuucuuucaguguuaucagauaucugcauccuuaaacaaggcuuagaaguaacauacuuacgaauuuuauauucaguuuuaaaucuaauauuuugaaauaaaaguauuuuauaaauucauauaaaugguauauucauaaauuagugagaaaacgaaauuuuuuuuacuuuguccaagugacauaauuaguaaaugacagaaauauauuuuauauguaggucaucugcuugugaaaaguaacaaguucuggcuaugacuagaagacuaaugaacuaugggaaauacuaguuacccuuguuacauguguaaccaaaagaauuucaacccaaaggauacuguaucccauuugagaaugcuuuaccuguguuauguugggagaugaucccuacaauguguucuucaauuaaaauaugauuacgucauuuuccccuuucuauuucauauacacacacacacacacuuuauauauguaaaugcauaaauguauaaauacagggcuuuuaauguuacuugcaugauaugauuucagagcuaauugguauuggauaaccaauuagagauucaucucugggggagacuauuucucuugcuuucagcauuccucaguugccugcaguucuuuaagguugaggaccugagagaccucccuauuccauguuagcaugucuauugguacugugcuuuuucggauuuauuuagauagccauauugguaagauaucaugggugaugcugcccuaucauuucugggaauuauaaucuuauagcagauuuccuggccucugguuccuaaaaucucacugccccuuccgccucuuccaugcucucagccuuagguacaaggcuuacauugcagauguauccacuggagcuggacacuauuuaaucaguugcucucugcauuuuuguuguagugguaguagugguuuuuuaugauuuccaucuguugcaaagagaaggguuuuuuuguuuguuuguguguuuguuuguuuguuuggaaugacagcuauacuuaucuguagauauaaggauaggcugguuuuguaaauugaugguuuaagguucuccuguaagauccaugaccaccuaccucaggaaguugggcuuccaauacuggacaugauuucccuccucuugugugagccuuaugugcaauuagacaguuguuggcuccuccaagauaugcgugccacuauugcacccuuagggaugucaugcaugcugagcauuguuauagauccuaagugucacagcgaggucggacuguugguugcuuuccuuguuccaguacuuugaaagcucacccuuaggcuggaggcuuuuagcucagaccuagcucagauccucuccuguguccaaagugacuuaacuucaaccugagaggcaaccauaggcagugacaauaaccuauacuguuugggugcuuccuaggcuccagugaccaacaacuuguaucugguacugagauuuuuuuguaagucuaugguuuggggggauagcacugccaguccaaauuguauaacuucauuuaaacuauguauguauacacauacuaugguucuugggaguagugcugacaucccaaauuuuacagcuuccuuuaaauuauacauguauaaacauacacuucuauguguuauauauguauuuuuaggugaauaaaaaaguuucucccucuccacaguuaaagcucccuuuguccuuucauaucacuuguaucccacuaugccccucucuaucccaugguuccuuuuuacuuuucugccuucugagguuaaccugggucuguugugaauucuuacuucccuuaaaaaguaaaauuuuccugcaacccuauagguggaacaacauuaugaacuaaccaguaccccagagcucuugacucuagcugcauauguaucaaaagauggccuagucggccaucacuggaaagagagacccauuggacacacaaacuuuauaugccccaguacaggggaaggccagggccaaaaaaaugggaauagguggguagggaagugggggggggaggguauaggggguuuuugggauagcauuggaaauguaauugaggaaaauacguaauaaaaaaauauuuaaaaagaaaaaguaaaauuuucuuugagagauuuuacuugguaaguuguuuaauucagcugcucacauuuucuuucuucaguuuaccaaacgagagccggaagauacaaaaacugcagauucugacagagauguuuuuaaugagaaaccuucuaaagaagaagucauggcagcuacucaagcugaagggccgaagcgaguuucagauagugccauuguccacacaagcaugggagacauucacaucaaacuuuuuccuguugaguauguaaaaccuuuguugucuuacacaaauaccaaugucaauauauuuggaguguaacuuaaauuuguugcuuucacaaauuuugaauuauuuguuugcauaaagcauuuaauccuuaacauucugauaucuaaguucuucuagagaaagauuacuuuuaaugcagccuauugugaggacaaaauaugcuggcucuguuagugcugccagugauaggacaauucuaugcacaaggcccuguucaguugcuagcaccauacaaacagcagacuguggaggggaacuguaaagauacauaaguguauaccacugggaccagaaacugaagguccagauaggguuuguggggauuuuuguagacaacuuccaaugcaaauuccucagguagggauaauaauuuuucuuuuuuugguauuuguuaaauaccuacaauuuuaaaagugaauuccaauuaacaacauaaggacuuuaaauuauuucuacaguugaaaagucuucugggaagugauggcacuugggaggcagaggcaggcggaucucugaguucgaggccagccuagucuacagagugaguuccaggacagccagggcuacacagagaaacccugucucgaaaaaccaaaaaacagaaaagucuucuguacaguuagaauuuguaaaauauuaauaccaaauauaauaggauuaccuccggcuuucuuggaucuagaagagaugaugucuuuuauaauguucucaaucaaaagugcguauuuugaauauaauaauuugguacuaaguaaagaacuaagcaguuacagauucuugaauaguccuuuuucaccugcuugguaaauauacauuuuugagccuguugcaugaguacuugaggcaagauucucuugauuccccuuuuuauucucagaucugagagguauugugaaauaaugaaaaaaucaggaaauaauuucaugagauuaguaauagacuaaacuucauauucuuagugaaugauugucgcuuagagcugauuaaacuuagaagccguuucuauaacuaagcgcagggaucacugagcuauaacacuguguuuguaagaagauuuuuuuucccagaaauaaguauuaccauguguguaucuuuuuuucguuuguuuuuguuuuugagacgagucaggguuacuucuguguacuguccuggaacuugcuuuguagaccaggcuggccuugaacuugaguucugccugccucugccucugugugcuggaauuaaagguguguaccaccauugcuggcugcauguguauaucaaggugcugucuuuggguuuuuaaacugcuaaaugaucuugaaaugccuuuaucaucaaacgaagccgugguguaaagacagagaaugagaaugcacucuugcgcuucccacugucauuguccugagaccggauuaugaaggacuguccugacguguuuagaagaucuugagaacauuagaaaauggaacauaagaacuuaaaaaaaaaaaaaccucaauaauuucuuauuuuuaauauauuauaggugucccaagacuguggaaaacuucuguguucauagcagaaaugguuauuacaaugggcauacauuccaccguauaauuaagguaaauuauacaucccaugugauuuaaaugaaaguauguuauuguauaacaggagcuuaagucucaugaaucuuuaauacauacuacuuuauuaaaagauaagacagaaauggaugguagaagccaagaugaguaaaauggucaugaauguaaagaaugugucaagagauauauacugaccuauuagcuaaauaaggaaauaaaucuggaaaagugaagagcaauaaugacaugcaaccucggagaaccugaggaagagugagcuuggucccagaauuuuacacagcauugcacagugacuaguuacugguagguuagaaauggcaaacggaaaaaucagauacuaaagcucugaugaaguuagaaaaaugguccacuaggaaagccagauuauuugaggaauagaaaaggacgagcaugagagcaauuggaugagauuuuaaaauuauaaauccuguaacuuucuggggacuguuaggaaagauaaugcauuauaagauacuugcauuuuuguuucaguaguugaauaaauagugauucagcaauggaaaucuaacacccaaacuuacuaugugguuaauacagucaugaaauaauuuaaggaauuuggaauauuucacugacuacaaaucucucuugauagagagauaacugcacuucauauacccagauuacauauaaaaaaguaagguauuuuuauacuuucuguuaccagggcuucaugauucagacaggagauccaacagguacugguauggggggcgaaagcauauggggaggagaguuugaggacgaauuccacucaacauuacgacaugacagaccguacacacucagcauggccaaugcuggaucaaauaccaacggaucccaguuuuuuauaacaguaguaccaacggugaguauaacacauuaucuauuaauuaagguuaauaguuuaucaucugacaaugugaguuuuacugcguaucuguauuauucaguucucgcacuauuauaucuguccagauggaagaugaaaagaauuuagagaugaaauuuaaacuacguaacaacugaauuuagaaaacacuauuucugucuaguaggcaaugugauauuuuauguucaggguacuugaguuucaucuccggucugccacuacuaacuuuuugcaggcuggaacaaauuauuucacuuguaguggccaauuucuucauccuucaaauauuuagugcuuuuuacuuuuauuaagacaaaaucauauauauaagcaagcccaagcuggccuuuaaccugcaguucuccuaccucagaaucagccugucacauucugggguuguagaugugagcuucauccuuugauuagagaaauuaagauuguaauuucccaauuuuaaaaccaaaucuucacuuuuuuuucuuuuuuuuuuuuuuuuuggucucuaagaguguaagucauaaucagcggcauucuagacaaaaacuuuauugcugagccauguuacaggaaccuaccagucgcagugcaguccucaugagacucgguguaagguugcauagcuccuuuuuauacaguuuuccaaaagcagaaaaaguaugagugucaacuaaauuauacaccaaacaauaaaggaaaaagauuucuaagucucugccaggcucauagucuaauguaagauucacaguacuucaguguuggugcucccacuucucaguaauaagaaagaaacacuuagcuggauaaaaaguuaaguaguaaaggcaccaggcaccuucugaauuaugccaaaguacagucuucuuaaaccauuccagguugucuugcuuucucaugagacauuucuuuggaaaacauccggagucuuauuuucaaaccauuuaaaguaacuuacuacuagguaaauaucuuccaacucccuuuggccuaaauaguauaaaaauuaaagacaauuuuuguaucauaucuucaucuagugauuugagcaaccagauugaaauuuaaaaaggaaaacugugccaauuuuuuucccuucuuaauaauuccuaaacaguacuauuuaacaauaggguggcacuuacgcuagauguugugagcacuaugccuuuuuauacaaggaaccuuagcaucuuucuguugugguggguagucuaauucccccagggauacuacaggauaacuuuuuaucuuuucuauauaaacucagaacaauuuuuaaagcugaguauucauugucaaaguauugcacuuuauuauaaauauguacgaaaauuaagugacauuuaaauucccauuugcuuguucacucaguggaugugauuucauaaauuaggguuuaccaaaauuuuccauuuuuaucuccaauauagccuuggcuugauaauaagcacacgguguuuggaagagugacuaaaggcauggagguugugcagaggauuucuaacguuaaagucaaccccaaaaccgauaagccuuaugaggacgucagcaucauaaauaucacugucaaguaacugcuucuguuacagucacaagacagucuauaacaacacaggacuguuucacauugggaaguuuaaaacuugcugaauauguaaaucauguuuuaaaauauaaacacuguauuuuuguauuuuuacuuaaaggccuuuuuuuuuuuuuuuuuuuuuuuuaaaacacugccuuuucuggacuauuugugauucucagggguaacaaauugaaaugcacuaaauugaggcaaauaacauucuuuuauaggucaauucuguuacuaugacucgaauuugguauuaaauaauggauucuuuuuaaaaaacauacccucuuauguuuagugguccuuaaaaagaucaaaagguauauauuccuuaauauuauaaaauucuuuuucaaauauacgugucaaaugacugguuauuugcuuuuccuaauguaacuaaucuuucuucuaucaaguuacagcuuaauuaaaucuuaaauauaccaucaagaacaauaaagcuuaauaucugaccguagaucggacuaauagagaaaggguagcuguaagcuggcugcagugguucaugccugcguguaagagguagaggcaggucagccuggacuacauaaugccagauaacaauaaauugucacaguaaaugaauuucaagucuacugauauucuucuucacgucccuuuuccguaacugacugcuaacaacugaugcugacuucagacagccuccuucagaaacguagaggagaacaucuaucucagcagagcuguuucaggacccccguuucaccacuggucauagcaucauuucacuuuguauggaaaugaaaccugcaagauugaaaagucugucuugccuugcaagugaaaugugcucuccuuuuaaaacuaauuugagcuuacuccauuaguaccuuuguuacauuuaccuucuuaacuacacguguuaaacuacc

SEQ ID NO: 7213 - RNA, 541 nt, Mus musculus
uguucgcgucuucuuccucggcgcugccuacgagguggcugccaucuguuuugcagcaucauggcugcccuccggccucuggugaaguccaagauccucaaaaagaggaccaagaaguucaucagacaccagucagaccgauaugugaaaauaaagcgaaacuggcagaaacccagaggcaucgacaacaggugcggagaagguucaagggccagauccugaugcccaacaucgguuaugggagcaacaagaaaaccaagcacaugcugcccagcggcuuccgcaagcuccugguccacaaugucaaggagcuggaggugcugcugaugugcaacaaaucuuacugugcugagauugcucacaauguguccucuaagaaccgaaaagccaacuagaaagagcagcacaucuggccaucagagucaccaaucuaccaugccuggcuacgcagcgaagaaaaugaauagauagcuugugugcauguuuugugauuaaaauaaaaucacaaaaacugcaaaaaaaaaaaaaaaaaaaaaacaac

SEQ ID NO: 7214 - RNA, 13112 nt, Mus musculus
ccucucgggcgccuagucgugacggcgacugagggcgacuuccacgcgguucccggcugcuuucgcuuggcacagggacuccuccgagaagaugccgaaggccaaguccgcagcgaguagccgccggcgggaucgucaggagcagcgccgggagcugaagcgagcuggaggugcgguguggaggaugcuugggacugacccgcggcgggggagcccuacgguggccugcgccucuagccgccccgaggagggugggcgcucagcgcugacccuuccccgcgcgcgccuggucuuccuugccagcaggagggauggauggacucaaagauacaucccaaccccggccgggagcgcggcgcuuguggaugcauuggagcagaaaccgucccggguccauccugcuucucugggacggccugagaucgguucuugaaaaguugggaaauuaaggcugcuucguguuuuauuucaggacucauguucaacacagggaucggacaacacauuuugaaaaauccucuaauuguuaacagcaucaucgauaagguggguguuaacgaugaaaggcagagcguuuguggauuguauuuuucugacuacuuaaugccuguaugccuaaguugcaugcccauaauuaucccagcauuuggggaagcugaggcagggugauaugcucgaccgcagccuacauacuaagaaaauauaaaccaagauagggugccugacagaauaguugcucuguauguauauguuggauggguugagaauugcccagugauuuccagauuauuuccacuuuuuggaggcuccaucuuguuuuuggaacugggucucauguaauucaggguggccucaaacauggugugugucaaagccagccuugaacuccacuuugcaagcguguaucauuuugaucacuuucuaaguacaucaucguuacucuuuuuauuccagaccguaaauuuacguccaaaucacacugaguuuguuccucaggaaaagauaugguacugcauaugaacuguuuggaggauuccuucuguauggguuacugugcugugcuuauggaggauugagggccuggagguaaaauacagacgguacagggagcauccuggagccauagaguauaguucuccagucucaccgaauauucuacucauaagcauaugcacacugguaacguuuuguaugguuacuauauucuuaaaacuguacagugguuaagaauugagaaaucuuuuccauuugaaugcacucuuucccauuugaacucuuuggaaguuacaauuaguuacaguuugcuggaauuauugccaauguagaaagcaggaacccaccaguagaaccgauugcucuugcuuuuguucuggcuccagaagcugaguauauccccuaaguuaggaaauacagguuuucacuuauaccuaaugccuuugagguacuacugcuguuaaccacauaaacccugaaaaaaaugaagccagaguaaaaugucuuuaacuguacauugauaaacagaaacagucacuuacagacuuuguguucaagugggccagagcauaaaggaguuguguuuauuuauaggcugcuuuaagaccuaccgauguggugcuggaaguugggccugggacuggcaauaugacugucaagcuguuagaaaaggccaaaaagguaaaagugggguuucguguguuacucucaaauuagcucagcugguuuacaaaugugaauguuuuaauaaauuggcauuguuccaauaguaguuagugggcccuuagaaauuuuaucucuaaaaaugagaucuuucuaucaaagaaaacaaaaucuacacuugauguauuggugggugaucuaauauaggaaugggccauguguuuaaaggaguaauaauaaaauagaaagucugagauaacccacagggcagcagcuaaccauuaugaagccuggaagaacagagccgugaaguuaaagucauuaggaccaaguucagcaggagacucagaggguaggaugaugaugaagaaugggucagggagucaaccagaaucagaaacucaaauggcuacgauguagaaguggucacgacacuuggugaagccccuguggauguggcaggaaaauaguucagcuuuauccacuuccauucaccuggagugcuaugguuucuacucuggaugucaguugaugagaguacuuguaggucccuucuaugcugucuaaaaaccacuaacuacauaaaguguugucaucaucuguucaguaacacagcauggagacagaucagacaggauguuguuuuaaguguagaaaagaguagagcugguguuuguguuaagacugaaaaaagcuuaagucauuguagcuccuaugaguuauuacugggaggguaaaaaacauuuauacuccacaaucaagcuuuuuuguuauuguuaaucuagguaguugccugugaacuugauccaaggcuaguagcugaacuucacaaaagaguucagggcacgugaguauauguaauaacuaaagggcauuucagucuucucaaacaagcucuuacaauuucucuccuuguuuucaggccucuggccagcaaacuccagguccuggugggagauguacugaaaucagauuugccauucuuugaugcuuguguggcaaacuugccuuaucagguauuucucaagcugucagaagcgucacacugagcauuucucugguguguccuuccucagagcuaacuguaauucucuuucagaucuccucucccuuugucuucaaguugcugcuccaccggccauuuuucagguuugugcaaaacagucccuguuaagcuuuagacaauucuggcaagaaacacaggggggaaaaaaaaccacaacaagaaacugcuggagaacuuuguagaaaguaacaguuucugggacaggagugugguagcucaguuguugaaguggcgugcuuauuaguauccagaaagccccuaggucagucuccagcagcacagaaaacucagcaugguggugagcacuuguaccccagcacuugugaacgagaagcaggggaucacgucauacucgucucuggucacacagcuaguccagggccagccuaaguuaccuaguagccugcucagagauagaacacacaugagugcacacacaugugaaaauacugauuuccagggagguccuuuaggugauaaauucuuagggcugauaaaugugugugcaugccaucccuucuacauuuuaaauucuaauccucuucaauagauauuaaaauuuuuucuuauguguagauacuuggaguaacuucuuaacugguuauuaaaacaguauguuuuauaccaguacuuuaaagcuaagacuacuuacuguuuauaaaauaaguucauaaauugugggggccauaaccaucuuuuuuaaaaaguuguguguuuguguggaguguuucuccauacuuacagaggucagaggacaacuugaaggcugucagggaucaaacucaggauuggaagcaugucuuuaccccuccucccauuucccuuuuaaaugguauagaacagaucguauuagaagaugagugcaugucgguuuuaugaaaguuuuguucgggauauguaaacauuuacagaaaauucugaaggcugagcuaggacgauugugaauuuaagacccacuugggcaacuuugugagaccugaucucaaaaucaaaagcagaagggcuggagagaaagcucagugguagagcauuuaccugcagggugaggccuuugcuucaguucccaggauaccacacacaaaaagucaaauagaguuuugaaaaugcucuuuucuucacuaacauuuaaaacuguuaccagggcuggugagauggcucaguggguaagagcacccgacugcucuuccgaagguccagaguucaaaucccagcaaccacaugguggcuuacaaccauccuuaaugagaucugacucccucuucuggaguggcugaagacagcuacaauguacuuacauauaauaaauaaauaaaucuuuaaaagaaaaaaaaaacuguuaccauugcuugcagaagaaaaagucuacacacuuuaaauuguuaaaccaagggaacccuggacauuguaaccuaccaggccauaccucagauguaauuccaacuacagcgcaaacauaguucuucugugaagucaaauuuacuguuuauuugggggguggggggguggggaggaggucccagaaggcaucuagauuauuaaguacauaauaagaucuaaauacuacauaguuguuuaucuaagccccaagggaacgucaucuucauugaggcuaggaguacaaccaucuguuuguguucuaccuucugaucauauugucaauaaccauacauccucccaggacaaugaacuaguuacaauuacaacuaaggacuuugcagauugcucagugguuaagagcauauguuacuuuugcagaggaccgggguucuacuccgaggacccacauggcagcuaacaacuggcuuuaauuccuuauucuaaggauccacaucugaccuccaugggcaccaaauucgcacacagugcaaauacaaguaggcaaaacacucagacacacaaaacaaaaaucaacaaaaguuuuuaacugaaacuaugccaguaauugaaaaugaacgauucuuguuccucugcuuccuuuucagaugugcuauacuuauguuucagagagaguuugcucuucgauugguugccaagccuggagauaaauuauacuguagacucuccaucaacacacagcuuuuagcacgcguggaccaucuaaugaagguaugagguuuauuuuaauucaucuuggaacacuuugccuugcuucugaaaccccaccuuccaccaacccucuuuuugagacgggggucuuguucuuuaacucaggcuagccuagaauuaucaacuucucaaaugcuggaguuacaggccuaagccacacuauaucuggccaacagaacaucuuugauuaacaacuuaagguuacccucgccaguuaugguagcauacaccuucaaucccagcaaccaggaggcagugggaugaaaaucucugugaguuccaugccagucaagaccuacaaggucagcccuugugccaaaacaagaaggaaauaaaguugccucagagaggacuaaacauguucugauuaacagguggggaagaauaacuucagaccgccccccaagguggaguccagcguggucaggauagaaccuaagaauccgccaccaccaaucaauuuucaggugaggccaaaauaccuagguuguaaaaugucauuccaaagcaacaaaacaauacucagucgaccuaaauauccaaaucgaagaagguaggaauggggacuaacuugauguugaauaguucugaguacacacaguguguguaaaaggcagaaugacuagaauauaggugcauuucaaaacuugagauuauaguugcaaaaaaccacuguaaaguuaaaauaauuguguuugaauaguaucaugauaacacuguuugguuaucaugauaacccaaagcaagugugccccaguuggacugcauccucagccuuuggggcaaacguguuugaauuagaauacuacugcuuuagggggaaaaaagcuagcccauuugauauaaaauuuaacuaauuacauaagagaaaaacuuguuggacgagugacauccuaaaucauguugguguuuuaaacuugauguuuuguuucagguuucaguucguuuuguuuuugucuuuugguuuuguuuuuuguuuuuuuaagauagggucucgaguggcuccaauucucuaugcacgggaugaccuuaguuagacuccugauuguuaagugcugggaucauaggcaugugccacuguauuuggaaagugauccuaaugccauauuaugaauggcaauuaugaagccgggcgugguggcgcucgccuuuaaucccagcacucgggaggcagaggcaguuucugaguuccaggccagccuggucuacagagugaguuccaggacagcuaagacaacacagagaaacccugucucgaaaaaccaaaaaaaaaaaaagaauagcaauuaugaauggaauuuccccacucaacuaaaaaaugauaauauauuuagagauacacacaagugcagagauguguauuguuuugcauaucugcuaguuagaucaaaacguaugacauugucauuccccuggcuuuguguguuagaaaugaaggaggaguagauaggaaguuggauauucugaagaaaauaucguuauuauauuucaggaaugggacggcuuaguaaggaucacuuuuguucggaaaaacaagacacuguccgcugcauucaaguaaguagcuacaguugugauggugaggaaccagguuucaguacugucauagcauuugcugcuuuaucauaaacagguacccuaaaguacaaccauuacucaugucagacagacuucaccuuuucaaauuucauacuagucugagaggcaaaauuuaagaaaauuggaguuaggagucaaauuaguuuuucuuugcaaaagagaaaaaaguaauuuagccacaaauuuucaaguuugugcuucuggguucucuucucuccauuucacuguaaguggggacaugugucauggugcacaugugaggucagugggccacuuugaggacuugguuuuccccccguuuuacauguguucagggaaugggacucugauuauuuauuaggccugcauagcaaauaccuuuaguagcucagccacuuccuagucuuuguuuuaaagauuuauuuauuauuguaucuaaguacagcugucuucagacaccccagaagaggauaucagaucucauuaugggugguugugagccaccaugugguugcugggauuugaacucaggaccuucggaagagcagucagugcucuuaaccgaugagccaucucaccagcccuuugugcugguuuuuuauuacuauuuuuuuuuauuggauauuuuacuugugcuguuuuauuaacuugaaaaaaaaaaucuaacaucacuuggggguauccaaaggcaaaagagguaagcuuugaauuuagagagcuuaaacauuuuauuccuggcaaugccaggaauuaagcauauggucuugagcaugcuaagucaguacucuuauuuauuacucagugauuccuucagaccuauuguuaccuuuugaguuccaggcuggccuugaacuugcaauucccccgccugucucagcguuucuagcaacuaguauuauaggccacugccaccagacccagcaauuuuuuuuuuagaggauguuuuguggaguuuuuacacgugggaaugucagagaacaacuuguaagagugguccucuccuuccuguguggguucuagagcuugguuucagauugcuggucauggcagcaggugccuguaccacugaacuaccugauagucauggagcauauauuuagucuucucuaaauauaauauguauaaucugauuuuauacuugucauauaauuuccagaucaagugcaguacaacaacuguuggaaaaaaauuacagaauucacuguucaguacagaauacugugaguagagaucauuccacucauuuuuguucauuuguuuuuugagauagggucucuauauaguacuggaauucauucuguagaucaggcuggccucaaacuuagagaucuuucugcgucugccucccuagugcuaagugcuugaauuuuucagugcuguuuacuuuuuaaagcauucucuuuaccagucucguacagaacacaaccaucuaggcuaagucugccucuggauuacugacagcagcauaaccuucuuuacuuucaucuguucuaagcaaggcuucccugccacuuggcugauagagauggcagcuuacuguaagcagcauagcucuuuccuucccuccuuuguucucuucagggcagcugcuaaggcaugcagcuugccugcucuguagugcuucuauuuuaaacccuugauaaaauuaccucaagcuuacaaaaaaauuuaaauuuaguaauccguaguaacuuaaagccaauacauaauuuguaaauaguauagaucucuuucuauagcuuugaaauggucucgcuauauagcuuaggcugaguuugaguuucaacagaccgugaauucuaugaacccuguccucuuuaaaguuuauauuuagcccuaauaagaguuguguucauuugacuuguaauuuccucaaauauauacauuguuuucuuggcuuaaaugucuguaauuugccaccugucuuagguuucuuguuuuuuguuuuguuuuguuuuuggagacaggguuucuucuguccuggaacucacucuguagaccaggcuggccuggaacucagaaauccgccugccucugccucccaagugcgccaccacagcccagccugucuuaggguuuuauugcugugaagagaaaccacaaccaagucaaaccuuuaauaauguuuaaucuuuaaugucugauaaaggcaaacguuuaguuggggcugccuugguuucagagguucaguccauuaucaugguggaaagcauggcagcauccaggcagaccugguacuggaggaucccggagcucugcauuaugaucaggcagcagaagagaacugucugucuucuuugcaggcauccaggacgcucugauuccacacuggguggaguuugagcacuaggagaccucagaacccacccccacagugacacacuuccuccaacaaugccgcaucuccuaacuucccaagggccaagcauucaaacacaugaauauauggggcccaaaaccuauuuaagcugccacauuacccuaaauugugauuauccuguuuguuguucagauaguggcccaggcugccacuguacauaguugaggaugugcaauuaucccaaguguugggauuaaagguauaugucaccuaucauacuaguaaagcauauaauaauaggaaaauggagguugaauagcugauuuccaguaauaugccucaugccucuuaacaguuggauuugauuucaagugugggaguccucaugcauacacguguguguguguguguguuggcuuuuaagcauucuaaauucgacagcagacagauuaagacuauuuccuuuggcuuugguuuuuauuuuuggacauggguuucucuguguagcccuggcugucccagaaauagcucucuugaccaggcuggcuucccaaauguggggauuaaaagcuuaaggacauacuggaucacuaucuggauuuuccuuuguacuuuuuauggcccauauucucuucugcuuuaauauaccaugguacuaucuccauucucuaaucuggacaaaagcuacaagagaugaggcuaguuuuuaaacccaaguuagauuuuaaaaggucuuugcauaaaugcuguggaucaaguaaaguaaaaaacugucuuauucuguaaagcuugcccuaaaauugaguuaguccuccugccuccuaagugcuaggauuacagggaugaacuacuauuauacccagcaacaugugauguacuuaaaagagaaguuacuccugagaguaacuggagaguaaauuaccugguuaggugaauaugugucaagaauguaugaauuaauuuuuaaaacacuaccaacuaguuuaaaauuucauaaaagucugaaaccugaauuuuuuacauuuuaaagaugaaaaggagacaauauaugcaagcaugauaacucaaauaaucuaagcauuauguaaaaaaaaaucagccucuuauuagaaaucaaagucuuacccaaacugucagguuuucucagcugucauuuauagauuaaaggugacuauaauuacugaacuuggaaaaaagucauggucucuucauuaaggauauauugcucauuuauucuggaucuuauauugauagguaauaccagaagauuucaguauagcagauaaaauacagcaaauccuaaccagcacagguuucagugacaaacgggcccguuccauggacauagaugacuucaucagguaauuauacuuguuguucuaaaugcuuacauuucuuuacugugguaucuucagauagagauuuaaaggcuucuaagcagcuaccugguggguuauugcauagcacuuucauggaguggaaaaguuauuugguguagagcagugguucucaaccuuccuaaugcugcagcccuucaguacagguccucauguggugacccccccccaucauguauucucauugccacuucauaacuguaacuuugcuaauguuaugaacuguaauguaaauaaccugauguuuucugauagucuuuggcaaccccuaugaaagggucauuugaccccaaagggggucaugacucccagguugagaaccacugggguaaaggcuggcagcuaguuagcugcagcagguguuacaaacagucugugccagaacggagccuguauuuguaugcgcaguguuuccuuccuccugcuccaaacucaccuucuaauagcgucugcucaccuccucacacuagagaaagcaugguaacacacagcuggggcugaugacccauuuuuuccuuacuuagaaccccuacuguuaaacagagaagcaggaagugucagucagaaccacaucaccugaucacucauucaauagcaguuauguggccuguuaaguuaaagggcaccacagcgaugucugcaauguggacauuuuuauuuuguuuuaagcaaguuucaguuaauuacccaauuguacuaacucacugacauuaacuuucaggaguuauuggacauucuguuaacuguuuucuuacagugcugggggcugcacucagguccuugcagagcuagacagguauucuacuucuaggauguguccccacuuguauccagagacuaaauugucuagaacaagagucacuguuacuggcuccuagcgggaggacugagucuggauguuaauccuccuaggugaacaccuuugcuuuuccagacuguuaguccacagggaccucucccuauauagaggccauccuaaaaaauaagcucagcuacaaauacaucauuucaaaaacuucacacuuccucagcgugcaguuuaacaaaagucagauaaguacaaagaaguacaguguauuucacuaaacuucgguaacagccccgagagcaggcagagaccaguuacucaucucaccuugccucaauuucuuuuucagcugaccaugcugaaagugcuguugagcuuaggccagagacagcaagucuuuaaggucauuucagucagugccaacuuaaacaguagauuucaacagaagacaaacgugccaugguuuuuacuaagguguagugacuagugcuugcacugugucuucaguauguuggcauguuuauguauuaggauuaaugguaauaggcacauuaugugucagaaguuggguuuauaguuuaacaccauuccuucuuggucuccucuucagguugcuacauggauucaaugcagaaggcauccacuucuccuagccauuugaaaacuauuuuuucaagaccaagaaaaaaugaaauuauacaauccuacuauuugagaauacaaccaauuuuguucuacaggacaucauuuaaauuauuuaauaauacuuuuuuaccauuuauuauccuguaugugaaaggugguuggguauauauauauauguauguauguauguguauuauauuauauauaaauaauacccugcccuuuguaguagaccuaguguuuuauauauaaauauaaaaauaauggucuuuaaguuugaaagccacagacacacacaacauacacuuaagcuuucuaacaauuuauuguaugaagacguuacuuuuauucacuauuuuagacugugagguucacguaggccuacagcucacucaacuagucagaaagcccccaaugugacuuuucuucacacaccuucacccuacguguuauuauuugccucuugcaacacaaacaacaucauaauucugggagcugagucugcugcaaugacaguacaggcaaguucugcauaagacuaccuguaaaaugcagaagcuuagaaaguaaaaacucauguuaaaucacauauuuccuuaagggagacaagaucuacaauuuucagauuuagaaaaacucuggaggguuuugucaaucaaauagguggucucauuaauuuaugauucauuuccuuucuugaaugagagggucuuuuggagguugacuuuaaucucagacucuugccucagccuccuaaauaaauucugggguuauacuugugcaaaguaaguuuuccaguuuuaguuuucagcuuuuuaaaagaacagacuaaaacuacagguuccugguuauuccugacuucuagauaauuaaaauucuacuaccugguguuucuuuuuaagcuauuuaaaaauugucagauaaaagauaaaugcuguuuauauauuuuaauaaauuagcuguuuuauuuauauaaggaaacuaaacuagcuucucuauuuauacuuaaaacuuaaaaggaauaucuccaauuacuugagaaaaagaaugcuaaguaaacuuaauauaaauugcucgccuacaguuuuuccuucaaaauccaguuucuaagucauauaguaaacacuuauuauaguagcuaugaauaguuagcagccuuuaaguuugagacauuucuaaagaauauuuaaucuagaacaaaaacauuugcuuagcugcaaaagcagcuuuugucauauugaucagaacuguucuuaaaguuuguuuauugucagaacaacuuugcacaguucacuuguaccauucucuaccuuagggaaacaauucugcuagacuaggcuuucucagcuuauuuucuuccaacuaaagcuuucccuccguaaagcugaaucauauuuuaccuaccaagauauuuauugauguacucugacuacagaucaggacgaagccaauaaggaaacauguaucuauaaagaccuucaaagauaauaccuguccaaugccaguaacauuaaagcucaacuguuagguaaguua

SEQ ID NO: 7215 - RNA, 941 nt, Mus musculus
cggacccuggcggagccgcggcugccagcgacauguucaagguaauucagagaucuguggggccagccagccugagccugcucaccuucagagucuaugcagcacccaaaaaggacucgccucacaaaaguuacaugaagaucgaugagcuuucacucuacucaguuccugagggucaaucuaaauauguggaggagccaaggacucaacuugaagaaaacaucucacaacuccgacaucauugugagccauauacaaguuucugucaggaaauauacucccauacuaaacccaagguggaucacuuuguccaguggggaguagacaacuauaacuaucuucaaaaugcgccuccuggauuuuucccaagacucgguguuauugguuuugcugguuuuguuggacuccuuuuugcuagagguucaaaaauaaagaagcugguguauccuccuuuuuucaugggauuaggugccucugucuauuacccacaacaagccaucaccauugcccagaucacuggggagaaguuauaugacuggggauuacgaggguacauaguuauagaagauuuguggaagcaaaauuuucagaagccaggaaaugugaagaauucaccuggaaauaaauagaaaacuccaugcucugcccauuucaaucaguuauagguaaacauuggaaacuccagacaguaaaucaguauuucuacagacaaauggcgaaaucaguauuggauauaguaaacuggcuuucuucaggaaaaacaacacuaagccuuuuugcucuuuugggugaugccauauuacaggccaacuaaucugcaaucuuucacauggaaauaauguacaagccuuagaacuccucauucuuauaccacuauuuauguacauaauuaaacuccagauuccaacaaaaaaaaaaaaaaaaaaaaaaagaauauuguc

SEQ ID NO: 7216 - RNA, 4778 nt, Mus musculus
ugcccaguguuucugagggaucccccuuguauaauuuaagaacaaguuuuguuacagacaacagcaaauucaacuauaagagacuuaagcugcugagcccgacuucauuuuucucaaauaaugagaagugcgcgggccaacagccgggggcuggcacaguuacugguuggugcugucagguccucugugucuuucugucccaucauucuucaugugaagcucugagcuuccuguuuucaagucagcuuccaggcaggaauaauguggaugccaaagccuuccccuggagaagaaagggacaugguucauguggcuccuacuggcacugucuugacuccaacauagccauuccuaucugaagggugacuaaggaauccaaagacacuaguagcuuuucagacccuguauuaaagguaaaggagguggcacugggauuagaugucgacuaagccacucugcaguaucugcugugacacucugaaaaugaucuuaagaguuuuugaagacacaaagacuuauuacagggggguggugguuguuuguuuuaagucagugaaagcaacaaacuaacagccaaaccccaagaguuacgcucugcauaucaugguaucuccauaggauucuucauaacauuugaucaagaagcaugaugcugggauacggguacggcucaguggcagaacaccugccuagcauaugugcagcccagagucugaugccuaacccucgaggaauaaaaauaaaaguguaacgcuucaugacauaucaaucugaaaugccaagagggagagaggaggauggugggaaggggagagaguggaaacucuugucuucucaagaaugugaaacagcuucugcuuucagugcuuccaagugauagacuuugggcuaacggagggaacugaagugccacuccaguugggagccauaaacuaccagagaguuguccucaaaguaguagacaucggugcaagccccucuggaagcugucuguaugcuuuggaugacauuuaucaugaaaguagaauguccaguguaguugccaagacaacauguugccuugcuccaaacacuucuguaccucuugcaugacaaucugcuuagcugccuuugggugaugggugugcaggguccuauggaaauuuacaauuucacacuuuccacgcucuucccaugggcacaugugguggcgguaggcacagguauauguguguacauucauguagaagcuacccaggaacaucagcugacuucuucuauuucauucugccuuguugccucagacagggucucucacggauccaaaagcuugcuguuacugcuaggcugccuggucagcaggcucaggacccaacugucucaggagccaauccugggucuucauacuugcagagaaaacacucugacucacuggcagccgcccccgccccccaccccucauauccuccacuguugauuaaggaguuaauuuaacauaugucauaagucuaauuacuaaaauaaaaguuuucucugccauacaugaucaaauaugcccuccugacuccccucuuuuccaauugugaugcuugagacaguaguaguucugagcaucccuuaaaaauggguuuucagagccauacaagaaauugucuuauuuugccuuguuaaaaagaauguucagagauaguguugaauagcacccauacacacacacaaacacacacacacacacacacacacacacacacucggugcggggagacagagacagagagacagagacaaagacugagaggcucagucauggccaggagacugacuuguaaggcccaguagaacaaaacaucaggauugguggcacugggacugagugagggauaaagcaagaaaaggagagaaaucaaagucuuuaagucaacucacauucuuguuugcuuauuugucuuacaaagucccaaggauaauguauccaagaagccaacaaaccaacaaccaaccaaucauccaacuaaccaaccaacgaaccaaccaaacaaccaaccaaucaaacaaacaaacaagcaaaccgaguucuaggugaaugaguaccuuaaagcuuacugcagcuuguccaugggcagccucucucugaggaagcaaaagaagcugauggcuugcagaagccgcgugcuuuaauauuccugauaaaucuagaaggcugcugaagaaggugagagcuggggaggcugcccucuaccugcacaucuguggagggguaagucaggugugaacccuggcucaugagacaguaacucaagcuccccuacaagauaaacugcuagaguccuacccucuggcccugucugaaguuccucggcuuggacuguaaagcagucucucagucagcuuuuggagacagagaggggguggggugcacuuugucucccaucgcaaaggcucacguuggcagcuccuucaggagagaacauuggaugcugaccaaaauggcugcagaguucaguaaaguugcuuccuuaguucuaucuggaagcucuucagaggcauaauuucauuccagccaaauguaauuaggaaugugauuugauuuaaaaaaaaaaaaaaaacaaaucgaaggagagaaaugaggcuucuccucccucccucccuuucuucacucguuaacaggguuuauauaugugaccuuaagggucggcuucccucugacccuggccaggcacccuaaaggaaccauggccccaggaggugaauggggggagaggcacaguuccugcaagagaauccuaaggaucuuuaaaauucugaucucgagauccugggaaagcacagcagcuguaugcccuccgugggaaugagauguccacuuaauuaaagcagggcaaggcagugggugagcaacucucugggaggaaagccgggguucuuaucucaccagggccuuagucaagagaauuagcagcagggaagcagcucuggcuuccagggagcaugggcgccucagccaaguuugguggaagagacaaggagaaaaguaggagaggagaggacccuugacucccuguauuauuggccaugacccaaaguaaucucucucugaccuacuccaucuuaucgccaaggcucuaaugagaauuguguggugaguuuuugauaaagggcaguucaaaaugagacagagaggucaaacauugcaggcugcggcugucaguuucugucugcacgcacugucuugugacucucucuuguuugugggaacgucccuuuauccauuuucugaaucuguuuucugccuucuugggagaagccuugcgugcaccugaaaacagcuaaugggagcuggagagcaguguccaguguuccuggguggacaaauuaagccggaaguuacugcaaaagaacugaguucaaggaaaguccuggggauuccuacagcuaugguagggauggcacugaaagauggacugggaaggcuaaacuggucccauggugugcaucucacgcccauguucgacagaacaccaauguucuguuuccacugcaucauuucuagaggaucccccuuugauucucaaguuuguugacucguggaugcaaagaggcugcugcaggucccagcaucacacauuuaugcaaaauagaaaaagaguauaaccgguggcuccauuccuaucuguuucaucuuaccaggaaagaaaacaguucccucuaagucccagaaaacuccuuauuuccuuggccaaaauugucacguaguuacccgggaaguacaaagagacugggaauuuaaggguugggaaauauuguuaaucuaauucaaauuggaguucauaagagagacagaguagcuggcuaccaaguaggcagagaauggggcauccuagggguguuuugaucuacaaacugccagcaguuuuguaaagaaaacuaaagcaggggaaagccagguccaagaagugggagugaguggguaggggagcaggugagggggguauaggggacuuuugggauagcauuugaaauguaaaugaagaaaauaccuaauaaaauuuuuuuaaaagaacaacaaaaaaacuaaagcuucucuaaguaaaccaaacagaagaaauucgaugcagcaauuuguuaucaaucugggaagugucaggaaggccaaagaaagaggaagggagggagggaaggaggaagggagagaaagagaagaaagggaaagggaagaaagagagaagaugaauuuauucagacauuagggacugagcuacaauuauauagagaaaaucuuauaacccccccaaccaggguugcuguauuccuggacaguugguauauggacugggaaguugguauauggacugggaaguugguauauggacaagauucaagaagccagaagccugugcuagcgcuuacaaagacauaauacucugacaugugugcuauaaauguaugaaaagcauuaaggugcucagguuucccauaagcccagaacugccucuugcaucuuccgggugccaggaggaaccuaagacugcacccccuuuuccagcaccccauucuccuaguccucaucacugauggaaucuagauggcgacuagcuggugugagaauugaccugggaacucuuugccgacuuccagccccuguaugagccauccuccagacagcacaggucagaauggugcggggguguggagaucaaccucaugaaggaaagugugggauggagagcgaggcgccacaagcucgccacaagcuccugcgacuccucgaagcguccucauuagaucuaagaugucuccca

SEQ ID NO: 7217 - RNA, 155913 nt, Mus musculus
cgugggcguguccuccgguggcggguugaagccucagaccuugaguucggcgcaggcaugagcuggugguccgguguguggcgcucuguuuggagcgccuuguccagggaggugagggagcacgugggcacggaccaucuggggaacaaauacuacuacgucgccgaguacaagaacuggagaggugagagcgaggagaggauaccggucgauggaugcgcgucccgggcggguggcggccgccguacuugggggccgggccucgggugcccuggucccugucccgggucccaggacuuggcgguugccuugggcgacgaaguuuggacccgguccugccagagguucuggggagcaucgggaaaggccuugcgccagugccuugccuuggucuucagauccggguuguccgcagaguuugcgguucuuggugucgcagugucuggcgcgcucucccugucugucgccguccuugucaacccagaacuuuccgaauacacugauccguucuaauguccaggucgauuucagaaaugugugucuaacuaaaacuguuuucaagaacuggaacgguuuaguuaagagguguucuuuuauagccaggcuuuaaucccagcacuccgaaggcagaggcggauagaucucugaguucgaggucggccuggucuauagagugaguucaaggacagccagggcuacaccuagacccguccccccgggggggggggggggcguuccuuguauguguguguguuugugacugugugucucugacucucucuguccccaccuccccgccccccuccucccccgucccccuugcagcaggccacacaaugucuuuuacuuuucucuauugcuccaguauagaaagucgcagagaaagaaguugggucagaguuuaagcgcugacugaggcagcuuaggcacaaguccauuuuucucacuuagguggucuuacaugaaagagauaauaguagugucugucgcuacugggacgguugaagacugguccaacaacuguguuucauuaauuucucacaauauuaacuauguuaaacauuuauaaaaauguuuuucuuaucuuuaaaaaagauuuauuaauuguguguguauugccugcagguguguaguuguguaucuggugucaaagcuguuggaacuggaguugaugguuguuuagccaccaugugagugcugggauuugaaccugggucuucuauaagagcagcaagugcucuuaaccucugagccaucucucuaguacccacuuaacccuuuucuaaaacuuacuaccuugaacuuuuuugcccacugagcauuuaaauaugcugccucugcugccuguacccagauauccacugaucuggguuucugaugcuacaaauuggucuucguuuccuacagguuuuaaacgugaauauuuguauauaugucuuuauagauuucuuucuggguccuguauuuaggaucauuauuuugaaguucaucuuuaugugcaucaaaauuuuuaccuuguugcuaauguucuaucguguggaaugcaguauauauaguuuucuuaccugcucaccuguucauagaucuuuggauuagucccugucuuaagacugucacagauaaaugaugagacuuauagauauaaugcguucauuucucuuuuacaaggagaacgccuggaucagccuggagauguagguuaaacuuugugagaaacagacagaguggcccuaguggcccauccgccuuuagucccagcacucaggagguagaggcuagggaaucucugaaucugaggccagccuaguguacagagcaaguucuggaauagguaggacuacacagaaacacugucucaaaggaaaaaaacaaaacaacaacacccacccccccaaaaaagagagaaaagaaacagcuugaagauccauuuuguacccccaccagcaccaacaguugaacuaaaggguucaacuguuaggcauaauacauacauaauugauacauacagauacucaguuuuucuuuacuguuuacuuuauuucuaaugaacugaguuuauuuguaguuguuuuccaggacugaggaaaugucucacuggguuucagcccuugcucagcacacaggaaguucugaguucggauccccagcaccaaagccagggauggcuguguguacccuacucccuagcuuuguaggaacagacuggcagcuccgagaggucagccagccuagucaguaggcaaguuuccaacccagagacagguggugucucaagguaaugaggcggagaguauagauagaggagaaggccugccguccagcucuggccuccacaugccugugcacaggaugugcgcuggcacacacagagcacccagacacagcacaacuuccuuuucaaauucaaacgcuauaaaacuagcacacaucucgcuuuuuggugggucagggcuucaucuaacuucaucaugaucaggauacugccuucaguaucagcugacccuugacucucuagguucguaaccuugcuaacugauuauuaugccaauuagaguuuugucuucuugagaauauuaucuggagagucauaccaucuguaacucuuaaaaaauggccucuuccauucagcaugaugccuuuaagaugugaagaguuaucaguaguuuguuuccuauuauuggugacuaacaguccgugucaaggauaugccguaguuuguauguuuacauugaaggacauuugggcugaguccagcuuuugauguuuaugaauggagcugccacagaauucacauauggguuuugcaugagcauuaauuuucauuuccccagagguaugacugauucuuagccuuuuccuaccauuuaauuuccacaugagcucagugcuccaacuugcuccaaaaaaugugaauaaaauacuuaacaucacaagaccuuguuggagugcaagagaaauaaauuggaaaaugucacuuuaagagagugagguuuaaguccccaucaacuggaguuaaauuuggauuccuuuuuuuuuuuugguucugugauuucuuuuuucacuuguaguuuucagcacagggagugugcauauauuuuguuauauuugcuuagaaguuucuuguguuggauacuaugaaggguauguauguguuguuuugguuuucuguuuucuccucugaaacagccucaguauguagcuuuggcugaacuagacucacuguguaaaccagguuggcuuggaacucauaaaagauccaccugccuuuggcuuuuggcucucccgugcuaggauuuuuauuuaccuuuugcgugcgugcgugcgccugugccucugagugcgcaggcacacacguguuccuaugcauguguaccucuauauggaagccagagaugaaugccaucugucuucuucagucacugucuacauuauuuuuugaggcagggucucuugaugaaccccgaguucacugauugagccugauugacuggccauugugaugcuggcugucccuggggaucguccuggcuccaccuucucugccuuaggauuauaggcacaugguacaggagcugguguuucacauggaugcagggauuugaacucagguccucacacuuguauaaaagcacuuuacccauggaaccauuuccuuaacccagcuuuuaaaacucccuuuguaagcuuaaucuaauagcuccuugcuuguucccuguuagcucagaagguuuuuguuuuuuuuuuuucaugaguguaucucaaaauuguuuacucucauaaacugaaauauaugggcuggcguuuuaguuaauauugacuuguuuauucauuaugugugugugcaugggucugcuugggccacagggugcuuguggcuagcagaagaagccuugggacagaagauagcucucuccuucugcucuguggguuuggggauugaagcucacucgggucgauagccuuggaagcaaguaccucugcuuuuggaagcaucugacuggcccaugacuuuguguuagguuuacaggaaagcuauuuggaaguuacuaacacagucuuucuuccuuucccacacucagccagcgucuuaggugaguuuccaccauuugcuccucccacggaaucucuaacugucacugccugaguaguuuacuuuucccaagagccagaguuguaacuguaccguguauaaccuuuucacauuggcuuucacuuaauaauaugcaauuauauuguuuucuuugugugcauacgacauaauggcucucuuaucucccucuucuucauucuguuaauuaugcauugauacguguuugaugagccuuuuaaauuaguagaauuuauuuuuuaugcauugauuucagugcuuucauaguuauuuauugccccaccccuggccacgacgugugcgcacauguguguguaucucaaguaugucagugcccacagaggccagaagagggaaugggacccucggggcuggaguuaccggaggcugcuacagagcggcugcuacaggucacagaccuauugauggaacuuugaucuguuuucuagcacagcuauaagccucuuuuauauaugaaccgaauaggauugggggagauaauagguagauagaguucuagucauuuaaaauuuacacauucauauaggaacacacacuagaaacacacuuugccauucucagugucaucacaauaccuccauugugugagcuuaaguuaaccguaguuaccgcucuuucaucgaauguugaguuuuaauauuuucacagccaccaacuagcuuaaauucucauuucaaaugcaggguuauugccccauuccccuguguauaacgaugaguuuccugugugucugccuguguaugggguaggugcugcaaaggcagcuauacaaugaauugagguaucauuuggcccucaauucuaaaagucaaaacagaacaaagcacauacacggaugaaguaguucaaagagucuagacuaggcaauucagauacuguucaauaaaugagcuagauuagccuggcaggaauaaguauuccuaccagaaauaaaagaaccuagccaugguauagugaacuuccaguguggucagacauggaccugccucugaccugcugaacugaguuucauuacaucaucagacuucuguagagauacuuagccuuacaauuucccuucagaaccauuaucuaauuguucaaaaccugcauccuccacuguuguguguauaguaaagacauaucgauuuggaaggccucaccucagccaauucacguguauuauuuagagacuagaaauaaucacggagaauaugggaaaggaaaacagccacaacugaaaguauaguuucugguuuuuuaguuaauaauuggaaggugguucuagacuccuccagguuugagacuaaugaaaauauuucagcucuuccagcagagggcagcauuguuccaaaaaucaagauugacugucuuuccugcuuuguacuugaaagugauuugaaggaaucucacuucccacacacacccaggaggaaucagagcauuuauuuauccaagcagcagcagcagcaacaacaacaaaaacacauaaugaaaauagaagaaaaacuggaauacacaauauggacggggacagcagucauacuuugcugucgguaguuuuuccuacaagauuuuguuuuuuauuguuuccugaauucccucagucauguacaaaguccauguccuuaaguacuaacuguauucugucacaggaggacaggcccauuguuggcccugaacaugugucuaucacauuuucaacaacaaaacgugaggauggcguguguugacagucacccaugccagucccuugcuguggcuuuaaaugaaccuaagcagcuguaacagacuccugguuucccuacccggggagcgugggaccuuugagcugcaauggaaacuaauugugggagguuggcaaucuggguugugucuauaguuaaaugacaucacaagugucuccaggaauucggcugcugguugucuuuguguuugaggguuuugacauuugcuuuagcuuaggacaguaaggucaguauugauacuaacgaucauaguguaaacacugugugcuagacucgcuucuaagcauuugccccgagacgcugcauugugggagauuucaagaauuaagaaaagcaauaguguugcuucaucaggaccacucaguaacagaacccaaccgugucauguguuuacagagcccauucucccuggcauuuaaaaccaggcagauaacuguuauccucaucuaacuccaaagagcgucaguccagaaagucaugucugcugcugcccgaggcuaaguguaagcugcuuuacaagggacagacugcgaugacauucuuuagaagucacaguugaaugaggacugguacugagaaauaaauaccuucagaguuaugugguaggcuucauuauucaacuguuagaauaauuuuuuucuauuauaaacuuuauucuaaauccauuuuuacaaaauggaguagagaauauauacuguuaaaaauagacugcauaaagacauuuuaaaauagcuugagucauuucaaucaggcugucucuacuuuaaucuugcauuccagcuggcuaauggcuccaucuugugguccaaaugagaaacugcacccucugccuaagaugcugguuaaguuuuuccauuuuagcugaauaugucacauaaaaugauuuauauugucuuauuuauuagaacauaacucucacuuagcauauauuaguugugucugcaucucucuagggcuuuucucugaaaaccauuucccccuuuuuagugugucuucugucuucccuucaucaauguugguuccacuuuaaagccccuuaagguccagaagccauuuuauagugcacugccuaugaguaaauaaaacucuuagauaagugaaguuaagcuggccuggacuaugcacaguguuuaguaacucuuaaagaguguauguaugaagagucuuacgauggccgugugaggaaggagacauuugaugaacagggaggugugagacuaauuacaacugcauggugacuucugacguaagaaugaguuaaguacuugucuccccaucagcuucauugaguggcuuuugcaaaauuuguauguagcuaugguuguucuagugaugucuugacauaugugcauauugugagugaguauaucaguguaauuauagcaccucacaucuuucuaaaaacgauguuucagagauucuacuuuauaauuuaauguaauuuuuuuacauuuuauuuuuucucugacaguuuuauauaugagaauuuuguuuacauuuucugccccuccuuuuucucccucccuuuccuccaucgccccaccacuuucucauauucaugaccucuuagucuuucaucaugauaacauauaucuaaguguguauaugagauaugauguauguguguauauaaccugagcuuauuuaacaucuuucauauguauauguauuuagggcuuacuauuuggaauuguauagaaaauuuguucucugagaacugcauauacauuuauauaaugcaauaugauauaacgcaauaugauauaaugcaauaugauauaaugcaauaugauaagcaccccuauuuccauacuuccucucccucggguucugaaauuguauuuuuaauuagcauaugaaguaaugguuacuguggcacugauaugcauuguuucugcuggugcuucuccugcacuccccuccuguccccuugugucucuucgccccuugcugccccccucagggcccacccugugccccugcuugcugccucccccucagggcccacccugugccccugcuugcugccucccccucagggcccacccugugcccccugcuugcugccucccccucagugcccacccugugcccccugcacuuguuguucccucucagugcccaccacguguuuucauguccuacuuucccaucuuuuaagacuguuuuccugucucacggugcucucuguagucguauguucuguacccacacuuacauacaugaaaguuaaaaucuaggauccucauaugaaggaaaacacauggaauuugucuucugagucgagguugcugggcuuaacacaguaaccuccaguuccauccauuuuccugcagauuucaugguuucauguagcugcuuuacaguuggguaaaauuccauugaacaaauagagcacaugaucuucauucauucaugugugucuucagucccucauugaugacuaccuaggcugguucauuuccuaccuauugugaauuuggagcaauaaacacucaugugcaagugucucucugguaugacauacagucuuuggggacaugcccagaagcgccacccccuuuguauguugaauaauacuguuuuuguuuuuuuuuuuaagauuuauuuacuuauuuauuuauuauauguaaguacacuguagcugucuucagacacuccagaagagggcgucagaucucauuacgggugguugugagccaccaugugguugcugggauuugaacuacggacuuucggaagagcagucgggugcucuuacccacugagccaucucaccagccccaauacuguuuuuuuuuuaaagauuuauuucuuugauguaugagugguuuaccugcauauaagucuacacaccacaccugugcaugccugaggaggccacaagaugaugucggauucucuagaacuggaguucaacacagucgcgggcugccauguggguguugagaauugaacacggguccucuggaagaacagcuggugcucuuaacuccuaaaccaucuguccaccaugguauuguguguuuguuuuaacuuagauauuuugacaaaguuauaauaacacaacaugauauccuuaagucacauuugucucuuuuacugaaaguaagaaguguuauuuuucuuucuuucuuucuuucuuucuuucuuucuuucuuuuuuucuuuuuuucuuuuuuuuuuugcaaaauuugaggguauugccauucuuucuaaauauuuguaauaaucuuuacuauauuauuguuugagcuauuuuucauauuccuaucuugcugcacuaucuuggucauauaaaguagaaaucagcaguuuucuugugauucuauaguacuucuguagacuucauaaagcuaccuucugcaagauuugcccuuucauuuuacacucaucuuuugacacauuuuaaccccuagaaaauuguggcaacggccuugaggaauauucuugaggaaugaguugaggaguuguaauaguaaauagcugcgucgaggacugaucuuauaggugacacagucuuauuuuggacaaacuguuaaugauacacugagcaauuccuggauauaaauacagcugcaguuugccacugccucugugccaagaacuuuuaaaaauauagucagccuauguauuucaugcauguccucaauugauuauaaauaguuacuaugcagcuggauuguuauuccuuuggauaacugcuagauaguaacagguguucagcaaaacuaguccguuuauuucacugguauucauaguucugggauuggaaguacaccagugagaguguacgcuguagugcgugcucucagcguaguggagggaguccuguuaaaaagcauacguaggcauaguagauuacacagcagugaccaugcaggaagugcagaagggguagucagugaccuggguacaccgugcaggguacuggggagugggugaggucaguggggcaggacugcuugacuuauauuugaaggaagacuggaaugagauggccaaguggcucucugaagcaagaaugcaucauucagagaauaacaaugugaguuucuucacucuggacuuagccagcuguucuuacuggguauugagaagaauggcgucauuugguucauggucucagaaggaccgcuuuaguuuguacugggaacagguaguagucagauuggaacaagaucaccuuaggagcuucgccuuggguggcuguuuucauacuugaacauaauuuuacacuuaaagaagcuacaaaaauaacacaacaaauucucacauacguuccccaagcaagcgcucucgaugcuacuguuuuuaaccaguaaaacauuugcuuuauuuuuguuuuuuuuuuuuaagaaaauuuauuuagcauuuacauuucugguaugcagcaugauuuaguauguguuuacauuauagaauacguuaagcuaacaggcauacugccucauauaguuagaacuuuucuuuuuuuauagugagauaccuccaaccccacagcaagugucagguuuauaauacauggucugucguuagccauugucaccaugcugggcaggaaacuguuuccuccguccuguguauccucagcucccagcacaccuccccagcuccucauaagcagcaucgcucgugugucuuugaguuuauaucucaugcauccgugagauuguguuguauuugucuuccucgccuaucucaguuuuuagaacauauucuccaaaucuaucacuuacacauuuauuucuugauaaguuugaagagauuuuuuguuuuuauguauauauugucuugccugcaugaauaucugugugccaugugcaucgucugaggagaguugugugguugcugggaauagaccccggauccucuggaagagcagccgguguucuuaaccacugagccaucgcuccagauccccauuccuccuccuccucucccuccucuucucauucucguuguuguuguuauuauaacuuaaagugcauauuaguuauuuuucauuugcugugauaaaagcaccgugacccugaacaacuuaauagaaggaggaguuugcuuuggcuuacggguguggggcugagaguccaucauggugaagaggcucaggaacaagcauccggccugguagcaggagcaggaagccuugagcucccagccugaacggcaagcacuaagcagagagcagauuggaaggguccaaggauuuaaaggaccacagcccaccuccgaugauccucuuccuccagcgaggcuacagcuccugaguuuuuauugcugucauaaaaaaaaaaagccaugaccaagacaauuuauggagaaagaguuuauuugggguuacggguccauugggauaggaguccaugauggcagaguagagacguggcagcuggaacuggaaucugaguguuuguagcuugaacugcaagcaaaaaaacagagcgagcacacuggaaauggcguaagucucagaaaccugccaccagagacaggucuccaccaacacagccacaccgaagucucuccagacagugcuaccaacugaggacuaaguguucagaugccugagacuaauaggggaacaucucauugucacccucacauuccacucccuggcgccauaggcugguggccauaauaauacagaaugcauucaguccaaccucaaaguccccauaguccuucacacucaacaguuucaaaauucagaaucucuucugagacuccaugcagucucuuaaugauaacccuuauaaaaucaaauagcaaauuacauacucucagcauaaauagcacagggugugcauuaccaucccaauaggugcacacugagaucacuuucauacacacacacacacuucauauuauuacuguacuugugaugugugaaugugggaugugggcaugcuauguguguggggucagaagacaauuuuggagaguucuuuccucuuucugugcuuuggaaaucaaauuuaggucaucuagcuuguaugacaaguguuuucacaggcugagucauuuguguguguguguacauauauauauguguguguauauauauguauguauguauguauauagguauguaugcacacacacacauuuguuuucuagagaaaguugugcugagagauuacaguuguauggcuaccauuaucugggauugcuguuuuauuuuuugaagugaggcaagaaaaacaguuuaagaauaauucugaggauuguuguuuaagcaguugcaagagguucaagaauggagagguaagaugaggucuucagucguaggcuccauuugaguuuugauuagacaucuaaauagagauacccagaaaauuguguaaaugagccuggaauuuagaagucugacuuagaaauagagauuugggaguuacugauaaggacaugaaccaaugguuacauuugauuauaaaugguggcuugauaguguugcucguggucaguuugaguugugguguguaagauugaagaugacgggaggcuggcuuguucuaaacagacuuugaauaaaggaucuaaugucaugucuugaguuucuguguaucauuuuggucagaacuauugcauuagcuuuuccugaggagacaugaacagacaucugcuccuuucagauagggcacuaaugacagaacaaagaugugaauccauccaaguccugcuugaugaaucagugcauauaacuggguuccuuagaggaucgugagugaggagugacccacagaugcauguuaacuuagaagcagcuaaccacucaaguuucucuccccagcaaucaguaaccacuuuauagggcggggggguugugagccccucccugccagcauuaggcacuugcucucucucugcugaggagguguggggugguuugagccucucuuuccuuccucgugauggaacauuaauaagcccaaucuugugugggucuccugugauaauuacagaugccaacaguuuuaggguauugccaugucaagucuggagcacuuacaacagaaacggauaguaaaaggacuugguaaaaaguauguaagaucguuuuaaaggugacauugugaaguacaaauccuuucauuuuauuaaguugauuguuuuuuguuuuaguacauuuucuguuuacuguaauucuuguuguuguuaccuuuuaguuuccuaagauaggaucucacugcauaacccaugcugaccuggaacuccucauguagacgaagcugguuucgaaccugugguugucuucuugccucucuccugaguguuggguugacaccacacucacucagcuguuuauuuaauucuaacacugcugcaguggacuuugguuagaaugucugagauugcuuuagcuucuccuauugugaugccagaaccuuucuggguauguguggaugcuucccauuucuucagaaauuucaaagccguccaauucuaaggugaaguuuuuauacuguauaaucuuucuguugucaacaccuccgguggauagcaggagucuaguuggugcuuguuaacauuaagaaaauggaccugggagguggacuggcucaucccgucccguuaccugucuuacacggcuucuuuugcucucucuugaaacagaauaaaggggaaagcaguccuuugagagugugcacaucccuguaggccuaacgauuuuguugguauuuuaucuuuuacauccuauucuuuuuguucagaguccugguagucuguccuugagacugcaguucauagaucugucuccuugcagaaucuccggucccacccuaggcugcugaauagucuucaucauaauagccuauuauuaaguuggagaguuggugcucgaaaugacugaucucccuauaaaaugucacucacugaauugucaauaaaugcaucgguguugcuccauguuggcaacaguggggaguuaggaacuugauggagcaggguuaguugaguuauggucuuaggcacuaggugauaaauaagaauaaaaagggaaaaagaauaauuuccuguacuuuuugauguaauaaagauuagaaggaaauaauucuuauucguuccuauucuaguucuuucuuacauugaucugaaaauuaguuuucagcuagcuuuaaaaaaaucuuugaggggcugccuagauggcauagugaguaaaggugcuugcagccaaaccugaugacuuagguuugaucccuggaacagguuugaaggagagaacagacucccacaauuaucagaagucuccacaggucuuuuugcacacagacacgcauagaaaaacaaaugcaauucacaauuuuaaguaagguuuauauuuuacugucucauuuccuuuugcccacuucuguguccgaguuccuugguucauaaaccuagagagcauagaugucgugggagucuaugcacucacacagcuugcaguaacgccucugcaacaaagaccaaauacaagagcaguugucucacacagccuggcuguggccgcugugaaugugcuagugcuaaugaugggugcccgugccuacgugguaagcugcuucuuggucccuuccucuaaguuuauugacuauugcuuaaagugguagagauuuccugaaaauagaaaucuaugccuugacuggauugccuucccucccuuugacuaucucucuccuuccagcaacggcggccugaagagaacgggagauugguaauucuaguguguagaauucuaucgcauagaaaaauaaguguaguucacaacuguaaaaauuguguuucuguuggagugcccgaacuauggaacuuccauuucccuucaugaagaagaagaugcugaaaaucaguguaucucucaucccugugaaguguaacccagguuacagggguggcugcugcucacaaaauauguagccaagcugacgggaaguccuugaccucagcagucuuucagauccagcuccgggaacauucaagcuccuggagaaauguguaguuuaaauagaugaccacagacaggagcucacaaggaaggugauuuacagcaaggacaccagcacuguuguggggaacaaacaccuucaaccaaugguacugagagcacugcgaaggauagagcugcaaaaacucacacugugcgccacggagaucaacuauuaacacaagaguggagcuuaccgaacaucuaaaagcccugccuguggguaaacgucgguagccuugggcuaccgaugcaguccugggcaggauuccuaaaguacaaacuacaauaaaguagacgucaucaacaauaaaaacccuugcucaucaaggacauugucagggaaaucaaaagacuuacauaagaauaagggaaaugcuugaagaccauagaacgugucuugucuuuuaucuaaaauaagaacuuguauaacucagugaugacaagacuaaugaucacuauaucuguaugucacaugguauauaguuauagaauaucuuugcaagaaggccuguugacauccauugcaugcauauauauggaggaaaagacuaaucacacacacacacacacacacacacacacacacauauacacacacacacauacauacauauauacauauacauauauauagcuuguguguggcauuauauguuauauaguuguauauguuauauauauucuaaugaucauauauaugucauuauacauguuauauauguuuuaaguauuacauauuuauauauacuagauauguauaacuauguagcuauauauuauauaauauuaauauauaguaaauaauauauaaucauucaauaacauacuauuauaggauauuuaauauuacauauauaacuauguaacauauagugacauauguacauguuuauacauaguagucauuagccaucucaucuguauacaugcaugcaauggcugucaguaggucuuucuacaaagaugauaaacuggcuaauaagcacacagaagcauaguccuuugagaagaacaagucaagaacuuuacaaccacuaugauuucaaagaggaaaaagugaguuagaccuggugguccuggccuaucaucccagcuacuugagaggcugacacagaggcuugcacuuuuagccucaccagagguucacaguguacucaaggcaagccuggauucuauaggaagacauugccucggccccaaguaaaucaguaaauacaaugauaaaguuaaaccaucgggcuaugugagggggauguggcugagucucagaggaaaaagaaaguaauggcaggcauacaaacuagagcucucugugggacuggggacugauggagguguguugcugggaagaaugcuuaguggucccucagagguuaucacagagucuccccccaaaaucagccccucuacugcaugugugcaaagaaaagugaacucacuugauugccuuaaaauacugugcauagcuucaguguaucccaaguggccgucgcagaagaauggauaaagcagaugugauguugcugcauguguguauguauaaugcagcccacacucaggcaggaaaaggaauaaagcgcugauuuaugcaugcugaguggggaugacccagugagucuccugugaaaacagaaaggcucacacuguaugauuuaauuauauaaaguguccagaguagacagaugcacugagacagagugugcacugcaggggccacgggcagccgugacacaggaaggggcagcuuccuacuuacaggguuugcuuuagggacgacgacaaaacaacuuugggauagguaaggagccaacuacagggauaaugcacuacugaauuucccacguuaauaaaagucaaauggauuuuuaccucaauuaaaaauaauaaauuaaccuguaauucuaacugcaugggacccaggguccccuucuggccccccaaaacacugcagucaauauauaacucuacacacagccacacucacaugugccgaaaauauaaagaaaauaguucugagugcaagucccaguacuguggcauggccaucugaaccagaucagggcaguagacggcaucagcagaaaauuaauuaaagucuucuacaugguggcccacagucagcuaucgcucugguuccagggcaucugagccccucguauggccucuacugcuuccagacacaccuagagagcacaaacauuuagccaaaguacccauacauguugaaaaugaaaaugaaaaaaggccuuaauauauauggcuuaauuguaaccuuuucauuuuauaauagaaagcuaacaauguuuagaauucuagaagaauuuucuuuuuuggucuggaauucacauaaugaauuuuuaucaggcuaaguaaaaacuguuaggacagcauauaggaaaaauuaaaauauagauauaauagauugcugaggugaauauaaaacgccuugaaggaucagugcugaugcuuauauaacuugauagcguuaaaaauguaugaaucaccugaccaacugaaggcugagcaagcaaagugaaaguccuuucagugggguguguggguuuauugauaacuguacccugcgugguuucauuaauggcacuuggauguuuuucugucacauugagauguuacguucagaggaggaagcucagcccccugguugucucaucugucucuaagcacugaucauucagaacuuuccaagcggucacacugaugcccuagaaacucauaaacuagcuugguuuguguuuaauguuaauaaauguuaaccucaugcccauauuaccucagguguguuucucugaugaugacaaaaagucagagucaagcuuagcguuggcaagaagacuucacggggaaaggugcuuucugccagucugaugacgcaggccuggguugauuccugggacccacaugguagaaggaggaccaacugcugcaaguuauccucugaccucuacacaugcuauagcaugacccccaagaaugugugcgugcucauacacaaucaaucaaucaaugugaaaaugaauuuaauuaggagaggcuaacuuaaccugaaaggagaacacggcacuuccuggagucacccuuuggcccucccccaccccaucagccuucaguuugaagcagcuggacuuggguguccaccgugcccugugagacgcagcuuuucacuuggcuuuuugaugacucauccuucagcuuccuuguccucccaugaccaaugaccacuguagaaggagcaucuugcauaaguagaugaauauugugcacuaggucguauagcaauaagacauuuggucauguucaugcaagacugauugcaggugguauccgagguguuacaaguagagaaugaagaauagaaacagcacagguuuagcuuagaaagagcuuuggaaugaggcagggggacagcguauaccuaacuagugcuucacuucuuucucucauucuucugugaaucguugccauaucacaccaaggccuuucuucuagcaacagacucuuuaggcguccagccacaccauggccguucuaaagguucuauugucccucuccuuucuuggagggagccccuauggacucaccauucccagucacucucugcuccucauaucccacaucccaccuauuccccucaaggcuucccgcuguuugauuaaaguccagucuggcccaaccucuucucaguuuugcuuuuacguucuguccgucucucucugugugagcucuuuccuacuccacaguugccuacauuuaaaaaggauugcaagaaugcacagaaggacuuugcaacaguucccuguacaacuucuauuuccaaaauaaauacuacucauaaaugccauugugaggcuugugaguccacgcuccaggcuugugauugugccggugugcugucugcucuccuugaaucacagguggggcugagcggaacgcauuuuucucaucucugccguccugccagucugggaggcagaguauuggucucaaaguagagaauccuuauuaaauauaauuugguuggaagcuaugugugauaaauaucuauauauuuagacauuaaagcuuauuacauugugaugaaugacuuaauaaauaaaaagaagccagauauuuuauuauagcugcaaaaucuucauauuggaaacauuuuuuucccuuuguguuuuuccuuuuuagacacuauccuuaggauuuggcaucucaggcaucaucuacagccccugguuauaccuuccuguagugucacucuuugugacaggaccauggcuggcccagggccagcucagguuaacucuaaaagugaaacaaaauagcaaaccaccagaaccucguguucagcuggguugacgcccgagaggaugggcaggguggggcgcccgcauuggcuggauuggcuuccgcaguggacagggugagcgaggaggggaccacagcacguguacaaacagagcacagaagccacgaagagcccaccuuccagcuccaggucauacgcaccagucacuuaacuuuaaaucaccacauuguccuuuuaucccccugcgccgugaguccguucugguccucacuuaaugucaggaguguggucugguuuaauguggcucagucaucaggguacggccaggguacugaaggaggacagucacccucaaccucuagggucugaggauuguuccauguuauuccauguuauuccauguuauuccauguuauuccauguuacucacucggauugaagagucugaaaaugugcuucuguaucaaaaucuaucauggcuuaauuauugcaggaguucaagggcguuggaaaaaguauaauuuaugguuccuuuucccucucugcaugaauagcuccaaauccagucaaguguugccuuggcuuuucuuccccaaauguguacuuaucugacucacuucaaugguugccuuuucccuuucggaaaugucuguucucucaccaggaugcuaaaacacugugcagauguacaguuggauacaaugaugccaauauaauauaugcacuguucaauaauuuauuuuguaucuggagugaugcaucuguuuccuucuugugggaggggguuucagcuucauuuucaaugucauuuuagguacugguccaauucuuccauccaguuaaccaaaaaugaaaaaucccaucuguucaguugccauucggaggaauguuucucugaaguaugacaacgaaaauugacagcauaaccagccugagcucuuccucuuucuuccucuucagauucucuugagcuuuaauaagaaaggauucuuuuuucuuuucuuuucucuucuuuuaaaaaaaaaauugcugcccaagauuccgggagggaacuuuggucucuccugcagcugucgaccagcagagcaugaguagcugcuguccacgcuucgguccacucuucauuauauauauauauauauuuccuguccauuaguaacccuccauguuagcuaaaugcuagcaacagaacaauacaaacucagaguucuguuucugaagaauaagugucugccuguacuauguggcuuuccauugaacucccaaaugucuccaauuggaagguacaguuacaggcugaguuuauugauuaguguguacuuuaaaaaacaaaaaacaaaaaaaaaaaaccuaaagaaaucuuuguaauauacuuccuguaaaguuuuacuuuuaaaagcugaaaaauauuguuucaaguagcuucauagcugaaauagcagaaauaauuucuuuuguacuguuaacuuucuaauuaaauuaaccagguaauggaaaacuuuuaggugcagugaauaaacuauggcuuuaucuaccagauguauagcuauauuccuauauauauuaucuaccagauguauagcuauauuccuggaggagccgcaggaucagaauaaaacagcugauuuuugugaugauuuccuaauacacucuauaccaauucacuagaugaagcugugcugaauccuagacaacaauuacucuggguagcuaauauuuuuuaaaugucuauacuuuaauaaauaucucugaucccuguaccuuuucuuguguuucggggaaauaugauguuuguucaauaacauuaacaguaccuuuugcuaucugauacaaaauuugugccguggcccuuugagauauguugaacuauaaguuugucuagugcuugucccaugcuuauuggcguauagauuucccacuggccuuccuaauauuucauguaccuuugccuaacaaccgugaugucccggggaucgcaucaaugaguuaaaguacuauacugcaauuauagauugugcuacccaauggaaaagguacugcuuuagaauuguaggaauuaauguuuucuuaugauauaaaacccugaucgaauggauaaccaacuggaggcuguucagcauggcgagcauuuuaacagcuuggcugugagaccuguuggaauauccuagaaagggauaaaggccacucuugagcaugcuaaacguugccgccaaaggaucccagcuuuguauucgauucucuuuguacauuuuugaguaaauauugaguaaauuuaaauguccugucuuugggaucuuaggaucugagagaaucaguaguuaaaauguuccucaugucucauucuuauuuaucagucuaccucugugaaugaacagguuugucagggaugaaauacugaagauguagccauauacuuauaaggaaacaaccuauucccuuuuuuuauuccaguucucuuuuguuuuaaauucaucucaagcuacucuccuuagugacccagaagaacaaagaaguagggagaaagaaagguggacggacgaagcucugaggacuggagggaggaagggcuugggaaacagugguaauuugcaaggauaggaguggcuugcuccaccaguucugggaaacauuuauaaacaaaacagucuguggcucuugauauuucuuuuucuuuuacaauggggaaacaguagguaagauagugaagcuauguagaaagacagaguggugugaauugguuuuguccuuguaauguacuguuucuguuguucggguaccuaagaauuuaaggcuugaaaucuaaaauguuacuucauucagcaaguauauaguaauaguauauuuuacguaaagcaguuguacuggcugguuuugugucaacuugacacagcuggaguuaucacagagaaaggagcuucaguugaggaaaugccuccaugagauccaacuguaaggcauuuucucaauuagugaucaagggggaaaggccccuugugagugggaccaucccugggcugauaguccuggguucuauaagaaagcaagcagagcaagucaggggaagcaagccaguaaagaacaucccuccauggccucugcaucagcuccugcuuccugaccugcuugaguuccaguccugacuuccuuuggugaugaacagcaauguggaaguguaagccgaauaaacccuuuccuccccgacuugcuucuuggucaugauguuugugcaggaauagaaucccugacuaagacagcaguguaggaugaggaggauacagaaagaaagcaaauuugggucuaucugggccagcagucuaggauuaacagaguuugaauccuagcucaaacacucaguaauuugauucauucagacauacuuguugaauguauacaacacacccguuucuuauuguaagcucuaguccacuuuggcaaauaaacucugagagguacaugcugucauucucucuuuagaagggggggggggguugggcgaucaaccaucagagagggaaaccgugggugcaguggaacaagauggggagaggaacucguccggucugcguuugccugaccaaugagaaaaggccuaaaggcaggaguggcucuguuccuagagcagaaggaagcuuugcagcuggacuguggugaacaaagaagagaguaauacaaaaugagucagcugcugacugguaccagcucaaguggggcucauugauuaggguaaaugccuugauuuuuauucaaaauacguuuggaagcucuugagagauuuuuaaguaggauuuuuaagucacaugaucugacuuccuuuuuuuucagcuuuuucuuuuuuuuuuuuguuuuaauagcccuuuuaucccauuuguuuuguaaaauuugaugucgaaaacggaaguugaauuaguuaugccacacuacauuuuuguugguaaaacuaaaaauuugaaauaauauugauguuuucuaguaauguuggaauugacaguaucugccccauuagacccagugugucuugaagaaagauuagaagucaugcugguguuuguauccucagcuuguaaccugggaaccggcacucaucaggugagaacugguuaagucuaaggacaauauacagggaccgcgugucacauaaagagccuuucagaucacagacuugccacuaagaugucaaagcuuuucugagagagcaaguuauccagagcacugaauacaaaauaguguagucuaguccagaggcucccccaguagacaagcuaguccuauauggcuauaaaguguaccuucgcugugguaaggcugguuuauuuauguauuuaauuuugagauagggccuugcuauggagcucaggcuggccucaaagucuugauucuuaugucccagccuccuguguacugggguuagaagcguguaccguuacaccuggcuacacauuuaaaaaaauuguacuuauuuuuuuuaaguuacaagcuaaaguaauacauaauuuauaauuccuguaagucugucuauugaauguacuagaaugugaguauuacuguguuguuaauuaauaccuuaaaagaaacuugauucuuuccuuuguuuaaacucagugaucaggugacugaagagagcaugugaaaauucaguaaugcuaaaauucugguuuggaaauaaacugucaggcaguacguagugcauaggaaagugauauuagcauuucucaagccuugguaauuacuuggaguaaucuuaagagagauugacagggacuggagacagagcucagugauuaggacaacuggcuacacuuagauaggacucaguuucaguucccagcaccuacgaagcagcucacaaccaucugcaacucuaguuccaggggauccaacucccucuucuggccacucugggcaccagguacacaggcccauacacacacaauucuaaaaucagcauuguuaccaccaccugcguuuucaucagccagguacagguaggaugugacggagcuaggaugcugacacacauccuuucauuccaaggcgcgugguuccaagacuguguuauccguugugccagaguguguuaugcucucuaggauaaugacaugaacuagggccuuaagaggugguguagggcccagugccuuuuaugaaaugccuucugugagugugccuucuguuauaguuucuucuuccugccuuugugguuuuguacauuguugcuucucagggcuucuauacccaggccuuugugcaggucuaugucucuugucauccugguuaacagucacucccuauguuuuguucaaggaccaguguuuucagauuuuuuuucauuauuuauucauuuauuuacuuuugaggcagucuuuuugcuuuguagcuuagauggcccuggaacucacuguguagaccaagcugaccuugaacucacaauacuccugugucagccaagguucucugacucgguuuucauacuucuguguauuauaagcuggaaauauuuuaagccauguaaauuuggguuacaauuuuuugcaccaggauuaaauaugucauuacaacaauauacagaacguuagaguucuuaauuuauuuuuaugcacuguaaauuuccaagaaggagaggguauagagggaugaauauaaaauaaaaccuuuuuucaauuuuuuauuggauauuuucuucauuuacauuucaaaugcuauccugaaaguucccuguacccucccccugcccugcuccccuacccaccuacuccacuucuuggcccugguguuccccuguacugggacauauaaaguuugcaauaccaaggggccucucuucccagugauggccgacuaggccaucuucugcuacaaaugcagcuagagucaagagcuccggggguacugguuaguucauauuguuguuccaccuauaggguugcagaccccuucagcuccuugggugcuuucucuagcuucuccauugggggcccuguguuccauccuauagaugacugugagcauccacuucuguauuugccaggcccuggcauagucucacaagagagcuaagcacgaagcuccccccauuccccacagaguucauaggccagcacaaauugaaggcuggccugggugccggguaggguauagugcuuuugagugucagguuucauagguucuacccagaaccacaaaacaggaccuugagaagugagaaacacaaccccuccucuuuucccucucuuaggagacugggcuccuaggagcucuuuugaccccgcuguagucgcucucugccuuucucggagccacugacuaggugcauuguggccucacugcucagugcccugaaagauuggacccguuccgccucucucggaucccagcgcccagaagacagaagacagaagacaguagcugacagacaggugauucagcgugaccguguuaaaaaugaaaaucuuaucucccaaaaaagaaagcaaaaguuuugcugaauagucaaacaguccgucuuuaugaaugguagccauaucuaacuccacaacuacaugucuagacagaaacuugagaaucagauuuaacacuuuuuuuuuucgacucccugugaauaccaggauggccaacuauccuuucuacauagcuuuugaauccacaguauauucucuguccucaggaucucuguccugggcugggccuuucauauuucucuccugaaguacagcugccuuuugcuuugcuuuucuagcuguccuucucuaacccagguccuacaugcuaaccuuacccugauuucuaaaugaaggaugcuucaguucaguaacuucauaccguccuuaagcauuggguccaggcugcuacauucugcacauuccacagcaacagcuucccauggaccugguaaacagugccgcucuccacuccugaucuggcucucaggagucuuaauuccuuuuuuaguaucaugugcagcccuugaacucugguucccuuaccucuuaccaccuuccucuugccuuuucuuuuugaccuucaacucucucuuuaaaggacucuuuuuuagaccugccuuacucucuagaccggaugggcacuuuggggggggggggggggugucucaggguuguuugggccugaagcgccacucuucauugcuaucauguaucuaauuguugcaacacuugcuuuguccugagccaggcuugaugcugcaguuugccucccauuauacaaccgucuuuccuuucuuacuaagaagguaguuuuugcuggcaccaugccacaggguuagugacugcccuguguuucuguugggaaaagcaguacucucuugccucuuauuuuuccugggcuagagcagugugaagcuucagcuaccuuuuuacucgcuggagggugagauggcacuuugaaagagcagaugagaagcccuuaagaugcagauuugcauuauuuauauccugacacuugucuuccaucauuuuuuaugagagaaaaauuaauugccuuauuacuguucuuuacuuuguuguaaacauuuuccuuguaacauagcauuucuauuucuuuccaggccuuuuccuguuuguauuccuguucccuauguuuuaccaaagaguagagcccaucuuccuuaaaguuucucucucagacggucacaucuagugcuuaaugauggcagacauggcuuuuugaugaugaugaugaugcuguuguuguuacuauauuuauuuauuuuguggggcacacaaaugccacauuguacauguggaggucagaggacaauuugcaguaggaguugguucucuuagucacauggguacugggaauugaauucacaaugccaggcuuauuggcaagugcccauugaaucaucuggccagccagauaauauuuuauuagaucaguucuguggcauuuuugauaguucucuuauuacauaguguugggaccuguaucuucaagauuuacacaaugcuaucagucauccaaccuucccuuuaaaaaauuaaaucacgguuucuauugcaugcucuuauugucuacugcuguguguggccuucccuggcagguuguaaacgcugugaggaccauugugucugaguauuuucuccacacuguguaggauuucaguggauccuagcucaaugcuacacauuaagaagcugcucagccuuuuucuuucuuuaauaaaugacagaccugagucuccaaccuccgcuuucucaccuaucccugcaucguguguaugccuucaccgucaacccaaggugcugcuggcaagaccacuggggguguucugcuugcuacacucaguauauucuuuccauuuugugccuugacuaauuucuuaaaaaaaaaaaaauuaaccacaguauuccuuucggggugucauucucucauucugacuguuccuucagguuuccaaaaguauugccacuuaucuggcagcuccuccauccuucuguuccccccagaauucuuucuuaaaugcacccacuccuauagcgucagucacuauacgugcugaugguuuccaagccuugucuuccacccagcccucucacuugaguuucagaccauuuguccaacugccuacucaauguaugcaucgugauauucugcagaacucuccaacuccacaugcucugccugacugaagauucaaugaauucugcuguccuucccagcagagacauaauauacauauggcuauuaucuaaaucguuggcuuacucuaauucucagcaaacuagcugagacuaaauuaauauguauguauaaagucaguuaaaauuuauucucagauuuucuuuuuuucuuucagucuagggcuuaugauuuccuuuuagaauauaauuaaggcuguuuauaauuuccaaauuuuuauguuguaccaagacaaaaaugcagacaaugauacuguauuaauaaucuuaguauguuacaaagaccgaauuugaauuucucuguuuagagaaaccgucuuaauugcauauugacaguuuuaauauauaauuuuuacuuaauagagcugguauucuuuuucaaaagaauaaguacaauaagaagaaugaauauugaaaaaugaguucagaagccgggcgugguggcgcaugccuuuaaucucagcacucgggaagcagaggcaggcggauuucugaguucgaggacagccuggucuacaaagugaguuccaggacagccagggcuacacagagaaacccugucucgaaaaaccaaaaacaaggaaggaaggaaggaaggaaggaaggaaggaaggaaggaaggaagaagaguucagaaagaacuauaaaguauuuuacaaagggagggagacugcgugaaaaauuaguaaacuaagucacauaaucacauugacauugucaguuaaguauuaauacauugugccaguaguucugugucugucagccaccuuacaagagagacuucagcaauuugguuaaacauuuucaagcuguagaauuacuaagucaugcaaacgaguacacacuguugguguugaagacauuuaaacauggaaguugagaaaacauugaaauuuguagaguugguuuuaaauuuuuuaaucaccccuaggaaauggcugauacauaaaaacaugcuuagugcgguuuuguucauuuggaaaccuucaagcuuaauuagauuuuuuuccaggcacuuaauuuauguaugcaccauaguuuccuuuggauuuuaauuuuguuuaaugucuuuuguucaaagguacauaaaaagaaaaauuucccuuuauaauaauuucuuucaacucuuaaaauaagguauuuaagauuucccuuuguugauacauugauuuaaagcuuugugccuuccauacuugaauuauauuaaagccaauggauuuauuucuagcuaauuauuauucuccauuggacagcugccuggauguuuagagcuguucgaauaaagcguguuuuuaucccugcaucccaugacaucgaaugucuucaggaagcuguauuaaacugaugcuguguaucacuggggagccaggcagaauaguuuuugcuccugcuuguuccgaguucauuauuuccuuuuguagaguuaggaguaaguuaaaaagagguuuggggggggggggguaaaagcaguguucagaacugaaguguuacaguguaacuuugcagugccggggaacuuccgguuaaguacccauaucacagaccuggucugcucuuagggguuuuuaaaugauguuuuaagauuuuggaguaaugccaucuacugguugaaaagagcaucuuuugcauuugcuuaauauaaaaaauguaaaaaacaguacuuaggagugcaggcccugcuugucggguaucuuguucauccucucuugagaccacaaugaagugaaggagccgucauucgcugggacggcugacuuuggaaguguuggcuuuuguuuuaaagcagaugugcaccaagucccagcuuccacuaguuuagugaaaguaugccaugucugcuaaugucauuaagcuguugccuaaguggaugauagaaaguauauuuaucucacuugcuauucuuaauuauuuuuaacuauuacuaaauauaaauccaguuuuuuccuguuucuauauuuaacaggagagucauggaaacagguuuuuaaauauuucucugccuuuucuaguacucagagguuuuuccauauuuagugagcaaaugauuuuauauugcuauaaauuucuaacugauaguuaaagguuaguuuaaaaucugaagggaaaagguuaaaaaguaguaacaauuauaaauaucuuuaucguaugauuaacugauuuaaaaaaauauauaucuccaaaggaaaaaugauuuaccuuuuggaacgaucaacaccucuuuuuauauaaaaguauaauagggcauuaaaauggaugcuguguaggcuggaaaagcaaaaacuugcauaagaacugcgaacugugggcagagcagccuccugggugacggcuguggucauggucacauugacaucguaauaauggaguuucugagcuggcagccaaguuucaugguagcaaauaccuggguugcagggaaacuucaggcucacugucaggagaaagcagaaaguguuuucuuuccuggcuggguuugcauucugcuucgcccaggaucaugaucccaggcucugcagcaguccguuccccacaacccggagaucccagauccaaagcccuuuguuuucuaaccaguuaccuggacugguuggagcuuguauuuaggugugagcugugaauuucuauuacaguaagaaaauugaauuuagggaccaguguuauguuaaaagauggagaguguguuaucuuucaaaugugugggguuuuuuguuuuuuuuuuuuccugccaggugguggcaacaacacacuucuaagucccguguacucugaauaugaucaguaguagccaaggcaagaacucaccuuauccucucuauccauuuaagaacucagcauuugccucagaaguuuuuuucuuucuccugguuuaaaaaaaaaaaaaaguccuuccuuugguaguaacugugaaagaccugccuacaagaggcagauucuauagacacugauuaauccuguaagauuauuuuggauagcacauauaccugugaauuggaaguguauguaagggcaagcuaagcuucuuaaauaagaauugggcuucagagucuuguccauauauauuuaucaucuaaauaaaagauuguuauagaaauuuugcacuaaaaucuauugacuauaagaauuuuuucauuaugacaauuuggcuucuuaauaguucuauuugcucuuucuaauuauuugguuguuuuuaauaauucacauacuuuagggucucgggagauggccuggcuauuacaaacugcucuugacuuggguucaguucuuuuuuuuuuuuuuuucuuuuuuuuuaaauuuuaauuuauuuuuuuuaauuuauuuuuccuuuuccauuuuuuauuagguauuuagcucauuuacauuuccaaugcuauaccaaaagucccccauacccacccaccccccuuccccuacccacccacucccccuuuuuggcccuccuuaauggggguuuacagcugucuaugauucugguuccagaggaucugacgcccacuuguggccuuggcaggcauugcaugcauuugguaccuuuagacaaaccacucauacacauuaaaaauaauguacauguuuuugaaauuauuuuaaaauuuaaaauucacauguauaaaaacaauauucucuuuugcuuuuucauauauuuuuaaauuccuaguguuguuuacuuagauuuuuuuucucuuaaaauugaauaacaaguuugucuauuuucuaagaaccagaauuugguuuugguauuuauuuuauauuucauuaaauauuaauucuacuucuguuuuauguauucuauuuucuuuauuuuuguucaccaauucuacauuuuuucuuuuauucuucaacuuucuuaaaagucucagggcaucugucuucauccuuuuuguuuccugauaucaagacucagggcuguguauuuuccuguaaauaaaaauuuguacuguccaagucuuacuguuauugcuaauauuauuugcuuaguuuuccaguauguucacuaguauauuucuuaauaauguauucugcauguguauguauauucauguauagucuguggcauaugugguacauauguuuaugugcaugucuauagcauaugugguacaugcauauuuugcacaugcauauuuugcacauaaccauguguggccugugguauauguggugcauguguauguaugcacauauuuauguguggccuguaguaugugugugucauguguguauguauacacauucgugcauagccuguggugugugugugugcaugaggagaccagaauuagaugucaucuucugucuucugccaccuccccugucugauuguccugagacauagucucucacuaacuuagaagcuggccauuuggguuggauagcugcccaccagcugucuccuggugcugaguuuacagaaguaugcagucugucuggcucuuuauauggcuggugggauucaaacucugauccccauguuuguguagcaacucucuuccagauguuuagccagcccaccucaagcuguacucugcaucccgcuccucccucucuguguuguuuaucagaucuugguucccuuugaugauuauuuccuguguuucucuuugggucuuuaaaaaaauauuuuacuacuacuacuacuacuacuacuacuacuacuacuucgucuucaccgucaucuucuuccucuuaccuuuuaaaacucgcucuaaacacuccuguguucagucaccuugagauugcagaugugcuuguugugccaugcgguugcauccucccaaacccauggugaguugaaaguagcaucagcugagcgugcauuucaucuuccugaagcacugagcauccuugcucaucuguucccgcucagccauguucaacucaaggauguacacugugcagcugggcaaaugaaacacaagaccaguuucuuagcaaggugauuaucucacauacuauguuguauauaacaggauuacaaauauauaauucucuuguauaaaaagcagaaugaugguauagauacccuuucauacacaccaucaugaacucaagagauugcagccaaccauuguaaguccagugcagucagaauucuacuacagugccguaguucuguuugugggggucaguucgucucauuacaccagguaaaguuuucccaucaugguggucuaaucccauuuuuuuaaaaaaauaaucauauuucauugagauuauuucugcagaaaucuagugugguagguaucuuauaacauuaguuacuuuuauguccuuuggauccuaaaggauuucaagggucuagcaaaaucucguuugcaaguuuaucaauuucacacuguacaguggaguacauuugaaacccuuguacaccugugauauuucucuaaauuuuaaacuuguugcugcuggcuucccgcuucuuuccacacugaagugaccguuugcuuugcuccaguucaaacaccaaggaucuccugcguacguuuucuugagcgacuuugauccugcaacaguuacacacaugcucagugccuccucugccgccccucagcagcuaaugguaaauuuucucucuaccgagagagagagacugcugccauccuacaccccaagggccugaagucgggucugaaacccaggguuugucacagucccaacuaaagcccaauuuuaugacacugugcuauuuuaagguguucuguagaguaccauuaacacacacacacacacacacacacaugugcacacacaugcacacacacaagagagagagaaggacuauuuuuguuguaaaucucaugaauuuuuaaaauauugaugaaauuucauugacuuuauggucccuuguauuuuaagguauugauugauucuguauauuaauaucuuucuaaaaucuauuucguaauuauugaauuucucuucugguuuucuguuuguaaacuucggugagguauuccugaaguaugcagcaaacauccaguaaguauuuuuuaaaugaaaauaacaucuugaugcuggagguccagcccuguaacugguuaucagguacagaguucucauacuaagccugcuguauauggugguauuuguugucuucuucacacguugauugagguagagaaagaaccugccccauucgcacagccuuaccugguagaacugaaucaagacuggcuccaggaauuuauguucuuuuucauuauacucuaguuuguaugguuucauaugcuuuugagaaauguguuaguuuuauauucaugcuuaaaaucucucccacuguccugcauucuaguuaauguuucaauaaauauuuuauuauuuaaaaaguaaaugcuucaauaaauauuuuaagacuccagccuaccuagucuagcccgucaccacacaucagcccuguuggccaugucuggcuccuaccaguuuuucacagucccucugugcuuugcugcugugugccaugaacugccccugccuggaggucagcucuucuuuaugcugccuuccuggugacuccucugucucuggaagugucaucgcugucuacggacaguugucccucuccagugcucuucugaguuuguuccaguucauagcacuuacagcgccucgcuuuagcagcuguuuuguuguugccaucucucucggagagaagagcacggggugcucggaucucugucuccucucggcccaguaagcguuaccugguacacaggagauguucgauaaauguuuauuaaagaaaugacugaaaagccauuguuuccguuaugauucuagggacauagugcuugcuuacugcagcagcuucccggcuuuuuuuuuuuuuuguaacagugaaaacuguuuauaagaagcaguaucuuguagguaucuugaagcaaaguauagugaauucuuaauucaaagcucgagacauuuuccuuauuuaguucuaaaacaacauagguuuuguaauaguguguucuuuaaaagcaguuccauuuguuuuucaguugaaaaugauucuuuggugaaaaauuaacccaguuguaauuauauauuaagaaguaugcccugucuggcuguuuuaauucuuuuaguauuuuuaucuuggaaauaccugacaaaaaaugucucucauuaaacuugucauugcuagucaugacuuuguggcugcuuuucaguuaggcacuccauggauaucauauauagaaaauacuaguuuugucaaagcuugucucccucaccgagcagcauaaguaaauacagaugaccguauagcacucacacgcucuuagguaacggucucuauaagauguaucguguauuuuagggggauuuggcuuguuuccuuauuaaugcagaaaauuuaauuguccaugcuggggaagcugccaccgugcucuuuguuauuuuaacucuuuacaugcagugaagacggaagaauggagagugauuugcugaggccaguaggcuguuuccaggcuggcagccgaaagucaaacgugaggaaauugcagaaauuuacaauucaaugugcguuucaucagggagagacccacggauuguuuugacacucaguuagaaauucagcaugaagauggacgucucauaaaaugugcagcugcugauugaauucauauuuccauaaaggccaucaacaguagaagccugcagggaaagagggggagacaugacaaaaaccugugaggccagcauuuuccucgacguuccagccgcaaauuacugguaauaaggguuuacacugaccgggauuaaagaaaaauauagacagccaggagggaaagacuccucagccuaauugauuuuaacuaaauaugucuacauuugauaucuaaauauguguuuauucaucuauagaaaaccuaauauauacuuaaaagucagucuucacuauuuaaacagcaaaaauaaggcaguuguuaaagcuacagaacuccaucacacagggucucuucguaagagccuucagagauuugaacacucauucagaacagccagaacauucugggguaguugauugcuguucucaggugaauugcagguuacgugcaagcccaugaaaucguuauuccaaucccauagaaaacaagcuugccuuuugucucuguaauaccgucauuuuacagggguucaggaaaagccuguauaauacugugccuuuaagaacgacuugauucuucuuguuuauguaguaacaauguucccagauuuuaaguauguacuagauuuucuacaaaugaugaaauauauacuuagauauuaaauauaagcguguuuaaauuuauacuaaaaaguccauucuccuuuuaaagugcuuuuaaaaagcaaaacagacaaaaccuuguauuuuuguacuuaacgcuucuuuuguaagcccuucauauuacacucaauugaaaaauccuguggucucugggagacccgaaggcucuggggauggggggucauuguucauccagagcucuuuguguggacagcguuaacaauguagcaugcccucagauagcauuucuggaaaauuagaguuuauacaaguuuaaguaaaaguaguuaccuuauagagaaaagaauuauauuuaauuagcaaugugacccaaauauauaagauuaccuagaaaauaggaaugugaaauuauugaacuuuauuaacauacuagauuaugaauauuagaacauagaaaauguuuucagauguuuuguuugugguuauaauugagagucucaacuauucuuauuugaaaagaauacuaugucuucuaguagucgucccuggaagugcacacugggccuuauuuuucuaaagcgcuuucggguuagguggucugagauggcugucugcugggagacugggaguggucuccuuuccacugucagugagggcauagugucuucuucaccauguguuaaaggccaaaucuuucagcaaauaucauuuucugucauuuuaaaauuuauuuauaauuuacuuauuuagauuuuaugugguucgagguaccacauguauugccaauagaagggauuugaucuccuggaaccugaaugacagaaguugugaguugccacauggguguuaggaaccugaccccagcccuugcaagcaucagcagugagugcucuuaacugcagagccaucucucugcucucccgccuucuuaaguuuaauuucaucauccauuuagaaucauugcuuacuguuagcuugccaucucuaugccuguuuuuaagucuuguacacgaguuguaacucauucauuauuuauauaacaaguauguacugacuggugucuguguccuguuucagaucccgcuacccgaguaacacacagaacuucauucguggacuuuguguuuuaauggcagaggcaaacgaaugaaugaauagauucuaugugucagguaggaauaggagagacagcaaagggagcucggggucuggccugcgaagacugagcauggaaaguagaggggaagguccagaagagguccuuuuccaaacaugacaucugaaaaaagccaaguaaagugccaggacaguacuaaaugauucucagauucucaccguugcuuggcagcgcagacacugcuugcccccaucuugugcucugggugugagcgcuccccacugagcccccauccuccugucagcuccgucccugcaucuggaaacugcuucugcagcuccagcgacucucccgugcucaggugaucuguauguugauauauaaauacagauaacgagauuuggagaaguauuucuuucacacagaaccacaguuguucuauuuaccuucccuguccuccuugcggcuguuacccugcagcaaaccaagaagacagaaaacuaaauuauucucuuaaagcugcauauguuuaugcuuuuauucuuugacaauuuccugcauguauguagugaacguuagccuuucccauccucccuuugucucgucugucucugucuccuuccucuccagcuuucaaccaggucucccucccuucuuuccagucuguguucauaauccacugaggagagucagaauugcuugcacaggcugggguggguguuauuuacaggaccaucaggcacuuaucaguggcuauaccacugaagaaagugaugccccugccucagcaaccagcaacuuccaguagacccucaaagaggcguggcaccucgccucucaagccccauggcugcauguauuuucauagugugaugaacuauaguuuuuccuguguuaauucaucauugacuauuugaaucauauaaaggguuuuguuacugcuaaaaauguucauaaacauccaauaagaugccucuuucuacacaugcuuuuauuuuuuaagauaaauucccagaugugauauugcugugucagaagauaugcgcaauuugauagugaauauuacuagaguacuuuggggaagguccugggcccugcaccugcucacagcacuagacgggaguguucuccucuccacagccucaccagcaccagauuuccuguuagccucuuaccucucuuccucuuuagcacauucuugucuugucuucccaggcucaguguauagguauucuagacacacagucuguaugccuauggagcugcugugcccacauggaacucuccagagcauuuccagcagccuuaagauccagaaaugcuuuacucaugcugaucccaacaaguaaauaagacaaagccugccacagaaggaaacaguuggguaaauacuugcuuugaaacucaacuacuuccuagugagggaaugucaauagugggaggggcugugcauguauaaggaugaggugauagagagauuucuguauuccugggucuauuugucugugaacuaaaacagcucaaaggaaagucuuuaaaauaaggugaaagaaaccuuuaagauguuugacugcuggucaccuugguuucuuuaucgguacggauaagcaccugcucaggacauuguagagcuguugccugaaacaccacacauucuuuuaaggaggcacuguugcacuuugcguuugaaggaaacguuugucuucaguugcacauuacugugaucuggacacacuuguauuugucacaucacugccaaccauuacucacacucuucugacccugagaucacacgucugcucgaggacuaugcucuggauuuauucugagauaauauugcugacucuuacagcacuaugugucuucacccuggugggaugugcacuguugcagagaggucaggcaggaagaaacgcuggcuuucgucuggcagccuguugguugcagccagauaaaaguauauucuuuuucagacugagagaauaaucaaaguccugcacuggccucaagcagccucuguuuuagaagcaucguguugaagugcucccuggacuggucagaagccuucagcuugcuucccauucuagcuagcaccaguguauuugggcucuugucuucgugccuccuagagggauauuagcagcugaacucagcuucucuuacaccgucaugaccucauaugggggaccuagauuuaggauucauacagaauacgacaaaggucaaguuuucuggucacacacaaacagaaaguuaauucagaccgagugaguagcaagccugugguccugcugacaguacuugcuaaugcugcguccgcgccauuaccacagcacgggucugaacauccaugcauucugacauggucccaaggagugcugccggguauaccuccaucuagugcagugucuuacuguacauacaaaguugacuccuuuuauagaaacaugaugguuuuauuauggaaaaccaaaauguuuaauauuucccuacugcuauuucucaacauguaaguauaaaauuaauuaauuaacuuuagcuuauaucauuuuuaaauguuugauuuuaaaaguugcuauuugauuuucauuuuaaaaagucauuaaaugaauuuuggcuuaggacagaauucccaacaguuucugagaugccauugugugcaguguguuuaguuagguaagguagacuucucagcgcugaugauuauaaaucaaaauaucagucaacccuggaaaacacugaagacgcuauacaucucacaguaucaacuuuucauccacgauuuaauuuauccuauaaaaacaaagaagcccaucucucucauuuguaugcacauuuccuuucauuuugcaggaauagugagauuauaaggauaccaaggaguugucaaaaauaaauguuuucaugaccuauuaccaguaaauguauucauguagauuuauaugccuguauacccaaauucuuguaaaacuuucucaguccauagugggucaugaguagaaaaaguagaagcagcccugcucuggagcaauggggaggugacugggaacaagcucuggaugacagagauuaugcucugggaccuggugagagugugaccuugggccaagagugacagacgggccauuuaacuauguaagaagaggaccagcagaaucugucuucuuacucugcucccuccucccuuucaguuuccuguuggugcucccugcuacaugacuuuuccuagacacccaagggcaggaaagccuguuacugcaucaugugaccuuugggggcaggggcaggcuggauguggggagggaaacaaauauucucaaggcccuguugauugcaaagguguuaauaauauggggcugguucaaaagccacaccucucccuucgggaguccugcuuucuaaauuaaaugcaaaggaagagcucccuguaaucuguauccaagcagagucugaaugccaagugaaaaauuaaaguacaagccugugugguagugugguagugugguagugugguggugguggugucaguguguauguggugugcaguggugaugaugguggugguggugguggugguggugguggugguggugucaguguguauguggugugcaauggugaugaugguggugguggugguggugguguguguguguggugggucugaugguaguauguguuugggggaggggguuacuaaugcacagugcacucuuggggagaaccagaacuuugauuuggcuguuguugggguccagggauugccucacaaaccacacaaacacugaucucagucagacagcuagagcaucccagagcugguggaccaaggcugugguccagauuuaggaacauaaccuugaguuaagauucuacagggauccaaauccacaagucugucugucagguuacuucaacaaucaagcuuuagggacagggauuuccguaagagcaugucuuuguuguacacuuauccugcucccauugguugagguauucaacuauggcagggaacuugccuugucuaacauucaugucuaccaggaugggaccugucuaggaugucacuuaccuaguugcaugcuucugccaaguagaaucuuaguucccaggaaggucuugggaucuuaaacucuacuaaaccaguauguaguaaauaauauuuuaaaauuccuggcuugggguuucuacuugccuuagaccauucauguucguggaugaaagauacacagccuuucuauuuuuaaacauaccuuacauagcccaauagcugggcagcugccugcucuccaugcuguuagaaucuccuuccuauccauaacgcaaguuauugcuuaccauguucuaucugggcugcucuuagcaucagccuagcagcuaucugggccacguucucuuggccccuagcccaugguagcucucucugcuucccucaagcccgccacacuuuaaccccaccuaugucuuuucuccccagcuauuggcugucggcaucuguauuuaacaaucagaauuaacugggugcaggauuccucagugucugauguguggacucucucgacuuuggggcaaacaauuuugggggccccaaauuagcauuagaauacaaacaacauuaggccaacccacuacaccacuacucaaaauggaagucuuauuccaaauauugucuuauguuaaugcaggugucucucuuauguuggaguccauccauccuaggccagcuuacaaaggcaaauaccauaaaaguuuauacacaggugcaggaagugcugcugggugguuguuuggguccaagcuuauuguagguaacuauacaaaacagcuccacugacuucuaucgugauugguuuccaagggcacagaacaaaacagaauauguaaccaaucuuggcauuaggaaguguaagcuagccagagaacaguuaucuaggccuuaacauuccauuucagccuuaauguuuuaccuagcuccuaacaguugucauggguuaccagauuauaggauugggaaugggggcaggguuauaugauagcauguauaauaacacauagcauguauaauaucauggaguacugugaguuaggguugaagggggacauuccuguaaauuuacagaaguagcaguaauuuaaagucauuuaggauuagccuauagagaaccacaaggagccaacuuugggcuuucuaaaccugcccuggcauucugcagcagcuuacaagggauccuguggugaaagggcccugccacaaaauaaauuugugaacuguguaauuccccaucguggauacacacggugugaaagcucugaacaguugcuaagaagaaaccacuuuuucuuuuaagcacuuggaaagagaaucuaccccacuccccccuguuuuauaauuuaaacagguuaaaaucuugugaaacugaucuucuauaagacguauuuugggaaauuacaguuaauggaaagccuuguaguucugggagcauugugaugugguucgagguaauuuaagaagaugauugugguggaucagcaugcgggcgggcgcccuguaagccgugauugguauagcagugaugcaggcacacaucgcucagcugaugagaaggggggucaucgcauuguaaaacaugguggcucuuggagggcguagggaaagaaaugaaagucugacuaauaauugauuggcuaugggugauaagagggaaggagaggcaggagggacagacaggaguuggugauaauagaaguuaugauuuuuggaaaaguuuuucauagcucaucaggaguaaaauauuuggaaaggcauuugggaagauggaguaggagcacacagacaagcacauaugccucccuuacagucagcugagagaguacagccacagggucugugugucagcgcccuuuucugaacugccuacaauucacaaacuagaaacugucucucccaagugucauccuuaacccagaaagcaagacggucauaccuaaaacuugucccucaaacuguuuuuccuucuuuauuuucacucauucauccuguucugguuuucaggacagugugagcccuuggguuuguacuccagcucacgugauaucgggaggaguggcuguacacaccuguaauccucauggagauggguugcagguucaaggucagccuagagaacuuaaaauguaaaaggguugguagucuuaaaugcaaaaggcccaguggcaguugauuaaccuggugugugggaagaagcccuggguuccauaucuagcagaguggggggaaaauuaaaaauaauaaaaauugcguauucugaccaaacaagauugacccccccaccguugggguuugugugcauaggugacuggaccccucuuucucuugugccugcaaacacaggcccuuuauuguccaccucucacccaaaggaaaguuuagcacaggccagccuaggacaaaguacagcuguguucuccuuauuuggaggaucacaaugacugccuaaaaacaaucuugauuucuguagcauggccuuaacucuucuugaaccaaaguuaugucccagaugagcugugugcuucagguugugugugauccacgugguaggagagcuggcuggaguuagugguuaggagaugcuguagcccaucugauugcuugucauuaaaucauaauuaacguaauuaaccucuaagagggagggaacgcagcagcucugugcuauuguuuuggggucaugucucuuaauuuauguucuguuuugucacuguggcuguuuaauaucauaugauguuguuaucugccuguuuuucuacauguuuuacuuguuaucuuguguguuuauuugcagggaaugaaguaaaguguagagcgucuuccuuauugcuaacuaaaugccaggcuuaaguucuaaagcccuauuucaaugucgcuuaggauaaauuuacugaaaauauucagugcuuauauuuucaguuuugaauuuauucauauugugacaguaauugguagaaaacuguuucucacagcugacaggccaaaaaagggggaaguaggggggcugaggacaaagcuaccacaugccagagugcuggggccggcucacauuuaagcaaguggcauuuguguuugcaugauuuaaaguacuauugaaaaagaagacauggaaaaagacuguauuuuaucaaccaucuuauagaacucaucuucuaaauccucauuuuuuaauggucugauauuuuauaaagcaaauaaaacaaauagauugugguucuuuagaaaacagcaggaagccaccagugcuguuauaugaauccuuugaaacucaacuaccucugccucccacaaaaauggccaagcuuccaguggagccuuagucaacgaugucaucauuuucuaaccaccacaguacugcucguuauuuagccucuagucugucagcuaguccagguuucgucaaaguguggcuuaagaauccucaaguguuggguguaguaguccaugccuuuaaucccaguaccugggaggcagaggcagguggauaucugugaguuugaggccagccugagucccaagauagccacagcuacauagugaaacccugucuuuaaaaaaauuaaaaaaggacccccuuugugcuuugacggugggcuuuuguuuuaaugaucauguggucauggcuguauuucuauuacuucugacaaagauaagcaagugugcccaguaagccacagcaucucauacauauuucaucaaggagaacaaauuuuguucugcugcucgcuggguguuuaggguaggaaggaauggaucacacauucacgcccgcaaguaaacuuggagauguaaaugguaguguaauggugcuuuggggguuugagagcacuguauagaaucauuugagauuccuuuugagauggugguuuauaaagcuccuauuugaauguuugaauaacuucuccgaauguuuacauccuggaacauguguguguuaaguuuacaugcugacgagacaagcauuucugugccugucccuccuccugcccagccagaagaguggguugaauaaaguucuccacagacuuauuucuaaggugaaaccucagaagacagccucaucauauaugaaacagggccauuucggccauaacuaagauguuccucauccagugucuuucucagaggggaagaaagacauagcugcucauacagggaagaaggccacaugaggauguggcagaauucgaggugaugcagcugcaaccacacaacguaaggaaaggucgcuaaaugggccaaccuaacuggaagagccauccuaacugggggagccauccuaacuggaagagccauccuaacugggggagccauucuaacugggggagccauccuaacugggggagccauccuaacuggaagagccauccuaacugggggagccauccuaacugggggagccauccuaacugggggagccauccuaacugggggagccauccuaacugggggagccauccuaacugggggagccauccuaacugggggagccauccuaacugggggagccauccuaacugggggagccauccuaacugggggagccauccuaacuggaagagccauccuaacuggaagagccauccuaacugggggagccauccuaacugggggagccauccuuugauagccccaucaaagcaaacaugccccagucuguaccuucauucuagacucguaucccccagaauggaaacaauggcuuccacugcaugagcugcccguaauuaguuccuugcuauggcaacucuaggaagccugaagaucucccuugaacuuuauuuuccuuuuauugauauuacuuuuugcuucauuccccguuuccuuuccuuccuccaaauccuccuauauaauccucucuuaacuuugcucucuucccaaauuaaguccucuguuuucauuguuacuacauguauuauguacaugcaugcacacacacacacauucccaaacauaaacugcucaguuuguauaauguuacacauauguauauuuuuaggacugaccaccuaguauugaauagccaaugagugccuccacccuggggaagacuauuucucccacaccuccgcauuccuuauuugacugugguuuucuguguacgguugcagcuucaugggccuuucuccauccacuuuggcaugucugcugcuguucuuguuuaucucauguucaggcagucauguggaugagacuuagggauguagcuucugauguucagagaagaccaaaucuuacaauccucuggcucuuacagucuuucugcccccuuuuccgcaauguucccugagcuuagauccuagauguaucuacugggacugguucuguuuuccuguuuacauuuauacguuauucuuaguccagcaaguguuaaguccugaaugggaaccaaugucauacucacucugucccuugaacacaugggucaguaucccucacauacuaauuagcauauaacuauguaaacauucauagguucuaagacccucagguauauucuuuaugaacaaauauguucacucuuauuaaaguccguguauuugaggaagauugcaguagaauaaauaacaagaauauccuauauggaaaaggguuucuauaguuagcaaagggagcuguuguuaucacucuuaugucucguccagaugacagauaggauccaaaguauguuuuaaagcagcaacugaaaucucuaaugggcuuucaaucugaauucuuaagggaauauugaauguucaauaauuuuauucuaauauuauagagcacagcugaaaauaacugcuuaacuaucaaaauucugucugaaguauaaaccacuuagagaaauuaacauuuuauuaaaaaagaguuaaaauguaguuuaaaguuuaguaaaaagacuuaaaaaauaauuuaaagagaaaaguuacagcugagugaauauguaaagguuuaaguucuuugaauauugguaauuuacuaauucuccaugugaaaaaugaucauugacugacuucaguuuaaacaggcucugucuuacuucuuccuccuugcucggaaguagcuuuaaaguguggcuuuggguaguucuuauaugaguguuggcguuuacuaguagagauacaggcaucuucuuggcagggcgguggguguuuuuaccugucuaacuguuuucaugaauuuuaacacacaaagauucucagcauucauuagucucugcacucuuuuuugaacgacucagggcagagauaguguucaacucaucaccuagaccaacacuggagcaaaacagugccagauuugaaacuuggcagcccugggugugggacucgcuaguugcagaaagcauugaccuaugaauauaagcagauguauuuuauccaagggggugaaugagcauugcguggagguguaagucuuuauauaucccugaacagacucuaaaauuaucuuccaguauggagaaaagugacguugucuuuacuuggucuuaacauauuuuucuucagacacauacauauucacugaucuuccgagagggcagggaagauuuuaaaggcaacuuauuuucuuuuuugcuuuucacaugcuauaaagcaaaauaaaccaaaauaaaguaauuuugauaaaaccuaugggaagccauaguaaaccauguauucuuauuaacaagcagcauuggccagggaguucacuagagauccagccacagucaaguugauuuaucacugauaggccagagccuuuuaaggaaaugcauuuguguauuugaacucaaaacugcuauucagaauauaugaacaaacaguaagugugcacgagugugcacacgccugugugugugugucugugugugagugugugugugugagugugugugugugaaugugucugugugugugugagugugugugugugugugugugugugugugugugugugugugcagagauggacccaguacacaggacugcauacagaagcuugccuucuuccuacauuacuaucacuauauccuauaaguguaaaucaugugaacagguuagucaaaaauaaagauagguugacagauagugauauuuauuaagaaaaaaguauguugaugacuucugcuuuaagacaauggagugauauucagugccaagaagaaaugagcuaucaaacuaugaaaaauaugggagcaaaaccuuuaaaacauuaaguagaaaagcaugcuguuuaccuccccugugacacuuuaggaaaugcaaaauuagggagcuaaugaauccguggaugguuaccagcucuuguggacagaggagggauggguagcaacaugggagauucuugggugaaguuuucucugauaguaagugagacggguaaugaugagcccauagaaugugcacagcacacuugaacuucugugcuggugaucugugcaagcgugcagcugggaaggggcacuggcagguggggaguggucugcauaagugggaacuagggaacgcaucucugauguaccugcugcucaguggugcucugagcuuaaacugcucuaaacgauaacacaggaaaugauuguauuugaggcuaccguagauuagaaauauguaaggcuuccguuguauggaagacaucuuugguagguguugcugcucuaccacaaaaaguuuaaagggaaagucagagcuuucugaguauguaugauuauaucacaaaauguccuugauuuuguuaaaggauucuguguccuaugucuuugagccacagccuuccaaucuguaaauuaagcuugugguucuuguauguacauguagguccuaauuacauaccucaguguuugcuucccucuggguguugucaguuauauuagcguaugcucuacagucuagacucacacauaucagcagaugcuguaguuuggugugauuagcaguuuucuuagcuuuuguaguuguauuaacguuacccagcuacuuacaacuaugacauuuggaucuucugcucugccacgguaagcagauauuccuccugaagcaacauagcagucguguuuaauuccacgagagugucucuguuuucccucuuccuacaguagaaacuacucagcagugugaaguugaaauauucuuccugugccuuuccuggccugaaccccggggccuuguugcaagcaucgcuuguucgccagugucuguuacugagcucugacugaccccacuaagccaccaaagcagagaaaccgaggugcagagcuuagaggugccucugucagggagacgucgccaacaggcucuaaugguaacucagguuggcucauuaggugaaucaugcucaguacagaggcuuaggcucagucacagcucaugggguaugucucuugguuugcuucuuuggaagugauguaugguuuguagugguuugucuuuuccugaauuuuaaucacuuuaauaugauaacgcuuuguggacuucagugguuuacaucugcauauuuuuacaacuaugauuuuagaugauaauuuuuucaaacuguguuucacuuuaauacuuaaccuaauucauuacuuacuguaauuagacaaauaguaugaaguagaaguauuucauauaaacaucaaaaaagucugccacaauccuugcccugcuuccuuaaacaguuugaaaucugugacauguuuauaucagggugugcgguuaucccaugguggcaguguauuauuuuuacuccuccuucagccuaggauagagugccagugaacucuauaaaucaucuguaauaguuuguggcauaacuaccaguguauaagucuuauuguccacucaagugucauuaugcgguguauggcuguagaucguaugguagccauugggaaaauagcauuguucaagacuuaaauguuagaccagaaaccauaauaguccuagaguaagaagggaggaaggccuauggccuuaacagcagugcacugacucggacacaguuuacaaaggugggauuaggucagguuagaaagcuucugugcaggaaauuaagcggucaucagaaugaugacauaacugccacggggaagaaaauguuugcuaagcacaucuguccccugcugugaugaagcacccgacgaugacagcagugugcaucaggaaagguuuguuuuagagcaaagucucaugggcuuccuguuauaguugggaggcuucauugcuuuaaaccuggggucaggcaguguagagaguguggaguguuuggacugaagcagcuuaugucugauaccugggaagugagaugggcagcaagcauccacgcggagguagugucacccuaaagcuaagccccgaaugaaccuacugccuccaaguccugccuccuaagcauuccaugcccuccugauaauguuacagcucugagcagccaggguaggagauugcagaccuaaacuaagcaccacacaccucaggagccuccccuagagcccggaggugguguggcuccgaaugcacagagcacaucuguucccagucuuccucauucccugccucccucuccaggggagggggucguugauccuaaagucauuagcaguugucaggcaaaaaacgguccuguacuaagagcugcuaaggccgcuccagccuuugguagcaucagacuuaaugcucacuucuucccuucagcaauggaucuuauuaacugauggaucuuauucuacaaggucaaaaucugcuccaugaagccaggcguggugacgcacgccuuuaaucucagcacguggaaggcagaggcagauggauuucugcauucgaggccagccuggucuacaaaaugaguuccaggacagccagggucauacagagaaacccugucucgaaaaaaaaaaaaaaaucuguucuaugaggguccaaaaucuguuccauguugcuauucucccacccuauggcaagcacugacagaaaaaaaaaauacaaagcuaacauguauaauauuuaccaaguauauuacauuauucuuagacauuaguagaauccuaugauuacuuuauuuuaagcccuauuuuauagauaagccaggacagacaaagucacauaguacuaaagaagauaggcugauaaggacaauauuuagagaagacagaacacuggguaacagaagaaugcaguacugucuaaguaaaacuuucuaaacaaacgugcacggugagcucgcagaguugcaguuuuagucauagagauaaaagguaaaguagugggcggugucgucuggugugucagugacacagcucucaggggucccugucaaauagcagcgcaucuuaugcacuguuucagcagagccugcagugaccugugugaaggcucacagcaaggcaagcauggacguguguccagugaugcugugcccgcuccuuuuuacauuggauugcacucuggaagacgggcugcuucucuaugucuuaauacaaguuccuaaccuacaaauuaguuaauucuaaaaguucuauguaagcagcuuauuuaaauucaacacauuuuccauagaaauuguguuauaaauuguaguucaguuuucagaauaauucacagaucucauuucaucuauaauuuaucugaauuacaacauauuaauaaaaacauauugauuagcagugaagccaagagagaugcaauaacucuucacaucuuuuaagaagaguaaagaauagauaugauaaauguuuuuccagguggauuugacucagcuauaauagucaaaagcugaaucaaaagaaagcaaaaguuaugugggcauuucuccugggagcuaaggacaugggugcugaaauuuuaaauuuuucagucucucugccagucagcagccagugauaccaucacagaauggugcaaagcaaagggaggguugaggauaggugugcaggggauuuagucucacagguuggggaaacggaggcaggaagagaaggaggcagugugagccugaguguguggacaguuucuagcacgggaauggcuauaccaaagcacaguuucuuaaauccauuugaaauucaguguaauucucaacacuaucccucaaagaugaagggcuuuugaacauaguuuuccaaaauuacaaaccugaagauuguuguaagaauuaagguagcaaaauaacaccuaacagaaccauagguauaccugucacuguaaacagcccugcccccuccagcucagucagguaacagugaguaauaacccacacgaacauaguaucagccgaacugcaaagaaguagcagaagucgggaagggcccucuuuacuacugagcauagaggaugcuuuaguccauccuuaccuguugucuuggugaucaaccgauugugcaucccaccagcacacaggccccguuucugagaucccauccaucccggaauggcagcccuuccucugugacucuagucuuuaucuucuuguguauuucuggcuuugguuuuauuuguuuguuguuuuuguuuguuguuuguuuguuuuugagaccauucucacuguguagcagaggcuaguccuguucaguagauaacuaucauauuccauuagaugguuaugugcucuuuguuacaucagagucgauuuccauuuacuaaugauaaauacugcuucguguugagcuagauuaaguagauuaaugaaggguauuagcaauuucauggauugauaaauauaauuuuuuuaaauuaagaugaauguaccaauaaauguacucuguuuuccuuaaacuguuuauauuuaagaacugucgucuaugcugugaacuagcaacaguacugcagccauugacucuuuuauggccugugauaaaugaccaaauccuugauugcuaugaacauuuuugagucuagaaaucaauuucuaaaaaauuagcuugagucuagaaauaacagcaauauuuauuauauuuuaaagacaaagcaaagucugggcuaagcuuuacaaacauaauaauuucaaaauucucuacacuguaguaauugcuacucuucuuuacauugaaaauaaguuuuucauccaauauguucugauuucuccucccccagcuccucccagauccucccaauuuucccgaccaccuaacuccauggccuucuuucucuuucucuggaaaacaaacaggcaaagaaaacaaaucagaauucaaaaagaaagaaaaagcacaagaaauacacagugaaagauaaaaacacaaaaucugaaacauaauauacaagcaaaagaaucauaagacaaaaaauaauaaauuaaaaaaaaaaaacccacagcccaaacaaagcaaaagaugaccaagucuucagaaguagcguugaguucauucugucauggcccucuacugcuggcacaaagucuaccuucaaguguggccacuaucccaagucacauucaauggagaagaguaauuucugcuugggaauggauauggauuagagauagcuucuuuguuaaaguaggagcucaggaauuggguucacccaucugagagcugggucccgucaggcuugaaccugggcaggcccuguggaugcugucaugguccugugaguucccaugccggccagccuccugaguggaagacaguguuuccuugaugacauccaucaccuuuagugaaacuaaguguuuuaaagccucucgcucucugcacauuguccaguugugguucucuguugauucccauccucagcaaaaagaggcaucucucuuuaauuauuucccauuuucucuuuuuacuuccuuaacguuuacaaguguuguaacuaguaauauuugcugccauuuuuauuaacucugccuguuucucauuuuacuucuauuagcagucagucccaaagcguucagucaggugugcagcaugauggucggauacuuaauucuacucauuguauuucacuguaagcguuugcugaguuuugagaugggguaugagauugcaauuugauuccuuuagccagcaaguuuuguuuuagaacaaagcuuuuccaucacaaucacguauuuuccuuuuauucgaagucuuugaugggaagggcagcacacuguuuguuuguucuugagacaguauuuuaaucauuucucccuuccauauguugcuucccccacccuaccccccaccacucuccuccaaauucauggccuuuuucaucaguuguuauuguaggcauauauguguugguauauacauauauauuccaaagucuaaccuauugcauccauauaaugcuuucuguguauauguuuucagggaugacuguuuggcccuggacaaucuuugugcuuuucucaggggaggaccaccuguccugcucccaccuuuacuguccuuuguguaggguggaguccccagggcccccuuuccgcccccauccaguuugguauauuuguuguguucuccuuguuaagcccguggucagaugguuuaccaggagacacagucuccuagaagccugacugcuccucuggcucucagucuccuccccucuucugcaguguucccugagcacacagaaagaacaccugaguguuggcguuuuguagaugugucuguugggacugggcucccuucaucugguauagagagacauuuccuugaugaggagaggaucuucggguguggggacaaguguuuacagauuguuguuagggaucaugcuggcucaguaaauuaucaguuggagauucuccuccaguuaccaugccuucacuagcacuggguagguuucauuaccaggcaugguuuuccucuagagagcugugguuaccaucaagguaugugggugguguauguauucaaucccagcacacaggagauagaagcaagcagaucucagugaguuucaggccauccagggcuggaguguguguguguguguguguguaaaaaugugauuuccuuaugauaugucaggugauuuccuuaugauaugucauaugaucuauuuaauuuggcuuaaaaaauacgaauccuucacuuccuuccuuuuguauaagauaaaugaacucauaauucaugugcauuaauuccagauuuaccuaauuuuaguuucuugugguauuuuacucuguucaaauuuuugguuauaaaugaauuuuauauguuuuacaaagaaguauagaacauuuuaagugaacagaauacuuucaacucuuggaccucaagcaaaacuuagaucuucugcucugcagagugaauugccaugauggcgucaucuggauuuuuccuucugguggaggcccaugagcuuuuucagaaaucguuugcagcuuaggaaaaauaagugcuucuuaaaaacacacuauuaaauaucuguucugcagaguaaugagaaagaaguaaaugacguaaaauacuagauauuucuaagauuuauacgcuucauuugggagcuuaucagaaaaccugcuugauguuuuauuguaaaucuucauaagugaguaguuuagacuacccacuguguuugcuguguaaaagauguuguucggacuucaaggcugguguguguguguguguguguguguguguguguauguauguaugugugagugugacugugugagaguguguugugugaguaugugugugugugugagugugugaguguguguguguguguguguguguagguagguagguagugagguuggagugggccucacccauucuaggcaaguguucaauggcugucuuacauucucagcuacuuuuuagagcuuuaaaauuuuguuugaauauaauaauauuuugauuuuuuaucagcaguaaacaagaaaguuuguguaggaaauuuguaguaaguggcuauauuuuuuucuuaaauuauuauauccuucauauaugguuccagacauacauuuuauuacagauuuuacuuacugcuuuuuuaaaaauauuaaugaauucaagaaaaaaauucauccuuuuucagucaagaaaagaacacagaugugcuauuagcuggucccaaagcauuucacugcuacagcaagcagguuacuuaaggcuuccugucucuuucugcacacugugugaggcccuucagcuuuugcagcccaagagguuaaaccauauuauaacaggcaucucagaauagccaagcagugugguauaauuucugauuuuuuuucccuaccaugaaaugaccugaggagaucuuccuugugaaggaagacccauaaauauugggaaccuacuacaguuucagcucagccaccaaacucauugguggucugaagaacucaccaucuucaccugucaggccuauugaauuguuuuuaaaaaugucuuaccuacugagaccugugagccuuccaagcucacauaaauaaauguguguagaauaugucagauuauacaggcaucagguucucaagcaggaacgcuccuucuacucacuacaagaaaacgauagcuuaugcuaacuguuaauaaauacuuguuuuuaacgggauauuugcaaugauucuacauacaaauguguaaauacuaauuuaaaaaucuuaaauagaccacacuuaucuuuagaaauaagaaaagugcuucccauauguaacaguugugcagcugggucuucaugugggacccuuaaagcaggagcagggcugucucugaccacacugccugucuuuggauuccugucccuaacuaaacugccucgacucaccucaguagaagaugugccuagucuuauugcaccuugcuaugccaaggcugguugguacccaugggagaccucuucuuuucugaggauuguggugggggggggggaggggggguaugagagggaggaaccaggaagagaagggaccaggaagagggagggacagggaagggagcugccaucaggauguaaggugaauaaauaacuuaauuaauaaaagugcuuccauuaaaaugucugcuaucuuucuuuacugauugugucucagaauacauuaaucacucagccccuuucucaucuguaaaagguuauuuuuaagaugagauguaauacgugggagacaguuaaccgguccguggccguccaucuccuaaugaacagaugccgcaucugaguaacuucagucaacuucuucucuaagucauuuguaacaugguuuucagucugaguuccuauuuugguucuuauaauugagauucguuuuacaauauaauguuucagaguaucagaauuuaaaaguucaacucuaacaucuguaguugggguucuggacucuucaguagguuuccuuucauauacauaucauaugcacugauguuccuaagccuccuuuuuauaugcagaauucaaucuuuuauaguuaaaacuaacagcuggcugcucugccagaggccccugugauaaaaggccaaaagucugugagacuuuaaagaucuuauuuuggcuauccucccuacugcagaacuaugucucucagccaggcacuuguguuuccaagggggagcuccucagaccugucaccucucucggcccaauugcucuuugcaacccagccuugccugcagcugaugcucagcucccaugccgacuggcuaaggagugcugggcugaguaaacaggggaaaccccucaccaugcuucucucugucaugucaucugucuuucuccuccuacccacaagccaggcuugcacacuguaguccaggauaacuggaacuuagcucuggucuaagaaagagaaauguauggguuguuuuuuguugauguuguugaauuugacacuaacuagggucaucugagaagaggcaaucucaacuggaaacaggaaacgccucagguugaccuauaagcaagacugugaagcauuuucuugauuagugauugaugugggaggguccagcccacuguggguggugccagcccuaagcuggugcuucuagguuuuaucaggaaauaaacugaaaaagcugugggagcaagccagugagcaguguccguucacagucucugcuucuauuuuuugcuuccagguuccugcauuguguuccaauccugaugucccugauguaagcuguaagaugaaauaagccacuuaagucgcuuuuggucauagucuucuucacagaaauaccuuuggaguucugaaucucugaaacauaaggauuaaagacuacuccacugucgcccuggccugugagggugaauaaagaaaggagugcgggugccaggaaaggugccugggucugcucucuuguucuuuggggccaguggcaucucuugccacaagccuagucuuguucgccugcaggguaacugaggcugcaggaagcucuggcguucaucagcguagauucacuauagcaguuuccguguggcaggcugguacauuugugugacacacuuuaacuccaguccuucuuccauguccucugcuucccacagggcucuuuccucuuuccagaccuucaucuucguuacuuuaaaaucuagacuccgagccaggugugguggcgcacaccuuuaaucccagcacuugggaggcagaagcaggcggauuucugaguucgaggccagccuggucuacagagugaguuccaggacagccagggcuacacagagaaacccugucucgaaagacagaacaaagaaacaaaacucuagacuccggauguccaugagcacauugugugagcgugcacugagcacaagaauggaagccucuccuggcuccugaccacucaguucucucuggugguaaaccagagcucuguuucugaagcagcauccaggcagcuuuuagcuguacaagccaguauggaggaagauuggguggguaggcagauggcauuaaugguagcagccaggucagacugcugugagugcuguuuguucucugcuuguaaccuacuacaacuucucacacacguagaacaagaccucucgccaucuguguccaaucuugcacuucaguguuuucccguuucuuucuuucuuucuuuuuuuuuuuuuuuuuuuuuuuuuuuuugguacaggguuucucuguguagcccuggcuguccuggaacucaacuuuguagaccaugcuggccuagaacucagaaauccuccugucucugccucccaagugcugggauuaaaggcguaagccaccaccgcccagcguguuuuccuuuuuuaaacagaccugagguagaacaaagaaugggcacagcauaaccucuccguaguuuuuaguugagggauauauuaguagugccuaagccuuugccauuauaaacagcauuggagugaauagcucuauggaugucuuuucaaacaagugagaauauuagauaaaaaacguccaggauugcuggucagguugagccugcauuuguaauuuugacaacuguuuccaaacuguuuuucuauaaaagucucccaguuucauccucuaugccuuuguccuuauuuucccuggauuaucuguccauguccucgggauaguuuucugguugcugcuggucuuuucuuaaugacucauaggagcucuuuauauauuuaagaaugacuguguuaauaauacauaugcacacaaguauucauuacagccuuagcugcuguggcaaaguacugaaaaugacucaaguggccaagccucaucacucucgugaauacgcuggggaguagucugaaguuccauguguaauauaccuccauacggaauuguaaugcucacgugaaaacccaguuuucaaauugagccgucuauauuaaacauagauacguuuuccuugucaucguuccccaaacacggcacaaguaauauaaaucaggguggguagauguggcaucuggguaugaauggcugaugaacucaugaacccacagcaacuauaguuuccugccucagacacauacaggauuauguguguccaucaugagugaggagcugcuggcaauuaguauuuacucggggagguagguagcacacacacucacacacacacagccagagauaaauacaaccuacugaguccauuguuguuugcgugcacaugguuucaaggcugagcacugcauuggacaaucaguaagggggcucucugucuccaggcaggacccaugaaguaucugcuucuacaugaacacguccacugacguugcccucguucugguccugcuuacacagccauuucucggagaaauuguuucacagucuuguguuugaaugcuugguucccacuugguggacugguuugggaaggauuaagagaugaggccauguuggaagaggugcuugccuuggucaugguguuuugucacggcaacugaaaaguaacuaagacacuguuauaggcucuacagucuuucaccccgucuucugccuguucccugagccacagacacaggaacugugaugcagaugugucccagagagcagagcucaccgugaaauguccucugcauuguauccaguugugaucuucugugauggucuccauuugcugcagagagaggcuucuuugauggaggugguagcuacccauauccagggaaggaggcucacgcacaguguuggcacauggugggucuggaccucggcuuguggguuugauugcuaauucuuaaagcagcagguuuuauuuugaucuucacauuuaaaaaaacaacagagaaaaaaaguuagcaugcuuacauaggagcuuucuuuucaccagagugucaaaacauacucugaagcuggguagcggaguuuuuuuuaagguagggaaaaugacaugagaauuuucauauuuccugugccagaaaacuucuguaugaauauacccuugucagcacauguaugugcaugucugucugugugucuauauauagucuucaggugauggaauuuuagaugguuuuccuuucuaauaauugccugcacuuuuaaaaaaauugguagugaauguuuaguaaguguugaaugguuagcaggauuacugccuuaacugauuuaaggaugguuucuacauuucuaaaauaugcuaguaaaggguggugcuuuucauucuuaauuguuuagagauaguaguuacuuuuguuuguagcuuagcccuuauauucuucuagcugaaaccugugugucuacagaugaacauuucuaaauacacuaaaauucaguggcaaagguuggcccuggaagaccgcuggcacuucaccuaaaauuaacaaacugaguuccuguaggccucagugucuuuguguauaagcugaggugaccggugggugacucauggagcugugacauugacaggaaagagcuggagcuuugggauggcagaggaaaggggaggcaguguacuucaggauauaggugugacaaggacuuuguaaagacgagguacaguggcaaccccaacaguugacaaaugggauuaggugaaaguaaacagacucauuauagcaaacaaaccaaccagcccagcgaaggagccaaccagccgagcaaagggcagcuugcaggugggaaaauaaccaccaguuggguuuuaacagcagacuaauauccagaauauauaaagaacugaaaagauuaagacgcuaaauacagaucgucaagucaguacauagguuagugaucugaacugagcguuauagaaagaggagcuacaagaacacuauuugaagaaguuuaauauccuuaacugauaggacugaaauucaacucuuucaucuaacaucucacccgucagaauaacugccaucaagaaaacacggggcaggcagaaaugcuggcaagauguggggaaagaggaaaccuuauaguugcuaaugggagugucaagugcuguggccaagugggguuuggucaagaacuuaaaauagcgcuacuccaugauggcagaguucuccugaagucagcacaccacagccgcacucacaccucuguguuuaccgccucgcugggaggaguagccaagaaaggggagguagcccuggguaucaacccacccugccuggcaccuccagucccugggugggggcucggugaggggggacuaggaagagggaggcugcaauuggucuguaaagugaguaaaguaguuaauggggaaaacaaaugaguagggaagaaauggcaccagccucguuaccaaucccuaggggaacugacaccuacauggauccagcagacgcuuguucagcuauaacagcagcuggacauagcauuuacagaaaaaaguacacaacuagagauuguguaagcaaaauaagguacacucggacaaaucccacauucuuucucccucccuccucccucucccucucucucucucucucucucucucucucucucucucucucucucucucucgugugugugugugugugugugugugugugugugugugugugugugcaaaauaaaagaggagcaaccaugagaagggaagaagagaaauugaggaagggaauucggugagaagggaagaguauggggguuggggguagaguauguauaacaugagagcagaaguggggacgauauuggggaaaacaagggaccagccugagggaagcaggaagggaaggagcgguuaugaaggagauggaugagaacaaagggcugguguuggcaggaugagcagugagcuggcagagagcaggagagcuggcccugcuccuugcuggccacagcaucgggugagcuagcaggcagcacuacagagcuuauuccggcgaugcugaugcaggagaguuggcuggcugaccagcucagcuaccgcccaggcacagauccaggacuuugaguuggcccaacccagcaucuacuccaucuaugaacugcuagagcucaugaaggggcagguccuguagauccaaugcuccaggaucuccaugacacagggcagcaacgggauaucugagaggagucccagugaggacccaguauugauaguguagcagaagccagaggccucacagcagaccaaugacucauugcaaugagcauuugcaaguaaagauauguggcaaaagaguacacuguagggcacacagugacagacuacagcuuccacaaagagaauuuuucuuuucuuuuggagaggagguugaaagagcgaucaaauaaaagguuaaauuuuuuaagaaggaagaagaaaccauaacaaagaacagaggacugaauuuaguccaguugguagagaagagguagaagcaagaggaucacuaguucaaguacaggguuauccuuggcugcauagugauuuugaggccagcuggggauacauaagacucuuccucaaaaaacagaaaaggccacugaaauaggucagcuuggaaagcacuugccugaaaggauccacauggugacaaaaucaugacgguguguguaugcauguauguguauguauguauguauguguauauguauauauauacacauguguguguguaugugcuauaaugaaacccaauacuuguaugcuaauuuuaaaaaguaaaccuuauucaaugacuagucuaugguaaacauaccauaaauguuaguuuuauauucucuuuuaaaaccuggucacauuaggacucugaccucuuuagacuggagagugaguacagugaauacagagcauugacauugaaucagacguugccuguucuguucacagaagccccacccugauuauaauggcuccugugcccuccguguuagugaguugauuagacaggcuacuguguucugaacugugguuacccaaggagguccuagauaacucuucggacuuacaacgucuguccauuuuaauguguuuaacguguauaggaacuccaaauccaacaagcacauggauggggagccuuuagaauuggcaaaagugacucuaaggaaaggucaacucaagucccuggguggaggaccauuaauuagaauaguauacaguauggcaaaauauggcaaagauaauauucaauggcaggguuggaacucaaaaccagagaaaagaacacgcggaauaacuaggauuaggacuuucugcauucucauucucaucccagggucccccaacccaucccaggcacuccggagaacacggaauuauuauugcaccugaugagcuuuuguaucuacacuaugccaccucggaucucaccccucccuggcuccucccuccuucuuucuaguuucuuuuaaaugggcuccacaguuuucuagaugaaggaauaggaacuuguuauugucccaguggcaaugagcuuuaaugcuuuuuauguuuggaaacuuuacuguugucuccugauucucacugacgacugcagucgcccugaguucaagcuuuuguccugccucuuucaauggagccuaagauugucugcucuuaacuacagcuguguauugcuucuuuuaauggucauugaauaaacuaguuuuugcuguuguauugggacauauuaggucuaaacauggaugucuuauuggguauuauuggcugcuuuuuacuauaaauagggugucuucacagauacugucugaaaacauuuauuaguaaauguagcuuguguuauaaauucuuauucaaugagaaacauaaauuucauuccuaauucauaaaaaucacacaaguaagauauauucauaagaguggauuuuuguagcaguuuauucuggaagagaaagugugagaccccagcuuaaagcauuucucccugaaaggcagagccccuaaaacauuuccccaaacuuguuuucccugaucuuuaaaaauacagguagaaagaagcucuuuguucucuauagccagcaaaaagccuuuuuguuucuauacuauacaaccagagaugccugccuuccugugcggaggacacagagauaaaaauucagaaagaacucacuacccacuccugccuuguaaauuucaccaaggacacccggaagagaagaacucuuuccaacuccucccaacuccucccaacuccucagcuagcuguuaaaagcccccuacugucaggggaucauccuuagcuagcugauaauaaaaccucuugcagcuugcaucaggugugguuuucucucagaacguuggaguguuggccagcucaucccuggacuugagcggaggcccagcaugggggggggggggugucuuacaaaagcaucuaauuaccaauaauuuauacgaacuaauaguuuuauuuaauacuuccaaaauagauauguuuuaaguaaaucuuugucaucuauucccaaauaaggguuuauuccacaauugcaaggagcuaaaguagcucauauggagcugaagugaugacuugucaaucaagagcacgcacugcgguuuggaucccagaaccuacgucauuaaccauccauugucccacacgugccaguaucucuaacccugaagggggcagagauggcugagcaccucugaggcuuucuggcuuccagccuagccagagaaccugacaagcuccauguuagggagugacucugcacauacauccccacacagugcauuuaugugcagacaaauaaaguaaaaaauaaagaaaaauaaggaugcucauuacuuucuuugucuucccauucauaugcaaguaacugugacuuguauuuucaaauuauaugaggacuuuacaugaaauuuauagaugggaaaaacaggaaugaaaggcuaacuuuuguguacagcuaaaccuauagcaaguaguggugcuccugggaauucagacuucugucuuccuccugugcuagacuuacugagguccacuuguauuuuggaugaugguuucccuuuauuuagcuuuguuacuaaaagaacauacuucuaucuuagcauuaaauaaugacuacaugaagacauaacaugcugauccucaaaauguuuuaguaagugaugugcaagcagaguuuauaguaagcauuggauuugugugcaucuugggaccuuugcaguggcugagggggugacacaccugccacacagcuugaggaccugaguguggguugcagcacuggagggaaaccccaguuguggucgcacaucuguaauuccaguucugagaagacauggucagccagacucaccaaauacaggagcuccaacaaaauaaacagacaagcagaggguguguagugguggcgacgcagcugagcguggccuccucagucaugcccuguguggucuuuucaaagcguuauugaauuuggucacgcaacucuggauccgcugugggauccagaaaagggauuugucuggagcuuuucuccauguuucucuuuccuuucuguacuuccacaucuacacugccaccagcccacuucagcuguggacacagcucaagaaaggaaacuguagagcaaaaauucuaaacucagggucucaccuagcuggcuuaucugagacucaccaguuuuugucccuugucccuauauucccuugagguagugacccagauuggugacagaauccaagucugagagguaggagcacagaauccaaccccgugugcugugggaacagaguggcagcaaggaauugggucuccuacuaguaagggcuguggauaugggcagucacagcagcuguuggcacugauaauauauacgcugugaguuuuaggagucacacauuucauuauuauuuuuuauuaguuauuaguguccuacaggauuaauugguuacucucuuuaaauagaaucuagauuuguucuaagaaaauuaauuuugcuucaaugcuagaaaguauaaaauuugcaguaguuuaaaaacuaccuuucccaccauauaacucuaagcaaaauucauuauuuuuucuaaaaauuuaauaauuuugccauauaaugugguaugcaauaaucaaaauaaacuagcccaucauagcuauaguagugcaggcucaugucaaauguucguuugauuuuacagggcagacuauucgagagaaaaggauuguagaagcagcgaacagaaaagagguagacuaugaagcaggagacaucccaaccgagugggaagguaagugucugccuccaggaggaugcugggaaaggcaagccacuuaaggcgaucugggaacuuagcaagagugcacagaauuacuccuccauggagacauuuuuacagcuuuguuuccggaacauugcauuguuuugaaaucuguaaaaguugugaagcuccagcaggacuuggguuggggugaaacaggcagaucaagcuaacccuaacccuaacccuaacccuguaaagucaagggagucacccaugccuugcccugccccugcccucccacccgcacccacacccaccccuacacccgccccugcacagccuccaggcuggacuucuuuuuccaggauucacuagucccugaacuuggggaaauauuuuauuuuaggucuccauuuucugucuuauaacuagaggagaacacuuagcccaggugcuguuuuggaguauuucucugacuuacaaagacaauguuaacugacuuccuucuuaaaacaaggguggcuaacauaggagaauuggaacacacaguggauuucaugcuagucuggcaugaggcccugccucaaaaacaguauuuuucauauuaaagaucagguagucaaaguacaacagguugucucuccuugauucuggaacauuaauauauagacuugauagcuucuaaguagacaucuucauuuuagaauccgagcuucucacucccaaaaggacgaucuaccaagaagaaaacuggaagcagccuccuaugagaaguacggagagagacccaguauuccccaggcuugcaacuuucugguucccagcagagcuucuuucuaaguucuugguaggaccuccuaagcuuaccaguuuccagcaugaugccuggcaccuaggaagugcucaguaaauaauuuacugaaagcauggagucuagcuugaguuagccucugcuacuuacaaugagaagaacccuaaccaagggcuagagacauggcugaauauuuagagugcuugcauacacaagcgucagaggcugagaugccacaguggaaagcaaagugucgcagcuugugccccuguaacuccagugcugacugcaguggagacaagacgguugcuggaguuugcugccgaguagcgagucccacauucagugagagacucugucuaucucaggagaauaaagcaauugagugauagaguccccagcauccuccucuggugauaaguacacagaagcuggugcaugcacacggcacacacagucacuuagacaccaaaaaugaaagacucaacugacauagccagcaucugucuucuacuuugcucagcacuagccaaguaucaccugugguaggcacuuucucuacagucaccaucacgugugaucguaaugacaaugagccggacagucuagacagacacauguuuaaucugcagaguuuccaggguccaguaaguguagaucaguugcugugauggugcaguugcauacauacagagcccuugcuucuuuguggucagaacauaauagcuucugugugguagccacaggcaugaugguccacuguuggcagcaugggccuguaaauaccguuucagccguaccaucguauccaugucugcucacuggccgcggggaugcuaugaccaugaaagaaagagccaacaugagggcagagagcagagccuguuuucuucugaaaugcagucuugaaguuggcgacuguagaaggagcagucgagcuucauuuucccagacuguccacauuugcaaaucgccacuagugcuugugccuucuuaggagccuauuuugucauuuucccaauaauaguauagaauuaaaauguuuagcgaaauaaauuaaguuauaaauaaacaaauagguaauggcucauuuuucagccucugcggcuuucagagaaugagaaugaaguuuuaaugcuucuuaugccucuguccugaucugguaauucagcacgcuauccccaugggcauagucucuaaagacaugcaucagccaagugccgaaacacaaacacuuuuacaguggcacacaucaauuaaauauggaagauacacacgcuuugccaugaaaauauuaacaaacauauaccacacuacgugcggggaacaggaagcugucgggguagcugauuucagcaccaaaugcaccuguuuuuaauccuggugaauaaaaguuggcaucuuuaauugaucauauuaaaguacucaugccuaccaguugccugcuaucauauaauaagauuaaguguggcuuucauucuuuuaucuaugaaacuguuuacuuccuagaacauacauucuggagugggagaaagauaaaucaggcauuaaacuacauaauaugccaauaaccauaggaaaugaagcaggcaagggacaaagagauacuugaaagguuuuacaguuuuaguuagcauucuuucuuagaagguagguaacucgcucucucucucucucucucucucuugaucaaagaucugacccuccccauagccagagaggggcauugcuaaagcaagcacagagacccugaagcaaagccuugcucuggugacuaaggauuaucauggaagcuggaauggagcguccagaaagcccugggagaugaguuucgagcccuuaggguugccugauguggugggcagcguugugagcuguuguuguaggaagucuuccugccuucacuuccagggagacugaaagccacugagaacuuugagggguacccacaugcugagugaguuaaaaggauuauucgggcugcagaauuggacaaugucaucaagacaggagacagcguguuuucugauacccaaggcaaagaauaaguaugacauagaccagauuagccguaggaauggaaugaaguagaugcauucugaaauaguuuaaaaguagaacuaaugggguugcugacacauuggacacagacugugagaagagagguuaugacgccugggccuggucucccccagagaaaaugaggugucuguuaacagcugcagggaaccauggguuaggaggaaaguaaaagcaguuuagaaaacgguaagcuugaggugcccauuuaacauccaguuagaaaugguaaauugugagucaagucagggagaaugcgugguuagaaauaaaaauguagauuacaccaaacagacgcugccuaagccugugaggccagaugaagccacacaggaaauaagaaggugaaaggcugaagccugugccccucgaguuuagaaccauggagacgagcagggugacaagaaaauuaggagaaaaauuuacaauuucauauccaaaaggcagucaucaucaguaaggaggucgugaucagcaggugucacaugagaccugaagauugaccguuuaccuuaagauuagacagagauuccccaccccccaaaaacauucaguggacugaugagccugagagaaaagagaguuugauaagcagagauaguguuuuaaggaguuuguaaggaaagugaugagaccucgagaggcgggaaggauuuuauguuggcugucuuggagacaaggagaaaugagagaauccaucaguacugauggggaagaccuagucucuaagaaagcucuuaucaguugaaagccccugagaaggugcacaggcgcugguccacggguggaagacagugggaauuccaucaguaggaaucuuggcaaagccgaugucgguggaugagacagugagagcuuacgugaacuccugguuucuccugcuaagucacggugcuuaaaaccuccccaaagcuaacagcugcuacaagauuugaacucggaucaucugaccucagagucugugacuuuugguuuuuaguugcugguccaggguugaacccagggccuugggcaugcaaggccagggcagcacugccaagcugagccccagcucuuucacucaauaugcuguacuaaauuauauuuuauuaugcucuauaauguuuuauuuagcccaccucccacaucagcacagacacagaaaucacucacacggugucagcaagcuaagccugcagucuaucaaaagugagccagaugugguggugcacaccuggaucucagccaccugggagucuggucaggaagacugccacccuagacaggcuagaccucuuaaugagacaugugccaaauaaaaauagaagaggggcugggggguacagcucagugguaggucacuugccuggcaugugcaagacucuucaucuaauccccaaaacacuacacacacacacuuuagaugacaauaacuauauagaguuauucuaauaugaugaauaguuuuagcauuggaaagucagggucugguagaugucucaguaggugagugcuugcuguguaagcaugaagaccugagcuugagucccagcacccagguaaaaagcccaaugugauagugcauugcuguaaccuggggcuggaaagcagagaccguggauuugcagugcucacugaucagucugaccaaucaaaggagagaagggccaggacgcugguucaguggauaccaggcacuugccacuaagugugaaacuugagugcaguccccuggagccaugugguacagaaacaaccaacgcaugcaaacaguuuucugaccuccacauacacaugcaccucccaacaccaacacaugcaugcacaaacacaugcaugcacaaacacaugcaugcacauuuuuuuuuuuuaaugaggaaagggauagaggauaacaccaugugugacgucaacaagugucuagcugcagguacacacacccuucauacacacacccuugguaccuagcuuuucaaaaaaagcuuggcaugcugauucugaguugauuuauaucaacaugcaauaaaccaagaauuccuaaaaccuuuugaauaagaauaaggcugggagauuaaaagauauaaaccugucuuuuuuaucaggacaauuuacugcugagauacguuagaauuuaagaacggacaaaaaaaauggaacugauauuucacuguuguaaaucucucaaccuuucgugaaucgcuggcugggauauaaacuaguacaacggcuuugggaaauaguuugucuuuauaaauaugaacguccagcuacccuacagcuuagaaauucugcuagguauuugcccagagacauaauaaagacaugugucuacccaccuaaauacuugucccaaauucucuguagaagcuucaguuacuuacgucauagugacuuaaaacagaaaguccuauuucugugcccaguaguacaagaaugagcugaugaugugcuguuuccauugcucuguguaaguacaccaaacucuagcuacuccaaacagcauguguuucuuaccccaggcucagcucagccggcuucucuaaugaggauccugagauacugugaucagggugccagccaggcaguguuccgccuccccaccugggugauuauuggcagcgcucaguuccuugcaguuuuaggacucagcuuaaguuuuugcugcauauuugagaagccacccugaauccuaaaggucaccagauaauucuuguguaucuguaagcuauacuuaaaauucaguuaccagaaaacaacucuuuucacaauaugucuuuugaagacuuucucauacuuggaaaaaaauguaucuuuauuuuauuuauuuuuuuaaugaagugccaacacucagaacugaugaagaucuuuuuucuucuuuuauuuuuuauuaauuaugaggcuuuaucauagucgcuuccuuaagugaaguaaacagcucuuuccaaauuaauauauuuuggaugcaguuguuaacaucuuuauacuuucgauuuuauugaccugcucaccuguugguaggauaucugauguaccguauaugguuggcaguguuucuagaaggauccugguaccuguagagacaugaagaaaaugugccucaugaaguauucuucugccugcuucuuuugucucucuacacgauuaaucggaggcuugauuuucaugcucaccuuuauacucaguguacucugucugugccaauaggaauaugaaggcucgugcauaguggugagaaugcacuugugcacugaggaaagacugcuagacugcaaggcuuuaacuguccagcccuugugcugagcucucuuuaaaccaugguggcaguauaaagaagacagugcagaauucaccucacggacauucuaccaauaggaggaucaguuugugauucauacuuggguaaagguucuauuuagauuguacugcuugugucauucucugucuuuugcuagcucucacugggacaugucuaugugacuuguagcugaggaagugggucucuaaaaugaguggucacacagagcaugcccagaaugguguuuccuggauacguaacaaauaguaguagcauccaccaucaucucaagauguuccaguaucugcuuauugaagaaucauaaacauauaggccuauugcaacagugcgauuauauaucaauuuaaagcaaagauuguucaauggucaguuagacgaagccuagggaugcccucuguccugccuuagagaauuauguacuaugacagcggcuagguggcacucaacacucagcaucugggcucucugacauucuuaaacuuauaaaugaauauuauaaacuuaauaaaacauuagaaaacagauguuucaauacaauaugacuugaagacauggaaaauuuuaauucuauauaauuuucauaucauaaaauguucuuuugaguuuuuuuaaacuaacauuuaaagauauaaaacaagcauaauuucuccuaauaucuucaucucuauuagagccuuuuaaaaugaggaguggggggugcagcuugguggcagagugcuugccuggcacacguaaggcccuuggguucaaucuucgagacaggagaauuguuuuuaaaaugcuuuggauucauuaaaacaucuuuuuccagucuuggaagggauuugaaaaaugcugaguuguggguuucccaguaaagcaaguuauuuugugguguuuucucaugaugauaaugugcacuaugccgauguaagucuuaucccagcuucaugcccacugguauguauuuauagauucuagaauauacagugaccauuaguaaaauacauacaagcuaaucaugauguuugucuaggcgcuaucguagcgguuugcaucugauguauacuuguugcugagcagacuguacuaaaugacagcccuagggguuggcacacauuuccuuuaaaggaccagaugguauuuugggcuuugugggucauuugggcuauuacaguugcucaauucugcugcuguagucacagauacaaaucaguauagcugucuuucaauaaaaguuuauuuauagacacugaaaaguugaguuacuuauaauuuucauaugucaugaaauaugcaucuuuugacauuuuuuuaaaaagccaugcaaagauguagagacugaauuuagcucaaguuucagauuugcugagcacugaccuaggaguugauuguucugaacuaacuuucuaauguaauuuaaagcugaagaguuauuugaaacuuuuucaaagaguaggauguauacugaauguuuuuaaauuguauuuacuuuuauuuccuaugcauuacuuccauguauaugagaauguuagaucauggaguuacagacaguugugagccaccauguggguacugggauuugaacccaaguccucugaaagaacgcuuagugcccuuaaccauugagccaucucucuagccccacugaacauuuuuaaaucaaaccccuuuccuggaaaaaaauugacaaaugugaauuacuuauuuguccauuaagaagcagcugaaaauguuguaaaucacuucuuuucuaugacugcauacaagaaguuuugauuuaauugcuaaguuaaauugcuaguuagauuucauugcuaaguuaauuuuccuagugggcaagcacuauuauaaugaauauaggucuauguuggacucgcguguucagcagguagugaguaccugcuccucagggcauuuaagugauggaggaaucucuccuugaugcacccugacccugacgaccuuagucuuauaaaaucugggcaaauuuuugguuaaaaugggcugaaaaaaagccuaaaguaaaauagagagcacagaacaaaauaagaaguaaguagggagguuuaaaacaguagagguugcugagcauggaguguauuggagaugcacacguggggucagugcaggagaacacgagggggcaguaaucccagcgagcugagcgguccauuuuccacacccacaaaccguacagaaggagaccgugcagaaagcuaggucagaugcuacuauuuguauggggaaaaaauggcaauuugguaaagcugguuugaagagaggugucugcucaacugaccgccuucccagccaguucagcauguuugauuccagccugcuccucacuaauuauauagccauaagcaggcugcucagucugucugagccuuggcuccucaguguauagaguggggucgaugcuuuguccuuccugacaggguuaggcuugcagcuaaccucuuccucgcuuggcgcccuuugcugcuaagguuugacaaacugcuuaggaaggcauaguuaguuuuacagccagagacaggaacugaucugauucaauuccaccauuacuaccuaaucuucaaaccuagaaaauuauuuaauuucccuauaaaagaaaacuucacaguuucauagggaagacugaauuaacuaaaaucagaaaacaguggguuuucuuacuuucuaaagauuucauacccacagugagguuuuuuuguuguuguugguuuuugguuuguuuuuuuuuuuggagggguugggggaaggggguuguuuuguuuuguuuuauuuuggaaucuccugaagaaccacauaggccaagcaggaguuacuggaucuuugccuuuaaaaaucauuuauaaaaaaguucacaagacugggugugguggcacaucuuuaaucuuauauugugacgcagaggcaggaggaucucuaugaguucaaggcuagcuuggucuaccuggccaguugcaugccagccaaagcuauauagugagacccugucucaaacaaacaaaauagaaaaaacuuagcuguguugaauaaaaacaaauauguuuauaugcuaaacaaugagcugaauauauauguaaauaauaaauaucauuauagcuuuuguaacaaccauucacuguagauaccauuauaguuucauuuuagaagaaaaaucugaugcuuagaaaauucacuaaguguccugggaaaccuaggaaggaagugauggaguugaaagucuaacucuagaccgugcuuaguagcuuuucuggaggcgacugcuccacccuccccuuugccacaaggacggccaaauaggcccuugcccagugucugugcucugucucaguagcucgccuccgccucccgagagagcgagcaagugagcgacaccaggaaagugcagacugauggaacucuccagccagaggaggcagcugcuuaccgcagcacaugugaaggaaacuaugauaaaacuucucuaagucuuugauaaauuaggcaauuacaaauucaggucuucaggacaauauugccuccaacuuuacuguguuuuguccuuugcgccauaaacagacuaaguugaaugcagaugaagacaugacacugaccuccugauagccuaguaugcuucucacugccugggucacugccugacacugcccugucccucacuaaugcgugucugcacuggaugaggacgucaucugcucgccuccuugccaaagcucuagcacuuaagacaguacauccuagauggucaaaaauaacuuccagccaggagugaauacaauguucauguauggccagguaauagcucuugccacugaacuugacgaccugagcuccaucccccaaaaccacaaaauggaaggugagaacugauauuggcgaguuauccuccuaucuccacacaugcugcuaggcaccccacuccuaaauaaauaaguacauaaauugggugaguuauggaaagcggacauuuaaaugcuguuuuuuguucuagcauggauuagaagaacaaggaagacuccacccacuauggagguaagaauacaugggaacuacuggagugauuuauguuuguaaugcugugcuucucagcuaagcuuguacuacuaaaaauacauauauucuugggggaauauggcauaucucaaaguauuaguuuuauuccuuaagaaguaauucuuaaauauuucuaguaaaaucauaauauuauuauuagcauugcauaguaauaaaacauuguacaaugaaaauacacauuuccucuugcauucuuuuaauuauacuuuucuuuaucuugauaauuucauacaaguguucaaugaacuaugauauaaccccuuccuguuguuccuccaacgacuuccuacccccucccaucaugccccucucuugaugucaugucuccuuuugguuuuucucucuguuuuuaaauaauccacugaguccuuuuagaacugccuauuuguacgugguuauaaagcaagcuguuugcucacaggaaccuuacaagggaccaucuucauucaagagaaaaugagccucccucccucuacagccaucaagugccaguuguuucucacuaaggggcgggaccacagggugagagcagcccagucuauaaguauaaaugugaauguuuuagaagucaguuuggcuccauggcugcaguaaguacacaucguguguaacuuguuagaaauauggagaacacacuuuuacaggggaaacaaagacuuucuaagcccgaugacguacuacuauccacucagaagguuggggcaggaggaaggcuaguuugaggccacccugagagucuuggggaccucagucuuuaaauucuuuagaauaguugugaugguuuguauaugcuuggguaauggggaacuaucaggagguguagccuugucagaguaggugugucacugugggugugggcuuuaauacccugguccuagcugccuggaagccagucuuccacuaacagccuucagaugaagaugucgaacucccagcuccuccugcacugugccugccuggauggugccauaucccugccuugaugauaauggauugaaccucugaaccuguaagacagccccaauuauguucacagcaguaaagcccuaacuaagacaauaguauauguuugaagccuagaaguuuguuaugaacucagauacuaugaaauuacuaguucucuccuggcccacuugaagggugaagggauccguuuguaguaccguucuuggggugcucgaaccagugggaggucagcuuccucccuugcccccgaucuuccucaccugcucugccuuacauccuccucuaaggagugcucugcagucucucaggcuuaaugcuucuuccuguagccauccgcuggcucacuaccugccuguaucuaauuccuuuucauuaaaauccuaggaugccucucugaaccuuuuucuccucaaguucuuaacucgcagauucaauaacgucuuucuuguguacccuggccuggacaccugcauaggcccuuggaacuuaguguucuaguccacgguuucauuugugcaucauaaucagaugcuaacagagcuugauuuguuacuaugagguuggauuuuauagacagauuugagaaaugagcuugaguuuccaucuaacaauuauagauuaaccuuguaaaacauauuuccaagcugaacauugccugcucuguuuucagagggguucacauucagguacuguaugucaggacggcucagcacgcggccuucagugcgguacaaugugagcucucuuucacaaagcuaaugagguagacuuucccugacucuuagucuauuagaagccauuaguagcaaauguuuaaaaauaucguucuuuucagacuaacaauaguuggaagcauaaugcagucuucuguuugaaaagugguuauguuuauugcuaauuauugacaaaaugcaugaugauucaguaauauguuuacagacaguaaaaaagaaagcuauaauauuaacagucugccgucuuuacuuuuaacaugugcuucaugaagggaaaaaggaguucaaggaaccaauggagacagagcagucagaggcgcuuggaaauggugcugauguggacuaaguucgggagauguguaggcgcacuuagcguggcuuugcuugcuuccuggaccaugaucuggacucugggcuggaagcuccagagacucauugucuaggcugaaggucguuuaacucugaaucgcauggucuugaagugguuaccagaacuccaaguacuggauuacagugggggcaacaggagcuugguuaguauucaaaugaggggaauguaugaauuaaaugcuuaguugcuucauacuuauuuaguguugccuauucuguccaucuuacaacugacucaggcugaccaagcagugcaagugcuugggaacgguuguuguuucuguugucucucaauauaaggcagagucugauagauuggaaucaaaaagugucaugugcuggcuaagacucuccaggacaguguuuaucaggauuaucugccagcauuugucucucgagucuccucuucucugcucccuauucugagugccgugucucucguacuguuuuguuuguuuguuuuauuuucaagacaggguuucucuguauagcccuggcuguccuguaacucacuuuguagaccaggcuggccucgaacucagaaauccgccugccucugccucccaagugcugggauuaaaggcaugugccaccacgcccggcgucucucauacuguuacugcaguuauauucuagucagaggcugcuggccugccacuucccugcucuggccuauaauauguugauuuugcaguuuaacauucagagaggaagauugcuucugaauuuuuaaggccuauuuauuucaacguugucuccaaguaaccgauauuuauugaguucucugugcucuguauucuuaggcauauauagcccuacuuuccuguagacuuaaauuacaggguaggaguauauguucuugcgaaaaguagacccuucuuaccccaaaucucaucuuuuuaggauuguggucgaaacguauaaggaaacuguagcauguucacacucugggguccagcaccacagacugagagaaguggacuaugaauaugggugacucucagaaaacauggaagugcacaaacagcauaucccaggaguuccaucuugugugccaauuauguaaacuuggaacuagggaaagauacggcauuccuaagguggggaguuaacggagcacuucacauuuacaagucuaauggaaaugacagcaacagagaacauuuuaaaaggccaagauggcaucuaugcuuugggggcuagaaagcauacagacaguugguaacagccuugccaaaaacgguuaggaaguaacccaacgugagcacagaacucacagugcuuuauagucagucagcagugucuggaaacugaaugugggugaccuggugcuaaaaaccaggaacugauuggaaaauuuuuaguuguaaucugcugcugaccauuuaguagaagaaacaauaaaguuaauuguuacaauuuccuucucucaaagccaucacugauucggggaagugucaucuacagauacugaaacgccugcuuucuguguucuagcaggccucccaggcugaaagcauagcaccgugaauuccguacugcuuacaaaaggggaacuagaccuucuuaccagauaaaucuggcagacaaaacccuagccagauggucaaauguuuugcuaagccauacaaaauugauguuacgaguaucuucuuguuuaaggcauagaauacggcaucaucuguaaaauaacuuacaaaaugcauaagccuaauauaacaugagaaaaugaucagaaaacauaaguugggagacauuccaucaaacuucagcccugucaugucaguguuguggacagcuaaguucaggaaaccuaacacugcgcugggguaggacuugacuguggaggauaguuaggcccaacuggugaagucgaggccugugccguguauuaaauaacaacuccuaucagcgcuaagucugcagaaaaggaugaugguaaauucucuuggugauaguucacaccggcaauagcuccuucccuuccaguuggaaacuccagguucauacuugugaaggagaaaacaguccaguucaaaauauccaugcagauauugcacauugaucuguaacuguuggcuuuugggaaacgggcgggauaacucauuucuagucaaaaagaguuaacucacaaagcuuaaaucugaagaacaaaggcgugaugugguguuucauggcugcugcagaaugcuuaagaggcagagccuuccguguagcucuucagcaguucuuugauccuuguuucagccuuggcuggcaccguaaagggcaggugaccguaaagggcaggugagcacuggguuagagcccaugcuuaaggcuuuacuaacacacuugagccuccacgugcaucccuagcccugcaaacgaccacucagaggcaaauagaauguguaaaguagcugcuucgagggaagggauuauaauauuuuuuucaugacaaacguguggcauuaguccugcaaacuucaacuuaagagagagggaaaaaaagaagaaagaaauuguuuuguuuugaaagauaggcucuugcacuguagcccagguuggcccugaacucgaaacaguuuucugguccuacucuccugguuccugguauugcaggggugaggcccaugcagugcuacacaugaggaguggcugaucuucucagcuuuaaguucugugagccaaacccuucugugguagaccuaguaguuacuccaaacacucuaagguaguuguagugugaaacaguuguaggcagcauaucugauugugguuguguccaauaaaacuuuaugaaaacaguaggucaguuuucacauucucucuguuuaugcagucuuucacacauacacacacaauauacauauacauacacauauacauauacaauacacaugcauguauaugcguacgaacuccuggccugcuacuugucauugagcuccuuuaaauuuacuauuaaaguguuggacuguuuuaaaggaaagcuuuuccuuuguccacgcuacaccugacaguggguucuugcuuugggguuuaaaaucuccaggcaucacagagaccauuacagcgagaaucucaccugaaggggaaucccucaagacugagagagacaaagcuucaguaaauggucagaggucagacacuguccuuauccaggccacaaacucgcagcagucuccgagacuugcacgucucuguccaccucacuagcugguuauccacuuagcauccuaaaguuaaaaaucagaagugugaaaguugucauggggaugcauaauaacacauuuauuugaauuuuaaaauuaaaacagacuuuuucugacaguaagucagauuuggcugauuggguuugacaaucaggacuugcuuugccaauucaguuguaugguuauauuuuuccauaaauugaacaagcuaaacugaagcucugaggccuuaaaaaauauuuaaaaccuacguucggugugcaaucacugcugacgcaggcuuugcuauugacugugccaacugaaacgugauguggcuugaaaagucucaggacaucagagcacugcugcuucuggacccaguaaaagcauuaaagcgugcauuagaaugacaggcaggaaccagagggcaacuguugcugaaggagaauggaagaaagaccaucgagggcuugugucauaacugcagaguuuaucuaagccauuccauuugauaguggguacagaggacuauauuguuagcuauauuauuuuuguuccugaaauauucuguuuaaaagaaucccaugagggcuguauuuguagcucagcuagaagaguguugcaggcaugcccuggguucaguuccuagcauaaaccaggcauggggugccacugucauacagaacucugaaaggacaggaggaucugaaggucaagauugucugcagcuacauauguuugaaacccugucgucguaauaagcuaaacaagcaauaaaacaccugcagucacauaauuaagagaacagguugaaucccugguaaaauaauaagacauucuuuuuaaaauacaauacuuuucauauagugugaucugauuguggcuccccagcuccuagcucuucccagauccugcccacagcacacccuuucuucacccuuucuucucucauuagacgauuuuaaacuaauacaugagauacucgaaauucaaacguacuuaagaacuucaagaauuuuucuagcaacauauauagaaaacaaaucagaaggacuuaauuuuugaaauuccuucuaaaaucugugugaugcuuaauuaagcuuaguacuuauucaguuaccaucaaauaccuuacaugugcuaaaaguuaacauacuuucucuguagacuucuuuaguauguaucaaccugaucuaaauucauuugacauaauacugcuauauuguuucuaauuuuaauaucuuucugccuuuuguaaaacugaauuaguccaauacaguaagcuggaucuuggugcgguuuacacagggguggcugugugcugugacagggucauucuggaauccuauacucacaaggcuggagagcuugcuuggcagcacguuggugauucagccccuggcauucccaucacccaagaaaaaaggcaugcuugaccagcaucgcugccaucguaauagacagccuuuggccaugcugguccuuugacuuccaucauaucuaagucaucuggcccuguccgggucaggugcaaaagucaggugaaaggucaaggguuaggguuggcucccauagcagcauugcagcucugcaguguacaccuuccacuaugacuuuaccugacuuauucuuuuaucuuauuaaaguguuaguauuaaaaaucauuuuacuuuuuuaaaauaacagauguaauaaacuacccccaaaccuucuggccaguuccacaacuuuaacaagauaacucacucacaugugugagcccuucauugcuagcagaccagacugccuguguucuguucuuaccuaacuaucacaauaaaugaaaacccagcagcuccugcuugcagcacacagacucagccuuggagaggccaauucucccugugugccuucuucaguguugaccuccagcucugugaaaacaggggaaauguaaaauucacugugcuucauagaaaagugugguaaaaggcaaagaugaaucugggaagcauuuggagucucagcccugggucuguguucuucacugcuaagacagccugcaucucugccugcaucacuggcuguucaggagcuguuugugcaaguuugguggagaugccccuccucuugaagucguuggucacaggugagugcugcuaagaagcauccuguggacuuccuggcucgcucuuuucucaguuuggggagcggcuccuucaucugccugucuaagcagcggcacuguuuuauuccuagcacacauuuccaucucuuuugaccuuuaucugaccuuucaggaacagaauguaaaaggguuuuuaaauaaguuguaaguaagguacuauuauuuauuuuuagauuuauuccuacucagagucuuuaaaguccaugaaacauagaagguacauauuaacuaguucuuucugcauaguuaacuaaguuagaccgucagucaggaagaggagccucacguagguuuggaagccugccuuagauccagauugggaaagguugaagaaguuagaguuggggauaaugucucuaaauccacaccucuuguuacuucaucaaguauccugacucuuuucacucaucuucucguuacuuuauaugaucuaaauuuaaagaaaagcaugacugauaaucacuuuggcaaucgguucuaaucaucuggcuccuucuuguucucuggcucauucggucuuuaccugugucuagcuugcucuuucuucagccugucucuguaccacugucccagucaagcugccuccuccuuucccucuccgcacugcucucuuaaguagcuucccuuuccccucucuuccuugagaguugggcagauccuauucugucaaaucuuucucugauucgucacuuuuucugccacucaauuuggcaucacuacaaacuuacuuuaucaucauugucugagauuaagggugagccacaccacaacuacaaacagguuuuuccagaaaucaacacaaucucaggguucacagugugaucaaauauccugcaagaauggaucaccucagauuugauuacauuguuaggcaugcuugauuuauucucaaagauggguccugacugugauaaaaugcuaggcauguguugguccuauagugaugggaauuagguguuuacuuacguauugaucuuugauaaguuuguguucauguguucaagcuugccuucuccguccuccugucgcugugaugccuuuucaccgggguucucgaccagccauagaugugccaucuagaacaggugcucaaucccugucauacaugauagguggggagaugaaauuacuggguugcauauauuuuucuuuuuuaugaaguagcagguacaaguaagagaaaauaaaagcugacaacagacaucugcugcccaugugcuuggguacaaguggccuuguguuaucucucacucagauggccauuugggcuuaaacucugcuccucggguguuuguuuaaaauucugucuggccuagagcaaaguuauuccuuaaaugguauuucuacaagacugaaacucagaggcuccuaaagguugacagucuaagaugcggguguagcuagggggagcggggccagaaaggcccaaaaguacaggaacuccucccaggaaugggcaagugugauugcaugagauucagaagguccuggcaguagagggagcagucaguagugcccgcagcacaggaaguaaucuugccaacucuuuaugugguggaggauugauucaucucuagagaacauagagaacuagaaaagccaaagugucaguugguggugggcaagugaaugaccugagcagauacuucucagaagaaagagaaucaaacgacugauaaaugucugggagaacguucaguguuuaccaucaggggauguaaauuagaacuguguugagauuccaccuccucucacaccagucagaaucaccaagaaaacaaacagcaaauuguugacaaggaugugggaaaggggacucugguaccaugcuggagggagcagaaacuggggcagccacuauggaaaucaguuuggaaguuacucagaauaacugaaagagaacuacugugcaacccaaaggaauccaagucaggguaccagagacaugcacaucuguguuuacugcugcaccguucacaguagccaagaugugggacuggcugggaugcuccucagugcaagaguggguaaggcaagggugacaugugugcaccaagaagaauggaauaaugucauuugcaggaaaauggucugaacuagagagcaucaauguuaaugaaauaagccaccauguagcacauggaagaagagaaggaacucaaaagggagggagggagggagggagggagggagggagggaaggaaggaaguuuauaagagguugugauggggcaaaagaaaggcaaaagugccaguuuccucuaugugcagaaucuacaucuaaccacacagcacacauacguacauacauacauacaugcauacacacaggacagaagguagauaauugcaggggaagagaaaggggauggaagacaaugagugggaagaacagaaauggacauucauaugugugagagagagauagacagagagagaaucucauaaaacccacuauuuguauacaguaacaauuaauuuuuauaaauuagaauuugaguaaaagaaauuaccuucaguguuugggcgggccucauccaaucagaugaagaccucagagggagaaguccugguacuugugaggguguugggacugcaccuguggagagagguguggaaggucagaaggcagcuuuuaccagucaagugucuccuaccugugagccccagggauugaucuuaggucaucaggcuucgaagcaagccuucuugccugcggagccaucuugcuggcccuugcuuauccuuuggaaagaucuacauuuaugaguagugcuaaauaguauuuuuaaauguuuacuuuguagaaauuaauauaauuuuuuugauuuugucuccccauuuguguagccugagagcugcccauuuucuucuugugauguuuaaaguauuugaauuuugaaaaugcaauauauaugaaucuuuaaaguauagcuaccuuuuugagaguucuugauaauuuuaacuucagccccaauaccagaugccccuuguaacucgccuauguacucuuuuauucuggcccuucgcucagacagcauggggugucuauagguaagaaugugacaguugaaagaguuaacauaccacuaaccuuugaucaauagggguuggaacuaagggacuaauguucucuuucuguccccuggguuaguaguucaaguucauucaggcaacugaugcacauuugccuugccuccucagaaggcccaacccccaguucagggaccaguaacagaacacaugcugauggggcuuuccuuucucccacuuuaacucugcuguguugaguuccuuuccgcugggguccuuuauucagcuucagccguaucaaaaccaaaauugucuucagcagacaugagcucaaaccagcgauggucaauaccaggucauuaaguucaacaggucugcucaucuuguaaucuggcugcacuuggguuuugcugacgcaaaacaauauguugauuaagaauggcgccugccaaaacagugugccagauugcuugaaaacuuggugaccaagaccagcucaagggaaugaaauccuggcgagcuguugaggccuugcccaggucauucagaaacccugaggugaauguucacuaacaagcucgguauagccuacaccuguuguccucguggcguugagcgguuuucuuucccguaagugaguuguguuguagcuguaccaguugggaaugggcuccacaagcugccuuuuugauugcuucuaguucuccauaauggucuucuuccauugcaaaagggaguuucuuugaugaggggugaggaguacucuuaucugugugcauaaauacaaauguuaagaauauauucagaggucaugcuggcuuaauaagguggcaaaagcagguuguacuccaaaacccaugacuucacuagggcuaggugguugguuagguuucuaguagcaggccuggcuuuccucugguugagugggacguaaguccaauuagagagcuguagguacaucaagguacgugagccacuacuucaugcuugucauuccacgaaagcuaguugucagggggaaggcguccguuacaggccagauccagcgugggggucagcucgagguggacuuuaauuuuuaaaguggggcggggggugucauuucuaauggaaaaaugaaaauagugccuuuuguuuaaagcaaaugccaucauuuaggcuuguucagcuuaucucuuuauuaagauauuuuuauuucauuuguacucagagaauaaaaauacauuuagguuuuaaauuuugcuuuucaucuuuaauguauaaaguucuucuugacauguaccaauaaaaaugcaguguuuucugaacugcacaauuggauauagggugaaauguucaggagggaaaugaagucucuaugacaggcccugucuuccugccgucuauuucuagcuuuucuauaaugggguauuuugacagucuuucuguuucagacgggaagaaaguauguuuuucuccacgacugauaagcacaagguuucaguaauugucucccccccacaaaaucagacuaauugcauuaucagcucucaccaaauuacauggcaauucaucauaaaaacaaaaacauuuauuaguguuugucuaaaaucgccucacuagugacaucuucuuagcagagggaguucugugcuuucauugcugguuggaugcuuuuaccacauuuauacuguguggucauuuauagucauuugaauucuauaguuuuuuuaaugcugugacaucacauuagugcaauacuuguuaaaaaauucauuuguguauuggcaaaauauuuacagguaauaaguucaguggucuauucacugaguagugacauggguuuaccuaaggaaacauuauuguugccucuuaacaagagagccaggggucuacagccagucuuuccagagcaagaucugagaaagagagacagagacagagacagagacagagacagagacagagacagagagagcuugaacauaaaauauaaaugcuauuaggcuacacucaacccaguuuuguucaaccuaagagcuuugcuaauuccugccacguuuauaagauaccuaggauaaaagaaaagcaaugaguuggguccccccccucucauacauacacacacacaccaacucccauuggguggggcacagucagguuuagcagaaagcagguguacccacacagccaugucuuaaggaaugcucugaaaagucucacaaagccugauaauuaaagccuuuuggucccagcaugaaaauaaggaaguaaccuaugaaaugaacuucuaccuagcaaguggaaaagcaugaagucucuucugaugucauccuguccuaauuacuugauuaauggucaggagccaaccaucacuguugugaaguuuauacuuaagcacgugaaggagaugucacuuuaaauaaggggacgauugucaccacagagugguuggcaguagaaauucagucacaacuaacuaacgguuccuaacuuuuugaguguucugacaucucauuccucccuuuacuccaaaguuauugggugguauauauucauuuacagagguaaacuaauauuagaucuugcagccaucaaguuuuggagguuaugauguccucuuagauaucaugaaaacuacauuauaguucuugaaccagaccaggcccagccuguuuggcccaguugcuuuacaguaguccuccaagccccacugccaagucagaggauagucuagacccagcagggccugaacucacuugcuuuggaggaagaccaagauucccacccccgaugagcaccuuuccaagggaagcaggcguuaauccagcugccuuugagaguauuggugaagagacagcuaacagggaguccccggggaaggaagcuaaaguuugcucccugaauaccuaugagugccuguuccguggcagagguuagcagucaggaugcugauggacccugacggcaucagggucaccucagagcuuguccuuaggaaagucacuuuucacaugugcccaaaguggaucacuacaaaugugaaaaggacucaggaaaagcagaagcucaacaaaaauaacagacacagccuucuuuaugugggacaaaguccaagaaagguacucuggagaggugagaaugaggcugagggcugacgcaugcgcagcugccucacaccaaaaccacacaccauaggggagagcagacuaacagcccaaggcaucgggguuuuccguaguuaacauugaaauccugaauacagaaaacaaguaagccaaaugcagggaggacaaggaacacuuuguuuuugcuuuuuguuuuuuaauuugacaaagcuauggggaaacgugugcucucauucauacauaaagauauaaaaguuagugcuagauacagguuuuccaaauaccaaaaaaaccuuucggauuuagaauuucugguccugagaaggugugccaagaagugaguggcaaauaagcuaaaauuuacauggagauguaguauuuauaaaauaugaaguauuuuaaacaugcauccacaagggguugggugaaucuaucacauucuucuacacaaugguuuauuggguccugaguaaccaguaagaagaguaauagucuguccgcgggcacacacacacaucugucugcgggcacacacacaucuguccgcgggcacacacacacaucugucugcgggcacacacacaucugucugcgggcacacacacacaucugucugcgggcacacacacaucuguccgcgggcacacacacacaucuguccgagggcacacacacacaucugucugcgggcacacacacacaucuguccgcgggcacacacacaucugucugcgggcacacacacaucuguccgccggcacacacacacaucugucugcgggcacacacacaucuguccgcgggcacacacacacaucugucugcgggcacacacacaucuguccgcgggcacacacacacaucuguccgagggcacacacacaucugucugcgggcacacacacacaucugucugcgggcacacacacaucuguccgccggcacacacacacaucuguccgagggcacacacacaucugucugcgggcacacacacacaucugucugcgggcacacacaucugaagaacauuaacuaagaguuaugagccaguaugcgcuggguuuguuuuauuuauauugacaaauguguuuguaaacaagacacauugcauucauuuugcaauauauaaagccaaugaagggaaaggacauaaugauggacuccgggcuuuuuagcagugcaaauaaaaaucuaagagguuuaugguuucuacuucaugaauuucuguuuguuuagauuccuuuauuuguuuuagaaguauuuuguagagaaaagaaguuuuccgugugagaaaggauagcaaaagggacauugugcagaguucuaaguuuccaguuguuagguagcaaaagggcaggcuggcugauuaaaucagugcacagcaacugcagucaccugcuuaccuucagucccuagcugugcuuugucucugucuauuagagucuaagccucaagaucagguucuguggucuggagcugcugcaucuguagcaucuacaacagucccuggcucagaguauugaaggacuuaucuccuggugaguuccucauuugcguuuguuuuuucucuucugcucuuauuugcggguguguguguguguguguguguguguguguguguuauugcugcuguugcuaaaggauagaggcacauguugaccuaacaugcauguggagggcagaggauagcuuugugggaucaguucuccuuguaccuuuacauagauuccagggauaaagcuugggucaccaggcuugugugacaagagucuuacccacugagccacuucuccggguccccagcaacuguuuggagucccucucacaucuccugugagaauucucaccugacuuuguuguuucaucuucuagucccaucaauggggcaucagggacaucaucccugagccucuuuuaguccuggcaccaauccuaaaagaagcucucaacuccacugauacccauuugagcuugcacuggguugccugaccuucagagaccacuguauccuaauuaaugugugagcuccuucaaguccucuuaggagaagagcugucacugugguuccuucuacucuuccuucaucccucccacgguaucauuucaguccguuucaucagaugcugcccuucagagaauuccacuucccuuccagcacaguugcuucggggagcuccaacugccuggcugccagugccagucaccuugcccaaggcaggugccacugcuaaacuuuguaauguuugccugugugacagcucugcuucuggguaaucacaggccacugucccugaccccugcgacuguuuuucccuuaccucguagccuaucuucuuacuccuuucuucuccaguccuauacuaggaagggagaugcuuugucuauuuuagaagguguauggguagggggaguuguccugauuuccauguuaaaugccugagucguuuacccaccugcuuuucugaaccaccucugccucuuugggaaacaucaguagguuuucugagcuguccguaccuguuguccuguuugcauuggucucgggcgcaguggguggaaucguaaccugccacacuugcguaucauugcagaugugcugcucuggauaaaugacuuagugugcacuaggcaggaaauagaaccaucaugauuacuuguuucucuuggggguaaaaagcuuugggggucuaaaaaguuggcugauuauuaaaguuucuuucuuuaaccuaacuuaggaacuccguauuugaguagugauauauucaaagccgaaugcuuaaugauugacaagugaagauacacaaagauacauuuuucccaauuucaaaagcaucaucuuugccacauuuauuuuuaaaaacuaauauaaauuccuaagaguauaaauauccuuuuccaguuuucaagaaucuauggcauuuuuuguuacuaugaagaaaaggccuguaaaauuauuuagaaccauaacuuauuaauggugaaauacaauuuauucuuaauuguuagguguuuaaauuuagcuuugcaugugugauacagugcacuauguggagccauuuauucauucagcaaauacgugcugagugcaccuuauaaucuagccccuguucuaggcacugugucugagggacaaagggggaccgagccaaaaagagcugacaagaacucauugccuauggcaaccaaacugcauauauauuugccuucugccuuggcaacccaacgucuagaaaucuacucaauuaucagacaaaggcaaugguauggccacacaagggaguucccagagacuaaaacgagacgacaaaagaaagcauagcaauauggacuuagugccacaacagaguuucaaacaaguagauuaacaagaaauugaucgcauaugaaugugaaugauagcugaaggacggccagauagguaauuugccuauuuuaugaaaaaaagcagaaaguauauagaaaaaucuguuuuguuuugcuuuuguuuguuuguuuggcuugguuugguuuuuaaauaaaagauuagccgcggagggagagaccaguaugcagagcaagggugaggcaugaauuuuggugacucugccguuuugcuuaauuuuacugugcaacaaucacuacauagcuugacaaggggagcugucuguggguugugaucuucucuuuaccaugagacuuaggcagccauaugaauagcuggaagaaaagccucccaggcggaaaaagggcccagugacaacggggagagugucugaagaacauaggagcagccaguggggcugcagcuuagcagagagagccaugauuggaggagaagagagugcagucagaucccugacccuccucguaggcugcaggcccaagaugaaguuacaguagaaggugucuaguagauccuuguggaagaaagaggacaaaggacaaaacgacgaagucaaacagagacagaggcccagcaaagcucuggcaagcucuuggggauccugagcacguuuguacugcccgucugguugggguggccuggcuuuauguccuugccugucuauuucacuggauaggcuuccuucccuuaaagcauuaguauaugagugaguugcagcccucugcuacugcuccacgcgacagcagcguggacaggugugagcugucuugucacagcucccccugcagcugggaaggaucuggagucuccuacaugcaaaucuaacguaacuuauaauaaacccaugaagguuuguuagugagaacuggcaugaaaagucagccucuguuggccaggaggcccaaggagacauguuaggaagugccuguaguccuaguaagaaaugcucuuggcaggagagguagcaacaaaugcagaguucaaggugcaguaggaagagcugguaagaucuagugcugcguagguagaggauggaaggggacacaggagcagcucuguaaauaugcacagugaagccccuccuccucuaacuuuuccuaccuccccccuccugccuccaccuccucaucagaucuucccccuaaugugcauuugauugugacaaagccuacuccgagagugaucaguaacuuucaaggcugucugugcacguugucggcuguugccuuggagcuggccuguaguuuagcagaugaggauugggaagagaggccagugaaacacgacagagcugucagggguccagggagagcagauagacacgccugcauuggccccaacucuaugggagccuugugaguggcuugugacaaguaccuggcagcagcagguagaagcagauuccuacuucaaguacaggcuagucaugugaccuuguggccuauggacaguuugaaugaaacugucaagucuaaugggcuaguuugacuuagagcuuuggacccuagaaaucugucagggcuaaaaguauaaaucugagauuguucagcaauauggaaauaguguuuaaacuugcagcaugaaaaacaguuaucccuguagaaauaagagggccuaugccugaguccucaaacacuugaggccaaacuguuuggauguuugaccacagaggagcugauuuugguaaaaagaaccugaauguuuuacagacauaucauuugguauaugaauguguaacacacaugugcacaugcacauaccaugcacacacauaccucuuuuucucaguuuuuaucucaccuuggccucaaccuccccuugccgagcacugagggcuggcauggccuuuugucuuugcagccauggcuaaggacaugcuucgcagucgcucuccgaaacggugaguuggucugcugccccccuccaugcuucccacccaagagcacagaggcuucucagccucaccaccacuguggcuuucuggccugaugacuucuuucuggcauuucuguagaaacaccuauuucaucucucuauucucggaggcccgccccucccccucgccucucaggccaguguacacaguugccauagucuuacuuuagaaaaaugaagugaacauggaaacccuguguuuaugucugcagauuaagcaaauagaaauauaguguagccuauuaaacauuaauuuuaaauaaacaacugauuuuaaguguaaguaggucccaugcaguauauaggucauaaauacuaaacuauuguuugcguaucugaaacucaaauucaccuuuaaagaguuuguauucucccucuggaacccuguucuugcuccagagucuuuggaauaaaaccuaaaguguauugcaagaaaucgcauguucugagugcuguggucucggauuccgcuuggagcaucaugaaugcccaacacugcuuuccuccucagcccugugagcaugcgcacaccucucugaccucuugguucucugauuaauuucugcaaacugguuaacacucaaauauuaucuucuccaaaaaaaucauuucuaacccuaguucccucagugagacuaauauucaggagauggccuuucuucugcauuuucaaacauccuacacuugaauacauuuguccuugucuuucucacuaaaguugcuacuuauuugagcacuggguaaauauuguauccuuuaacuccgcucugcgcgcaugguucacauggaugagcaaagaguaauugaaugggacaguaggaucccuaggccuucccugauggccaaacagagcuuucaguccuugacaccaucuagaucggaaucacugcaggguaacaccaugacuuagucugcccugcacaccaaggacagguauaagaacauaaccuugaugugaggaugccuggccuuuauugaccaagugcacagaagaagagagagcaggggucagagucuuuagcaucacagucugcauugucccugcaucaaguccuaaguccgaugugugaccacagccuuuuuguuucucugggacagccuucguauauguggcuucucuaacucugugcaucacuugcccaacccuucuucaucucucaacacagaagagaacucuuucccccuccagcagcuggcagaugagucaguaaacgucagcagccacucacugcggcuccuucucuuuucuuccuggcuuuugcuucucugccaugucacugccuuucucagaagaaagccauggacuuccaacauugucuuuucuuucagggauuuuaaucccuccccgccacccccgccuucacauaagagagcaacguuuucuuugucuccuaccagaguaguucaauuaaauaagacuaaagcucaguaacuuuaauuauuuucuauuaguguuuaacugcugaguuuuucuauuaaauaauggugucuuuaucucggaggguuuuuuguuuuuuguuuuuguuuuuuuaauguauacauggggaaguucauuucuuuuauuaaaggaaauaccaacacaaaacuauuaaugacuggggcucugugauuaguucguuuuagugacauuucaagauuuaauuauuaaucuggcucaaguucaaagacagaaaacucagugccagaaauuccuaaucagcaaagaauauaaacaaaccuuacaauuguccccucaaauaacaagaaccagugagauuaacuucuuguaauuagagacauuuuagggggaaugcagaagggagaguucaagaaagcaugucaaaacaacaaaccuccguguguauuuucauugcuguaauugaucagaggauguuugcaguggauuugaaagugcauaaauuaacugugacauugauuuggcagaggcacagaagugauuggcaggaacacagagcagagcagcaugugcuggagccuaagucccuccugcucuuugguucuaauagacgccuuugcagccccgugcguucuaaccugagugcuaaagcucauuuauuuauccuuaugugggucagccucgcaucacuggauaacaugucagcacguuccuuggguuugucugaacacagaauacuuuugggggaccuauguaccuccccuuugucuagacugaaaaggggguaaucuaauaacucacugugucaccccaacaguucaccuuauagaaugaggaaggucacuuaaacaacugaggggcauuuucaacacaguguuugcuaggauugaauuuuucucugcauguuacaaaauugaugucaaaaagaauuuccaggaggugggauacaguacagugauagugguagaggccaaguucaaccccagccuccacacacagcccagugugcguguucagcuuacaguguucccgagggauggaucucugugguauauuaauaauguaacgugcucccaucucugugacuaucuguaauauggcauucagaaacauacuucuggccaaauuucacuuuuaaucuguugauuaaauccuuuuguauuuguaauuuuuuacuuaacucaaaggaaauacacucauacuaaaauguuuaauaugauuuuaaauuaaauguuauucuuucacaaguauaguuuaacuuauaaaacaaaacuaguggaacuaguaaaauuaaguuuauccucucuaugccauauggcugauaagagauuaaaauguacauaaauuuuagagaguauauguaguaauuuaagcauuuuagaauuaugucuuuaugugagaccaaaauuuuccuuauauuuuuauuuuacauguucuccuauauauaaugucaauaacuauauuauaaauauuguaauuuuaaguaguaacauuuuauaaauuuccauucucauuuucuauauguacuauaauuugagcuucauaaaauucaacaacagaaacaguuuucuuccuauagaaaaauauaagaaugguaugugccugaaucugacugacuccuaaggcuuacuuguuuauauauaagaaacuuucuaauaaugaacggcuguuaaacuuauuuaaacuacauuuugauuuuucaguauguuuuugaacuacauuugaacauacuuauguauacuauacuuagaaguuucaagcacugguagcuacauauaccucaggaaccagagcuuaaacuucaaaaucgggcucugccaugacguguacaagacucauuaccuguaucagguuuuuugguuuguuuauuugcuugcuugccuuuuuguuuguuuguuuccugauuagauuucuagcaauuucaacgcaaaauugguaacagccuaaugaaagacugucauuagucugucuuuccacgugucuguccauggggaaaaggacauggcugagaguaugacccagggcagggugcacgcuuagcacguacaaggccuggucaaucccaagaucccccgcucaaaauuuuaacaaucacuuugaaggcuguuaucauggaaccuuuuaaauuugacaugaguaucuuaucgucagcaucacacauguguauacacaaaugcauuacaggaaaacuccuugauagacuaagucucaguugcuugguuuaaauauuuuaaaaauuaaaucuggguugggguaggaucuuaaauaacauaauggagacaacugucuauucucguuaugcauguaucacauacacaaaauguaaacagucuagugacauacguuguugcacuauuacuagguauacugcuaacagugcuccuaaauguucuuguuaaguacauagaccugcacuucaguacucagcugcccucacuagcagacucagaauuguucguuugcacacuuaauuccagugguagccucagagucagaagaacuugagguggaagucucuggauagucuuuaggacuugcucacauauuucuuggccuguccuuguccccagaacccagcagucaucgaagcuuugguccauccauggcagccucgucagggaguguuugccaguuccccuccccacaccaccccgcccccccagcuucucucagauuuuacaguucuguccaagucucagcugugcgcugccuggguuuccuucgcucucaggacacauuauugaggggacuuuuucucuagucugccauuuguuuuaccuucucuuaucaucuacauuucuauuucuuuuacuucagauuuccuacagccguaacuguaugauagagcugauuccucaccauuguagaaaaugccucuauaagaaucuuacauaaaagacugauaaagauaacucuccugaugauaucaugccuaaugucugugacugcgcuauaugucagcauauuaguagagugcauauuuaagccuuaaaaaaaaaacuuuaaaagcuucuuggcaucaugcuucauguaucaauuugcacugcugaguacagcuacccaaaggacucuuagcaaguaacggcguuaccgaggacuuggccaccucuggggagccugaguucacauuagugaaugagaccaggaaaauagcugcccgucucugucccauggagcgagcguuuggaaggauucaaccccuccccuucugcuguugcaucucauccuccacagugacguuuaaggucacaguauugacauauaaaacagccuauacauucaaacaagagguaacacugacaggucugucaacugucaccaaaacaaggcuccauaaacaaaccuaagugugugggcuacaugggaguaaguucugcugccugcuuuaauaagaguuaucacagacacuggucauucauagccacacuuacgcaacaacuuagcauacagaguuugacugacuucagucugucuccauugucaguaggguuucuucuuugagcuugguagggaauaauauucuucagccguucacuccaugagacuccaugucacucucccaggauggggcgacaugacuuggcuucagacugaaucaaaagaccacuguugauaugcugcacaaaagccuaugucaagggacacagaaagugguguggcccauggaaggcauguuaggcaggugcuuguccuuaguggaaguagggaaggcuuuagccuugagaaugugaaauguccccauaggcuugugugccugaacacuaggucccuagcugcuaaugcugucuggaagaacaggugugugggcggcaggaagagggggacggagguggaaaugaguugcuagaaaugugcuucauagugaagcccagcuuucugacugcucucuacuuccuguucugcugagaugugaaaagcaugaggcuucccagcugugcacucacauccaugacccugcagccacgcuucuccacccugacagacuguuuccccuuacucugugagcugaaacagccuuccuccccugaagcugcuugcuuuaugcugccuauugagacacagugcugagacacaaaaguaaugguagugugagggcugcauaugggauuagcaguccucccuucucagcuguacuguccugaacuuggucugcaaagcuugaggaguugucguggcagcagcaccaucacuggacaggguucugaugggcuucauauuuuucaagaacuugaaaggaaugaacagaguucuagaacaccaacaccuaccaaagugugcagaaacccugaguuucugugcagugaagcccuucacugcugcuucccggugggcucguccuauuaccugagaucagacuucucuaugcaggaauuuacauuaauuagcugucuuagucgggguuucuauuccugcacaaacaucaugaccaagaaacaaguuggggaggaaaggguuuauucggcuuacacuuccauacugcuguucaucaccaaggaagccaggacuggaacucaagcaggucaggaagcaggagcugaugcagaggccauggagggauguucuuuacuggcuugccuccccuggcuugcucagccugcucucuuauagaacccaagacuaccagcccagagauggucccacccacaaggggccuuucccccuugaucacuaauugagaaaaugccuuagaguuggaucucauggaggcauuuccucaacugaagcuccuuucucugugauaaccccagcugugucaaguugacacaaaacuagccaguacauuagcccaaguguuuccucugauguuucucaucuucagauuugcuugugaucaguucagcuucuguuugucugaaaauguuuguuuccugagaagaguuucacaggauagggaauucuguaucuggucuucuuauuugagcacuucaaagccguucucucuucuuagcacacucacuaguucugaaagaacucggugauuucugucucucacaucugagugcccuuuccccuaaagauuccccuuucucaucaguuuuuagcaguuugauuuugguguguggucaucccaauggggucuguugaacuucuuggauauguaaguuuauauuuguauccccuuuggguauuuuugauuauuauuuccauuguguguguacauggcgaacaacuuguuacguccccaccucacugaggcuuuauuuuguaagcuuuuccaaucccucauuuaagcucauagcuuuuuaacucuuuucuuauacugugucugauuggcugcuaaacagcacucaagguuuccuggcauguacguuuccccucuaguucuucucuugguucucuuuguuuccugccuuuccuccugcagccauuauagcugaacauuuuuauguuauagcuguaauggcaucuuuauuuguugguucaaucauuucaauaaucauuucuauaacucugggcuacauuuaaaucauaccuuucucuucuugcuugcauggugaccgcuaagaaauuccuuuguuuauaauguguggguuuuguuaucuuuccuuuuacugagguuuguacugauggaccauuaauuggcaugugaaucaucucaaaguucugaaguauuauuucuaaguuauauuagauaaacucuaguauacuccaauaagaaauucuguaaugauggagauuuuuguaucugucuuuuccagugcaguagccacuguauacauuuggcuguuaaauacuuugauuucuaaaucuuauuuauucuaaauaaguuacagucaaauaacaucuggcuacugcauucaauagcacaguucuaaagccaagccugcucuuaugcuguuugcuucuaauccaagcagcugugcuccuggggucuuuacuguuugcccaggugcuucuacgcuuccuuggccugguagaucuugaaugucuccuaauccagggcuagcuccagcagugguccaucuuacugcucugcucugcucuaagacuuggccagaaggccuccuggcuggcuuugugaaggcucacauuaugcauacucagcagguaucuuucugaacacucaagugggucccugugcagagucuagaacuugauaaucugcccagugugcuccaucuuccuuagucuccauaggcagccaacauuauggcuugagcuuagugagaugccaaguucucuuggguccuagcccauguggcaguccauaauguguauccaggcagaaaugcaggguaacaggcauuaccucauuuuaucccucaccuuucagaagucacaucugggcucugagcacuguguuuuguacauuucucuacuuuuuuuuuuuuucuguuuuuuuuuuuucuucuuuuuuuuaacaggcuaaugugguacuaguugugcaccaucuuggugggaaauuugaagaugacauuguaucaccuccuuuccguuucaaaaggacuaggguaggguagggauacagcccuguaggagaacacuugccaagcuuguauacacccuaagcuuaagucccuacuaggacaggagcuaaaaaggaggauggcuaagaaguuggguguuuauuucuuagcauagugaaauaagcagacacucucuuuaaaucagcaugagccuucguugucagacuguaccuaccgcacagccgccauuuccuuaggcuugcucuguuucagagccucugcugcucugaugguuacucacucauauccccuguugucuccuuuguucauuaaccucucuacuuuacccucuuggaauuuacucauccuuuuagcaacagcugucugaauucuuagugcaguauuucaucuacuccuguaucuuugaaugcaguuuuguauuuuuaagagauugggucucacuuagcucagcuggacaggcacuggcuaggacuagcaaggaccuugaacucugaauucuccugcuuccaccucaaggaagcugaacuuauaggccugugcaccaccacccgguucaugugggugguugcgggacaucuuguuagaacacuugugugauggauuucuuuuugggcuaguuugcugcagaggagggggucacuuucagacuaacuccuugugcuggauuuaaaguuuguaagaaucauaaguuucccuggccuauugauauuggggugggguuggggggcuguuuacacucucccaguuuacuucacacuucuuccuccagggagccaaucuugaaacaugggugcuuugugccuuucugauucugugcccucuagcuuucucugcuugucuuucuugauccuuggagcuuguccucuauuuccucauacucuagucucucauugucaugugaaggaugcuccuauccugccuucucacccugcaacccaaaaggauuucauugccuuucugaaaggccuauguaaugaugcuccuaugacagucuuguacucaauguaaaacaauaauaaaagauucaccauaauuuuaguauagaucccagauagagccaagcugcaacuuccugccaauuggcugcuuugaggaaacacuuccaguagugaagagccucucuguagcucgagccuaggaccugcugaacucucagcucuguucuccacuagaccacucuagggacacagaaguagauggagcuuagaucagcaauacagacggugaauuagcauucugugaaucccacugacacagaguggcagguaugaguagcauucuggaauacuccagcgcaucuugcucugcaguggaaaagcagucauggacgcuuggcuuuaaggcagaaagcaguugugaaaccugaaaacuggaguagugcagauucuuagguaacauuuguuucacuuuuuaaguaguaaauauuuuucuguguugucucagucuuucucuuauaacauaaaauaaggaauauuucagaaagauauguaauugaaagccuuccggccuuagccuguucauuagcuacacauguaacgcaguaucucuuaauaucuugauugacuuuauuuccauaaaccuuugaauuauuuaaacuaaaaauuuaaucauguuucccaauuuuaucuaugugcaggaaauacuaaagaaugaaaaguacagagaagaaauuaaaauaaaaagccaagauuuuuaugaaaaagauaaacucgguaaagaaaccagugaagaacucuugccuucaccuacugcaacucaaguuaaagggcacgccucugccccguauuuuggaagggaagagcccucaguggcucccaccagcacuggcaagacuuuucagccaggguccuggacgccagaagauggcaaaagacaaagucaaugaaugacaaagucaaugaaugacaaagucaaugaaugacaaagucaaugaaugcccugcccugaagucauagcauuguaaggauauggcuguuuuaacaaauaaaagguuaaaagucgaucccuucguauuuccugacuauaaacuguguuccacaaagcuuauugauuauguauaacaugauauuguaaguauagaagccuaacuguacuuagguuugaauccuacacgugaucauuucccuccuugauaacuaugcaggcaaguggcaugccacuuuacauacccaguacaugcaauguccccgggcucaggcaggaaccagcacagauaaaaagggagggggaggggaauucuuauuucaauaagagaacuugggacagaacauaugauccaaagaaaauuuaaguaaugaauaguagguuugcugucaggugaugccgaacagucaugugaauccccuacagaacaaacaagauacaauucuagccugauuaucaugugcuaugggccuuguuuuagaaauaaggucucaaaguuuggagcuaaggcaaaaggauggaccauccagagacugccccacccgggaguccaucccauccauaaucagccaccaaacccagacacuauugcacaugccaacaagcuuuugcugaaaggacccugauauagcugucuccugugaggcuuagccagugccuggcaaauacagaaguggaugcucacagucaucuauuggauggaauacagggaccccaaaagaggagcuagagaaaguacccaagagcugaaggggucugcaacccuauaggaggaacaauaugaacuaauaaguacccucagagcucgugucucuagcugcauauguagcagaagauggccuaguaggccaucauugggaagagaggccccuuggucuagcaaacuuuauaugccccaguacaggggaaugccagggccaagaagugggagugaguggguaggggagcggggaggggguauaggggacuuuugggauagcauuugaaauguaaaugaagaaaguaucuaauaaaaaaugguuuaaaaaaaaaguugcacuuuguacaccacacuggcuucaaauccaggaauucaccugccucugcuggcacgccagacuucauuugccguuccacuuuuuaaaagccaccuagccaaccacagccaaacaguggauggagguuggggacccuuuauggaagaauaggaggaaggauuguggggugugaaagggacaggaagaccaacagagucaacugacuuggacccuuggggcuucagagucugaaccacuaaccaaagaacauacacaggcuggccuccuucacaucuguagcagauguacaccuuggucuucagguggguccugaacaacuggaaugggggcuacccaaaagcuguugccuguaugugggcuauggucuucuagcugagcugccucgucuuauuucaaugagggaggaagcaccuagccuaacagagacuugaagugccaagguggggaaauacccacagggguccacaccugcuuggaggggagguaggauggaggacuaggggaggggauaaacgggagagguguagugagugggauauaaagugaauaagaaaaguuacauuaaaaaaaaaaaagccacccagcagugaaaacacucaaagcagaauuuaaauauuaaauaauaucuugccugccacguuucauuuuuuaauuagcuguauuugaacauuucaaaauuuauugucuuucaaggcagauuuuauacuuauguucaaagguuaagguuagucucaagagugaaaaugcucauauuaacaaaagaacgcuauauacccaaguacauacuuaagaacuugugcuauguauguauguauguggauacuucugcaaggauggccuuauuauugugcagauuccuaaagcgcaaaacaauguuucugauuccaggguuuaaucauauaacuuagcuccaccuauauuugaaguauacacacugaaguaacuauguggacugaacauguuauauuuaagaauacacauguguauguauguguguauguauauguauguauguauguauguauguauguauguaacaaagaaaaagaggccaugaguuugaaagauggcaggcguuagggcugggcugggcugggguaggagaauggggagguuuggaaggaggaaagaaaaguaggaagauaugauuaucucaaacauaaaaaaaaauuuaaggaaaaaucauuaccauucuuuuaucaacauugaaagcuccuuuccuaauuaaccuugaacuaauuaccacuguauugaucuuuuuagugcuguuucauuaaccacauuauuuaaaauauaaucucaauuuauuuaaaucauucuucaaacuguuuauauucuuugaaaaaaaggaugaagaggcuggaaggcaacugagauuucaagaaauuaugaagaaacuuguccaaguuccauuugcauuuucaaaacuuugauaucuugaccaucuguuauuguguuccaaaaaaacuggccuuaaauauuuauuccaaacaagaagcaauaaacuaaaugaccuauaaccaaaugcagauauuaaggcggccaucugaaguaggaucacauuuccucuaucauuuggggaaaaugcuugcacagccucacaacagcuuguuucuagccacaaaaggggaaacaacugcauuuaguuuucgggaauucagacaugacaaacgggcauuucuuuuaaaaaguauucuggaucacauggaagagucuucuaacgacacuacugcuucucagugagaaaagauggauuuggggaagaauuccaaacuucacaguguuuccugcuuuauucucucucacacacacacacacacacauacaucuuccccaauaguuuaaaugucuguugaucucauggauacaaagucuccaauguugaagaaauaauagcuuaaauacaaaauugucacauuaggacauuaagguauauuaagaaaccagacuuuuaguuacauaccuuuaaauuauugaaaccucuucuuuacugagaauuauuguaucuuuugcuucacuauuuggacuccacacuaaaauguggccauaaacaaaauauacuaaaacuuucugugaaaugagugacauccaaacuguggcuucugaagaucuauggagaccagugguucuuuauaagcaaguuuuuuuuuaauucugaugauacaauaccuuauuacauaaauauaauacaaccgagaucaccugacugucuuaagugaauacugaauucuuuuagugcuuagagcugaagaugggacuaaccaggagcuaauaaccuaaagaaaacagcugguccaucagcguucucagggguccuugacuucuuuugagaaacuguccuaauucuagaacauuuagauaugacugaaauucguaaucuuuuugaaacauuaacuuggaugacauauguaauuuaaacgaauacuccucccaccaaaagacaaaaacucaggaccucuuuauaaaaagguaucaaauuuauuucaauauuuaguuucauuuuuauuaagacuuaacaauuauucuaacuuaaaauuaucagagaugcagaaaacaguaauaagcacuucaauacugcagugaauguugcucgacaaugcauuuagaaaagccaugauuaauuucucauguguguauuaccacucacuggaaggugcccagcuuguacugccauuuuauugcagucccugcaaccacuguuauacccaugaaaucauguucccaaauuuaaacccuuacuggcuuaaauuaugaagucugacuucauaaauuugaaauucugauuuuuacuuugaaccuauauuaaguaaagaguaacaggacaucacuacuauauugguuauaaacaauaaaaacaaaaguagugucuauguaaucagcuaauuauccggugacauuuaacaaguuuacauuuaaaacagaacccaaggugucaccagcacaaggcaucugcacugcuggcucuacagcauguuacucugcaacacauugaagcaaauggcaguguucaaaguacaaaaccuauucuauccaguacaugguauugaacauggucaaggcaauaagaauccuauauaaaguuauguuuuacaaugcaguaucuugauaauuacuagcuguguuaaaagcuaacgucagaagaaugaaaauagccauacucauuaauaaaauuuuccuuugagaaaguaaugcuuccauuccaaaaaaauaagcaguaacaauuuugaaaaagugauuaauauacuguaucucuuuucagccaacguaaaccucacuuccgguuaauucuuuuacauuccuaauauccucugucuagaacugaaccccauuuaaacuaccauauucuaaaaccauuuucucaucauuuuucacuugaauacuuuaagcuccaaaauggcaaaugagugucaguuuaaagaauuuuuacuacagguugaacagacagaaaugcuuggggcuuggaguguuuuaauuuuuucccagacuuuaaaguauuucauaauaccuugaggaugggauccaauucugaacacaagguccgcuuauauuucucauggcuugaagauaacuugauguauuuuuagugcaccuguauuuugacugcaacccaucccgaagugggcugugggcuuuuccgcucuuggcaucaugucugagcacagguguuagguuuuacagugcuucugagcuuugaauuuucacauuagguaugcuccaccuguaugauaaaugcuaacuuaaauacuugccaguagauaccaacaaacuuuuauuuccaagccuaaaaguuacuauaguauugaggucagaacaugacucuucuguacggucagauuaauucacuaaauaauacuaucaggaacagccuggaaauuucgugagaguccuuccaaagcugcagguuuuccagagugguuuucucuggcuacagucugugcgccccuucaauccuucuuuagucguuuagcuuuugcgauguuuucuugccguuuuuguuucuucuuuugcuccuucucucuggcuucaaucaucuuggccaacuuccaggacaguacagcacuagcuaggaacaguggugugagcgccaagauaacugugguaaggaagccauauggguccuuugcagcccacuccacaacauacucagcccaagccuuuaugucaagcaucuuugcagcaagcaggaagcagcuuggagaaugaagggaggggggaaagaagaaaaaaacaaaacaaaaaagaagacuauaugguuacucaaauccugaaaguuagaacacauccaauuuaaucagaauuccauuaucgcauaguuuuguuuuuucaguauuaauuaguagcauuucaauaaagauuagcaucuccauuuaggaaaaaaauaguucaaaucgaacaacacagaucauuucuagaaaguaaagaccaauuuauagaagguaaggcccacuugaacuguguccuaugggcauccuccaugccucuaauucucaggacaaaccgugcaggagcagacaaacaaagagcuugacuuccaccggcucaauucaggaaagggcugaagccggccguugcugacacaccaucaguacugcuaagugcuaauuaaccaaaguacaaaucagacuccuugucugacaucucggccagaccauaaaaaguccucccagagaaagagaaguagguguuuauuuuuggaacauagguuaaggaaaccaugaugcuuaaaaaaaaaaacaaaaaaauccacauucauacauccgggggaaaaaaagauugcuaaguuaugggcuuucaaauuugacagcucuaccaaaaaaaaaaaaaaaaaaaaaaagagaaaugcguccacacgguaagugugcaucuuggucuuuuuugaguugguaacagaggaucaccugguaaaauauggugaggacuugaguggcauuuccuauauuguuccuguuucuagcaaccuguuucaauuacagguugaauuacaaugccagcauuuagggaagguuuguguguauuuacagccaccuaaagucucaagcuaagauuuuuaaaaaccauuuaccuuauguuagaguagugaccucuaauuuuccccugggacuaucagugagucagucagaauucagacgauuguugguuaugucuucuucagucugaccauacgauguggaggggguuaaauucuauauacauauacauggaugagcuagaaaagaagacaaucaagucauaacuauuguaagauaguugcaggauauuuugaucacacugugaaccccaagauugugcuguagugugcccuccccgcuccuuagcacacaccuuuggucccucugccuggaaugcagacacgcccuuaguauacaaccuuuaaucccaaacaagguaaaguuaguuuguagaaggaagcaccauauuugaaagugaugucaaagugaugaaucagagaaagauuugauacaggauaugcccagcccucaaaagaggaaagaggaaaaagaggcuaguuaagagagcagcacagagaaagaagaaaggagaaggcaguuuuaccaggagaguuuuacagagacaggcuggagagagagaacaagcuagacacaggugaagacaaugagccagaggaugagaagccagaagagcagaacacauugcuagagucugaggucaagcagagcaauucagaagaggagaaagagaagccagauugaaucagucaacuuggcgaggaguuugagcuagaacagcuagcugaguaagugaguuagccagcacacaggaagaacaagaaaggaugcgcuuuucagcaauaagucucagaagcugaaaacacucuaggccuagauaagauuguguggaggcuagaagcuuccgggacuaggccuggguuagcagacugagcaguaagccucaaagaugacaauuacaacaggagaauaaaagauaccuuuacaguaagauuagaaauggaaaaaaaaaaaaaaaaaaaaaaaaaaccucuaaauucuccucuaaacacaaacaaguaaaaacaucuuucuauaauaguauagccucuuaacaccuauuucucccuaaauuacaacugcaaaugucccaaaauaagaguucuaauucguagaagccaaguauucuacguaaauuauuugaguacuaaaguuuugucugaauaauaaugacuuucacuaacauaaaaaaaaucaagcuggcuggcugacauguuacagguaccauacccauaaagauuuuuaaucuuugcgucuacuguuggggauccaacccaaagccuaguagagcacaguagacagaugcuccaccgcugaccaaccaagaauuuaaacugcuuguacuuaagaauccucauuuauucguuggauuggguacaucguuacaaagucaaacacuaugcuuugcucuuuaaagguuuuguggucuguaguucaauuaauguaccuuacaagaaaauaaagaauuaccaaaauaauuaugguacccacaacccgucacaucaagaaaacuaucacuggauuuaacuuccauguccccaugcuaucuccguauuuguaucagaaaccaugccccuacuuucagcacauuaaacuuucuggagacguuaaccauccagucccuugucgcuacgcccucgcccaguuguaaccaguuugcaggaagguccaagaaagaucgaucuuucucgaguccaguaacgaacuaaauacaagucugcgaaauccgcccaacuuugcaaauaagacuagcgcgacuugaugacuaggcuauggcaaaguuacgguccacaggccacacaucucgagagcaccucagucucgcaccaaaacauccucgccuuacuuucaggcacauuccuucaccucacaaagccuaggggacccggagcugcaccaggcgucucuagacuuacagcuucucuccuaacuuuccccgcuuagcauucuccuugccccgggccauguccacggccaucagucggccucaccggcuaaggacgccgccccgccgagcgaagccgggcaggacccgcggucaggagcucagagagccgggagagcccggccacacgcucagcuuaggcuacagcaagccaccgcagcccuaggggauccccgcucccauucccacucaccgccaggcaggaaaguggaaagcggaagccgcuccgcucaggucccgcccgaaggcggggcggggcggggcgggaugaggaaguggcgggcggguuuccggcggcgcaaugucuagagccauagcgggagggcggggaggggcggcgcggcgaggcgaggcgaggcgcggaggcuucguguccgcggucggggaugcugccgcgcgccgcuucgugugcgcugcagguggggcaucguggccucgcguccugcgugggacgccggcgaggagacggagugggugaggaguucguccaggggacucucagcccagagagccgcagcuagacacgagggggaccccgcagucuccuuagagccuucucgaggccguggaaggacuggcguguucccuaacucgccccucacucaugcuguagaguugaacaauaguuaaauauuuaaagauuuggccaagcagcagcccggcugggauguguccagugaaccuugguagcagggggaaaugcugccacgcugugggaaagagguuccguuguuuguuuuucauuuaagagccuaacuuacuucacaaaggaauggucgauacuugccccaaaguaaacugucaauaauuaaacugucagggcauagagaucgcaauacauaaauaaaggacuucaaaaagucaacaagcagaaaggggugcguuaaaugggucuccuaaucuacagggacggaaagauuagcucugguuugguuggugcucaaauuuugugauugcuugccugaacuacuugcucuguuugacugccucuggcgaauguugcaagaccuccucgcuguugugugccaaauaaagcaaguuuuuauuccugagagacugugagcguucccuuugaggagcaagccgagacauguaugaguaguuagaguauaacaacaguaaccauuauuuaccaaggagcagacuuuggcagcuaaucuaaggaucuaaaauacugcuacccggguauaugcuaauggcugcauauuguaauggcagccgugguuuucuuauucuugugugaaagccugaaggauugcuuaaaaccuguacaaacaagcguacccauaaccggcuuguauccauaaccggcuuguauccgugacauguucacuucaguagaugguuccucacaaguucugccucccaguguguugcucuguuuuaucucuaaaggacccaggguccccgcaagucuugggaauaaaaggaagcaguaccguaaggaaggaacugaggagggggugcaccagccuaaucgugcacaguacacacacuuacaacggagagaaagaaagcagcaagcuucuuuggcuauuggagaccuagccuucacacucagauuuuagggcucucucuucugguguauuaggcaggccugugcaagcccaagaacagcauagagguugccauggaggacagccuuacuggggccugcauuaccuuaaccaaagaugauaaguaagauaggcucccaaaccaugggcugacuguuccauggcgaggucagcuuucuagucucuguacugaugccccuacagcacucauucucucugagccuuuuccucccguauaucuagagggcauucuaguugaccucugaucauucgggccccuucagaucaguaaauuaguguaucuggccaguccccuagcucuuuauccuuucugggagagggaguagucacggguuuguuugaaagacucuugcuauguagcccagacucuaccugagcucugggucauugugguccacucucuuaaguaaugggauggugggcggucaccaccaccguugucuuaacuuggauuuuauucucccaaaugucccaaaugcauuaugagauaacaacuaauacguucugccuuguucuuaagaagcagauuuuagccagguguaaccccgagacuugagaggugaagacaggaagaugaacaaccuugguaggcguacagugaguuugaaccauucugggcuacuugagacccugucucagagaagagguaggguguuaagguaguucccauggagagcagacuaggaaaagcugugugugcaggauuaaagcagcccacauagcagcucugaagccaaggaacagcugcacaauauuuguuauugcacaaagccuuuaaaaaauuguucguuugcuuuucucuuguaagguaauuccugguagacuugucauuccuuaguuucuaaagucuuuuuuuuuuuuaauguuuguaaguacaaaguuaagucucacucuaaccaugugucaaugaaaggcauguacccugaauaagauucuguuguuguaauaauguuauuugcucugauuaaaagaugcugaaaggucucucaccuguacuuggccuuauuuccuucccuccaguaacccuguacauauguaacuucuuuugauggaauuggguuuuaucccugaauuuuauuucauaaccuuauuuaaauaucaguugaguacuuucuguguacccaguacugaagucagugccucucaaauacugucacuaaucccgaacuaaaucacccaucaaaaguucauguucuuauacagguuuuccaguuuaacaacagaagacuuaaaaaguaaagcaggauucuaaacuuauuuuaucaaaaucucugcucacuccagucuuggcagaaauguuuucucuuuucuccccucccccucacccccggcccccaaaguggaguuauguuuuuagagucugucacugcugacaaaaacuaaaauccccgacuugccuaguguccaggugguggcagcaugucucagagcuagcgugcuggggaaggcguuuccagccgugcugguuggcugcuugugugaacgugcauaaccugccucugugcagagcucucacuucuccauuuaucgacccaucagugauucaucccacuauagccuccucuucugguagauuacacuucgggaguuucucuucagcuucuuuuaucuaugaagugucuaucagacucuuucuagaaaacucauuagggccuaucaggccagacaguguuauuucaguuguuauuuuuaaccaacauuugguauuauugggcaguacugaaaguaucaauauuagcuaauacuacuaagaaacgucugcuuaaauuaaaggcaugugucuuacacucacagacucaucgguguaggagcuuaggaaaaacaauuaguacucaaaagaguaagaaacucaacagggaguaaugcaagauuaucauuucuggggcuaaagagacagaggguaaagacgcuggcaaucaaggcugaauuccauccccagagcccgacucauggaaggucagacacacacacacacacacacacacacagagauggcuuuuguuuuuguugaugacuucuugggaguuugcuuuuaugccuuugcagagcuaaugccuaugaagggggcuggcaaacaauugcugccuucccacccgaguccuccacagccaccacugcucugcuugcacggcucuucagucuggguuuacuggcuucuugucucuccuagacaguaaccuagacaguuuuuuagaauguaaaccccaggauuaguugccucaaaaguaugaacaucacuguaucauuguugcaguacugggcugaacccagguguguggcacaugccacccaagugccuaguccuguccugugugugaccuacauccuuuugcccuuugucauuuaaugucuuuguuaguuuguuugaaacaagggauuucaguuguuguucuauugauguggagagaaaccgagaccaaggaagcuuacaaaaggaagcagucgauggggagcuugcuugcugggugagaggguuacuccaccaucagcauagcagggaccuggagaaguagcugaaagcucacaucuaaaucacaagcagagaauaagcuagacugggcguggcacacuucuaauuccuuacuaaacagcccauccucuggaaaccaaguauuuaaacauaugauccuaugggugccagucucauugaaaccacaguguauugcuaaguuggccagucuagucuugaacuugcuaugguuuuaaauaguagauuucaggguauaguguuacucaaauaccuguuaggguuggaacaaauuaaguaaauuaaguccuggguguuugugaagcuuuuguuaagugcugaggguuggaagauuuugacagcgauaaaggugccugggaagggauguuagugucaaacuuaauaaagcuguuuguagaucaauacauacaucgugguuauagcccauuaaugaacgaaguuuauguagugcuuuccaaguauguaaaauuaucuacaggaaggaaggucgugauucaucauuuucacugauaagauaaaaagaauuaguucuacacgauaggugcuaaaacuuaagauaagagcagcuggacuacagaucuaacuagagauacugaaaacgggauaaggauguauaugcagacuagaugcccuuucgagauauguuuuagccuuacauucccggugcagacugcaagaggagcagaguagauagcaggagccauccucgguccuuugccugccagggcuauuuccauacaguuuugagccaguuggaggaggcacgugcuuguuuuaucuuuuucagucagugcguguggcuguauguuacugauuugggucauuuuuaggcuuuuguucacauaaugcugaaaauuggaugccugcuguuuuuaacacugcucauaauucuuaauuuccagaaugcccugcauaugcacaggcggccaacaaauguccuguaguuggaggacgcccuuucgaaugaggaaaaugcucuaguaaauuccugcaaagcucugggcuguguaauccuguuaaaguuugagaggccucuuggacuuucuucccgagucucgaugcucagaugucaguccugucucuuagaugagucagcuggcugcuaugucaagaugcccuuuguuucucugcuggauuuuucuagucaccaaacagaaguuacucgcccauugagaaaagcaauccauguauuagauucacacuuuggugugaagucuuccuugacaaaauuggcccagcaccaccaccuucaccacaucgcuuuuuaacuuuaagcuucugcauauaagcuuguggcuuaaauagcaguuuuuaaaaauaguuauguuuccuaaaugaugcuaucaagaacauuuuaaagucccauuuaaagacuuuugugaaaugugauuaugagaaagguuuuucaaaacuacucuuugauagaauugugucuuguugauuugacugucaagaaacuuugagccaaauuugaaauucauguugaucauccacccuaacuucauauguccuaagcauacacuauaccagcagacaacacaccaaaccucuacauuucuuuagauuauuucuuccuaggguagguauccuacauaacauuuguucacccuaaguccuuuguuaagggguagggguacagguuaccuuuaaguggagugugaaauuccacacuuuacagaaaccccugauguguaacaacuacuuauuugcuauucaaacucuugcacucacuuuuuuuuaucuuguauuauaaccauuaagaaccacuucuucaaauucagaacuaaagaaaggaggaaaucaaaauugcuuccuaaggucuaauucuaaaagccagucuguguccuuaggaccacugcccccuauccccaccaccaguauaaaguauauauuuggaaucuagcuuuuaaaaguaaagaaacauugaaaaugccaggcuauaaauaaagcuugcuaggccguuacuuacaaacauccugguuccaacauuccucccuucauugucuuacucacauuugaugcuuugguaucucccaacuuaagaagggaaacggucugaauucagacgcuccauuuggauuuuugugugcccuuuuagccccuuagaaguaauacuaugauuuuuccagaggcugugaauuuggaauuuucaauuuuuuaaauuuucaacuuuuaauuuuccauuuuacuuuuaacauuaguuuucuacuguauuacacauaauacacaauaucuaccuucagacggaucuguauucuugaaauuaucuuuucacgucugccuuugaauauaagaauacauuacaaugguaggauuauauuguuaaugaacauagacgcuuaaguaucugauuuaauauuucaguuuauuuuuauucucuuguggaagaaggaaaucuaauuuuucuguaccuugguucugauauccauaaaaaauagcaaugccuauuuucuguaaaauaaugacuacacaugaacuccuuuuccaauuaaguauacugcaguccauuguauauguguguguguguguguguguguguguguguguguguugauuauuggaugcuuacagugaucauuaagagguuagugucacuaaggucuucauguaagccuguauuugccuauaaaccuaauacuugucaggggugggggcacaugaucaggaguacaaggcuaugugaggcuccagcucaaaacagaaaaguccuaucaauacauauuuaucacagcccaagugaaaaaagcaucucugaaaaaaaaugauagaaaguuauuucuaacacuauuaagaaaaugauaaaaauuaaaugaguuuuuuaugcuuugugcuacaguaagauuucaaagaauguagaagaaaaugaauuuuuauggguucauauucaaauuuuugcucccuagaaaauaugaaugcuuagccaccauuuucugaccaucuuacucuauaagcaauccaggaaauacucuuucuugcaucuguuuuccaaucugcuaaccccuuuuauacuucaggaaacuaaauccacauaugguucuauaaauuauucauguguauauccaaugcauauguaauuuguccauauacguuaaucuguaauaugucccucacaccuccccacauacacauacaauagaaugaagacuuaccagacuggccaagcuuccauguaaacucucaguaugacagagaccaauuuauuguagaucucugcaguucugagaugcuucacagggcagugauucagagucuagacuaugaacccaaacugccugguuugaacugcuacuuacugggacgauggagcuacuuugagaauauacucuagagacaaccggaggccaucaccgugucugugucagggccuugguucuuucugcuccauagcuaaucacggcaaaaaguggucgagcuagcaugcuuguagacaugaaaauccuccaauagccaauuauguccuuuguuuuguuaagccuuccuuaggcuacguggucuagaguacuccacccaacauaccuccccugucacuugcauuuggggucacacuugaacugucaagugauaacccacccagucuuucccagauccuuccccaucucacaaaacuccuacauguguauuccucucuuggcauguccucggguaacaaaaucgagacaccaguuuuggugcccagggcauucauagucccuggcauaagauagaagcuuauguugaccugggacaaugucccaguggagguaaauaccauaguagguguaagaauacaagggcucagaaaacagagugggguugaugccuaaaagacagcaagauuggcuggauacccguguuggaguccuuaagaaggaaaacgugggaagcacugugcuaacuuauaaagaggccuucagcacagagcagauccagcugaacuggggccgaagagcucauugcuaagaggcacagcacuccacuuacauuugggcuuugaacauguaggcaagucuguuacaaugaaggcagagaaagguaggauccugaacauaaauaagaugaggucaucucgucgguacccauagacucccucugauuuaacuggcaugccuggugcgauagaaaaacucucuugccuaccuccucccugaacugcccuucacuuccauuccuggcugccaagccaaucacuaggauuaaaucccagcacacaccaacuaagacaagugacauguucuggcagaaaccaggagcguacaccugggacuagauauuaacaguacuugauucuguggauugaaagcuauuaugauagagccaaaugacaaacugaaacugccucuuguuccaagacagaucagacacgaaaguguauguuaggagaagacaaagauuugugccccaauuuaagaccuaaaggacagaggggagauauuccugucuggaggcaucaauuugccaggcuggucucuaaaauuggaugggucuuggagaaugacuaugggccaucacugacuugaccaaacaguaacugagaucugagccucuaccacaaauacacagcauacaaccauugauuuggcaagugcauuuauucucuuccacuuggaaaagaaacaccuucacaaaauacaggcaauaauaguaauuuggaaugaguuuugccucaaggcuguuaacgccuccacccucaaucauaauaagaauggauuaaucugaaucauuuaaguguucguuagaucaauggccugauccucuuuaucgaccacauuguacuguuuggauacaaugaacaaaggacagccacuaugcugaauaccauuguaagacgugggugcuccugauggagagggguaaacgcuauaaagauuaaaaauucuccaauuuuuuuuaauguuccugcaugugugugcgugcauguagaggucaagugucccccucaggaaugccauccaccuccuuugagauagggugaaccccugggguccucucugucuccccagcacuuagauuacaaguaccucccaccgugccugcauuuuuuuuaauuagguauuuuccucauuuacauuuccaaugcuaucccaaaagucccccauacccuccuccccacuccccugcccacccacucccacuuuuuggcccugguguuccccuguacuggggcauauaaaguuugcaaguccaaugggccucucuuuccagugauggccgacuaagccgucuuuugauacauaugcagcuagagauaagagcuccgggguacugguuaguucauauuauuguuccaccuauaggguugcagaucccuuuagcuccuuggguacuuucucuagcuccuccauugggggcccugagauccauccaauagcugacuguaagcauccacuucuguguuugcuaggccccggccuagucucacaaaagacagcuauauuaggguccuuucagcaaaaucuugcuaguguaugcaauggugucagcguuuggaggcugauuaugggauggaucgccccucaacagaggaauggauacaaaaaaaugugguacauuuauacaaugaaguacuacucagcuauuaaaaagaaugaauuuaugaaauuccuaggcaaaugguuggaccuggagggcauuauccugagugaggcaacccaaucacaaaagaacucacacaauauguacucacugauaaguggauauuagcccagaaacuuagaauacccaagaaauaaguuacaauuugcaaaacacaugaaacucaagaagaacgaagaccaaaguguggauucuuugccccuucuuagaauugggaacaaaacacccauggaaggaguuacagagacaaaguuuggagcugagacaaaaggauggaccaucuagagacugccauauccaaagaaauuaaagaucucagaagaugguaagaucucccaugccugcauuuguaugccuguucugggaacugaacucagguccucauguuguauugccuauugcccaagccuuccuacuugagacaggcuuuuaaagguccugcacacacaguguuaguaguggggaaaggugccauggagagguuauagagauuccaguggaagaaucauagcugaagcuuuuccaauucaggagcaggugaugccacagagaccugaaggcccagugagguagcuguucucauggcacugaacccaguagagacccagaacagaggacgugaaaauguguccuuccuagccccuucaagcauuccagaaguauuuauuaguccacauucugugaaaagaaaacauucuuccuuucuucugucucugucuuuucauuuauaacacaaugcacucacaguguuuacucgacaaauuaaaacccacuaugauuauuuauuuugauguucugaauaucccugguuggaccaauagaagccccaagugccuguauccuuuucuuaugucaucacucauugggcccugucuuagucaggguuucuauuccugcacaaacaucaugaccaagaagcaaauuggggaggaaaggguuuauucagcuuacauuuccacauugcuguucaucacugaaagaagucaggacuggaacucaagcaggucaggggucaggagcugaugcagaggccauggagggauguucuuuacuggcuugcuaugcuugaucaaacuucucuucauaagacuuaaccagagaacaaagucucugcugggcuguuuugaaacuuccuuugucaauucauuuaauuugagucccuucaccuuagccucaggcagacuuuucagacaagggcaaaaaguagccacauucuucaccaaaauaccacaaaaacagucuuuaugucacauucugaaauucuucuccuuugaaaucucuugggccaggucaaaacaguucaaaucacucccagcaacaaagucuuccauauuccuacuaggaugacccauuaagcaccauuuaaagcauuccacugcuuuccaaauccaaaguuccaaaauccacauucuuucaaauaaaagcauggucaggccuaucacagcaauaccccacucccaguaccaacuugucuuaguuaggguuuuacugcugugaacagacaccaugaccaaggcaagucuuauaaaaacauuuaauuggggcuggcuuacagguuuagagauuuaguccauuauuuucaaggugggagaauggcaguauccaggcaggcauggcgcaggcagagcucuaugucuucauccaaaggcugcuaguggaagacugacuuccaggcaacuggagugagagucuaaagcccacacccacaguggcacacccuacuccaaccaggucacaccuauuccaacaaggccacaccuccaaaugaugccacucccugguccaagaauauacaaaccaucacaggcccuuuauuaauuuuugauacaagaagaugccccaggcucaucugcauucucagcuccaauccuaggauuagcuagguuucugaggagcccugcuuauuuuccauggcaaaugguauuccauaucuaaaaccucaaugccggguuuguucaagcuacuggcaugucacuucuugucuggcaugucacuucuugucguucucagcagacaguuacacuccuaucucuagcuacuucaacguauuaaaaaaaaaaaaaaaaaccacaaguuugggucaguuaugauaauacaagccuuuauuccagcacucgggaaacagagaggcagaucucuguaaguucaaagccagccuggucuacauagugaauuccagacuagccaagagugcauggugagauccugccucagaaaagcaaaacaacccaaaaggguauucugauccccucaggaccauaucaggaguguguucuaggggcuggggagacggcucagcgguuaagagaacugacugcucuuccagagguccugaguucaguuuccagcaaccacaugguggcucacaaccaccuguaaugggaucugaugcccucuucuggugugucuugaagacagcaacagcguacucauauacauaaaauaaauuaauuaaucuuaaaauuuaaaaaaaaaaaggagugcauucuaguuuucccuucugccauauuucaaacucacucaacagacagaaaccugauuggcauuagcuuccauauucauucacuccaggguacagcauacagaaaguaauuucagaauuacucucugauauuaucaugucaaaaacaaaaaacaaaacaaacaaacaaacaaaaaaacccuuuacuggaguuuuaggugaucugccccuucucaguuaucauucggcuuuggucacugaagugccaacuguggagcaaacuuaauaagucaagcgugggccccauguagccauguguagcccaugagcaggagauccaacacucuaggccgucuacguuacuagauuuaacugguuagauggucugacacaaaacuguuuauguuggacaguaguaacugaucgcagcuuugucgugugagucuuagugcuuguaaucaugucacuaggaauugccaccucagcugaaagaaagggcaggcuucccccguggugguguuuaauccguauagaagcagaccauaauagauugcuuuuaagucguuucuauccagguaaaguacaugaagcuugguucucaguugugucuuuuuauaucuugcauuaugaccacguccuuagcacacacacacacacacacacacauaucagguuuuauaagacuuuuguucaaaugcuuccgaacaaauauuuaggaaaucauucaaaggaaaaggcacugucaaaggcagugcucccaaaguggaaggcuggugcucucaacacaaaaacaauggaguuuuuaggagguggacuguuggaguuggaacagaaauucagagauuaggguugugugugaugggcaguccgucucaagcuuccagaggacagucguuugugccuucaugaggguuucuucucaucugggguacuucauuguaacuugcuaaauaccauuaagcaacuuaaacuuacugcagugguuugaaugagaauacccccauaggccccauauacuggaauccuugaucagcacuuggugaaacuacuugggaagguuaggagguguggccuuuuggaguaggugugugaaggggcugacuuucagaccucaaaagccuccccaccaucccugauguucuuauucugcuuccugcuuucagaucaagaugugagcucucagaugaugcuccugucaacaugucuuccguccaccaucauggacucugaccuucugauacuauaagcccaauuaagugcugccuuuuaaaugccuugcuuaugguguuuugccgcagugugguauuuuaaauaugaucggcccauggggaguggcacuauuagaaggugucacuguggggguggccuuugagguccugucuuagucaggguuucuauuccugcacaaacaucaugaccaagaagcaaguuggggaggaaaggguuuauucggcuuacacuuccaugcugcuguucaucaccaaagaaguuaggacuggaacucaagcaggucagaaagcaggagcugaugcagaggccauggagggauguucuuuacuggcuugccuccccuggcuugcucagccugcucucuuauagaaccaagacuaccagcccagagauggcaccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacaauugaccccuugucaacuugacacacaaacacaucacuaguaagccucaacccucacauucuuauucauccccaaggucuaaauaacuuuaaaugucccacauucuuuacauauucuuaaaauuucaaucucuuuaaaauauccaucucuuuuaaaauucaaagucuuuuuacaauuaaaagucucuuaacugugggcuccacuaaaacaguacugugggcuccacuaaaacaguuucuuccuucaagagggaaaauaucaggucauagucacaaucaaaagcaaaagucaaucuccaaccguccaaugucugggauccaacucacgaucuucugggcuccuccaagggcuugggucacuucuccagccaggcccuuuguagcacacgcaucauccucuaggcuccagaugacuguaccccacugcugcugcugcucuugguggucaucucaugguacuggcaucuccaaaacacugcaugaccccuucaguccugggccuucaauugcaacugaggcugcaccuucaccaauggccuuccauggccucucacagugccgagccucagcugcuuugcaugaccccuucaugccuucaaaaccaguaccaccugggugacccuuacauauuaccaagucccacugcagcaggaguacaaucuuggccaucucuggaacacagccucuuuaugcuuucagaaaacacuucccagaagaugucaccucaaugaugcugguaucuucuuaaucaccacuaauuucuuagcuccagcuaaccagcaucaauagucccaguaaugcaacguuuuugcuuugguaguucugguaucuuguuaaucacagcugauucuucagccccagcuaaccagaacuacagaaucuucacaaucaaaacagcaauggcccugaaaagagucuuuaauuuucccucugaaauuucacaaaccagaccuccaucuucugcaguguucucaacauuaucuucuaagcuccuacacaacauccaacagagcucuuaacaacagauggaucuucaagcccaaaguuccaaaguccuuccacaguccuccccaaaacauggucauguugucacaggaauacuccacucugcugguaccaauuugucuuagucaggguuucuauuccugcacaaacaucaugaccaagaagcaaguuggggaggaaaggguuuauucggcuuacacuuccaugcugcuguucaucaccaaagaaguuaggacuggaacucaagcaggucaggaagcaggagcugaugcagaggccaugaagggauguuacuuacuggcuugccuccccuggcuugcucagccugcucucuuauagaaccaagacuaccagcccagagaugguccuacccacaaggggccuuucccccuugaucacuaauugagaaaaugccuuacaguuggaucucauggaggcauuuccucaacugaagcuccuuucucugugauaacuccagcugugucaaguugacacaaaacuagccaguacagguccuaaacgcaagcuuuucccaguggggaagagagacagccuccuucuggcugcuuauaggagacagucuccuccugguugccuuuggaucaaaauguagaacucucuacuccuccagcaccgugucugccugcacgcugccaugcuucccaccgugauggacugaaccucugagacuguaagccagcccccaaugaaauguuugccuuuauaagaguugccuuggucauggucucccuucacaacaaugaaaaucuaacaaagacacacaccaauagaaaaguaacuacucugcgugccaucauagcaggaauccgagaacagaacaaacaugauugcaugcauucauacugauggagucuuuggggaaggcuuuccuccugugcuucugugguuguuagcaugaaugcuggcuacccuucgguagaguagcuuuagccaagagugugagaaguguagacugcuacucucaccagccugagagccaugcaugagcuugccugucuuccuuggcauuuuacccucucuguucaccauuuucucuucacuaaaaucagauuuaguguuguguccucacagugcuuggccuauuuucugugaacuuguauaaccaagaagauguuagggagauaaaggaaaaucacuuuuaaucuuugaaaagcacacugaccuaauuuauaagaccacaugcgggcuacugcuguacagaugggccugguuugauacuaucucaccuaaauggccuucaauuaaucuaucuguaguuauauaacuagucaaaauuauagauuugugauuagcuaguacaccugucuguugacuuccagaucauuucuaugaaagccuucagcaucgguuuuacauugaugggcuugcuccuaguguuaagaccgucuagcuggaguuucuuuaacagagguuaauuuuuaagccaaauguuauuacaugucuagguaggcagcuuaaggacagccuccagucauauccacuuccuaccaucucugcucuuucuuuaucccuuuaucugccuucccuccuuacccaaccucaccauuuuuuuuuagcucuuucuuacuuuuuaguacaaaaauaaauguauuccagucucaucuucugcuuccucagcuccgauccuagaaucagcuguuuuucuagggguccuguuuauuucuggucgagaaugguauuuacggaccaaggucugagccgggggggggggggggaaggguacaucccacucuggauccuucccacuccucuggcuuccaccucgcucuccuuuuuuagccucucacagaagccaguugucauccucugaacugcucuaaugaaaagcaaggaccaaaggauggcugagggccaacagccacggagaaaaucaauccugucauugcgagugggucuggacgcacccucuucuuuccaguggagccagagguggcaccagcuugggcuaagccuuugaauguggacuugcaaggacucagccaaguugugucuagauuaccggccaaaagacaccuguaagaguuaaguuggguguugguaguugcucacuuuuggaguaauuuauuacuaauucauagauaaccaauaaagagucuuuuaucguuuuguuuuguuuuuuuuaagucccaaaagaccuuccuauuucccauuuccuuauuauagcucuaacuagcauuuccaaguaaaacaggaguugugagacccuggcuacacauuagaccaucugagaaguaccuucacuucacaaauucaauucaauucaauuggucuaggguagaacuccugucucagucacucucaaagucuuccauggauuucuaguagguacauaaagaaucacagauggaucacacuuauuuacuuauuuauuugacacuuucugaaugcugcauuugaaagugacaauagagaauacaauaugauacucaccuaccuucuagggaaagagaccaccaggcaaaacagauuuuaauuacaauaaugacaaacguuccaauagaguugcaagauaauggaaagaagauggaaugcccuaagucaagcuuguuaaaaucagaacaggcgucaucuagaaaaauguggggcccagauucaagguaaguauaaaaccagugagugguuuugaaugaacauagcaaaggaguagggagagcuaagguguccaguugucaaaugagcaaggagauggcauaugauuauuugaauaaaaagggaggacccuuuaggaguagggggcugcugacagaacacuuguguuuuagugauguguagucagcuuuaauaagucuggggagaucuuucuuccuucuccuccuccuucuccucuucuucuucuccuucuucuucuccuucuucuucuccuucuucuucuucuccuucuucuucuucuccuucuucuucuccuucuucuucuucuccuucuucuucuucuucuucuucuccgucuucuucuccgucuucuucuccgucuucuucuucuucuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuucuccuccuccuccuccuccuccuccuccuccuccuccuccuccuucuuuuuucuuuucuuuuuugagacaaagguuagguaucccaggcugcccuugaguuuucugucuucuugguuugccuccgaaagcugggguuacacaguagggcgccauggugcuuugcucaggagaccuugagaguuagcuguguugacucugagagcacgcguuauuucaggacaaccacagacuccauucucacccucuggcuguggcuuauucaguucuuucuuuuuaggcaccuuugccccaagcuaaaguguuucuuucuccagcaaucaguagaauaugagcugacaucaucagacuuuuuuaccuguauuuuauuuuauuuuugaggauuuuauacaugagcucuguauuuacaucuucccccccccaauuuuccuguuuccuuaacuccuucuaaaauucaugaccucuucuuaauuauuaucauuacauaugaaugcauauguacauaugcauauauguuauauaaauauaacaauaauauuauacacacccacagacuggugaguucauuuaguguucuccuauguuuagggcugaccgauuggcauucugguuuggagccuagccuuuaagggcugagucaucucuucagcccagggcuggccacauaggguuagauaaccaaugggggaggggggcuccucccuggaagagacugauucgcccucucuuaauagccauuaguugccuguagcucuucaucuccagguagggacuugugagugauagcauucauguuccucguuaacaauuuggucuuuguuuucuuuucaaagagcaguacugcccaagacguuucugcccagagugucagggcgagcguacacguuuuuacuguggauccaugacacagauggaugccaacuuuccagcugcaaucugcucaccuguugggcagggcucuucauuuuuuauuaaguggugaagaacacauaguauucccacugccuaaucuggaugcuuugagcuuuucaaucuguuuuuccuucuccuuuauucuggauagcugcuguguccccacaagaggagggaccgucauagagaaacacagcugaacuuuacuguggccaaaagaaaaagaaaaaaaaaaaaaaaaaacaauuacaaggucuggucuggacaucgagccugaggcugguguuuaaaaaaaaaaaaaaaaaaaaaaaaaaaaaaaaaaagcuuaugucugcauaacuuaacuuguaucucuucaguaaaucaaaccugcaauuccacuugacugcaucuaagucacuuagaugucugccaacaagaacauuaaugaacucaguaucucacgcagguuuguucauguagagcacacgauugcuuagccuuccuuccagcugcugccugggcuccaucugaaggagguagaaaaaugggaccaggauauuguauguuguggucuucaguuccucugucugguuuuaagguggcauagcuuugaaaaguaguaauucuuguccugaaaaaacauuaugaagcguggcugccuccgacuuuucuaccuuuauauaagugcccauggcaccuaacugauuauguuguacuccugcuuuuuugugucucaguuuaccuugguggauuuauaguuaggggauuauuccagaacacauuguuccuccuuagaugucuccaaauggcaugagaccauuaagagaaaggugcuaaaguugaucugaauuuguugaaaauguaauagacuuuuaaagagaucacuuguucccagacuuuucugcagguggagucuaaugaaggucuauaaaauucuaagucccaggcuaugugccagaccaauuaacucacacuucuaaggaugggcuucaggcaucaguaguaguuacacuccacaggucauccccauguguagacauguuuggaaaccaugaucuggacaaggcugucggcaacauggcugugguucauucucuccuccccagcccugccguuggugguauguuuuuugacuuuuuagcaucuuucauaucuccauccacagagaacucugagcauguaagccuaagcaggaacacugggccagacauaaaugaaaggugacaagcauugagggggcaaagacccagauguggauguaaaagagaugcuuguacuuccugcuggguugaggcuaauuuuuaagcauguuacagauaaccaaguuucuuuuucccucuugcaguuucagacaccaaagacuucucagguugugaauucuguauaaugagucucaugcuguaagcuuuagaauucugacuugguugucuuugucagguacagccugaaauaggaaguccuaagagcagggagugaggacuguccauuuguccugcuuaacgaaucacaaucugauguaaaaagguagguauugaaaaaccuuaacuuucugcauguagauaauacaguacuuauuuauguaaauaacuacuuagcuguccagaaacuaaaaggaaggugauuuuaauuauagcaacaaauuguucacucguagguaaauguacauguuggagcucagagcucuaacacugcacaaauaauugcaugcuggcuuauaaaauuuuagaacuagcaguuauuuugcuagcuguaccuugggagagauagacugaaauaaaauuauaacucaaguuuuuggaugauugcaauuauccaaauagguauggcuuugacuuaaagaaguuaugaacaaccucucucucucucucucucucucucucucucucucucucucucucucucucucuuaauuucugaucuauugcuuacguaaaaccuuccaugcuaauauguaaaaguucuugaccuugugcuuaauucaucucuggcugcuagcauugagaagagaaaaccaaagacacacagcuauaaucuaaucauucauaauaucucuuaggaaaaaaacauucaggaaacaauucuuguugggaaaugcauguauguauguuuguauguauguauguguauguguauauaauauaauauaauauaauauaauauaauauaauauaauauaacugauauauauauauacuauauauaauuguuugggguguauucauacaaugaaaugagucccacaggauauaagaaguuagcucccaguuuuugguggcuauaaguccugacuccuugacuaacucaccacguguugauuggcagacagcaacagugggaccaccauuacauauggggcagagcagagagagaggccaggcuuacuaccuaagagcaccucauggaccucaguggaggcacuggggagacggccugaugauuagaagcacuggcuucucuuccagagaaccguguuggauucccagucccacaugacagcaagcaaccauuuauaacucuaguuccgggagaucugaagccuucuucuggccccugcaagcagugaacacacauugcauggacacacacacagaucaaaacacauaaaauaaaacaguaaaucuuuaaaagaaaccuuccgggacuccagagcgcuaccuggccaaggcaugcaacuaugaacuucuuucuuggcuuaguccaaggccucaccuuuuaaagagacagcuaccucuaaauaucaccacggagacccaggcuacacuauaugaacccucacagggacacaaacucuacuaagccucaacagggugacaaugcacaugcaccuuuuuagaaacaagcuuuugucugagauguggaaauuacaauggucaucauuuuucauauaaaaauuuuagcugugucauuacugaggaagggaaggcuagcuguagugucuuacuagcaugcgaggacauagaguccaagggccugugucugcauuacagcuacucuaauacauagugacauuuuacucgucuuuugcuaaauucccuuuuuaauguacaaguuuacauuuuguccuagagggcacuuaugccaauccacagaaaaugucaucuccuaucugccaguuucaaauuucaucccaaggaagagcugccauugcaugcauaagccaauagccacuaaucaccauacacugugacuuugaauugagccuuggaauuuguaugugaaugugaauccuuccggaaauuaacucagugacaagguuacaaguuagagguggcauuccccaucuugucacagaagcaguuauaucuggagaagccgccuuuggccuguugucguuuguuuuuuuuuuguuuuguuuugucaaacaguggacuaucauguagauuaaacaaccuaacuucuaaguaagauuguuuuauauguauuuccuaccuccugcuccuuuugcagaaugcuggcuuuauuaaaacacaccaacaggaaacaauuguccugguuagcuucaguugucaauuuccuacaacguacagaagaaucaguuaguugguuaagguuuaagucagauuuaccaucaucugguccugggucaguccguguuacuuugguuuucuuugucaaagaaggucagaaaacaauacagacagaagcaagaaacugucccccaaagcagcaaagcacugaagcuucugggucacaugacauuaccuucaaguaaugucaugaagauauguuugucucgagcacugcucucaaguuauaucagaaucaggaaaaagagaaaaaagacgaagaaucuuuguaugcaagccuacucucagccaaaggccaugcaucugcaaauguucaaauauuugcuuguaaccacaacuguggugaaaaggaagaaaggggaggggacgaagaagagcgugacuagcacaucaggacccuugcagucucuucuaagccgccgcccuccccacguguguacccauucccugaaugaacuccaggucucuacuuaaguauucccugucugcuuuuccuuacaguucugccacaugagucaccacacagacaaguggggucccuucgucugguuucuuccauuccuugugcguguugcugaguuauucauuuucaguacuauguaguauucuguuguguaaacucauagccaccuguuucagccauccuguugggaugaacauuuagcuuagaugugugucccuacuucauaugucacuauggauauucuaaaugcaccuccccccaccccuuuccaauguuuugagacaaggucuugcuauguaguccauucugaucuugaacucaugaacuuccuacucagccacucaagugcugggauuaugucucaaaccaccaugccuggcuacugugggcucucuuccaccagcucuuagugcuuguaggcucauauuaauuaauuaauuaauuaauucuuuaauuaauaauuaauaagaaauuaauuccuuaaaucaaugauaaacauaccaccauucuuuggguuauucuaagaugguggauacuuucuggacacauuaauagaaauuuccauccagagaaucuggggucugaggagauggcucacuuaguaaagggcuuacuacacaaacaugaggaccugaguucaaaucccagcaucaaccuauaaagggaggugugguagcaugugucgguaaucccaguacuggaaggagagggaggggcuuaaggcaggaaggaggcuucucagcuaaucuagccaagucagugagugagcuccugguucagcaaaagucccuguugaaaagaaaaugggugaggaacaauaaagacaucuaacucggaccuuuagccucucuaugcaugugcaaagcagugcacacagcauagguccguggugcccugggcaacaccaaaagacaaugcucugcagaguucccuuuuguuuggguuuccaugcagucccauguucagggucauuauagacugaccucucacagggcuccauacucuucaucaugauuuccaugcguauagaaauaaacacaguuggcaaaugccagaauuuguuguuguuguuguuuuuaccauaugacuuuuacauaaaugcauguacauacuguuacacauuuauuuuguguguguaaaucugugaaagcacacacacgguuacuauagcacauauguauggagcucagaggacaacgaacaagucugcucuuaccuugcuuuuaggcagggcaucucuugagucugcaucucugugugcaugcccacgagcuucuugacaauccuguuucuuccugccaucauagcagaggagugccaggauugcggugaguaccacaacauuuaugcugguuggugagaacucagauggccaggcauauacaucagggccuuucacccacugagccaucucccucaugaagauucucggaauguggagaguagcuccauucaucuacuucuggaggacccugcaaggaucauucugacugaugguauauaguaucguccuggcagcuugauuuuauuggucuggggcacacaauuaagauuauuuuagggacaugagugaguuaaaaugacagaacuagaaaaauauauaagaagaguugcugauuaccaugguggggauaaguuauucaggauggaagucaugauaaagguagcagauggagccagguauggugucucaugcguguaacccuagcacuuaggaggcagaggcaggaagagcaacacagacuugaggcuagucuaauuuacauagcaaguucuaggugagcuauagcaagauguugucucagaaaaacaaaauuauggcaauaacaacaaaaaggaacccaucacccaaggaacccaacacucaaggaacccaacacucaaggaacccaacacucaaggaacccaacacucaaggaacccaacacucaaggaacccaacacucaaggaaccuaccuuccaaggaagccaacaaccaaggaaacuaccauucauggaauccaacacccaaggaauccaucgcccaaggaaacuaccauucaaggaacccuccauccaaacugucacugcuguacuauguucuaaguuccuguacauaucacaccacauguaaaugggaacagaaaugguuuuucucuuagaguuagaauuuuuuuuaauauuaugcaucuugauauuccaagaagaaccuuauauuucaaggcacgcuggguguuccaagaaauagacuuuugaagacaguaaauuaugagcugguucaauauauugggcaaaaugucauagggaguuggaauguguguuuaagaaccauguaaugggagaggccacagcuucacccuuguacaauagacaguugucuggaucuuucucuuuaaccaugagacucaacagagauugcccuugaugaggugcgcaaaguuuggcaaaugcuuuucuucugccuguguuguuucgcucucaguuuguuggcaugaugaauuccacugguuguuuuuucuaauguuaagccaacucuauuucugugaaaauuccacuuggucaugauguacuguuuuguaaaagacuauuguuauaauugaugugugugauggcuauuccuaguugucaaccugacuacaucuggaaugaacuacaauccagaaaugggguaacuccggugauccugaucuuaaggcuggaagacucaggcuucugacuggauuuugauguuuaauuuaauuccaggagacugagguaagcagaucucuuuguucaaggccagccugggacagagcaaauuccaaaucuaggcacagugguauacaccuuuaaucugggccacaccuucugcuggaggccuauauaaggacaguggaagaagggaaacucacccuuugccugcucgaauuuacuugccagcauagcuguuggaaccuacuucuucaggauuccagcuuauauagaagaccagcucaaacaccuaggcucgugggaccaagaaauugcuagauucuuggacuucccauccacagcugccaauuguuggguuaguuggacugcagucuauaagucauuccaauaaauucccuuaauauagagagacauuccauaaguccugugacucuagagaaaccugacuguuagaauguggcaagcuuuuguuuggcucuuuguuccuguaaaauauuggccuguaaguugucuuuuaucauaaugacucugucugguuugaggugucauucauaguuagcuuuggagucugacuuaggaaguaccuccuuucguaucucucaugccaguauucaacuugacaccacaaagucuguuugguuuuuacccuuucuguacucauaacccccugcucuggccacaaaaaucccaccucccaguaccugugagugacccuguuuguaaccagcauucccacugacauuccuuccucuuaccacuguccccucccucuuugaguuuugcuucagucaaugaccacacccacuuagauagcuuccucucaccacucugggccggcauacgcccagggccagacugucccauugcuuagacauccucuucaccuuccuuuuccaaccauuuaugaaacucuuucugccagccaaaccuguuuugcucaacuuaagcuccagguuaccuacauauaauuggcaaaugauaaauaccuaaucgauaaguacuuuuuaaaaccuauauuuuaaaauagagaucuguuauguugacacuugggugaagauggcaucagaauaguuugaguuugcauugcuguuaacuugaugaccagccauagacaaauuagcuuuuuaaaguuuuaugugaaaugggaugaugacacaaaugauggcacaagcuuaugaccgugucccuuugccauucuaaagacuugacaucuauuaagucaugugaucuggaaaacagucuuucuaacuucaugcuaggacucccuuuagccuacagaagagaaagcuguuagcugagguaggcgcuuuugugcauucuguuucauagauggggacacaaagacuccaaggucauacagcugggauccaagcacugucacccugggaagcauacugccuggcacccacgcaauguccuuguauaguacuuguuucacaguggucccuggcaagaaauaaccguguuaacaugaaacaugaugauaguucauggucgugacacugcacagucaggcugaggaggguuaucugcucugagcccgacugugagcagguagcaauauuucuuacuaccuggaguuuaaaguccucucuguuguaauaggugaagugagcugagcgcuuuauguagaaagaagacagaguuagaaacagauuacacauuucaaacuaaaguagaaaaacaagaaaagauacuuccaguugauagagauugaggaagugaccaaugagacacgggagauaacaggauaaauaaugggucuccgaaggagcuggagaaaauagcccaguggcugugauggaaaaagcccaaagcuugagagacauaggauuuaaaagcagcuaaaaaguccacagacccauuaaugugagaaguguauacagcuggcacaugauagaugcucaacauauucuuguugagucucugacaguccuuuaaaaaaauguguuuccaguuagaagugcaagccuaauggaaaaagaaaacuaaugucugaaaaugauggaggcugggaagaacagagguacugaugcggggcuggaaagagcagaagcccaaaugggcggcgugcaaagaugaagggaaacucaauuuacauugcaaaauccccgaagacucuggaaagugagggugaagaugagguuaagguuucuuugacaguguguuaaugaagcaauuauucuuuuagcccuuuuccugcuucgagugcagcaacaacucugacccucucugcaugcagacuguugccuaucaaaccagcaugcuccuggcagaaaauagaaaucugaucuagggaagaaaaggaguaccccaacaucagcaacccccucaggggauagccuaaggucuccacuucgggaauccccaagugauggacgcagcuagauuucgggacaugggggacagggguggcuuuagucaaugaaguacaaccuugggguuuuaaaucagcucucugauggacaauuuggggguugaacaaacaaccaggcaauggggggaaaaaggcaaggaaacugaucugacugauuccccaaaaucucaaaggaaacagagucacuuaagggagauggcaacgaccauuaacacuuucaaauacuacaagacuuggugugcgugugugugugugugugugugugugugugugugcgcgcugcaugcacaugcgugugcuuuucuuucuuucuuccuuccuuucuuucuuucuuucuuucuuucuuucuuucuuucuuucuuuccuucuuucuuuuuaaugaugcuauccuaaaaacagauaggcacuuagcaaacacagaaaaauuaauuagcuucuuuaaaaacuaaaauuaugccuaccaccacauucaaaugcuuuagauaaauugaagguagacuuaaagaguagaauuuaggaaauaguuccgagcacugguugguuuguugguuuguuuguuuguuuuuguuuuuaaaaauaggaaggaaaagauaaaaaaaaaauugaagaccggugcaaaagauuugauaccugaguaaugaguguucccuaaaaaggaaaaagaaaagggcuaggggagagagaaggcuaggaaauguaauuuaagaagugauuagaugaaggcucguuacugcaaacagcuaauuagggcuggugagauucuuaguugcaagcacaaggacaugaguucaagccccaagacccauguggggacacacacaaaugcagacauacucacauacauacacacacucacgcacacucacacacauauacucacaaacacacacucacacacacucacaccccgugcuaugauggcuguuuguacucucaaugcuggggaggcagagaccgcuggauucaucagagcuuacuagccagcuggccuagcugauuaagagguccaaggcuucuuuccaaaauaaaaauaaaaauugugaauauagugugaguaugagcuugucuucugaccgucacaugcaugcacacgugagcacacccacccguacacacacgcacgugcaccuauacacacaguaacacguggacacacaaaagaacaguuaaucaaguaaagaaaggaaggaaagccaaaugcagaucgaugacaagugugugucacaugucccuuuacuauaacccacgaaccucaauuucaauaaaaaaaauauguaggaaggaaauaaagucauaguguguuacucagcaugggacaagagcacuuaaguaauguacgggcaggauagugaccuaagccauugucaccgagccaaacgugaagauguagagcaugaagcugaggccaagcaggaaguaaugaggaccagauccuuauuuucuuuauugggaaaucgacagauaaugucuggcauggaaaaacugagaaaugacaguauggauuagaacuaagaagaaacacagaguaugcagccagacagaguuaaagauggcugccagcaggugugcucaguggagcugggagggagagaggauauuugaaacaagguugugaaagcugcuugacucucuauacuuauauuuaaauuuuaauuuguuauuacgugugggaugugggagugggccugugugccaaggucuguuucucuccuucucccugggagccagagacugggcucagggcuuuuggcuuucguggccagugccuuuccucaugugcagaacggucucaccagcccuguuugacccuuuaaacuauuuguaaacucuaaaaauuuaguaaaacuaaaagcuauauguuaguuaaaagguguuaucagaaacaaguaaaaauaacuacagaaccgagcacaggggaaacucgugccuaaaacucauccuaugcauaaucuacugacucaacaauuuaauuuuuagcaaauucuuuccacuacuacuuauaauauuaguaguaguaguaguaguaguuguuguuguuguugucucacagugcagcccucgcuagucuggaacucaccauguagaacuugaacucacagagaugugccugcuuggucucucgaaggauuaaagguguguggcaccacgcccagcuucuucacccuccucucuuucucaguuaaaagggugggaauggguauggguugcacuugcauuggcuuuaguagaccaauauccauaguacaugguccucaaacucugaaaaauuaugaacuaaaaacacagcugugcuacuguuugauuccaaacaaagguucaauaaaaauaccugcaaaauuguuauuagucaaacuucagacuagaagaaguauagaucgaaugauguaacauugugaaauaccaugaucaaggugauaauuuuuguaaaauaucaugugcaugugugugcacacaugugcauacacacacacacucauacucacauacacacacacacacacacucacacucacauacacacacacacacacacucaaacacacucuucugguagagaacauccuuuuguucaggcaugcgugaugagaggcuacugaggcugaacuuuucacacaguuucuguuagccauaaacagugugccuuaccuucuaguuaauguauaucaagcuuggcacucacucaaccacaauuucccagauccuagcuaggcgacgaggcaccagucaaagcucccuucguuccccauugaccuuacaacugaucugagacaggcgucuucaccacagcgaauccugaguuuacacacagcauuuaaagugugccccuuaguuuugcuaacucugaaaugagaauaaccaggcugguucaccuuuuauggauuuuccaaaacagucguuacgaugcccgucaacaacugccaauaaacaaguaagauaguuggcgguugcuuauuacaauaaacaaagaaaaagugaauuugaguuuuauaucaagguagggacugggcuguuucaacuuuccagagcgccugcaggagcagauacuauauagcaaaggaaaaugaaccaucuaauucauacauuauauaauaaguacaaacauauucaaaugucugucuccggacuccuugucaaggacaaaauauguauuuuuuuuauauugacauaucugcaaaguguuaacucaagagcuuacuuaccgucauugaaccaucuacauuuagcuccuuccaaaguaaaugguugcaggacauuuuucaccggugucauaagcaacaacuugacaggccccauaaaguuucugguuacacguacugaguaacuacauuuugaauuacaaggaugacagaucccauggccauuaaaaguuacaacacccccaccccauuagauauugcagucguaucuggcuuauucauuucugccuccacauugaguaacuaaggaaacaaugacgucauggcucagcgggguucagaaacguguccgcugaggucucugguuugggaagccugcaauuuuugcuaguucccuucucagccgcuggauaaauucauacaacuuuucuuauuucugagauacugauuaggaaaauuauauucuguuauaaauacaaaaucauauuuauaauaauuuaaauaauauacuguacuguuucagaacaacauaguccaaaguguacuauuucugagaaguccucuacauuugcaguaggaaguuuuugagguucaguaacuuauaugaaaacaacugugugacuccagguccccaguaauaaucccacugagguaugucuuauggacccuuggccccuucaaggcuacugaguacuucauucuguuuuguuuuguuuucucuaagugcuggcucucuuuauacuuugaacuugaaccucaaagguucauguuugaaagacuugguccucagcuuguguguuaguuugacgguuguggaguuuucaugggguggagacuugaggguugagauuaggugacuagggguaggccuuugaggucauagccaccccugguucugggccccagaacucugcuuccuguugugauaugaccucauguuccuguacagcagccuaaacuucuauggccgugacauccugcccaggacgguggacugaaauccucugacucccuaagccaaaauaaaccauuccuccaguaaauugcuuuugugagcuauuuggugagaguggugagacaaaucgcugauacauuuucacccaaaguagagcggggauggggggauuugggcaaagauuccaaggagcuuuaguuaguauucagagggcuaaaggugaguucauagccaugcuuuggaaguguccacaauuacaggugauccugaagagaccugugugccucaggacugucuaaugucuguggauaaaagggcgugaguaucucaugggucuuaucccucagacuuccaagcgucgucugcucagccccagcuucugcaugagugcugguggguuccugaagaccccuacuccaagguuagagagacuaagggcaggaagcagaaaggaccugacugaggagguaugcagccuccuccucggccuccuugcugagaugaguggaguuuacacugagccaaggaugaaagggaaaacacuccacuucccucacaaagcucuggaguaacuggaugagggauuggcacucaccugcuaagauucucccucacugugauugucaaacgguuuuuuucucucucaccugacuaaacaugacuaagcaccuucucugcucauugaucgccuuucucuuucuagaucugccaaauugcugaguaucgcuaccugggaguuucuugcccugcaguuuuacaugguggguucuaaaauuuucacaacauaucuacccaaagaugccuucucugagcaugcaaacagaccuaguuaguuacgcagcagucuuuuuuguuacgcauuauaucacccgucugcucagcauucaccauucucagauauuuuuuuccuggcuugccgacuccauugaacuucacuuuaaacuccaggagaacaaagaccuuaucugucuaguugggacaguuaguuucuagugggucuuacugggucaauuacccacuaagugaauaaaaagugagaauuaaaaaacaaaacauauagggcuugugagauggcucagcaaguaagagcacugacugcuuuuccaaaggcacugaguugaaaucccagcaaccguauguuggcucacaacauguaaugagaucugacacccucuucuggugcguuagaguacacuacaguauacucacauauauaaaauacauaaauaaaucuuuuuuaaaaaaacauauaaaauaaacaggaguuuaaagaccauucuuauugagaagaggcacaaaaaggaaaacguuuugauucauauccaacauuucaguuuuuaaaauauaaugggauggaggcgcacauaguaagauaagcauggauaguaaguggauuuugucacucacuaucuaggugguuuuggaccaauugcggagcuaccauuuauuaguuggauugauugguuugucuuugugauguugggaucaaacccaaggcucucccacauuugcacaugcuaggcaagugcucucccaaggggcaccccgcauccccuguccuaccgauucacacuuucagaugaauaucaaucacccucagcuccucgagcuguugugaggauggcagaggaucacacagagaaaauacugagcacagugucugcccaugguaaaggcuaggaauaucccaaucgcuguugucaucagcuucagcuucaucaucaucuucaucacggucaucaucaccaucaccauccucaugcucaaucuuauuucuccauaucuucauaguguuucuuccucaucucaaucucggucuucaacuucaucuccucaucaccuuucacuguacaguucaggaacguguuguuauaaggcacaugcuguuaucguuguugucacccauuguauuuguuacuuuucuauugaugugauaaaacaccaugaccaaggcaacuuaaggaaaagcuuacaugggcuuauggcuacagaggguuggagcccaugaugguggaguaaagacauggugacaggauccaaagccaggggucagauauugaacuacaagcaugaaacagagaaagaguagacccaaaauggcaugagucuuugaacucucaggccugacuccuguaacauaauuccuucaaccaggucacacuccuacgccuucccaaacagugccaccaacuaggaaccaacauuuaaaugucagacccuacagggacauuccuauucaaaccaccaccaagguccugaaaugaauccaggagccccaacccccacugucgaucuuaccacaaacccagaauugaccacucguggggcuuacagucacauuuucuuuaugguucuguaugacgucaccauccauauuucagccuuacacuuuauaguucagucuuuacacucuacaguuuagucuggaccacauucuuacugucuccacagugaaucagcugaagaaccugggccacuucgaguguuucucucgcucuagcuuuguuugugguucaguucaucaugguccucugucuucugcauuccgugaaagcugaauccagacacuugaccagacucgggguagaucuuuucuguaagguuguaggugguugcguugucucucuuuugaaaugucaccauugucuagcccagugguucucaaccuuccuagcgccugugacccucaguuccucguguuguggugacccucaaccacaacuuccguugccacuucauaacuauauuuuugcuacuguuaugcauccuaauguaaauaucugugucuucugaugaucuuaggcaacuccuaugaaagggagccaacccacggguuaagaaccgcugaucuaguugcauugaucuguagccagaaaggaacaguguaguaaggaaacacuccugccgcugcguuuaucagucaggaugauuucaacagacgcuucuucucaucuguaguuggcgagucaguaauagucaagaagagcaagauaaauguuuggcuuuuccuuaacuuaaaaguuuuuccaaugaguuagcuccuggucauccuaaaguagacaguuauuuuuaacauuauaaacagacaacuauauaaacacgugauaggucucaguccauggaaauacuuauccuuacugaaauucaagcuguucugcuuucagagccuugcuggguugcucccuggguccuuuuagacacaaugcugggaacgucuguuaguguucuuccugucuaauacgacaccacacuccuuuuuaaauaguccuugucccagaccuagaugcaaccaucccuuuucccuagaaacucugguuuauuucugcaguaaaugauguuuggagacuaugcuuugcagaacuggucauuguuucugggcuuuauagggaagcauaaaauauaauaguauuaaaaauaaguuauacgauauguaauaauguaacauauaugcuuaaagguaaaauaccucuuggguuuacccucccauguuugauucaacuuccuagcuguagggcuuuugguuagcccucuugguauauauccuuguacuccaugaaucuugguucucaaagacucaugggaugagggagugagaauauucugcaguaguucucucauuuuaucucagacaugcaugccacagccucagagcaacaauucuaauauuaccaccaaaaauuacuacuaaaaauaguugaaagcauuuuugcauauccucuauuuguacuucuccauugccgaaaggauuacuuauuugcaugugucuuaguguuugucugcauguguguaagaacaccaugugggugcagugccugaggaugccagaagaggguguuggauucccuggaacugaaaucuugacugauuccaauugccacauggaugcugggaacugaacccaaguccucuccaucagcagcagugcucuuauuggcagagccaucucuccaguccccuacuccuccauuuuuauccuauauauugcauagccuauagucacuacuuuuuaauuuucagucuuaguucuacaugcaauucuguauuugguguacacaaucaaccuccuguaacucacguuuuuguuagguuaauuguuaaagaacaauuacauuucuucauuugucucuguguuuaggcauaugcaugcaacaguguacacauggaggcuaaaggacaaucuguaugaguuacauuucuucuuccaccuugugggucccagguauugaacccaaccugucugguucggcaacggaaugccuugacucaccaaaccaucucauugacccuggguuauuuuugucaucuuauucugugguagauuccuaaagaaauauucuuacgaaugacauccuuagaguucucacauagugcuaauaguuuacacacacuuuuuguaacugcagauauguuuuacuagaugcaaaucuugaauauguuccuuguguaacaucuuaaauauguguuaguuauguaaaucuuaaauaugccauccgguuucccuuugccauaaaacauugcugucaaaaugucugauugugaucuaauuuucugucccuuuugggcuagaugcccagagaaccuuuuuucuuucuaauuggacugguaaacgcugggcaugguugugcaaacguauaaucccaguacuugggaaucugaggcaggaggauuaugaacuguagcuuggguuacauugugaaaccgaguuucaaaagugaaacuucacaaaaaaaaaaaaaaaaaaacaaaaaaaaaacaaaaaaaaaaaaacaaaaaaaaaaaacaaaacaaaaaaaaaacccuaagguuuaagguaagacuucuagcaguuuacuuucagaaauucucuuaaauuauauuuuucaguguuuguuuuguuucuccccuuuguuuuccuuuaaguacuugugcuguccagauuuuggaucauuuuaauugcuuugcuuauuagguuuccauauuucauauuuuauguuuuucuucuccuccagcuccuuccaaauucucccgaccucuccuucuaccuaucaaacucucucucucucucccucucucucucucucccccccccucucucucucucucuuucucucaaaaaaagauagaaggaaaaguccccaaacaaagaacaaaacuugacuuucauuuguguuggcauggggccugccaugaguaugguugauauucccugugauucuccacuggaaaaaacugcuuuucccugccccagcagguagcaauuacauagcaauugugucuggguaacaggugugacuuuguccacuucccauucucugagcugggauuuugucugauuugaaccuguauaguucuagugcaugaggccauucugugaguucauauacacaucagcccuguuggagucacccaucccuugggcuccuacaaucuuucugcguccucuuccacacagauccaugaaccuugagagggggagagcuuugaugaagacaccccauuagaaccaaguggcccaaagucucucacucucugcacguuguccaacuucucuacuuguuuucaguauuuaucacuuacagccuuuuuaaagcuuauauauacauauauauauauuuccauuccuuuccuuuucuuuuuuaaagaaaccagugcugggcuggagagauggcuccauggcaaagagcacuggcugcucuuuuagugauccaaguucaauucccagcaccuacaagguaacucacaacugucuacaucacuuggaacuuccaagggaucugucccucacacacagacauacacgcagggaaaaaacaccaaugcacagaaaaauaaaacuaaaacauuaacaaaauaguuuuugcuugcuugcuugcuugcuugcuugcuugcuugcuugcuuguuuugauauaaaucucaugcuggucucaaaccauauagagcaagucuggaacucguaaauuuccuaccuuaaccuccaaagcucuaagccugugagcucagcuucuggccucuuuuaucuaaaagauuaauaauaacuuucucuucucacuuuccucuucugcuacuuuauccuuagguucuuucucauuuacuccucauuucuaaaauggccuuuccuuuuauuuuauauucuuucuuggguuucaugaucuaauuuuuacuuauucucuuauacaaccuuuucuugguaacuucucagucauucugauguagucagcuguggcuugggcaucuuucuggacugucugccauugacgguggggauguuauucugcuccuguccaguuguugagacaguuaccauggaguuugacuuggggcuuuucccauuguuuacuuugaugugagauccacuuccuccacucugagaaggcccacugcauguagcuucugacuuggguugcuuucuguccucacagugcuaauaacauaaugcaguacauuuuaaauucccugccuuugccuuccucucugauuucauucccagcucucuguuguccacgucuuucucauguuccguucacuuucagccaucuuguuacaaugccaggugcuggucuucagggagcccuguguggaccauacuuaucugcucauagacucuaagucugugacugacccuguacaccaggcaccauccacuauugcuaaagauaaaauccugugggcuucaguuucaucacacucuucuuacagagaaagucccuggguacuucugagaucugucacccguugucuuaucuaggggacgaccaugguuucccccagccucgcccuacucacagggaccaagacuagacacauuuauggucccuggcgguugcccacaccauguguuuucuggagcaucuaucaccauguuugguuguaacuacaguuuguggcucuaggguugggcuucuguuuucuguuuccuggaggggaucugcuuuugauuaacacuaccaugcuacuguggcauucucaaguagucacuuuaggcagaacagccaaaucuuucuuugcauucauugccugauacuuugauugaaaugaaaacuguaugggucaacacaauaauauuuuacuuuuaugauagugaaacaaacguuuuuccuguuuccugauaguucacauuugcacgucguguucuugggccucuauuaaaaaauggcacugcagggugaaguauauugucuuuauggccucuaacucaaagcuuuucuuguaauuagaucucugugugccagggagcugauugagaucuuuauaaaucauggugcuaaaugcauauggcucauacuaacgaacacauuaguaucguagcaaguucaguuugugacuuuaugcuuaaguguuaaugaauagacacauuuacccacuaguucaagaaaaauagguucucccauuuaugaauaagcagacuaggggcucugagaaauaguccugaaaccuuugcaaggcagucucuuucaacuuccaaacaguagaauaacugauugcucuaacgauugcacuaaaacaagacucaccccagcaaguguuaaaaugaguuccagauccucccacuaggaaaguggagcuuuacagaaccaaaucauauguauaauaccucuaugauuaaaaagagccuuuaccguuuauuuuuguuuaaaguuccuauaugagaugcuuagucuacaccaaaacguaaaaugauuucuuaaaaauugcaaugcuaucguuuauaaauagcaagauagacauauagcuacagauaggacaagguuggcaaauuguuaguggaagaaucagcauaagggguauagggauuuuucuaugugcguuguuuaacuuugacgugugcuuggacaugcuugcgacgcacuaucggaagaaacacuauuguaaacuuuaacuauccaugaaagagaaauggaaaucacuucauucuagaaguuucuuguuuaaaaucaaaaggacuuuguaagacguggaagaauuacaccuucaaaguuucuuugugugagucuacguacauuuuaaucagucucacaaaacgagaguuccucaaaaacagguuguaucuguucguucuuuacggauguccuccauccaaaauagcuccaggaaggagguuuccuugauacaggcuuaaaauaaaaacccaauuuaaaagacucuggcugacugagccaggugccagaagacacuggaguagacgcgcuuccuccccacaugcauuugcgcuccacucggcuuugguuuucagcuugcuugggagagaagacuuugguuucugcacaggcuccaagaagauuuggggagaggugacaucauccuacuuguccauaaaagugggcguggacccucuggguuagaguaaaggccaacaacuagugcggugugccagggcuguucuguggcuuaagugacaaagugcccaggaagugaagagaaagacugugcuuccagcucuccagagauagcuggucauggugacgacuugggggacgucccagaugagccuguuugauauggccaucauuauuuucagagggaggguuuucuacagauauuaugaagagguucagucaacgauacucaugagugaucaccaggacauccagguggaagaguauacagaggaacacugcacugccaccaugccaugacugacuggcaguccgccacuguggugguuugacagaaaauggcuccuauacgcucagaggaaggggcacuauuuggagguggggccuuggagugggcgugccuuuguugaaggaauugugaaacuaggggguggggcuugaggucgcaaaagcucuagccaguucucuuucugcugccuguggauccagaugugcaacucucaucuccuccagcagcaccauguccuccugcguguugccauguuucuugccaugacaauaauggacuaaaccucugaaacuguaaggcagccccaauuaaauguuuuccuuuauaagaggugcaguggucauggugucuccucacagcaaaagaacagugacaaagauauccucguggcuccugugguugcucaucagaacacaucagguauuccucgaggaaccccacuguuuccggagguucgcuccugacaucgaaguucaucacugagugauuauucuagaagaaaugcaggaaauggauggguuagggaggggagagagcucuaggucucagccucaguuuagugucuucuggagcccacaugagcaucccagaggguagacuggucauauagaggcugagcuucaccccccaccucuaagaguuagaauagccuucugucuuaguuaggguuuuacugcugugaacagacaccaugaaaaagacaagucuuauaaaggacaauguuuaauuggggcuggcuuauagguucagcgauucaauccauuaucaucaugguggaaacauggcagcauccaggcaggcauggugcaggaggacccgagaguuccacaucuucaucugaaggcugcuagcagaauacugacuuccagugucuuaagcccacacccacagugauacaccuaccccaacaaggccacaucuccuaauagugccacuucaugggccaagcaaauacaaacuguugggagccgcccccacauucgccguuacaagauggcgcugacauccuguguucuaagugguaaacaaauaaucugcgcaugugccaaggguaucuuaugacuacuugugcucugccuuccccgugacgucaacucggccgaugggcugcagccaaucagggagugacacguccgaggcgaaggagaaugcucuuuaagagggacgggguuuucguuuuucucucucucuugcuucgcucucuugcuucucucucuugcuucucucucuugcuucgcucucucuugcuucuugcucucuugcugcuuacacucuggcuccugaagauguaagaauaaagcuuugccgcaga

SEQ ID NO: 7218 - RNA, 1454 nt, Mus musculus
uccccucuucuuucuuuuuucauauggggugcuuuaaauauucugugaucaagaaaauucugaacccuaaaccacuuccgguccgaugaaggugaaauuaaaucagagagggcacagacacgcggaacagcgggcgcaauggggucggaaccagcuguauacacauacaguggguagaaaagggucuugagaacaaacagucccggcacugccggguguugaaccugcuaaacugugugcacgacgggaggcugagcugaagacacugcagaugauuucccaacguuuggauauccaaguguguagaugcaaaaauaacucacaacgacuuucaacuuaaaccucccaaacucuagaaaaauuaauucaaaguagaucaugauccauuuaaguguaagaccauaggguuacgucuugaaguuaggcaaggagucuggagaguuggcucagcagcugggagcauuguuguugcagaggacucaggcuccuuccuaguacccacaugacagcuccagacccagggaucugaagcccucucugcuucaggugcacacaugcacagcacaccaaaaccacggucacacaugcaaaauaaaacaaggcaaaaaaaaacuaacaaaggggacaaauaacaggcagaggugucggcaagccacacgugugacgguggacugggaccaaggacauaggaagagcuuucgaacucagcaguagcggagcaacaauucaaagaacgagcaagggguuugagcagcugcuucaaaaugcguagaaagcagaugagccgucguaaagacguuuaacauaguaaaccuuacggaggugcacaguaaagccacagcgggugcugccaacuauuacagcggguauuaaaugcaucagcagcgucaagugccacugaagugcagagguggagaccuccucugaucugggcaggaaucccagguuggcagucacuuuggaguuaauaaauauauaauauauaauauagauggucucagucaucccuguuccuagcggauauguccccuagaacaaugaaauuguagugugcgaaugguaaauguaugaguguuggcgguggcucuacuaauaauugccaguaacugauacagccuaaauaucccaggauuggauaaacaaguacaauucauguauaaaauagaacacugucagguuggggaaggguguucuacuguacagugagaaaaagaaaggguguuuagaggaguaaagaaacugcuguuccuggauggcgugguuacagugugauuauguguaaaaacggaugcaauuauaguacacccucacaucaacuuuucuguaagccuacgauaauaaacagagauuugaaaagucuuauuugaaucucugaugccagaaacuugaacauacguuugaagcugugugaccucuuagucauuuugucugucacccucugaaacauucuuucu

SEQ ID NO: 7219 - RNA, 1198 nt, Mus musculus
uuuguuuuguuuuuuuguuuucuuuuuucuguauaauggaaaugacuuucugcugagucuucaaguccccuuagcuucucuguucacguugccacgugguagcaggagaaaagugauuuugagguaguuucuuugacuuuugauagagaagaaaaguucaauggcuaggggugugugccuuaaaaaggugcucagggaggggguccuuucugaauaacacagacagcugcuuuuccagaggagggcauggccuugaaaaucuccagagcucugcugucugcguggcugcuuugcuguccugcauucugcauucagaguuccgccccuuugcuuuguaagucagcaauugaccaggccggguugggcgcuuuuuuuuuuuuuuuuuuuuuuuuccucccuuucucacuucccugcgauguuuugaacugccuucucacagacgucauucagcccuugaggaauaguuucugccuggugagacuggaugguaauucucauucacaaagacucgcagccgcguucucaggggacacagcggauauuggcuuggcagguaccucgggccacccagcccacggagcugugcuccuccagcggacuccuuugcgcugcagagagcuuugucccugcgguugaucgcccugaaaugaaacuuccuugacagcucgcccucugcgugucaccaggcugccaggcacuuuccuuuugcucuaccugagugagugcccaggggaacaaaccucuaaguccguuguuauggaauugcagaaaagagauugagugaccgguucgcugggcuggcuucccuugugacccagaugaagaagagauucaaaauucaguuccucugugggcaaggcaggcagagaaggaacucccuucggaagagcccgggcuugggcaugaaagaggaaagcccgccugcugccggcgacacugagagcugaggcaggaggcagccuucccagcccguggcgaaaccuccaaaccuucuuuguggagagcccgcugaugaauauugaucagaagacuugaacauuucccuuucccuuuuucauuuugugucuccccucuucaaaaugagcauuauaaugaagccaagauccaggucuacaaguucccugaggacaacggaggcaguuugguaaagugcuacuuucuccuucuuccccuuuaagacugacauagaacucaagug

SEQ ID NO: 7220 - RNA, 1683 nt, Mus musculus
auuucagcaaggcaaggcuccuucguuccagcaagccagaguugugcucugcaaagcagccgccuuagucuguggcuugucaguuaggauccuguccucuaguguccucuccuucaaggacccaaaggggacaagauugcugaguagaauguagaccucccucagcuugcagauccguguuccgugcuucugaucccaggauggaagccagccaacccugcuccuggucugucuuuaggguucacuaaagcuuuugauagaagauuauuuucuuauacuguguugcaggcucaguccuugaagugaucuugguuuuuacucucugaaucagaaccauauugacuucauacugcagugaacaccuuuuccuuccuuuucauaaacauuuuguuuaagaaauaagauuguggggaugaagaaaauaaccauagcucaguauaaaacgguaucacugugaacugaacauuuuacugucaguguaacuguuggagaaaucucacugacgugcucaacuuucaagggacgcacuagguucuaaguucaaguucguuauucauuuccuccccgggagcugcggacugcuauuaugcugcuaaagaaacagccucuguuugcagucaaguuuauuaggguucaacucuaccuucagauuucagauuuggcuauagcucaacuggaaggcuguaaagacccaaggacacuuagcauggcaggauggugaacaccuaaucuaagcaggcauugccugucugacaucaauacagaugaaucaaauguugguacaaucacuucucuaagauugccaaacugccuauaaccaacuuaguaggagcaacuguucagaagaaacucuguuuaacaccucaagguagagcuauuaguucuguguagaaauauuuagaauccugacacugaaggaugccagccuguacuucacucaacccuucugcauucauaugagguacugaagcccaaagacgguuguaugguguauucaagaucacacagucauuacccccacaagacugauaaaaaacuaaugcucacacugucaugguauuccagugcugaucuuuuaaaauaaaauaaauguuauuuuuaagcuuguuuucuuucuuuccuucuguauuucguguguguguguguugugugugugugaugaaggugggggagacaguugguaaacugacugugggcuagaggaucugaguuaaaucugcaaaagccauguuaaaauucaaggugugguagcaucuguuugugcuugcaauccuagcuuaggggagauaaagacaggaagguacuuggggcuccacggcuagccagucucccuuuguugaugaacuccagaccaaaaggagacacugcccccaaaggaauuggaugguuuuucugagaaggacaccugagauuguugucugguguccacauacauccacaggcacacacaugcacacagacacacacaugcaugcagaccacguaucuuaaaaggauaagaggcagggcuggauguguugcugauaauagcacucaggaaguuagguaggaagaugcuagucuagccuacacagugugacugucucaaaaacaaacaaacaaacaaaacaaaacagaaguaauaaucgauuugaugaguucuggaaagaaaugguaaguuuuccuggauucuaaaauacauga

SEQ ID NO: 7221 - RNA, 1837 nt, Mus musculus
ggcuccuccccaccaccagagcuaggucgauuguugcccacugcccgagaucugccagcugcgugcccacgaguucccacuuggacuuuugcaaucagagauaacagcaauggccuccaacuggagggcuagugcaucuugguauucuuacccaguauaugcaagauacuggcaacauuaucaucacgcaaugcuuuggaugcagagccaccagaaugccuacagaaaguucagugauuccuauuucacauccccguggcucuucccucauggagcucuucccuggaacucuccugcuuaugaggcugggcauccuugggacucucaaggccagcacauggcgcggcaggagucucccuaccguguuucccaucccaaaagcccugggcagccucugcguaacagcaguagaacccaggcauccacaagagggaaugaagcacggugugaggaggaagagcuggagucagauucagaugaugaaguagagugcgaccugagcaauauggagaucacugaggagcuccggcaguacuucgcgcagaccgagaggcacagagaagagagaaggcgacagcagcagcuggacgcagagcgccugaaugacuaugugaaugcggaccauggccuguacuucaaccaccguaggucacuggagcccccaucugagaagcccugggagcggcgccaagcagagaugaagcgcuuauacggcaacagugcucccaagauccuggccauggagacugcuguacagcugagcuuugacaagcacugugacagaaagcaaccaaaguacuggccugucauuccccugaaguucugaguccugggcaccgggacccuagggaaugcaucacaguuccuagccucucccucuucaucucuucuggacauuuuucagagaaagaggccuguauaccaacaugguggauacagucugucaacaggagagagguauacuguugccaacacaaggaauggucacugacaaagugauaauuuauguauuguacuggcucuugguuuucucuuuaacaguccaguucauugaaauuauugccuagcaauacugccuauuguuuugcauuuuuaauguccuucuuuaaaccauccagaaugucauaaaagccuuaagccacgugucauuuauuccuacauuuuuauuagauauuuucuuuauuuauauuuuaaauguuauccccuuuccuuguuuccccuccuuuaaaagcucccuauccucugcuccccagcccacccacuccacauccuggcccagacaguccuacauuuuuaggccaguuuucauacagugcaugcuagcuacaaacuuaaaaucuuccugcuuccaccucccaaaugcucguuugcagguuugcacugcccacacugagcuucuguccauguauuuucugugacuuuuucuuuggaccccucugaaaaccauguaagugaacaguaaaagaaguggcacugugcaaggugugguggcacacaccuuuaaucccagcacuugggaggcagaggcaggcggauuucugaguucgaggccagccuggucuacaaaguaaguuccaggacagccagggcuauacagagaaacccugucuuggggggggaaaaaaguggcacuuguuauucugcuaggugucagcccgcaugcucuauaagaccugagaguaaauacucugggcuuggcaggccauguugucucauaacugccuaacccugucuuuguagcauaaaaacagccauaguuacugaauaaacaaaugaaugugacuguguuucaauaaaauuuuauuuguaaaaaaaaauaaauuaaaaaaaaaaaagu

SEQ ID NO: 7222 - RNA, 6356 nt, Mus musculus
uaucaggcgaugggaagaggcugcagggagcucagauacucccacgccacagcaggucacccggaucugcgacccggauugugccugguucccuagcugcucuggcucugccuggugcccgguuccgcaaggccggccacugagccucccgccugcgguggcggcggagguccccaagcgcuccgggucuccgggugccaccccgcggggcucgcuggaugacaggguguggggcugcacacagucaggagggcggugccaacccugcggcucccccgggcugcuaccccgcauccccgcuccuccaggacccagacagggcguccgcccuuggguuucuguuucccacguccaaagucagggcacgcgacgaacugggggcacuuggcguaccgccgccuucaggccaggucgaagcccacgacauccaggcggccaccccgcaccuauccacagcgcggacuccggggccgguggguggagcgcucgccgugacgucacgaggccccgccccagccagccggcgcguauuuaaagcuucgcugcucgcucuugcucgcacaagcgaagcaggacgucagacuagagaguagggagagagacuggugcucgagggacagggcuagcccggacgcuuguccgcgccucggagguggcaaguaggcagugucggguggcgaggcaacgauggagcuccugcggacuaucaccuaccagccggccgccggcaccaagaugugcgagcaggcucugggcaaagcuugcggcggggacucaaagaagaagcgaccgcagcagccuucugaagaugggcagccccaagcccaggugaccccggcggccccgcaccaccaucaccaccauucccacucgggacccgagaucucgcggauuauagucgaccccacgacggggaagcgcuacugccggggcaaagugcugggcaaggugaggagcggcggacgucaggcugccgggcgggagggcgggcugcccgggcaagcugagcgagcagggacccagcgcccgcacuucucgcuccuucagcugucugguuccccgaacgaucgacguggguuccucuccugcccuccugggcuucugugcgccgacagcgcugggguucggauuugcauccuuagccuguuuuucucccgagucuaagaaggaggacugaaggcauucuaccuuggccuugggcucucacuaucugauccccagggagcuagccugucaaauuucuucagagggcauuuuccucccuuucccccuuccacucccuucuccauagaguucuuuguaaaggggaaacgagaaaacuggacugguuucuaggaaugugcugcccuuccugaaaaaccauuauacaaagcagauuguacugcucugcccacccucuguuccucaaauuuugcuucccguucccauuuacguauucauuuauuuuaaacguuggcccuucauuuuuuuuuuuuuuccuuuuuucuguccugcucaauuccaucucggcuuuguuuccucgcaggguggauuugcaaaguguuacgaaaugacagaucugacaaacaacaaagucuacgcugcaaaaauuauuccucacagcagaguagcuaaaccucaucagagggaaaagguggguaugacugucgacuaaaguauuuucuuugugugcagggauggcccuacccuguuagaaaaaaaaugucuucugcauguguaagcacugccuuuccagacacgacgagagacuaauaagccuucucuugcuuuuuuuauuuuuccuuagaucgacaaagaaaucgagcuucacagacuacugcaccauaagcaugucgugcaguuuuaccacuacuuugaagacaaagaaaacauuuacauucucuuggaauacugcaguagaaggguaaguguugacuccugggucagcgagcuugccgacaggaagccggagugguguuuggauuacauuuuaucagcgguuuuagccgugacaguuaauuagucucccaccauaugagacugcgucgucaguccagcaaagggaugcccgaucuagguaacuuuauuugacaaauucuccucucuccccuucucuuccuaguccauggcucacaucuugaaagcaagaaagguguugacagagccagaaguccgauacuaccucaggcagauugugucaggacucaaguaucuucacgaacaagaaaucuugcacagggaucucaagcuagguaaggcuucuccugcagcgacggggguggggguggggugggggugggggggugggggcuagagagugggagguuuuccaguguugugaaucuagcuuuuugaaugggugccuucacuggagggugcugaucuccaagugugaaccuuuccaagggaguucauguuuccuuuuguuuaucuucuagggaacuuuuuuauuaaugaagccauggagcugaaggugggagacuuugguuuggcagccagacuggaaccacuggaacacagaaggaggugagagccaugcucuuccugggguuuguggagaccaaauaugccucuauuauuaguuaauagaaaguuaguucacacuacaaucugcaaaccacagcaguguuacuaaacggaaacuugugugcacucuugagcgagauaacuuacaccucuaaauggauuauuaaggcaaucaauaaaauaaauguuuaaauuuacuugauauauacauacacacacauacacauguacacacgcacacacaggaucuggucucaucugguuaaaaauacuuggucauaugggcugggcaaauuguacacacauuaaaaaauuaccaaaagaaacuuggucaaauaaaaacacuaaaaaauagucaaguagaaaaugagaaaaaaaaauucaagcuuuuauuucccauugagucauccccagagaaguaauuuuaauugaagucauaguuccuaaugagaucuugcuauauucugucuucucagaacaauauguggaaccccaaauuaucucucccccgaaguccucaacaaacaaggacacggcugugaaucagacaucugggccuuaggcuguguaauguaaguaaaugcacuaaaaaaaaaaaaaaaaaaaaaaaaaaaagccaaaguugacucagucaugaugcucaaaaagaguuccuucuugaccauuucugaagaugugcuucuguguacccagguauacgaugcugcuaggaagaccuccauucgaaaccacaaaucugaaagaaacguacaggugcauaagggaagcaagguauaccaugccauccucauugcuggccccugcuaagcacuugauagcuagcaugcuguccaaaaacccagaggaccgccccaguuuggaugacaucauucggcaugacuucuuccugcaggucagugcucuuugaccuuucuguaaaauugagugucaucguccugguugcuggagagguuucugauggucucuucugguuccacaggguuucacuccggacagacucucuuccagcuguugccacacaguuccagauuuccacuugucaagcccagccaagaauuucuuuaagaaagccgcagccgcucuuuuugguggcaagaaggacaaagcaagauauaacgacacacacaguaaguuuccguauccaggauuucccuugaguuugaugacugcauugagacuuucccuuuagcgcaacuucaccaucuuauuuguauacugcugacacuaagagaauggauugauagcuuugguuuaccugagcacugaagugugugcugccugcauagcugcagcccaagccaaugaugacaucgugcuaacucuuuuccacacuuguugagauaaauuaacaugcgcaauucuuucccucgauuuacagauaaggugucuaaggaagaugaagacauuuacaagcuucggcaugauuugaagaaagugucgauaacccagcagccuagcaaacacagagcagaugagguaggucggggaagcacacaaagaaaaggucacguccauucucggauaacuagcaucuguaugauuagcagggcugaagccaugcuuccaggcaggcuacuuauaagcuuuuccagcgauuaucauaaucuuauguuaaccugaaacuucacauguaaagagacccagccccuuggcucacuguauggugcuuuucuucccuuucaaggagccccagccgccucccacuacuguugccagaucuggaacguccgcaguggaaaacaaacagcagauuggggaugcaauccggaugauagucagggggacucucggcagcugcagcagcagcagcgaauguaagugcucaaaaccguauuuuaaauagacuguaagauuagugcugauuaacauaggaauaaaauccuagcaucagggaaaaggcaccaagggaccgugaucucuauuucucugucuuucccauacguggaguggaggggaaacagcauuuccugaucacagggguuuaaucguaaacaaugucgucauuuccgucucugugacuuugcaggccuugaagacagcaccaugggaaguguggcagacacaguggcaagaguccuucgaggaugucuagaaaacaugccggaagcugacuguauccccaaagagcagcugagcacguccuuucagugggucaccaagugggucgacuacuccaacaaauacggcuuuggguaccagcucucggaccacacuguuggcguccuuuucaacaacggggcucacaugagccuccuuccggacaaaaaguacgugugugcgucugaaugccgcagccggccaguucuccgcuguugcgcuaaugaaaucuuggaaacagugaugaauugcugcuaaccuuucuuuucucuccuuccugaucuuuaggacaguucacuauuaugcggaacuuggccaaugcucuguuuucccagcaacagaugccccugaacaauuuauuagucaagugacggugcugaaauacuuuucucauuacauggaggagaaccucauggauguaaguaccccgugucuuuuagagcagagauacgugaagcagucuagaccccagcaacaucugccucccuuugaagucuuguuuaguuuagcuucucagggcuuaucuuagaugcagugcagagagucagcaucucuuugagauagagccaggaaucuugaggccguuccgaggcuuaaguuugagaggcacgguguaacguccacacaguacaguuucagaggcauugacccucucuccugauuucuuccaggguggugaucucccgaguguuacugacauucgaagaccucggcucuaccuccugcagugguuaaagucugauaaagccuuaaugaugcucuucaaugacggcacauuucagguaacugagccuguuagggacccacacgucuagguucggaaaucuuuuucuacccaacugcuuuaccuuuuuuuuuuuuuuuuuuuuuuuuuuuuggcagaaccuugauuacuucuugcuuagcaaguucuaaugucuguguuuauuuuuuucuuaaaggugaauuucuaccacgaucauacaaaaaucaucaucuguaaccagagugaagaauaccuucucaccuacaucaaugaggacaggaucucuacaacuuucagacugacgacucugcugaugucuggcuguucguuagaauugaaaaaucgaauggaauaugcccugaacaugcucuuacagagauguaacugaaaacauuauuauuauuauuauuauaauuauuucgagcggaccucaugggacucuuuuccacugugagaucaacagggaagccagcggaaagauacagagcauguuagagaagucggacagguggugguacgaauacaauuccucuguggccugcuggacugcuggaaccagaccagccuaagguguagaguugacuuuggacaauccugaguguggagccgagugcaguuuucccugagauaccugucgugaaaagguuuaugggacaguuuuucagaaagaugcauugacucugaaguucucucuguugagagcgucuucaguuggaagacuuggaacugugaauacacuuccugaaggggagggagaagggagguugcucccuugcuguuuaaaggcuacaaucagagcagcuuuuggcugcuuaacugugaacuauggccauacauuuuuuuuuuuuuuugguuauuuuugaauacacuugugguuggaaaagugcauuccuuguuaauaaacuuuuuauuuauuacagccccaagagcaguauuuauuaucaagauguucucuuuuuuuauguugaccauuucaaacucuuggcaauaaagaguaugacauagaaac

SEQ ID NO: 7223 - RNA, 2739 nt, Mus musculus
ucgccaucuuacuuuaaugaaauuaaaugaaaagcaagcuuuguaaaagaaagcacaucugcagauggaacaacugcagcagcaugccugcucaguugauaaaggaaauaaaagaauaaucaagguauugggaacguucuauuuuaaucaagguuccaaauucacaugucuaaacacaagagcuuuccaaacuaauaugaaagagaagggauuccuuccucccacgugucuaacaguaucuucaugagcaaauaagcagaugaauaucuuaacuuuuuagaaaaagacaugaaaaaugcaaauuacccugauaaccaaaugaugagaaaucacagcauagauggaaacagauauggucauucuaaagauuuguuguucagucaccacuggguccacuaaaucaucucaaacauuguaggaagaaacccuaauauguuuuuugagaagcuaacauuucagagacacguuuguacacacguguugccagucguuggaugucauaaaaugaagaacgacaaccaaaucucccaagagcacaccugaggcuacugaacuucuacucuaguucccugcuugcaaggaugcugcugcugcgcuucccauagcaacauccuugcauaugaggaauacccagaaucacggccaacagauauuacucaagacacauuauuaggcugagagauaucgauaaaauuauucuugucacucuguggcagaacaaaauuaacucgauacaacaauaucuuucuguguaaacaguuaggcaucgucuguaggucugcuguuucgugagucugaugaaguccaggaacuaagucaugaccaacagaucuuuaccuugacuugaaaaguuauuugauuuauacacacuaaucgaaugguaacuguuuaguuaugcuuaugugauaagucaauuccuugaaauacagagcugauaagacguugacuagagaauaaaaacaagcacauaaguugcucagucagccaaguacauuauuaugguuuaagauguaauauuuuacuuuccugaugcauauguggauacagaugauugacuuguauaauucguuauauccauagaaagaaguaaauaaauaaagggacuaagacauaguugcuaaacuuuuguauugcagauuuguagaguguuuuugaccauuucagcaagagcucuauauaaggcuugcaaauuguauucagccugaaauuauauucucaugaucuuacuccuugucacauauuuucauguaagcaagcccacauuucuuugagcccuacaggcauaaaaaaacggaauaugauaucagaauucccucagcugauaaaaaucacagugugguuagcuguguccuagcccuggauacuuggauggugacgcagauuuccuggcuuguacacucaauaagaagucaaugauuuaccuucaguguccugggugaggugggguaccaucauuaugacccaggaaaagggacacgguagcuuaccuagaagcauuuucuaugaacaaugggagguccagcuucgucauauuccugcuuacugauccacaucugcuggaauguggacaggcuggcgaggauggagcccccaauccaaaccgaauacuugcguucugggggagcuaugaucuuaauuuucaugguacuuggugccaagguuacaauuuccuucugcauccugucggcaaugccuggguacaugguacugccuccagacagcacaguguuggcaaauaaauccuuacgaauaucuacaucacacuucaugaucgaguugaagguugucucauggaugccucuggauucaaugccuagaaaggaaggcuggaaaauggcuucugggcaccggaagcguucauuuccaauggugaucaccugcccaucagggagcucauagcuucucucuagugaggaugaagcggcugcagugaccaucuccugcucaaaguccagggccacguagcacaacuuuucuuugacaucccgcacgaucucccucucugcugugguggugaaguuauagccucguucugucagaaucuucaugagguaaucagucaggucccuaccugccagaucuagucguagaauggcaugaggcagagcguaaccuucauagauaggcacagugugagugaccccauccccagaauccaucacgauaccuguaguccuuccggaagcauagagggauagcacggcuuggauugcuacauacauggcagguguguugaaagccucgaacauuaucugagucaucuuuucccgguugauuuugggguuaaggggugccucggugagaagaauaggauguucauccggugcuacccggagcucauuguagaaagugugguaccagaucuucuccauaucaucccaguuggugacgacuccguguucaaugggauacuucaaggucaagaugccucgcuugcucugggccucaucucccacauaacaguccuucuggcccaugccuaccaugacccccuggugucguggacgaccaaccauggaggggaacacagcacggggggcaucgucacccccaaaaccugccuugcacaucccugacccauuaucuacuaccaaagcagucagcucaucgucaaccaugguugcuggcugggaucuuccagaugggugaacaaaaguucaauagaggugaguucuagacuaugaugugcgagacagagaauggguacucagaacacuucagaacugcccucagagaaga

SEQ ID NO: 7224 - RNA, 643 nt, Mus musculus
cuuauaagagauucuucucuacaugguuguuugcaauugagggaaaccugacugcucucaagaaaggaggucuggaagcaucaacugcagcaugcaguugaucugccagguccuacagugguuuaaaguucucuccacuccucaagccccgaccaccagauaccaccacuuuggcaccaguuaguucuggucggucgcuuuuugucaauuucuggucaagccacucugauauucccacugaugaagaacuuggugccuuuucugaacgagcacuaccuccacuuguugcugcagcgucaaaagauguuccucgaacagaaaacaccuuuacuuucucaucacacuuuacuguacacaacgcauuuccugcauagguaguucucacaaaugugucaggugacuugaucucaaugaugucagaaacuggggcaacuuuaaguuuggcagcuacucugggcagaaggcucuuugcaaagagauguguguguaacugaacugcuucugcguuuccaaaaucaauggugugaguuccucuggaaggaggcuggcuuuguucccaaugacaugcaagucggucagacaggaaaaauaguagcuccagaacguuauauugcuguuggaauaucuggagccauccaacauu

SEQ ID NO: 7225 - RNA, 643 nt, Mus musculus
aauguuggauggcuccagauauuccaacagcaauauaacguucuggagcuacuauuuuuccugucugaccgacuugcaugucauugggaacaaagccagccuccuuccagaggaacucacaccauugauuuuggaaacgcagaagcaguucaguuacacacacaucucuuugcaaagagccuucugcccagaguagcugccaaacuuaaaguugccccaguuucugacaucauugagaucaagucaccugacacauuugugagaacuaccuaugcaggaaaugcguuguguacaguaaagugugaugagaaaguaaagguguuuucuguucgaggaacaucuuuugacgcugcagcaacaaguggagguagugcucguucagaaaaggcaccaaguucuucaucagugggaauaucagaguggcuugaccagaaauugacaaaaagcgaccgaccagaacuaacuggugccaaaguggugguaucugguggucggggcuugaggaguggagagaacuuuaaaccacuguaggaccuggcagaucaacugcaugcugcaguugaugcuuccagaccuccuuucuugagagcagucagguuucccucaauugcaaacaaccauguagagaagaaucucuuauaag

SEQ ID NO: 7226 - RNA, 1873 nt, Mus musculus
uacacagagaaacccugucuggaaaaaacaaacaaaaaaccaaaacaaaaccuauaaugguauccagcgaguacggaguacggagacaguugcaucucuugaguuggaggcuuggucugcuugguaaguuccaggaugggcaguuacacagggacaccauggcuugaaaaacaucuuuuugucuaacggcccacugaagaggugugaacucuugagaaugaacuaccuuccccugccugugugugugucagugugcuuaggcuggccucaaacaugcugcauagacaaggaugaccuuacuuccacuugccagguguuaggauuacagauuugugccaccaugcccaacaaaauuuggaaaaacaaacaaacugaaacuggaagaaaacauugagcucuggugcccucaagugucauaauguugcaaaacagcuuaggaagacuauaaaauuugagcauccuuugacuuaaauugcuauuucuauauauuaagauuuuucuacaguucaaauugucuugcacauguacaauaaacuauaugaauuauauccccaccucuuguuuagauacaacuucaaauggcccuauucauuauaaaauaguaucacaauuacaugacaaguguaccauguuugcucauuucuuauucuucaggaaauguuaacgacucgcacuauggcaguuaguuuccugauuaagagggugaguucuauacuuagcaggguucuugaguuaucaugggccuuucaccauaaucauuugccauuguauuucucuaugacugucuuuuuuuuuuccagagcauauauuuauaucauuuagaaugguaaggccauuuuugcauuuuuaaguuuuugauaugccucuuacaaaauacaugaacuuguaugaauuuuuggguucauguacugcugacuaaaagaguggguacuauuuacauguagcucauaggucuaggaaaauauagguucuuuucccuguuacuguuuggaaucugaacuuuggucaauacagccagcccuguuuauuggcauguauagagucaaccaaucaugaauugaaaauaucuaaaaaaaugacuaugcacaaucuuccaaauacuacaauaggauaauaacuuaugacauuuacauugcauugguauuauaaguauguugagauuauguacaauauuugggaggauauguuuagguuauacaauuauauaggugaccuuugcaucuggauuuugauaucuuuagugucccucaaaccagucccucaugaauagcaaaggaugacuaugaagagaacugcuuguccuauagucaguuuagggcauugugguuccggaguucaccaaaguaacugaaaggaaggacaggaagaauuccaguucuaugacuaggaaaauauauagagauuuccaucaagcauguaugugauauggccacucuugcacuuuuugcuucuugagacaggguuuuaugcaguccauuauuggccuuaggcuugcuauguaucugaaccagucuugauucugcacugcucaaugcugaaauugcuggcaugugucacuacaccaagucuuuaacuuuuauuuuuauuaaauagaaagauuacuuaagccuaggaaaugaagaccagccuaugccacaaagacacugucuccaagacauuagaacaaaaagcaacccaauagaacauuuacauuugugggcuggagagauggcucagcaguuaaagagcacugacugcucuucugaagguccugaguucaaaucccagcaaccacaugguggcucacaaccaucugugaugauauuugaugcccucuucugggguaucugaagacaguuacaguguacuuacacauaaauaaauaaaucuucga

SEQ ID NO: 7227 - RNA, 62568 nt, Mus musculus
gagcgaauguagcccgcgagagaaaauggcggcggcggcgggcgaucgcgccucgucgucgggauucccgggcgccgcggcggcgagucccgaggcgggcggcggcggcggaggaggaggagcucuccagggaagcggcgcgcccgcagcgggcgcggcggggcugcugcgggagccuggcagcgcgggccgcgagcgcgcggacuggcggcggcggcagcugcgcaaagugcggaguguggagcuggaccagcugccggagcagccgcucuuccucgccgccgccucgccgcccugcccaucuacuuccccgucgccggagcccgcggacgcggcugcaggagcgagucgcuuccagcccgcggcgggaccgccacccccgggagcggcgagucgcugcggcucccacucugccgagcuggcggccgcgcgggacagcggcgcccggagccccgcgggggccgagccgcccucugcagcggcccccuccgggugagcggcgggccggggccgggcgggcaaugaaugaagcgagcggggcgcgcugcucccggggcuccgcucguuggggguggggggggagcccgcguccccgagcccugaaggucgggcggcgcccgggacggcguggggacgggacgggaacgugcgggagaguuuguuauuguuugcggacaugugacaggcguggaagccgcgaaggugcggggcuccccgggccggguccugagagcccccgcggcgcgaagugaguuuggggggcucggagcgcgaaggugacggcggugggucugcgcgcugugacagccuagagccccucggccccacggggacgcgcgcccgcgggcagguaccgggccgggcuccggcggcgcgccccgggcggccgggggauuccggggacugcggggggggggggcgccugucaaagcgacgcaggcggacgcugcgggcucgcggggcggccgggucugcggggacuccguggcugcccucgcugcguguccuugggaauuccucccgcaccucgggggcuagagcgcccggugcugggaguuugaauccggcuuugaaguuagcuuuuggcggaaugcugugggauccaggaccggaugugucagccauucagcuucaaagcuguggggacugcgccccgcagccccgcugcguggcggggacagggacggugcggggcugccgcuuugcucgcaggggucuuccggugcaccagaaguaggaugugcguaagauaguuuacaccaacggcucuuuggccucgcccuguuuuggcuacuggaaaguuuucuguuagaggaaauucuuuuaaguauaugauacuuaaaaaaaaaaucugaugaaaauacacaaaagcauaaaaucuugauggaugugugaaguugcuggauauguuuucgucaucgucacccuguggccccccguagaauuucuugacguuuacuguggguggagaguguuuuauugugugucgaaucugacaguaggaauccuugguuucgguuaguuaucuaaguaauuugacccccuuuugugcucuggauuguuuaaaaucacgguccguuuauuacuuggaggucguuuucccuccucccaacccccaagcccaguaguaaaaaguguguugaccccuggcuguggcaggauugggaggaagguaggcaguaagcagccccgaugcagcuuuucugugugugugcccugugugcacuuguacacguaucuuccucuaggguuuccuguuucugugcagauuagauuaaaacuaaccagaauaauucuuagguggcaacucuuacuacagaucaacuacagaugaaagaaaaaacaguaacucaaacuuugaggaauuaauuuuaucuaguccugugagaccugauuuuuuuuucuauaugauaauacaguuggccacacuuaagcauuuauaaagucaauauaaccaccuaugaauauaccaugagcagcaacugcaaaaaugacauauagaacuuuaguguugccucuagaaaucagaggaccaaggugagggcagguagaauugaauaccugaguaaucugcuugauuuuugcgcauucuucucucucucucuuuaucucuuuaagcaguggcuuauaauuguaaaagcugucuuuaaaauaaauacugcuagcuagaauucuguuggugcaccucaaauguuauaugugauaguuucauuugcuguaaaauaucgauugucaauccuuuugaaauaauacuaacaccccccccccccacacacacacacaccccgccuccaguuuuuguaacugguuugaaauucauuucaaaucugcgggucuaaaacuuauaucaugaagaagggguuauccagaaauguuguuguguuuuggguuuccuguugugauguuuuauuauuuucucauuuaaaaucucggggaaaugauuauacggcauguagaaucucaguugaacaaugugguucccuuuucaaguagcgcacguucaugcuuugaagaggaagaucuaaugcugauauuuucgguuuguuuucaguaguaguagagagccaaagaccccucugcaugucuaaagaccuaacguauuuuucuuuuguuuuuuuuuuuuguuuguuuguuuuuuguuuuuuuuaauccaguuucuaaacguuggauguagaaauugaauguuuagaaaauacacauuuauaaaaagauaagcuaugggaaauucauuaaagucaaagauugcauguaugucugcccucucuccuucaguaaaauaacucaagccagugaaaguuuguccuguaaguggcgcccaaggguuugggauuuuuuuuuuucccuuaugccacagaauagggggcuuuuccuuccuagugacugucuuugaagaaaaauuacagugcugcucugcauugaacaggcuguugugagguuggcagauauaauuacucuguccuauuuuuguaguuucaaccaaacuaucaaucacuuugcugccccgugaaagagcaagcuaugcugggccuguuaguguuagccucguuuaaaacuagcgauauuucauaagccaccucugcugcucgggccucaguuucacuuccuuuuagaagcuguuaagcuaaaaauaccacucacugaucauuugcuagagggaaggcauaaaaacauuaauaauaaaccuaaaaauaaguccuuucaaacugugaguuggugauucucuaacaucauagauguagccccggaaguuagcccugagugaauuccugagcucugggacuuaggguuucucuccagguuuuguuuuaaacuggguaaggaaacuacuguauuuuuaaaagauuaaccuuauuaaauaggauucuggaagagaaauaucagagcuagagugguugccagcuuuuguuuucucuucauaucugaucuuggcaagagugacugguuaaccaacauuccuuaauaugugauuuccaauacacuauaaugacuccauuuugugagauaggcaaacaggaaggagccccauugauugaugcuucuguuccucuccaaguguugcauguuguggaaauggucacugacgugugggccugaagcuugcaaaaugugcagaggaagggggagagagagagagagagagagagagagagagagagaggcuacaguuugccuaggaggagucugcuacccuguccuugacccugcuggccaauuccaaaggaagaagucgucagggagaauggauuauucugaggaaaucugagggauguuccaaaaugcaguuaguauugccucugcauucugcacucggggcgcuucccugagcugaggggaaagcuguguuaaaggaagugggaaagcgugaaugggaaggucuugguccauggcgggcacugcugaccccgugccugcacuuuucaacguaggaugauuuguuuguaucacgggugucacaugcauccuuuagacuggccgucuuccuuggcccuggccuuucuguaucuuuagugaaaaguuacaguugcugaaaaaugucaagggaacugguaaagccaggaggagguagacagacagacccuagcaugagcaaggccuuggguuugauugcuaacauauaugcaauauucaaaacauaacaaugucuuucaggcauaucuugagaguauuuuuagucaugaaaaagagucaggaccagaauucaggcaaaugacucaccagaagcgggggcguuagucugguacccucuagaccacuaaacguaggaauuuuaccuauggcuuaaaacacacuuggcggguguaugcuuuuaauacaguuagcuuccuugccuucugugcggcugacagauuacauagaucaccuuguuuaaucgccacugccgcccucucaggcaugguaacuuguuuggggagguaaaaauuauuuggauguagagccccccccccccccgccccccaugaacacucagccacagagaggaguuaggacucgacccaagucagccugccucuguugccagcgccucucauuaguuuuugcuguuucuauuuuuguuuucaaguuaauuauuaaauuaauuuaugaacuuuaagaaggaaguugcucuguaggagucgugagaggacgggcgcggacucugcccugccuguacagaucugacacauucucuaacagccuugcgugggcacaggcauuuuacaaguaaauacuauguaugccacacacacacacacacaccccaaacccccugcucuggcaaagaggauaaaugauuaguguugaaaguuucuuagauuugugccauauuaaaucauaagugaaaggagacaaagaagcccgaauaguguucccacugucuuagauuucauucauucaguguagaugaacuuugcgagacaguggucuggcugaucaaaaaaggucacugguacagagccuggguuucaguuggaggaugguagagugaccguguuuugugauccuauguuaagugcagagugagagaucgagagagauagugagagaaaugggggggggggggagagagagagagagagcgcgcgcaaaaucaguccucugaaccucaccuacagccuuaggugaauacauccguaccuuccuagccccugaggccaguuuuaagucaguagcuaggaaagcuggcuuugcccccugcuugguauuccugcuccuuuccucugguuguuugcccuucucugagaagagaggcacgcuggguuugggcagccucagccauaguaaacagauacagaucugguucacacucugcccgcccgccugccugccugcucuuauuaagagagauggagacagagcugcaaguucaggcauggcuuuuuuuauucucuuguucuaagagaaaauuaaaacaaggguaugggauccggaaacucaauaccugccaacacugguuuuaaaccugggcccuuauuauuugucaaagcagcuccugauaggaaaacaacucgagggagcgcaggacguguuccagggcguggagugguccgguuaggcuguuuuucucugcaccccaguuaaugcaggugcgugccguggaaaggguacucagcuccagcagcauuugaguuguuggcuugauacuauagccauuugguauuauaaacuuagaugugaugcguugcuuggcagaauuuuuaagucuuaaccgggugcacgguuuaaagugcauggcugucagcugggaguuccuacuguggccguuggaccucuugaaggcucgaggaaaccccuggagccacacgguaccaaauauacuguccuguaguuaggauaagaagucaguuugucaccugcgugccuaucugucccggguauguguggaguaggaggggguagaggcuagacuguauaggugggcgcuuugcuuccugguuggcccaagaaaucauuaacugauagguuaugaugucaccuuuaaacaggucgcacaacauccugaacacuaguaccagauugggaauuguaauucccagcguugacucuucguguuuuguacaucgcuugguauugagcagaaguguguugguauuuaguaaguagucauugaaaauucugacauaggauuuaaaagcuaugauaauuagcauauuucaguaacuuacagguaguuauaacuggagccauaugcaaagugucagguacugagaaagugagcucuggcgucuaacgugccuggugacucuaacgugccuggugacuugggaagaugguacagcuuucugcacacauuagcaguucuuccuuggagauuaucuccagccuuugggacauuagaauuaagucuucagaauggcuccaagcuuucccuauucugucuccuugcgcuggccauucagaauaacucuggaguuuguuuuccuggucaugaccuccccaggacugcagacugcaccagaaucaagcugcuauucuucccuaaaccagugccagccuguuccugcucacuaagugcagaaacaggaccuaggacuccuccugggcaccugcccaccucucccucagccuuguucacucucccgucauuugccaccugccuaguccaggcagccacccuguggacuggagagcagccuuuugcauccuuguguccucacuuuugccuucccagacauguuauaugccugagagccaugcaaaccucaccuuaaaugcaaaccucaccuuagcuuccuaccaccagaaaaaaaggaaggaauucuauuaaguccaaaaacuugcuaagguuuucauugaauuacagaccaacugaaucugcaguguucccucagcagucccuggcuggguggguucgcuaccucuaccucugccucuuggcuccauccuggcucgcccuagucccuggcucacgccccucaucuccucaaacuccaaacccugccuccugcuggcagucugugcuucccauguuccucugccuugcuugagucucugucccucaguacuuaaggcagccucacuguugaaaucuuagucccuugucccuuccguagggaaacuuuuccacuugcccagucugacuuugugguguggugccccuguugacgugguugagguuuuaaaguuaacuccuuuguugacugacugcuggccccagaagacuggccucaggggacagagcuguggcuggguaggaaccuaacaccaguggaugcucgcucaacaguuucacagcugucugcggaaaccgaacaugagggacagcgccaugcguguucagacaaguagauccuguguucuucccucuggucagauguaguugaugaccuagcugagaggggcucaggccauaaaguauagacucaaccuacagguucuccauaggcuggcuggaaagucgcuggacuuguaagcaguacccggugccuccaguaaguaggacagccagugugucuggagcauguguggcuguacuccccgguugccuucagguauaaggaguuugcucagugccuaagacuuuucuguacugacugggugguugaaaacacacacauaggaauaaguacgugcauaaggcuguugggccuuaaugcauagcucuuuuaccaaguucucaggaugguguuuaauguuaaaauauacuucuaggauuuuugucuuugaaaacuggcuucugagaucgauagucuuggcgagucacuuggggaugaggagacguccauauucccauugaagaaaagauuugcuaggcaagcacuguaugagauuucaggcgccucagacucauguaacaggaaccagacaggagguaacugaagccagcaggucccuuaccuagagcacaguuuaguaacuaagagagaaggccgcaggcagccaaagggggcggggcaggggagaguggaucugugaaguccuuugauuuuacaagcgucucagggcauuugugcaggacuggcacuuauuuagggaguugcagucuuggucauuugguguuccugccccacagaaguuagaggaacaaagugugggcauugcaggaggcaagcagguugcuuucuggcaagagguaucagcaggcugaccccaggcagugcaagaggaaaauuagaauguacauucagggucaccugguguugggacaguuagcuccgccuggguagacaggcuugcuuguuagagcauaaccccuuugagcaucaugguuugggugucaguuuuuccuaagcugcagagugaaugaauggauucaagacauaaaaucacuuugcuuucuaacaaguaugguuucuuauuuaaagucauuuuuuggucaucuuagagguuguagcauguguuaaggaaauuuucucagauuuuaaugcuuaagguggugagccuuucuaagugucuacagcucugcaguccagacagugaauaaaugaaguuuucuuugaauuacauagaguggauauugcugauuauuucuaguauuuuuuuucuaaugauauauaaacaucuugugaauccucugugugggaaaccugcuuauuuguuggucugcaguuucuuugaaauaacaauaagcauaaagcugcccccaguauauucucagcuuuuucccucgauuuccgagggucgggcacucaguucuagcuucccacccagcaucgcccaaacuguaaauuacugaagguuugggguuaacgagagucgcuugcaaagcguuaauugugugugugugugcucuaggacagcacagcauggccguuucuacugcuuuuccucugagaagcauuuuaauugauucuauuuguuacugauuuucaggauuuuaguuggugcuuuuuuuauuggaccuuagauuuuuuuuuuuaaaaagaugugacaaguuggggagguagcucagucauaaaggacgcuucaccucugcagaggcugcaaaaagaaaagcaggcagacagacagacagacagacagaaaaggugggccaggaaguguggguacuaucuccuucuuuacggugcugaugacaacccagagugucccacaugcuaggcaagggcucucccaggagccagauccccgccuguauuaguauucuugaaagggaggguugugucuuggggggaaggcaugaacauagaucuuauagguuggcuuuaaacuccguaaaccgccuggcugcccaacugugucccucugcgucugcuucccagugccaggacaagugccaccacaccuggcuuacucugaaauuauacauuuuauuauuuaguauacuaaguauacaccucucugccguuuauauuacagugaugaaguaaacuucaucaauaaaauaauaaaugacauauauacauauauaugucacuaaagcuuaauuugacaauucaaaacaauauaaauaucuaaagauagacaccuauauguguauauacauacauacacauauauacauauauauacauacacuuaugcucuuggcuucguaaaauaaauaugcuggcauaaauuguuguaugaaagggaauguguauuuuaaaauauaauaacacagccagauuguccugugaaaccucgugucaguuuacauccaugccauaguaggggacagugaccauuuugccagccuuacuaacaugguauauugccacaguuguguuucaucuuccauuuuugucaagcugguggguaaaagaaaauuucccacuugaacuugcaugucuuuagcuugaucuuuucguucuugaggcgggggugagaauccuacauccccaauucaccacauuucaagcucugugcuggagaaaaagaaagccaaugggcgcccagaaacaagagucucugcugacucagccgugagagugcccuccuccagugauggcucucuauauccagcugucaccugaggaggucucccaggcagggcagaagguggcugucauuacuccuugugcucugcccucacaggagagccuccauggccuucaggaugccuuccuggguauauaugcuggcaccaucucccuaugggcucugcucucucucuuccacccugucagccucacucacccugagcuggccugcccuucucccccaaggguccuugcccucucagacuuuucuccauccuuaacaugaagugcagucucccuaaugcaguuuagaugcucugggaugcagccuccugucauccccaaaugccaccucccccauagacacagaaacagaacaccugaacccuuccauggccacuguuuaacgcuccugucugaagggcucacucugacuccucagugaacuauuuuuuguauguuuuuauucuuugaaauaaagaauuauugguauucuacuaaaaauacaugugucuauuuguggaagucagcccugagcuguaaacacugcccaacuccuugguuuagaaguucucuauagucacugcucuuaaagcgucuucgucuucucuuugucgcucgcugagugugugcucgcugagugugugcucgcugagugugugcucaugccuuucagcgcagcagcaccaacagacagagcggugucugaagcacacgcuguaaaaugaaucaaguguucuaacucaccgguguuaacguuucagacgugcgcuggcaggggaaaauguugguaccaagccgagacugcccuugagacuaauccaaggccaucacgggucagaccaagagguucaaaugcuucaagcagagagccuggcugggcaugagcacgucuguggcaggcuugugucagcugccaggcccccacagccccucuccaugagccuggggcagcggucuuagaggaacagaaggaagggcaguguagugagugugauagcaugagugacccgugugagucaccacucuugaguacgggacaccaucccuucaguaaccuugagugucagcuguccuauagugugucccugagagugugcugcgaauaucugccuggcucggggacaugccacuaagcccugaagcauucuuaagagugggacacucacaagaggcucucaagagaauccauuggcuaagaggguggaaaguacagaggcccagaagucaaugucagcgugauuagaaaucuguccuggguagcucaggcagccccaccugaauggagagagggugcagaugaggcucagacaccuaggauaaggucccuggcucuggccagcuggagagcuagacagagaucuccaccuggguuuuguuccacggaccgauccuuaggucucagugcuuagaacuaaauaaaaagccuuuguagcuggacggguaaccacgcugcaccaggaagugggucagcaggcucaaaggaggaguuucugagcugggagccagaccugccagccaccuauugccaucaggccccugggaaugaauaccacucuggagucuccgcuucauaucucugagcuccaaaauggagugggugaucgugagacaagaucccuuuuaaacgucucucauuaacuuugaugccagccacugcccauaacugcaaaggcuuguacuuagccgcucuuguuuuuagcaaaggccaucugugcacauagugaucaucuuguuagaaauucauuucuccuuacuauuuuguaaguuuuuuuuccacggggcggggggggggaauggaaaaguguagcuuuucgauucugcaauguggggugaaauagcuguuagucugguggcaggcugagguccuggaaaccccugcucugugcugcucacgugcaacagacccaggaaggaguggcagggagccccugaggccacucugagccacagcuuucagacucagacuguccccgcccagcucaggcaagacuccuccuccucugagaguccugacccacuuccuggugcgcugcaggcacuguagcugaccagcgcucucagcucugugaaguuuaguguuuguuuuccugaccccaggucguccuucaaauucuuguuccuuucugaaauuuaauuuugaaaguuauuuuuuguggcuaaauuuauugaaaguuuguuuguuuguuuguuuuuuaauaaacucuugcgguuucaaacuguuuaucacccgugaagagaagcuuaaaguacuauaaagagaagcaguggaagguaacacauggccacauacaccuguaaucucagugcucaggaggcugaaggggagagaguguuccaggcuagccugagggacauagugagagauccuguguacacacacacacacacacacacacacacacagagacauugaggcugcucauaacccacugcugagcagugggaccuuagcaggaauugcuguuugucucagauugguggugaagaacacuugagacuuccugcuucugcaagcccgccccucaguguugcaauguugccaucagauauagagauagguggcuggggccucacuguacguucccagcacgugauuuccagaccaggcugggugaagggcagaacauuuguuacagauugauucccgaggcaccauucugaaccuuugugucagacugugaugacuggcuguagguucugucgcuaggggaugaggcagcuggacugucaaucugcacagcgcacacuugggccucuccugcagucuccaaaguggagagugagccacuccuccuccaucccgagaggguuugcuaggagaccucugacaacagcgccaaagaccugggaagagaaccuccccucgugggcauaggcccaaaagauuuggcgucggagagaaaaggcuaagcugaagaacuuguuacuuucuauucuaccuccuuccugggccaaguuuuguugauacaaagucauuagcaucugaagucagcuucucucugaauccagcaacuugguaagaaaugcaucuggcauuuuauuguacaguauaauacuguauacauguugaugggucccccuguccccccaaaaaugcuagaugucccagaucuuaauccaugcaagugaguuagcagaaaccucguauccagggcuggggauguaguucaguugguacuguucuagucuuccugaagcucugguuccaucccuagcaccacaccuggacaccuaggggccuagccugcacccuggcuguucaggagguggaggccuaaggaccagaaguucaaggccacccugaggugccugaaacccucuagagauccuuuuacaggggucaacuaauaccaucuguauaucagauauuuacaguucauaacaguagcaagauuacaggugugaaguaacagcaaaauacaaguuuauggcuggggucccacaaccugaggagcuguguuacaggccugcagcaccccugcccggcugguugguucugucuuuuaaugcuugugauuaccuaccuuaaacucucuguccuuguucauuggguucccucugccccagcuauuucuuuuuguguguauuuagagcacaugaguuaauuuuauaauaaucagaaauguuuuaaaucacaaaacuagcccaaagccagaaaauuuugcacuguuggcugcugauuuuuuuucugauuuugaugcuaauguaaugcuaaucuucuguuuguuugcuguuugguuuuuuuguuuguuuaaguguauuaauaagaagcaucgaugcucagauuugcaugauuuuuaaagggucucagcuuaggaaucugcuuuaaauauugauucauucuuucaccaauacuuagguagucauuaaguccaaaucuuuuuauacauauaaaaugcucuuucuuuaaauaauuaaaauuguuucagaaaucucaucacuugccacucuuaauuugugccuucuugagucucgccuucuugucucuucuugaguuucuuugauucacugugaacugaguucagagaaugcgaucacugcagaggcuggccucucucacaggcuucugucaccugggaucucuaccuggaccugagggauaggccuucuagcccuguggcuuucauuggcuccaaacacacaggacuauuuuggagguuuucucucucucuuuuuuuuuuucguuuuuguuuuuguuuuuguuuuucgagacaggauuucucuguauagcccuggcuguccuggaacucacccuguagagcaggcuggccucgaacucagaaauccgccugccucugccucccaagugcugggaucaaaauagggaaagugagguugcgugguaccugcguagcccaggcugaagcacaugcccggggguucagaucccucacaacgguccccauaaacaagccaugcucaggagggcauugagcagccgcagcccuggguguggaagcagccauaggcacuccuuucaggcuggagcaggagagagagcugggagauggagagcaguccccagagccagugaacuucaacucggaacccucuuuccagggaauuagaccuugagagaagagaggaagaacucuccccagaagcccuugggccuccaaaucuguuuucugcuugugacaaaaagaucagacccagucucaagugagguagaaggugaggaccaacccaggaggcccccgagcuuccgaaugugcacaggccacagauguucccacaccuacacgugggcgacucgcucagaccuguaaaaacuaaacacaguuuuagauuuaaaugugucuacugugaugugcaagaaacuagacuccaaaugugguuaaauuuccuuauuacacacucaagguuuuguggaauuguuuugguuuuuuuuuugguugguuuguugguugguugguuuugggguuuuucgccagcagaaugagagauguguggguguaugcagucauuaaagguaauuguuagcaccuguggagcgcuuuaccuugcucugagagcuuguccaaacucugacucucaugcggcucacucuggugucacagaugggaauaauucaggaggcugggugggaaaggaaagagcgguagcuccgagccugaaccgucccucugcccauaacccagugaccugugcgcgcgcgcgcacacacacacacacacacacauacacacacacacauacacacacacagagagacacacauacacacacauacacacacacacacacacauacauacacacacacacacauacauacacacacacacauacauacacacacagagagacacacacacacacacgcauacacacacacauacacacacacacacacacauacauacacacacacacauacacacacacacacacacacacacacacacacacacacacaaggagcguccugcucccucaggcguuuggaaagucacuuaaugaacuagccccagcauagcuuaggcuaccccaagagagcuaguuuucucuuccagcaguuuucauuuuaaauucauuucagaccaguauuuccccuuuugguauguuugaguuguuggucaagccucuuaacuuguugaccugaagauaauaucuaagaccagcagcccguguaaaguucugccuaaauagagcucaggucauuuauucucuuauugauacuuguuccacuacugaaguaaguuuaugccugcgccugccugucugccgaguguucagggggcaucuuugaucauuaaaagcccuuagugucucugaacucaguccucugccaucccugcaaaggagaugaucuuugaguuucuaacuauggagaggguacccagacaagaccaagucuuaagggaaggugcacguuuucagccuguguuccucguguugcguugucuuauuuccuucggugcggaucauguguuugucacacccuaaauuuuauacauuggcugccuuaacucagugcgugacuggcaugguuggcuauguggaugccaccgugccagagacucagacauuccccacguccaagcuggagcucuggagguccacccggugcgaugccuggcucuccggcugcuucuugaucgcccagagcuagucucacauugaacucuuggagaaagccgaggcaugugguccccucggggaugacagucuccugccugugcugcauacgauacuccuuggagaaaaagaacuuguguaaaguugaucucacgucccgcuacacucauaguaauuugccuucaggacuguuuccucugaugucacuuuccuaagaacgugacugacagacaugcugccggguggagagaugaauggauggucccuaaugacaaaugggauuccuugauagguagaccagacucaggucagcaucucugaaagggcagcagggaacccaucuggcugcuuccuaaaagccaguaccuccuggacgagagccgaggggaccugggacguugccaagugagggacacaggagaggccgagaagaggacuuucccagagagcagaugguugguagcaaaugagggucacaggggaugacagggacuguccccaagacagggcagcuuauggagugauggagugguaacugcuggacuucagugugggacagaaggcaggugagcacaggcuagcucuaggcaagccugaggaggagggaggcugcagagagaugaagccagauggcuugcaaaggcuacgcaucugggggcugguagguuggcuuaugucuuaagacggauuuucacagguuuuugaaguagaguuuuguuuguuaaguagugggcgugcuuuucugacacauuucuccuggaggaaguuuaggcggggcuugauugggaguuaguaggaagccguuuauggugaaauguuugccauaauaaagacaugaaguaugugcauaggaguuuuucugucucgguucgagguguaacacgacacaggcucagcagauucauuaagaaugggcuaugccagacucuaggaacacagcagugacaacacaaacucccagcccucucaggccucgcaucuuaaugaaaacguuggguucugcgugcgcccugacccaucacugggcucuagucacguggcucugugcuguuugggguuuuuuccuguuuucuuggacuuguguuagaauguuguaaaugccugcuuuaacacuucaguccguuguucugugauccuaacuguccuuucaaaugagcuugugcggguaccgucuauccguuuuugcggcuuucgcagcaugcgugugccugguaacaguuaaacugggcuauuggagaagcagaggguggcaacaccuagugugugaucucugaguacuccagaaaugaguagagcauaccaaagucucaguaauuguuuagacaaaacaguaugagacauacagaaacacuuucuguagcuuucucucuugcccauggguagcuuucucggauggacaguguaaaaacguaucuauaagauaggggaguuuuauuugauuguucuguuuugggacagaacaccgguaaauagucccggcuuguccccucccucuccugggccuacaguacaagccugcccaaucacccaguuuacuccuuuggcuuuugucuugguuucucuuguggugcuggguaagcaaguaucacaccacugagcuauauaccccagcuccaaagugcagucgggaauaaugaacagaacggaccaagucuuguggcuugguuuaauucauuugugucuuuuagucacgugcuuuuuuuuaccuacaccuuggcuguguaucuuugccugucccgcaagucuugggauaaacuuggaagcugcggaacucaaagcgccgcuacugcaguaaagagaagccugugugcuuaaggacaaaagacgggacugggagacaaagccgcuggugcagccaccugagugucugccuuguuuucucuuaauuuacagaggcuuuuccagaauggugcuggaaaaccguauauccacacucagacugaaacuaggccuuucaccuuguaccaaaccacuccagagugaaucagaggccuuaacguggaccuaauugcuuuaagauauaacguagacaagacuuccugaauggucugcaguggcucagaagauaacuacaagaauuagaaaagcucccacaacauguuucccccgcugcucauugacagagugaauaccuaguauauauaaagaacuaagacucauaaaaauaacccggucaauaguuacacaaaugaguaggcggcucucaaaagaaauacaaaugaccagcaggugaacaugcugaacauggaaaaaugucaguauccauaaccauuggagaagugcaaaccaaaacuccacggagcuggguaugguaguguaugggugugaccccagcagaggggaguauaggaggaggaagguuaggucauccucacuuacauagugaguucaagaccagccuuagcuacguaagacgacacugucuuaaaaacccaaaaggaaaggcuguuuugagauuccugccucugggaaaccagcaccugcagcugaguugggggcuguggccugccgguaggaauguuaacuaguuuaaccacuguggaagccagcguggagguuccuuagacaaacacaagcagaauuccugugugauccagcugucccacccccagcagauuccuaaagagucuuaagucagaauacagcagaguuaucuacacucucugcaagguagacagccaguuuaggcgcccauccguggaugacgagguaaagaaagcgugcugucagcauacgcaaggcaauucuauucggacacagaaaaacggagccaugcugucugcaggaaaaugcacagauguuaaaguaagcaggacucagauaaauacggcauauuuucucucuucuguggaauugugugugugugugugugugugugugugugugugugugugugagugacauacacacacgggccccaaaguagaaagaggacuauuugauaggaagggggccagugggaugagguaucgggaggguagugguggacaucagaguauauuacacacauguaugaaaugucauaagaaagcccaccacccauacaguuacuaugugcagacagcauugcuugcuuccugccagcucuaucuuacccugugucuggguucgcaguuccugcacuugccaucccuggacaccaccccccugacugccuuaguucuccacugccucccagguugcuuggcugagacggcacagcuguccgccuccccgacacagacucuuggaucuuccucggggcuguguuuugucacuaacuucaggaaaaucaaauuaacuagaucacaugggcaaguuucaagcaaugggaaagcccccugacuaaggacaaaugaucuggacucagggugguuucuugcuaauccugccuugguguuuuccuggggccaaauucugucucuuuaaaccucuugccuagcaucugaccucccuucuccaugcagcgccccucagggcacagcagauguuucuaccagagaaggaucuuuuugguucggaggcuccuacaggaaggaagggcauuuuuuuuuccuucacaagcaucugcaaauaccaggggcauccguuagcacugcuuguaaacugaaagcugaguaagacaaaucuugcccucagguagacccaguccgaggaggacaguccacccuacucagcauguacuugccuaguccaucccuugugccaaccuuucuaguaagacagugauaguagacuugaaacccacuucugucuucauucccagucuggugguagggacagacagacgagugaggagcugugugcugaggaggcuggaggaagguucucugcacuguuacaggggcuguagccugaggggagcucaguuagugucuagggcaguauggggugacugaccauagggccuuggaaaugugagcccauaggcugauaaaagggguggggcugagggggucuagaugggccgcucaucaguuaagagcacuguugauucacuccggucccaguuaacuguaacuccaguacccucuucugaccuccuccgguacuuaagcacacuccggaugcgccuauggacaugcaggcaaaacacucucccuucaaaggaauaauuccaauuaaaaaaaaaaguccgccgugccccagggagcacugcaugaagggagcacgggcaccaguccuggggggacacaccucgggagagcaugguaggguuagcuuuuguucucccuucccucgugcuaggaaaacucagguucuaucagaacacugccaagugguuuucauguuucaguuugaaagucuugaggcuuagaacugugucguccguuaucagccugacugagaguuaagugagauugcuguuccugacagagagcauuggcugacccgcgugcucacgaaggagucgcuguugguuuagugggaauaauaguuucugucacacucucgcccaguacacgguuguuguuaaaacuggaaagugguuccgacgggagguuuagaagcacgcacccgacagucaugagucaagcccugccagcguaaagccauagaagugugauccugcugagucaucaaaagugaaaagacacuggcacuuaggacggcuucagggugccccugaggugaggaaggcauacuuaggaagaccuugacuccagcuauauuuggggcaggaugucagagugagugcugcuucuguucgaagugauuugugggcaggcuaccuuugcuauuaauaaucgucuaaauuacauuuuuaaggaaagagcgcccccuaccgagcaaagcgucguuuuuccugauccccuucccuuccugugaccuucggguuuuccagacaaggcagucagcucuaguugguucaucuugcaguaaaggggcagccggcagccaggaugcuccuaacaccaucuaaacagcacuuugcacguuucagugucccaaccaacuggcucgucucaugauggacacauuggcagagaagaagagaacuauucuaaagagugacuagggagagugacauauggcauguggcuggggccaugaucuacugggagcugcacucucagggguggggcugcuacugagaugauccuguuacugagaugauccugucacugcagggauuccugggauccaccugcaaauccagaccuacggaggagugcgauccaccugggccuuuucagucucaggguuuuaauaauaaauagugugcucucugcugagaagcugagacauggacgcuuagcaaacaugccagcgucuuagcuaaggaaugcuauuucauaauuuuguagucaugauuuuuagaggguugauacacuuuugguaacauggcuuaauuaauuacuuggcauguaucuuagauuuuccacuuugcugaacuauacaagcaucugguaauuuuuaagggauauguaaccuacgggcugaauugauccguacuugcgacauguuccucuguauuauacagccuguaaaaggauuuauaucaagaucaugaacuaauuaauacaacuacaggggcuggcgagauggcucagcugugacaagcauuuuugcucuugcagaggaccuggguuugggucccaacaccaagauggcagcucacagccaucuguaacuuggguucugagagaucugacacucucuucuggccuccaugggcaguacucagacacaugcagacacacacacacacacacacacacacgcacgcacauacacacacacaaauaaaucuuuuaaacccacaacuuuaaggaguuagaacgugguauagaauguguguguguguguguguguguguguguugugugugugugaagucagaagcaccaaguguaauucacaggaguccagucauuuguuuuguuguuguuugagcuuaagauauaucuugaaaugacagaugccuaaauaaugaauauuaacugaccgaauagcuaauagucaugagaagaugguuuuaaaauuauaaaauacucgguuauggcaaaaguuauacuuucagauuagcccucagaagcuaaugugagccagggguagcgaugaucccagcacuuggaagggaaagcugggcaggcaggcagcucgaggccauccuuggucacaguggguuuuaacugauauaugcgacccuguccaaaagugagaaauaagccauaauuucaugaguugauacaaauuaagcauuucugguaauguuauccccgguucuuggcaaaguaggccaggugcccacaaagaggccugugcuagagaguuggaccucaguguaggaugucacuguggcugcacugccaccaagccugggcaggcgcuccuagccccccuccagccccugaugcucuccaguucccugcacgccaauauggagaguggcucugugucuuuuaagggaugacauugaugaugcaguuaaucuucuaugagaccgcaacaguaauguuuucguguaaaacagccuggaaacccaugcuuugcacucgcuacuuaacagcuugaauguucuuaacagcuuuagaugucucuaagagagcuuugaaacgaugcccaugccuaguaacuaaguuaguacuguucuuaaaaucaucaagcauugagugucuucccgggccguguuaucacagagcgugugugauccacauagcuucugaccagauggagaucauguaagagucccacguuuaaauaugcuggucaccaagguugcucuaggaagcuuuguuucugaugccguguccucgugccguagggaaauugcaccugucauuugacagaaauuauaugauccuaguacccacacugaacagacccaaucccugacuccugagcccagaagagccuccaccauagucuucauguucuucauguuucuagccaaguauuaccuuccgaacccgaugggaaaaggcggcagugggguggguaaugguucuauuuggugcuuucauguaugcaauaguaaguauugcauacaugaaauaguaugcaauaguauauauguauguauacauauacauucacauauauaugaagcaucaugguuuagguggaaggggagaaagcuuugaggacagaaagaccugguuuuaaagcccccaaauucucucguaacugagagcucauagacuacuuaaccuuuuuguaagagucuauccucagccaugaccgugagucuuggcugugcucagaccuggagcagcaccuggaccugaggcagucuccacagcacaguguaacagcagcaguguucauaguucuaguagucccugucuccccauuuuacuuacacaagaggucagcagggggaggcgugaaaguuagcucccuccaaaguacccuguauacagaccaugcucuggaaccgccuuacggaacaguaaccccgcuugacggugaggcguguugaacaacuuggaccucaguuacauggcgaguaagauuugacccuaggcggccuggcuccagggcucacaccccguggucagugaguucgcaucugaccuugucucccccauccucggaacacgcauuacaagaaaugcgaucucugcuguugcauauaugaguaacguguauauacauuuuccugccaaguccaaccuguuaaguguuguugucucuuggauggaaacucccuguguuucuccgggcuuuggugccucucuucccugcgcacaugcacaccugcaccccagaagggaggcuuccuucuccuccucagcgcagcugagugggcgacuguggucuguugcuuucuuucugucuuuucuggagauugagacuccucuagcugucagaucagccccguccaucggccgugauggccuuucauccuccuccagggccugauguccaguguucucugacaugauuggguuauaagucagccccugccugcgcuaggcuguccaugcugaaggcuaaaggcucaccggugcugucuuucagacccccagggucuguuaccaggaaaagagaacacucuacaggccccuuccaaagaucugaauaguggggcuuucuugaggcaguaaagcgguuuuuagagaaaaaccuucuuaacuucuuugaacuuacuccagaacucacgcuucggcugagaaucaacggaccagacagguguagcugaacucgggcucugccagccuuuggauggagucagcucccauuguccgaggaccacucccuucacugggagauucggauuuggagccuuugcugacacacacacuaaaaaaucucccucccuauuugagcuccugaaggcagagcuuuaugaucacugaagcccuauguuaacaucuaagacaguuggugucggguucuugucuggauucgcgucuuaggaauauuggcugcugaaacggggucuguaagcgaaagccagagcacacuucaugcaguguguuccguuagagcagcaccuccccgucgggcacguuccucucgcaagaguugccacgcugagcagucgagauggcccuugugggccuucuuuccugcagugcaccuagguuuucacuaaaggcuccgagacaggcugcagcgagcgggcucggcugucuguugcgcugguaucuccuggucugcacacagauguggugucugggaaucauaaaagcauuaucucuucaaaugguguggccccuguguaguuuguacacgucuacaccaucauccuucagaggguccaugucugcccaucccgcuauugauaguuguucaggcaccaccuccucaguagaccuuucuagagcuuucuauagguaguuagcaucgaguugauucuacugcagcguuguguacuuucguacuucuggggccgcagaggugcuguucuguguaccuucugugcauuuauuuuuauccuccugccugagccacugcccacaugggcaggugugccacucccaaguagaauggucugcuagcuuuccaggaaaccguuagucuucuauuucaagcauccuagcuagcaugccuucccacccaccagaaggaaagacgguagcccuugcugucccucagggugcaaagaaauucuuuuagcagagacugcaaaagaguuuugcauucuacuucaguauuaaaauuuccaaacauuuaaaccacgcuaauggguuuuauauagaaaauaguuguucaaagugccauguaauuuaacuuuuaaccacucuuccuaaaaucugagcuggaaaucuguacuaacagauggcuucccucggaacuagccuuguucguugaagcucuuagaaagacgacacacguuuggaccaagugucaaaggacauccacggacuuggggucgucuugauggaaagcagagcagcgaaagagcagccaccaucccugccaguucccugccucgugacacgggcucugggcagugcucccagguggagcacuggcaggagguagcaggcugccuugcuaagaucugcaccacacaagugguggagacccagccugcuucucuacugaagugugagaucucauuaggcuuggccaccauugucugguggacuggucccaggccuggaugagucaaguagcacaaaggggcggaauucuugagaggaaauagacaggcaaacacuuuaaaaaaaaaaaaaaaaaaagcauccuuuucccugcucacuaaggaaaaggaugcgcacagcaucccacucuccccccuccccaaggcuucuaacggacgguccuuuaucaagaaucaaggacacagccaggagaaauauaaacacuggaauuucuagcagugaauaucaaaggaauacaagcguucguggguguuuguggggacggaacaaauggggcacaggacuguuggcccgagcucucuuagaaugggcacucgggaaggugucugcguuaaacccaacggccuuucugaauuccugcagaaaaucguuuagaaguaccguaugagaauggauuggacuugacuuuaauaaaugugugauuggaugcgguugucugucuagaggcuugggcccagccaaagcucagcgagcagagcucagugagaaccgcgaccaccucaguccagucccuggacccacgcguggacagagccaacucccaccucugugcacaugugaguguaaaaagagucuagaaagacuugggcaugucguaaacgucauagacuucagaagucacaggugauugacaaguacggaggggagaggggaacccguauagaacuauucacucuuuaaaaacuaauauaagagaaauggaucagcacuuuaagaugcuugccauagaagcuuugaccacccgacuucaauuccuggccuucucggaaaagccagauaaagcugucugaaucucuaaucccagaaguccuguggcaagaugggagguggggacaggagaagcagcgaggggcuguaggccggccagccagcuggaggagaggaaaguggcagagcaagagagcccugccucacaacccacauccgagguggaaaaccugacuccugagaaguugacugcagcuuccacauguggaccaggguacgcacaugcugccacugguacacgcaugcacaugcaaauacaaauacauacauguacccucuggcgcuuauauacacacacguacaugcuggcagucaugcacgcaugcacacacguguacaugcuggcaguuguacacgguuaauuugaaaagugguuuaugcugaauaacugcucucugacauuuuauaaucccuguuauuaacugugcacgguggcuuuucacccagucuuaccaagaguacucguuaagaagcaggaagaccuuuggguauccucugguucccuuugaaauuguucacauggcccccuagcuagguugguugggccagcuaccuucagcauccuccugucuccgccucacagcccugggcuuacuauggaggcuucuaugaccaacuucucuaacuguaagugcuuggugcucaugcauguguagaaaaugcuuuacccaccaucuccuaagccccaagaguguucuguuuuauucauuuguauguuugucuugucaccaagucuuacuauguagccccagcuggccuagaauucauucgcuauguagacuaaacuggccuugagcucacagagcucugccugccucugccucccaagugcugagacuaaaagcauaugcugccacaccuggcuccacgaguguuuuugaaagacaucgcuaacccuggcucaggaaaugggggcaugggguccagccuguuuucuugagauaaaauuuaaaugcauuugggaaaugcaagagcaagucaauuaguuaaggccaaaaccuucaugccccgagacacagaacagaagguuaaacagaaacacaauccacggcuuucugacuuuucuuugugugcugacauuauugcuucuuagccaugauuaaccuugagucuguuucacccugagcuagaacucuucauucuggagcaagucaaaauaguacaauuggccaauaguuucuaaguaagcgagccauagaagagaagucacugaugagaaaacaauuaacauuaucaaagggaggccggcacuguggguaaacaccaugacuuaugauccccacgcucacugguguuucucucccacuuugcagcuguggaauaaaaggacuugaagaaaccugagucugccgggcaguggugacacaugccuuuaaucccagcacuugggaggcagaggcaggcggauuucugaguucgagaccagccugguuuacagagugaguuccaggacagccagggcuacacagagaaacccugucucagaaaaaaaaaaaaaaucuccugugaccuugcuuuggaagugcuagccguuacauauaccaacagccuguguagacuugagcgcugcagugggcagagguggaagggcugcccuucaccuuccugcucaggaggccggcugucgccagcaacaguccacuuagcuaaaacacagcugucccaauacugaaaugcagauuuuuggauuuuguuuuguuuuugugucucuaucugcacacguuccccucuaguuuaguagaccugucaguacucauuucuuuuuugucaccgguagaaauaacugacgucgcggcuaagcagguuugguuugguuuuauuuuaucauaggaacacagcucgugcggcgcccuguacugagugaggcguccucacauauccaccacucacugcauacuucccuggcucucucuuggcccuuuccgaggguccuaggcuguucccuuguucuccuugcuccuuggugugugauuuccugcuagaguaagcucuuagacccgucugggagcagucugugucucacggaacccgggucuuucccacaauuucucuucuggacaccacaggcaugaagagucuccuuaguacagccacccagagucuacacuauuaaaguaguuccuaucugugcuaaugaaugaccugugcuaagcaguaagauuguguugggacacuaguaguagcugcuccugccacacaggagcacccuaaucacaaguagaauuuguguacuucucaaauucugguaguaaaauggaugccacuaagagagagagagacagagacagagagagagagagggagagagagagagauauuauuaauauagcccaggcugggcgugaagcuugcaauccuccugcuucagccucccaggugcaguugugccccaagccugguuuauaaaaucagguugccugcugagccauccucuaggacacaguuaacccuuuguacuacuacguagccuaucaacuuuuuaaaaaaugguaggguucugagcgucauugagcgccaugucuaugugacuucguugugcaaagcugaaaucugagcccguuuuugggauuuucccagagacuagaguguauuaggguguuucauuccagacuaggugguuuauauuuguagauuaauuuaggaauaaugaaaaaacccucuuaauaaauaccauugagaucuuggcuuagcugguuaaagaaucgugaaaaugcuucccucacugagacaugccuguggcccuugggaguuacagccugucacuuggggcaguauuaggcuagcacuaauugucuaguagcugcagagggacccagugcaacccuccugccuacuuuuauuguuccucccucgguagcuaaguccucccggaguccugacuucuuuauucuaucugcgccuacaguuuuguuuuacuuaguuuuuucuuuguuacucugaucccacucuuuaugcagugacacuuuucaagcauccuacuuucaaacugcaagauguccaauaccaucucgguauagagugucuuugaaccaaggcacacucuuggaccagccaacuaugaacucaacagggagaaagccccuggggacugccccccaccccuacacacauacacaccucugauacaguauaucagucccagcacacuuggcuccucccauaggaaagugcugaaaaugcaguccguccuguaagaucucccagugcugugaggaaaccaggaauuuagaucgcguugcaauggauauguagccugcuaggauagaauagcuagugacuacagaauacuguagggaauuuuguauuaaagacgugaggauaggaaacuuugcagauugcgugugugugugugugugugugugugugugugugcagacuaucugcaaagacauguauaaauugucaguguucuuagugcuguaagaacggggcgugccuggcguguaaggcacuccaggaaaggggccuggcuuauggaacugaugaacccauaguaagcugcuuagacccagacauuaauauaaucauaauaaauaauauaaaaacgaccucuuccaagacagaaggggacucuugaagcaccuagaguuucacagccguacuccauacguguagaaaaagcuagggaaaccuaacaucaggcugagggguuuuaaaguucuagauccagcauaaaauggccugggcuccaugcacccggaucaacaggaacaguccugucggcuaguguuugccuuucaaacucaugucacugcagccuuguucuugcucuaagucuuccaguaguucuccccagaaguauuuuggcuuuacuagaaucagcuaacuuaaaaggucagacauguauaaacuauuuuagcuaaaagcccguauguuucuagguaauaacagccaugguacacuaccccccaccccacacagugugguuaaccagccaucagaaguuccuaguagcuucaaggcuuccugacuauaguagcuuugguuaaaaaaggaagcucgcauucuacuguagcuguaguguuccuuggcuggcaagucguugcuguguacaugugcacacacaaaugccugaccacuggagacccugcugucugucuguccguggauggacgacaagcuaggagccugcugucuguggauggagcacaggcgaggcuaugaauaaaccacaguguaagcacgggaggaagauuugguuccugcuuuccacuucaaggacaacggaagcaguguguguguggggggggggggggggguguuuguuuugguuuuuuuguggcaugaaaaaugggauguacugcauguuuuguuuuguuuuucugagaucucagcguuugcaaauuauaccauuuuacaaucuaugaaggaaaaaacggucaccuaaaaauuuacaugucauugcucagagccauucagauuucagaugacagaguguaaaaaaugugcauuuuagaauuaacuauacaaaauacuuaugagaaggcuaaaacucuuuguuuauguuuauagauugauuuaggaaugaugaauucucucaauaaauaacaucagaguuccagacguaaucacaagugcagagugauaaaaauacuaacauggaagucauucagggcuagaagugguagggaagcccuuaggacugcugaagcuguuaguaaaagauaacucguuucaucugaggcaacggucacucgguacugccugugcucugaugcacaguggaucgaugaagcgugugccuccgcgugaggagacgggagagaagcaggagugugagcaccuaucuccucugagcugcucccagccugaaggaggcucccugaaaacgcccagcaagggacccucacuuaucaaggcuccaggaggagacaguugucuccaguagaguuugcaguuggagggaggaggagacauguuuguaaguugcagugaucacuuugaaggagaaagagcugagcugggaaagggugaacugacgcagucucugaguggcuguguagaagugaauucagugagaagucaggugggacauagccuguccaggacaccccagagccuuguguccuggggcuggagaaaaggcaggagggugagccugggagacugggguggcagugagaauaagccagcuccagagacccugccagaccugcgcgccccgucuccccagcaguuguuacugcagccuggaaccuugugacucuucauggcugagggguugcccgaggguccuccguugguuuccuuccagagccuugauaagcaugccuugcuuagaguuuuaaggaagcuuccuucaggaggaaauagguacccacuuucuccugucuucucccuuuaccuccugucugacuuucuuacauccucuuuuacucugucaucaccaucgucaugguaacaacaucacaguacggaaucagcaauggaaacaaauccugcuaaguaaaugaaccgucauuuaagcagccuuuccacccggcguucccucuugcuuaggaaccuuuuuuuuuuuuugaguagcaggaugucugcuuuguagccugcccugucuuuugcaggauucaggucagauguagagugucaggucagauguagaguguccuuuucuucccacgggcaccuagucguuuccgacuguguccuugcugugugcugcuugggccacagucucgguguuucauuggugucuggugagcacacccucgccgcuccuguguaccuuggguuucuuuuguuuuguuuuuguuuuguuuuguuucuguuuguuuguuucacucaagcugcugcuucugaguugugauuaacuggaaaauucccugacaaguucgaaguuagccuucaggagugaguucaaggucaucguuucugguguuucuacgagcguuuccccuuccugucagcguacaaaaaucauuauucucuagccuuaccgggcuuuccaaaaauagcuacugaaguuagccuagaauucuaaaaaauggguccuucucccagaauacaggugcuuagccguccccgggagccaggcuuugaagccugcgcgcgcacgcauauuugugcacgcacaccaguggggaugggugcacuuugcaauuagcggucuugcagagaauggugcuuuuaacuacuagacuuuguguaauuaguucccugaagucccucgcuuaaagauuaucuucauucugguaacucacuauuauaaagugaaggucaaaauguucguagcagguccuuuccacucuaguuaugaaguauacaccaagagcuucgucauagugaucuuguuccaggaacacgcagacuugaucguguugucucaggauaucggcaugaguccuuagaaaaucuaaaauaaggguagucgggagcuuuccaaauaccuguuucugguauaucguaauaucgguguggugggcgggcuuugcuaaagcaauagcugauguuuuggauuuguucuggcaucuacuaagaaaggagcugcauuuguauauuauuaggaagccuacaacuucuagguagaaccuccucuuguuagagauaccguuaaaguuggugguagcagacagugcugagcggugugcacgcuaaacacagaauucaugaugcguggugguuuugucccuuaccgcuguuuuucuggggguuuguaacucuguccuuucaggcaccugucaccagggcaaaacaaccagcuguuuacuugugcuuaggaaucaugucucgcaccugacgcuuuucuuguccuuauuucucccguaacuuuagucgagagauggagaauaaagaaacccucaaaggacugcacaagauggaggaucgcccggaggagagaaugauccgggagaagcucaaggcgaccuguaugcccgccuggaagcacgagugguuggagaggaggaacaggagaggcccuguggugagugcugugggcuccggcucuggggaaggcggcgcaggaagugaggagcucaacuuccugucgccuugaaauaaggcauaacuaaaacucugcccaguaagccacuuaagccgucacaggacugcguuugguggagcgcauaaaggaacccucugacggcagggucuguacucugaguagguuuuguacuggauucucugaauaaaaauucuaauugauuucagacgcuuuaugucugaucaggccuaagaauugugcuuccagaaaucuuucaggaaagcagggggaaaaaaaaaucagauuaaauagacuuggggcuaaagauaaaauuuauggagucacaagaguagccagguuaagaagggaaaggacccugcauccugagcugugauuuccgcucagacaguugaagaugcugugguaaaaugcaccucuguccagacagagggagagggagaggccgccagucucuggaaaacgcuuggcuuauauuuuucuuuugaaacagaaacagcaaugcauuacacuccagccagccccugacuaaacccugccacauagccuucugcuccuuccucaucccacaggcauauucaacauuaaaucaacuaaacacaaaauaaaaaucucagcuuugaaauuguacuccaugucuuaguguccugccugcauguugucuguguaucauauguggugcccacaaguaaugggauccuucaucauuucguucuuuggagaggagagagagaaauaaaggacuaagcuuagaaagaucugcugaaacacuuuuagaugugagagagaguggagaggggcucaguucugcuccgucaaaacuaagcaguagagaacuaagcagugaacaccauuaaagguuagagcgugcuccaucagagcuuagggccugcuccaucagagcuuagggccugcuccaucagagcuuagggcgugcuccaucagaccuuagggccugcuccaucagagcuuaggaccugcuccaucagagcuuagggcguacuccaucagagcuuagggcgugcuccaucagaccuuagggugugcuccuucagagcuuagggcgugcuccaucagagcuuagggcgugcuccaucagaccuuagggccugcuccaucagagcuuaggaccugcuccaucagagcuuagggcguacuccaucagaccuuagggccugcuccaucagagcuuagggcgugcuccaucagagcuuagggcgugcuccaucagaccuuagggugugcuccaucagagcuuagggcgugcuccaucagaccuuagggcgugcuccaucagagcuuagggcgugcuccaucagagcuuagggcgugcuucucuuuaagcuccaggagcuggaguuauucuacagugcuauauggcaaauccaaccacauuaaugcuauauuauuuaaaacuaauuuucucucacugucuacuuucuggcaaaugcuuaaauaccuuguauguggggcaggaggaaagagagaagagauguguagaguaagugacauaaccuauaauccuugagcauaauugcccaucucgaauucuguggcuuacagauuucaaacuauccuuaggaaguuuacuuuguacuuggaaggucuaauuauuuuuguuuauuuauuuauuuuuauucaguugccuuuaaaaccuucuuaaaacacuaaauaauaaaaaaaaaucuccaaacaggaaauugaggcuuacacccauaaguaaaagcaauguguaaaauaacacaaauccccugacgagcagguaccagauggaugaggugggcaggcgggcaguaaagacuuaggacagaugaagaauguaggcuugggccagcaagauggcuccauggcuaaagggcucgccagcccagacagucaggguuugcuccacacagugggaggagagaaccaguucauaccaguuacacucugacuucacacacaaguaaagaaagaaaugcaguuucgggcuggagagauggcucagcgauaaaagacuauaagaugcuguucuugcuaagggacugaguggccccugaccccacaucugguggcucacaccuguaacgguagcuccaugggagucccugucucugucauccucaggucccugcacccaugugcaugcucccccauaaauaaaaauaaugaagauaaaccuuuuaaaacuacagaaagcuuuaaagaacguagguuguguuaucagaacguagguuguguuaaugaacgguaggauuggaacgaaacgugagggaugagugagcagcccucagauggaauugugccgcacauagcgggaggugcgggagugcacaguguagacuucuacuguccucaggcugcacagcccagaucuggucggagaggccuauauuuaaacauggcaguaacagcagcagguuguguaaauugcauguuuccaauuuaagaaauuggucuuuaagcuugaaacugcccuggcuuuuucuagccccuuaaucucucuuuuucccuuuggcccugagauuugaaccuaaggcuccaugcaugcugagaaacgucuguaccaccaggcugugcugccagcccuuuccugccuucuugagcuacacuuuaaaaauauuguaaaauaacaauuuuuaugauaguauaagacgaucaaacuguauuuaacgaguuaaugcccauuguuguuuguauugccuacacuuuuuccaaauguagaggaauaguucuucaguuucacugaauaauccuugaaguguaauuuuucugcauuugauuccuaauuuaaguugauugugacuaucaaaugagcuagagaaugcaguaaguagcaguuaguucuuccguaauuuuguaugguaaccuuaauuaguuuacacaugacaucuguguaaguaaaagagugucccacaccagugacauaaagucauaccaaauaaagugugaccuguuaccuggaauaucuguguuaauauuguauuaaaaacucaguucauuuuccacccugugauggucagaugugcuucucguauauuguuacguaaaauaaugaacuacuuucaauucagguggugaagccaaucccuauuaaaggagauggaucugaaaugaauaacuuggcagcugagccccaaggagagggccaggcagguuccgcugcaccagcccccaagggccgacgaagcccaucuccuggcagcucuccgucagggcgcucggugaagccggaauccccaggagugagacggaaacgaguguccccggugccuguaaguuaagauucaagcccagucuguucauggcugucgucuuuggcucguucacgacacacagaggguagcccagcugugccagagagcagcagcuuucaaagugugaucugaagugauucacaaggagcacgggcccuaggucccaagaugcucuucugucaggucaaaacuaggccccugagaugcucuguggacacuggucaggucaaaacuaguuuuauacaaaaaccagugcuuugucugccuuuucagugcaugaguaacuaauaaagucgcuagugccccgccccagugacaguagacuacgacaucagauucggggcuuccccuuuauuagcaccuacgcauugugugagucaucggccuugauaccuguuuucauaucuccuguccaccugccuuacacuaaccccucagaauucaugcucuucauugcuauguauggccuaugaacggaaagggcuacuuugauucaagaaugccuuugugaaugaaauagaaauuauguuucuugaaucucaguguguauuaaauauuuauaaaaugggaugcuugcauaaagcacuucugccguacccuaaaauguggucaccaucucaaggagaagcauuuaugcagcugcuggagcuguaaucguccuguucucgcggaacagaaucauucauugaaaaaaaaacggccaacgaaguacgguggcguggacguguauuuagcagacgcuuuucucuaaagcaaacuaaaugaaacugucucuucaaagaaaauaaaguauuuuuaaccacugauaagauuugagguuccuaagcaaaaauuuuaauuuuacaagacaguucccaccguguuugaccauuucucaguauuuaaaccuuucugagacagaugauaugaaaaaaaaaauuuuuuuuaauacugcaugauuaaguaugucuuuguuacuuaguaaacuggcauuucccagauaacuaaguguauacugaagggaaaugauucguaggacccauucaggacauacaguguacccuguggaguuaacgcgcuaguaagaaaaggcagagacaguucuuugcuauucccaucgcagcugccuccauugcuggagagagggcucaguagcugagggcacuugccacucuuccugcucccacaagguggcuccagcuacguguaauccaccguuggggaaucucaugcccucuucugguuuugugggcacuacacauacacaguacaguguucaucgugcauguggguaaacuuccuguacacaaaaaauaaaaguaaaaggauguaaagaaaucagagacugcuguuggagcuuggggugggugugaugggcagcuauagugucauagagaagaggcuugcuuucucugaaaaggcucucaaaauaucccuuccuuuggaagucagauucuuuuuuuuuuuuuuuuuuuuuuuguaugugugauuuaaucaacacauaucacagcagaccagagagcuuuucaaguuaaaucagacaucagagagauaagauagcacagggcaguagagacccuagugguggaaaugcacuucugcguuugaagagugagcgaaugacgcugugcacaaggaaaaccuuacguuuccccgacuauuuaaagcacauagauccgcccaaaguagacuuugaucacuaacuaacaccggugacgacucuguaacugggaccggcucagacauuugagaacuggggacaggagcuucuucucugcuccugauggccucugcucaagcugagggggacuucucugaucaccaaggugggggugggugggguggggggugcuguugguggcugccuccuggaauggcugcgggaccagagcagaagcugcugugugcgggauccauucucaaauccaugugcaucuugauuccaugaggcaccaaagggaaggaggacccuggcuauggagagacagaaucgugccucucugugccccuugccccaaaccacaguaaggacgagcuaggcaccauuagccugaaguuguuucuauacuuggaaaucagacugagcuuucauggacugcagacagacagacagacagccaauuuguugcauagcugaggugugccuaucacacacacacacacacacacacacacacacacacacacacacacacacacacacacacggccaaggcuccuugcagccaguccagcaauugcuucaccuugcuuuguguucggccugcacaggcuggcuggacauugcuaagucgucucucugaugacuccagguuuugagucugcccaauccauggggugcuucuuugcucaaguaauccaugaccugcgguuucucuguuagccccaggcuuugcguuagccccagggauacuggugggaacauucacauacaaguuuguuguguggacauguuuucacuucuccucaguucauaccuaggggugggauuccuagguggaaaugugacauuuucagaaaccguuacaccggcccugucccaccaccagaggguucugggaagcuuuacgguuugaugcuauuuaugccguuguugcaacggucaggccaggcaucuccaccgaccauaaucucuacugggcguugaugacaagaccaaguuccggucuuggucuuggucagccuugagggggcguuguaaaggagaaagcgccugcaggguucaggggagggggguccaugggggagggggccugugggggagggggcccaugguagcaguugugaaugcagucauggggagcuaaaagcccagagauugcguguuuacagucacugcaagaaacggucacuuuaugccuuuagcauaugcuuugagcucgcacgguacuuuaaaagacccaggguuauggaguaguuuauaaaaugaccauaugguugucucccaggcaaagaguuaucaucucuucuaggaauggcugagauucuaaaaugaguugugucagguuucagcauuuucuuccuccgggaagcugguuuuuuuuuuuuaaucugggaauauaaucugcugcauggcuuucugguaugaccgguuaauuucuuaucaagaagugagaaauuuaccuaauaaaaaacaauuuugugaaguuccagaguggcagaaucacaccaccccgaagagccccgucaccggauggcuucuccccguacagcccagaggagacgagccgccgcgugaacaaagugaugagagccaggcuguaccugcugcagcagauaggacccaacucuuuccugauuggaggagacaguccagacaauaaauaccggguguuuauugggccacagguaguguccaacacuauuuuauauuucacugguaugugguaccguuuuuuagccugcguacuaggaaaugguuuuucuucuucuugcaugugugugugugcgugcgugcgugcgugcgugcgugcgugcgugcgugugugugugugugugugugugugugugugugguuagaaacuguacaagugucacuucaucccggagguuucuuuggauucuucguucuguuggugguguuuguuuuguuauuguuuucauuuugcaacagagucuuaacugugcaucuagcuuauuucagauucgguuuguagccuaggcuugcccuaaauucacagugauccuccugugucagcuuugcagccacuagaauuacaggcgugucucugccuggcucucaguuuuauaagguccuuaccugagaugcgcucuguuuaguaaguuaaagugaguuuaaaaugcaucuaggcugugcaugauguuuugacuguagcuuaguaucuugaauaaaauaaauuuaaucuaucaaauacauucauugaaggcagauuaaugcauggggauguaucugugucuuuaugugagaaugaugaagaauguuaguagaaacgucaauaaaaucgacuugaaacuucagagcaugauaacuagaaccauucucaccaauguauucacggcaguuuuccuucucuucugcagaacugcagcugugggcguggagcauucuguauucaccucuuguuugucaugcuccggguguuucagcuagaacccucugaccccauguuauggagaaaaacuuuaaaaaauuucgagguaauuuuucaacauacaacucugggguaaaauuggcaacagacuuguaugguacaucgugaauuuuaccaagagcacugaaugaaauagacggugaccauguugggcaugugaagcuacaaaagaacuaucugaugccuuuaaagguuccuuggugauuuccugagugacagaugguuugguuuuccuucuccuaaacuguaaaaggcaggaagcacugugcugcgguuaaagucgcguucuuacguuggaagcucuuaaaucagcucuaugcaaacuuuaugcaaauaaggacgaauaauucaccucuucaugugcauaauuguggcauccauaucauugacgcugucuuuuuccaauguuagguugagaguuuguuccagaaauaccacaguaggcguagcucgagaaucaaagcuccaucccggaacaccauccagaaguuugugucacgcaugucaaauugucacacacugucaucgucuagcacauccacaucuaguucagaaaacagguuuguacuggucacaggguggagcacugauguacuggccacaccauaauucuaggguuuuuuuauuuuuuuaacuuacugaauugcuagacaaugauguaguuauugagucuuggcuuuucauguucaaaucauagguaaaggcuauuaaaggucacgugaagacgcuuugcucuccacacuacagcacuggaaaugacguaucagaaauuaacauaauguccacucuugugagaaagcaggcggcagguguaaacgaaugagaggcugcucugucagacauuacuguagccaagcccccgacagcgcuguucccucccguucuuauguuggguagauuuugucacuguuccacagguaaugaagcugaggcaacuguaagguagaaggaaacaucgguaacucuuuuauaaauaaacugucuacaaggcaaagcgguuuuccaaaaucacuuuuaaguaugggauuuuuauaucuauaccaucaguacuccggucguaucuguuucuggagagucuguaccugggagaaggugagcuuguacucggucaguaggcagggcagccguaggauaggaggucaccaucacucacgguuacugcauacagucuacagugcuucacaaacgcuccaaggcacgguggcuggaaagaugaccaagacaagcuccgagggaugcaaaacgcagccuaaacgaauagauguggguguuuuaagucucugguauucuguggagacuguuaucugcuccguaacagaacuuucuguucuguggcaccaccuccuugguguaaaaaugagaugauucgguuacugcagaaaggagagcaggcaucuguguccuuggcucccuguuugagaagcacuggcugugggaggucucaucugcaucccaccacagacccucaaguucauaacugccucggaguuaacugagcggagggaaguggugcugaggcccacugagcagauguucaucuguggaaaacacaaagauuugugaaaugaaagaucuccuggcuuccuuagguguggaugaagccagaagaggcggcauaacucguuuaagucauagcauggccagaguguggguaucuugacuccuaccccagguuucuuucuguuucugaacaaauggggagacuuagggaggucucuucuuuaucaagcuucagaaaccacacuuauuuucucuuuucuguugaagaaagaaaauaauguuuaaaccuagauagcuaaagcuuagaucagaaguuccuaaggugagcaaggacacauugauaugggacaggagccgaaguguccaggugcauugguauaucagcagugugggcacagaguuugucauguuguguaauuuguuccacauaaucacauauuuuuauagaaaaaauaaguaauaaaaaggacaccuaaagggagagucaucuggggucuaauuuuauaaaaauugcaaaugauaucucaaaaaaguagaaaauagagaaggaggcucuagagguggcccagcaguuaagagcaccaacugcuauuccagaggacccagguucaauucccagcaccgcaugguagcuaacagcuguccauaauaacuccaguuccagggcaucugacacccuguucuggccuccacaggcaccagguaugcauguggcacauauacauacguacauacaggcaaaacacucacaugcaugcaauaaaaauucaaaauaaacaagauuaaagcauacugaaaauauacaaaacccuucuaaaaacugaaagcgcaaaggugacccuagaaagaacauagucaugaaauaaauuuuuuuuguuguuuuuguuuuauuuuguuuuucgagacagaguuucucaguguagucccuggcuguccuggaacucaggcuggccucaaacucagagacccgcccgccucugccuccugagcgcugggauuaaaggugugcaccaccaccacccggcucauaaaagaaaauuuugaagaggcuaguaagcaugucagugagcccaauaacauucugaaaaaugcuuaauaaaaagcacagcagagagacgagggaggaaggaaagggugaguccgagcacaguaggaaggcgucuguggguggggaugcauggcgaguccaggacauugugcuuucuacaucauaaaaauaacauuuaugaauuuuuauuuaaaaacaaauauuuauauaaaauuuuuuauuucuccauauaagugaauauacauauauguggggaaauggcacauuuuacuuagguaauuaaggggacuuucguaaugcagcaggccuguucuugaaaggcacuccacuguaugaaaguaguucaaccuggggggggaggggggggcagaaggagggugguuuccugaaacauuuucaucuccugcgcuagagcaggcacuacccagaccuggugcauugaagaaauguaccaucuucaguagguuuuauguggccuguuuguuauguguggcauaguguagugaaaauauagaaaaagguuuaaauagccagcgacgaaugaaugauuaaagcauacccacaccauagccagauguggugacgcgcauaugauccacgcgugccggaggcugagagagagcuacagugagucugaggccauuugggcugaguagggaguuccaggccaacuugggguacacagaagggcccuguacacugcacugccccccaaacauguccauguuaugaauaugccauguagccauuaaaaugacaccccuggagacuacugaguacuaugggaaauauugauaagugaaaccuuauuugaguucuauugcuuacuuauacugauuauauaauaugaaauuauagguguauaaaaauuagggcagaguuauaauggucacuaauagugucuguuauuacagcuaugacauauacuauuuacuauuacaguuaugucauuuucuuuaagugcuuaugucagucaugcccuaguaagcucaaguaguuuucauugauaauaugaaagugaguggaagccgggcgugguggcacacaccuuuaaucccagcacuugggaggcagaggcaggcagcuaucugaguucgaggccagccuggucuacaaagugaguuccaggacagccagggcuacacagagaaacccugucucgaaaaaaaguaaguggauguggucauuguccauaaaacuuuauuuauaaaauaggccacacguugacuggauaacuuucccuuugauacucauuguuacguauuccugugacuucaaaaacaucaaaaacuagacuaaaaaauguuuauuaugauuucuuaaacuguaaaacuaggaauacauuuagagugucagugguacacagauacauauauaguuagaaucuaucaaaucagugaacauuauaccaccaugauguguccauggcuggucagagggaucauuucagggauacgaaccuccuuucguggguuguaguuccuccauucacaguagggacagucuaacucacauacaaucugugaauccaguuccgugguucugcuccugaauuccuauguguuaacaggcaggaggugguguacaucuuuaaucccaccacucgguaggcagaggcagacggaucucugaaggaaggaaggacugacugcccugcaguuguuacaugaucacauggugucguccaacgggaaucuguggcuaaugggugcuuauuccagagacaucuuccggaguugggcgcuuaguguuuugcuucuuucccucacagcaucaaggaugaagaggagcagaugugucccaucugcuugcugggcaugcuggaugaggagagccugacugugugugaagauggcugcaggaacaagcugcaccaccauugcauguccaucuguagguguccccuccccgacacucaaccuggcugggcucugcuuggcugcuuuacucgggguuguggggacauugucuggagcagaagggaguccuguuuaagcuccauguagaguuucuacagacugggcuauagggucuguguagauugaggaaaggaguguauauccaggauugcagguagaaauggaaggaacauaggcugaaaagcucccagcccagaagcugugaggacagaaaggguggaagaccuggacaggcuuuccagagggugagucugcaaggcuagccacagaauggaguggggaagaugcugugagggaugcucagcacagcaguguuaucacgagugaugguagcauuuguacaagcaucaggauugacuccacugcgguguaugaggcuccuucuauauccgucuuacacuaaccaucaugaaugcuuaggacuuuaugcuuaaacguugacauuuucaugauauuuuuccuuuauauuuuucaggggcggaagaguguagaagaaauagagagccuuuaauauguccccuuuguagaucuaaguggagaucccaugacuucuacagguaguaauuuugaauaucugauuuguauauguucaacaaaaaauuaaaaugauguccucuaggccuucaugguaguacacaccuguaaucccagcucuugguggagcucaggcaggaggaugguggguucaaggcuagccugagcuacagcaaaccuggucccaauaaauaaauaaauaaacaaacaaacauaaauaaauaaauggggggacuuauaucuguuaauaucuuguggcuaaguuuuguuauuuuucauuuuagccaugaguuaucaagccccguggagucccccaccucccugcgagcuguccagcagccauccuccccacagcagcccguggccggaucacagcgaaggaaucaggagagcaguuuuaaccuuacucauuuuggaacccagcagauuccuuccgcuuacaaagauuuggccgagccauggauucagguagguaucccuuuauguaauucccagagaguccuguuggccaugucccguguuuguccccgucccucagcuguuucugauuuagggaagcacuuggcuugugugacuccuagcaugcuaaaaccuuaaaucuggcuccuggguuauuauuuucuauauucacguugcacagccuacauuuuaauguuccuuuguaguuucaccuaucuccugugucucuuccuaaccuaacguacguaagaggccgugcaaggggggaguugcagccuuucagagcugacuucccccguguaguccccguuccuggcaagugugucugcugugcaccuguuuccugcugugcaaacccaguuucccccuugugugucacccugguacacagcaggcacuugcugagaggacgcacgaggacucggguuucucaggcuuggguguuuugguugccuuuuccuccucggaaugguuuuucauccuccgugaacuuggguuuugguuggccaacuuauaaauuauuuucguggucacuugaaugcuuacuguacuauuuucaaacguaggaucuauagccagugcuuccaguagauaguauagugagauaggagugaggucagauagcaccguguggcuaguuggcaggcucugggugcugggcuguuugugaggcaccuuaacucauccaauggcucugauagaaaagggcugccuuucggcuucgcggccccuucuucugcggucuugaaauguacucuuccuguuagccacccgcuccuuaccaaucugauaaaauccacagaauuuauaggcacagcuuaauucucccaucugguuugugagcaguguccugcggaggcacaucuccuuguuuauucucagcuaugcgauggcacgguuuugaggcugucaccggcugugucaccggcuuuaccuuaggacaucauggaagguugauuaaagcugaagcagcgcagaaagcucgaggcucuggcuggcucauucuccuuagaguuucuuuguaacagaacacauguaaauacaucagaaccuguuccccaccccagaauuggguuaaacuuaucucucauauuuagaagcuuucacguauauacgucgucuuagacauuaagcuuacuuuuugcuaauuggucaugaggucaauaccauuuacgguccuccuguagaggagguuuggggccuggugcuguagccacacaaacaucaacucuguuacaucauugcccuucguuaguauaaacaaagcauucucuagucucaccuuucucuucuggucccaccugcuucaucuuuuccuacaggccaaaaguaacauaaauuucuguggcuuuuaucucuuaagaaaaauauucugacuugaagucuccacaccacugauauuccugcuuuuccugccuuuuuuaaauaaaacuuugcuuccuucucuauaaaguauuuuaaucaagaauaaauauggaguucuuuauaguuuuuucuuuuuuuucucucucucaguuuuaguguuuuguuuuaagauguauuuguuuuauauaugugaguacacuguagcuauccucagacacaccagaagagggcaucgggucccauuacagaugguugugagccaccaugugguugcugggauuugaacucgggaccccuggaagagcggucagugcucuuaaccgcagagucaucucuccaggcaagguuuuaguauuuuuaagcauaaagcaaacuaugaaaaugaagcuacccaguuauuagaacuuacucgaagcucuccaguguuaguucccaugguuaccaaucaaacuugaguaaagguaugccgugcucuaaguguuagaguaacgagcguuucagacuaagugcugcugugcuuuagugauuucuauuguuuuugugaccaauugccuggaagaaguaacccuagagggaagaauguguuucaacaacugaagggagcagcuaaccuuggggggaggcaugacaggaggagcuagagucucacugcauccacagacaggaagcagaagagaagagcuuauuucuccucacucagcccacgagcuggugcuuagcacauuuacgcuaggucccccgccucaauuaacauaaucuggaaaggucucaacagcuauucccgcaaguuucuaagucccaugaauuugacggucagggaacuagggugugacgcccauuucucccuggaugcuauuggccaucgacgugaagggagaaaagggagcagaggcagagagagagcagaguuuggacggcugugaguauggacgaaaugaccuccagagucugcuacuugggaggcugagacaggaggauugcuugaguacaggaguucuaggcuauagugcgcucuaccgaucagauguccacacuaaguucugauguuuacacuuaaguguuugccauuuaagaacgggagucugaguauaauguccagcaugcuauagaaagcuggguguguugauguacuugcaaucccagcucaguggccagccaacauggccuaguuagccugauagaagagcccaucuccaaagagaaaaagagagagagagagaaguggacaccucccgagaacaacucaugaaacugaccccugcccuccacacauauacaugugcauccaugugugcacacagaauuuguauauaguaauuccucacuagaaaaacauugacaauuacaaguaucugucagauacaguaaagacuugagagguggccauguuuucuuuaaucaucagaaacuuguuaauauagcauuggguucacuuauuucucaucccguuguguuugcuugauucagguguuuggaauggaacucguuggcugcuuauucucuagaaacuggaacguaagggaaauggcccuuaggcgucuuucccacgacguuaguggggcccuguuguuggcaaacggggagagcacuggaaacucuggaggcggcagugggggcagcuuaagcgcgggagcggccagcggguccucccagcccagcaucucaggggaugugguggaggcgugcugcaguguccugucuauagucugcgcugacccugucuacaaaguguacguugcugcuuuaguaaguauuuuauuccauaaccauauuuuauuuaugaguuuucuuucuuuggucuuuuguagauaucaguuauaaaaaaacaaaucuucuuuaccuuaacuuuagaaaaauccaaauuuuuuuaucccauacuccuaagaaauugcaguauuucauuuugucuguucauauaacuuuacugaucuugauguacucaugauuucuuaugcacuguuugcuuuucuaccaucuggugguaaugucuugcuguucauauaauuucuugaauauaugacugcaucacauauggccaaguuaagacuucuugauggcguguaugguaaugcuaagccaggaauccagcccuugaaaggagaaaggggagcaucggggguuaaguuggucuucauauugugagaaaauucagaggcuuuuuauggaaaauggcccccaugaugccucaguuccucccugucacugauaaaacaccccagcagaagaaacuuacagagaaaagagagguuuguucugggucacaauuccaaaauauaguccgcugucucagaaauuucuggaagcuggccacauugcauccugucaagaagcagggaaagacaaguguguccacacuaauacauagcucugcgucuucuacuuacaugaccaaauccuggccacaguucagaugcucaccacauaaguuaggaaaaucaggacaguccccaacaugggugcagaggcccaggccauguguaaucccagagucugucaaauugacaguuggcgcuaucuguggcacaugcaggagauguagacuuucucaguugaccgcaacgacuugucuuccaggagcaggguagcaugauagaaaggugauucgcaggcuaguuugaccuuugccauuuggagacccccaucuuggagccuuguuucuccaucucagcaguguugugguugggcagaccuggggcugggacaccagagcugcugucgcuguacgauguugagcacgugcucagcuucuaagcacuagacggcuagcagcguuaaacccucauugcugcccguccgucaugagacgggaaacacgaagcaugucuucaggcacugccagugacccccggagcucaaagccauccucacuuagaauccuugccuuaggaguaauuccuauaaauuagacagacagacaaugauagauggauagauagauauacagacagacagauagauggggaggaagaaagaaaaagaggaagagggauggggugcccaugugaaaaucagaggaccacuugcagaagccauguaguuccgucuguguguguucuggaggucaaacccaagucugucacguuuagugacaagugccaauggucgcugcaccgucucacuggcaugauuucucaccuaaucuguuuaagcuaccucuugcaaucuuuuuuucuaacucacaauuuaacagucagaucuagugacucucccuuuuaagacgcaugaauggccacgaguauaaguuuaggucagaauucagugacuucaaaagcccucacaucuagaacacucacugugccgguugaacugggaggagccaaggaagucuggccgcggagaugucagagauuccaacucugguuuaagucacucgcugcugcuuugguuugaacagccccaguuauccauuccuguuauuacuuguuuucccagcuuggcucagcuuaggccauuuucuuugaugcauuucgaaugugguuaaacugaccuucgggguuuuuuucuccccagaaaacauugagagccaugcugguauacacuccuugccacagucuggcagaaagaaucaaacuucagagacuccuccggccaguuguagacacuauccuugucaagugugcagaugccaacagguauggccccacuucaaaauaccucacacucaguccuugguacauccgcguuagcaagucuuugaacaccgcuuuguaauacgaacucugaaaugacaacauaggaccucaagcuucuaagggcuaaggaaagaaaccccaauggcaaguaacagccaggcuagcaaacugcguggaccuguucaucagaaguacugugacuaaagcauucuuaacgcaaaggcccagugacaagaacacuagcuggcauagaaccaccaggaguacacucaugccaucauaccugccuccgccucauagggaccgccagaagaggauccucuuccaguacuuuuaauuuaauggaaguuuauuguaaugagagguuuuaacugguuuucaaguuucgcaucuucacauaguagucuucgaagcugagagaaacgcagagcaguagcagugagcgugagcgauggccaugacgcuuacauccaugggcagcaaagcucccuuucauuuaauaagcccugggagcuagggucgagccauugcuucucuccaucagcgcgguucgagcggcagagcggcucagucucccuugcuugcuucugcggccgccccguucaccuucucgugccuauucugccuuucugaguuauaaguuaaucuuguagagaguuuguaaaugcgcaggggaaaucgugguuuucaaucugaggaugguuuagauggcgugucuuacauagcccauuuucuggaacucuggguugcuuacccuagguaguugcuugaacaauugagaacauaagaaacacuguagagagauuccaugacguuugcagcucaccagggaguuguugacccaggaucugagacuaagguugcuuucguugcuuuguagccgcacgagucagcuguccauaucuacagugcuggaacucugcaagggccaagcaggagagcuggcgguugggagagaaauacuuaaagcugguaauaacuuccacuuuaaaauaaagagcacaauuuauuguuuucuugaccuaaugugucucauaagacuguuguugaaguaauuuaguaaauugauucaaucagcuguguuaaaaguaggaaugaaucuaagagaaguccuugagauuaauauaauccggaaugaaucuaagagaaguccugagacuaauauaauccgcaagguuuacaugagccuucccguuacaugcucguguuucgucuuagaguuuuacaguacuauuguuccaccauuuauuucuccuucuguaggguccaucgggguugguggugucgauuacgucuuaaguuguauccuuggaaaccaagcugaaucaaacaacuggcaagaacugcugggucgccucugucuuauagacagguugcuguuggaauuuccugcugaauucuauccucauauugucaguacugaugucucacaagcugagccuguugaaaucagguaauucuuguagaaaucagaaccugucucuuccuucuugcucacauaucccgcagugguagacuaauaccuucauauuugaguagcauagaagccugaagacugggcuaaacauuuacaaauccuucauaccaaagugguuuuuguguacgagggcaggcuauacauugccuuuuuaaaacugcguuauuuuucuguucauuugagcuuuuccagucguugaagguguccugccucguuuuuccuucagguacaagaagcugcucucccucuuaaccuuugccuugcaauccauugacaauucccacucgaugguuggcaagcucucucggaggauauaucugagcucugccaggauggugaccgcagugcccgcuguguuuuccaagcugguaaccaugcuuaaugcuucuggcuccacccacuucaccaggaugcgccggcgucugauggcuaucgcggaugagguagaaauugccgaggucauccagcuggguguggaggacacuguggaugggcaucaggacagcuuacaggugcuggcccccgccagcugucuagaaaacagcucccuugagcacacaguccauagagagaaaacuggaaaaggacuaagugcuacgagacugagugccagcucggaggacauuucugacagacuggccggcgucucuguaggacuucccagcucaacaacaacagaacaaccaaagccagcgguucaaacaaaaggcagaccccacagucaguguuugaacuccuccccuuugucucaugcucaauuaauguucccagcaccaucagccccuuguuccucugccccgucugucccagauauuucuaagcacagaccccaggcauuuguucccugcaaaauaccuuccgcaucuccucagacacagcgcaaguucucucuacaauuccagaggaacugcucugaacaccgagacucagaccagcucuccccagucuucacucagucaaggcccccacccuccaguaacauacacaggccaaagccaucccgacccguuccgggcaguacaagcaaacuaggggacgccacaaaaaguagcaugacacuugaucugggcagugcuuccaggugugacgacagcuuuggcggcggcggcaacaguggcaacgccgucauacccagcgaagagacaguguucacgccgguggaggacaagugcagguuagaugugaacaccgagcucaacuccagcaucgaggaccuucuugaagcauccaugccuucaagugacacgacagucacuuucaaguccgaagucgccguccucucuccggaaaaggccgaaaaugacgacaccuacaaagacgacgucaaucauaaucaaaagugcaaagaaaagauggaagcugaagaggaggaggcuuuagcgaucgccauggcgaugucagcgucucaggaugcccuccccaucgucccucagcugcagguggaaaauggagaagauauuaucaucauucagcaggacgugaguauaaaaccuucacggcccugggaaagcucacguuaacgucuacugggaagacggacgugagcggguuuucugcauaaguauguggcaaugauuuugagucucugcaguagcagcacucagccuaacugagauacuucuggccgguucugaaaugauugucacuuacgcacuggauaacugguuguuaacaauguccguucagaggucaaauucaugcauggcgugggaauuacaacaguauuuucucagucuucucgcauacagucucguucuuuuuaacagugaaaugauucuuuguuuacuguucagacaccagaaacucuuccaggacauaccaaagcgaaacagccuuacagagaagacgcugaguggcugaaaggccagcagauaggccucggagcauuuucuuccuguuaccaagcacaggauguggggacugggacuuuaauggcugugaaacagguugguauugggagcacagggugacauuguucaaauuaugaaaugaugcguguacaacugugaacucaaagggugaaaugccgguauccuagggcuucgguguuagagguguggguuugguuugguuugguuugguuugguuugguuuuggaagcaucauguagcccaggcuggccuggagcuugggacccucuugccucugcuuuccuagugguagaauuacaggguuuugccaccacacuugacaguuuggaaaagcuucagacucaagguagauguugccagaaguggcacaaacaugaacucuuuuuaaaaguugaagcuggucacuguaagauccugugugacaaugucugugcuuuccccucucuaaggaucucgcauacucaccagggugcagaaaugacgacuucccaguuuaaagucaugcugcuugucccucugucguuggcuuuucucguucuuugcuguucuguacagucagagucuuggcuacagcacacuccccuuacgucauuuuucugaucuacggcucacuaagcuauauucuucuuguguagcguuaucugacucgucuuccauguugaguugcuguuuuuauaaagcacacggcauccgggaggguaaaugccauuugcugcccacgugggagaugguuuggauuuguucauuuuacaucagaucgguuugaaaacuuagagcgguaaaacucaaaccccguuaaugugucuguggaaacaggugacguacgucagaaacacauccuccgagcaggaggaggugguggaagcguugagggaagagauccggaugaugggucaccucaaccauccaaacaucauccggaugcugggggccacgugcgagaagagcaacuacaaccucuucauugaguggauggcggguaugugcacucucugaagagggcugcgugcccacuuucuccugcuuacacacaagugacuagaugcuucacuuaugaauacuuuaggucucuaaaaacaaaccacuccuaauauaaagcuacccacgaaaaauacuguauuuuaaaucuaguaaauauuaaaauuuuuucaucuugcuguuuuguuuuguuguacuuggaaucgagcccagaccuuguccaugcuaggcaaguacucuggcaccgagcugugguccccagcucagcaacccuucuuaagacugauuuuagaggcuggugagauggcucaguggauaggagcacuugaccgcucuuccgaaaguccugaguucaaaucccagcaaccacaugguggcucacaaccacccauaaugagaucugaugcccucuucuggcacaucugaagacagcugcgguguacuuauguauaauaauaaauaagucuuuaaaaaaaaaaaaaaaagagugauuuuagggcuucguguagaauuuuuuuuccccaaaaaaucuggcuuguuuaaguuccauauuucucuuuaauagucaucacuaauugucuagauuauguuucuguaagaaauguuccuaacaauauaaaauaaaguuacuaagcaggaccugggccugcaggcaguguacucgagaggccgaggcagaagggugguugguccaagcccagccugagccauaguaggugagaaucugucucaaauaaauaagcaaaccuaaauacauucauguuuaauuugaaaacguaacuaaagauaaaacagcacugggacacaaaguuaaaccucauuuucuugaacauagauggaauucacuucacuaauauauguaacagugacuccagcuaugacaccuagguuauccagccaguuguuaagugcuuguaugauuugagagugcaucucuaguucauguuugcaucauguuugugcuuacuaguaugaaugugugcccgugugcgugcagaugucagaggucugagacaguguguaccucggucacucuccaccuuuguugggauacggucucucucugaccccgaagcucaucaguugggcuaagauagcggucccaugcugaggccacaguguacaguuuugauagaggaaaucaguuggacuucggacgugggcuaugagcguaccauuugauacgaggccugaggaguuagagcguuaagaagccgggcucacgguucugccugucuuccaggaggaucuguggcucaccucuugaguaaauacggagcuuucaaggagucagucgucauuaacuacacugagcaguuacuccguggccuuuccuaucuccacgagaaccagaucauucacagagacgucaaagguacggauccuaaccgucuucuagugauggcaagaaaacgagugucauuuuaaaacuugacccuuggugguuucuaacacagguuucuaagucuaggacuaaauaacccuaugauuauuagagccaaaaggacccuuacgagucgcucuacuguccucauuagcacagcguguuccguaccacaaggcugugacuuggcaggacguguaagacugaggccuccucgucccccaucuuggcuuacaguguauccacagaagaccccuguuuuugguuuuuucuuagauaauuuguguaucauaaacuuacgaaaauccugccagaucuugcagcuuugauuuuuauuuauuaaaggcaaccuggauuuuugggaggggggguuggagacagggucucucugaguagcccugacuguccuggaacucacucuguagaccaggcuagccucgaacucagaaauccgccugucucugccuccuaagugcugggacuaaaggugugcgccaccacugcccggcuggauuuucuuuuguggauaucuugaguauuuaacaauguuuuugaagugcuguugugauacaaacuuuaauuaaacugugauuauaaaauaagcauauauuuuugaauuggccuauguuaguaucagucaacaagccuuugccuuaaaauguaaacugagccaaaauuugaagucuuagauuuagcugaaaucauugcuuaaaggguuuugaauccuggcuuuccggggucuuuaagcuuauuccucuaucuccauggccugaugauuuugaucuccagacuuuccuucugaggcuuuagguuagacccacacuagagagacuagugugcccuugcauagauggagcagaggaaggcgggggcagcuuucugggaggcaauggcuguaccuacuuugucuuaguucauuagcagcacuucacugggacucucgcauguccucauugaucuaacacgcagggucauuugcugucucuguugacaggugccaaccugcucauugacagcaccggucagaggcugagaauugcagacuuuggagcugcugccagguuggcaucaaaaggaaccggugcaggagaguuccagggacaguuacuggggacaauugcauucauggcgccugaggugaggaguggcuuugaguguaaagaaggacagugucguggaguccguauggcagcauugugccaggcuauuucacaguaggauccagugugcacuuaguaauuggaagcucaugaccuuauagacuaguuuuuaacaguaccuccccccaccccacccccauuucagacccuuauucccaacccucccauuucugucuuuuaacaaaauuauaaaagacagguuuuuauagauugcuuaaaggcuacuugaacacagaauugugggguuagcuuguuagugccugugguagaaauauacagaaguuaccucuugcuucccaagggagguaagccacagagauggcccugucugucaacaucuuagcacaggaugcgcuucugaauagggcccggccugagcucguggcucuucguguucaguguaguggggauuugcucucgcgccccauuguuuaagaagaggguuugcuuuugaauccugggauguuuaucuuagugccacauggacauuaagcugguuaaugagaugccaagccauccauguaauuguuguuuguaccacuguuugcccugaacuuacacaucaaaaauggaccucuuuucaguaagucacauuuccaaauuaacucugcuuucuuuuagguccuaagaggucagcaguaugguaggagcugugauguauggaguguuggcugcgccauuauagaaauggcuugugcaaaaccaccuuggaaugcagaaaaacacuccaaucaucucgccuugauauuuaaggugauuaugauaugacaacuacuguuuaguaguaaaauuggcagaaguuggauucucaggcguugucccuaccagucuuugucuguuuuuaugucauguuacgugcauggauguuuagccugcauguuugucucugcaccacaugcaugucuggugccugcagaagccagaagagggggucagauucccuggaaccaaguaagugugugugugugugugugugugugugugugugugugugugugugugugugugcaugugaggguaugugcaugccaugacacauggagauaagaggacagccugaggugccaguccucacucuucaucuuguggaacugcaccacacugcuccaggacuucuacuccagggcauucuccugcaccuggucccucuguagaacuacuggcuuucuacguggggaucacggggucugggaccccagcucaggcccaccaucaggcuugcacagcaagcggucucagccacugagcugacucccuaauuuguuucguuugggagagaggggugacugggucucuauaucguccuggcuggccuuaaacacagagaucugccuaugucugccuccugagugcuggaaucacaggcgugccccaccaagcccugcuccacuccccacauuuuuaagugcacuccuuuugacuucucugugcuccuuauaaggaauuuauucuguguggucaaacucaggaccaggcauugcaccguggguaaaauacuuaaagccugaacuaacuguauuuaacagaaauguuuggcuuuuuuuuucccccucucccuguaaaggaaaaacaaaaacagugagugauuacacuugagaaggugaaaaagggugucacuuuuguaagaugugagugcguccacucauugucucuagacagaaagggaucaugggugugugcauucacucagugucagagauuuuuaggauuucuuuuuuuuucuaucaauuugcauuuuuuuaauaaucauucaugaauuugcuaaggugagggaaagggagacuuuuacuaugaugagaaaguagguagauuuaaaugauuuagauucauccuuuaccuguuuaugggauaauagcucuuaucuggcuugguggcacacaacuguaauugaaguacucccgaaguggaggcagagagauagauccaagccaucagccuguccuaagucuuuaucaaaagaaaggggggaaaagguaaaaauuagcaguuuauauuguuugcugcugagaauuaagaucuguccaacacuggagaaaaacucacugcacaccacaccauguaggugacugggaggcuaugagguucacaccugugucgcgugggaagccacuguggaaacucagggcucugguuugcucuccugcagauugcuagcgcaacuacugcaccguccaucccgucacaccuguccccgggucugcgcgacguggcgcugcgcugcuuagaacuucagccucaggaccggccuccguccagagagcugcugaaacauccggucuuccguaccacgugguaguuaauuguucagaucagcucuaauggagacaggauaugcaacgcggagagagaaaagagaacuugugggcgaccaugccgcuaacccgcaggcccucacgccacugaacagccagaaacggggccagcggggaaccguaccuaagcaugugauugacaaaucaugaccuguaccuaagcucgauaugcagacaucuacagcucgugcaggaacugcacaccgugccuuucacaggacuggcucugggggaccaggaaggcgauggaguuugcaugacuaaagaacagaagcauaaauuuauuuuuggagcacuuuuucagcaauauuagcagcugagggcucaggaucuauuuugaugugucacuucuuccauuucaccuaguggucacagcaggggcucugcaauucccuuuggguuagguuuuuggguuuuuuuuuuuuuuuuuuuuuuuuuuuuuuugguuuuuuugguuuuuuugucacuggcuguaaaaaaaaaaaaucauugccuggucagaguguguaugagaagcaguaaauacaugcguuuuuaaaguuaauaacuucuuuauaacccacagcugaccccccccccccuuuuuuuagcuccugguuuauugugguucacugugcauuuuacugucggcccguucauuucgguuuuuuuuuuuuuggaaaauaugguucuguauuuucacuucaccuucauucguguugaauauucagggaaaggugaucucuucaaaccagaaaaaaagaaauagaaauaggugugaaguaguucauuaagucugugucuaucgcaagagcucugcuuucuucucucggcaugcuguaaagaacucgcuacaucgacucagucucugcccucacugugcggguuaagcagaaacucacuuaggagucugcuguucucggaugcagcuuacaaggcagggcaagauugccugaagguugggugaauuauuucauauuauuuugcuagccuauaggcaguucacaccauugaaaucuuucucucugucacgacccaucacucaccccgcugaucauuacauaacuacuguuuuccuucugccgugcacgauaucuuuauacgagacugggcugauaaacucacucaucuaccgaucgaucaguagcguuuuuaaacaaauacuaaauuugcucugcauuuagaaacugcucagaaagaaaagugagguugaguuucauuuacacacgaauuccuggcauuugcacagcuauuuguccuggccucaaguugaauucagaugcauggaaucaggaaggaaaaaaacgguagcccuuuguaugugugucuucuaaaucaaguacugguuagcuauuaaauguaacuuugagauguuaaguuuuaacucuucagaagccagugugaaauagaauugguuauucucaaagacucaggauaaacuaaauaagcuauauauauauauauauauauaugaaguacauuuggaauguacaacacaaauuggaaguaaaauaaguuccaagauaaguuuacagggauauauugcaaauaauuuucaaaggcaguuuuaugugaaugugcuucuuagugaaauuuuacauuccuuuguuuugaaagauuggcaauauuugaagaguuaaaaauaauacagaaaugugaaguuugguaaugcuaaauguauuguacuugacuuuuuucuuuuuacuuuuuacuuuuugacuacuuagaauuuucacaauucuaauaagauuguuuccaagucucucaugugcaagcuuuaaaggacgcacucuugccauuuaccguacuggaagaucauucggucagauuagcacugugucugacagagauauaaacuguagaaacugagggaccucagcuaaucaguauuaccauguagaucaacaugcccgccacauuucaaacucagacuguccccagaugucaagauccacuguguuugaguuuguuugcaguucccucagcuugcugguaauugugguguuuuguuuucgaugcaaaugugauguaauauucuuauuuucuuuggaucaaagcuggacugaaaauuguacuguguaauuauuuuuguguuuuuaauguuauuugguacucgaauuguaaauaacgucuacugcuguuuauuccaguuucuacuaccucagguguccuauagauuuuucuucuaccaaaguucacucucagaaugaaauucuacgugcugugugacuaugacuccuaagacuuccagggcuuaagggcuaacuccuauuagcaccuuacuauguaagcaaaugcuacaaaaaaaaaaaaaacucuggguuaaaaaaauuuggcuuaaauguauccuuuguuauuuuaaauauaucaagauauuuuaauuaaaauuuuuaccccuuugaaccaauuuuauaguauuuguaccuauuuugguguuuugucuuuauaguaaauaaaaguuuuugaacaaaaguuaac

SEQ ID NO: 7228 - RNA, 1906 nt, Mus musculus
cggagcggcgggcgggcgcgcggcgcaggugggagggcaggggcaaugcggggaaccgggcgccgggcguugugcgcugcaaccaggccgccgccagguagugcgagaccgggcggggcagcggcucggcgggagcucgcccacccuugagcaagcaguaauccgagcgugagucccugguucuggaaggggacgcaagccggaggacucacggucugucacuucacgcguuuaguagcgguugcugggggggcccccgcgcgcaccggcccggcccgcgcccgaagcgcagguggcgccccgggacugucgccugccgcagacgggcggacgcgaagccuucucuuaggaaagcagaccucuugucccgcccucgugucacaaauaacacuacuuaagauuucuugcgcuaccuugugcaccucugaagcugcugguuugggacacccucccccccacucccccggcuacgcagagggaccaacccggguacucugccagagguuacucccccgucuuggaaaggcaggcuccaaccgaaagcgggagagcacgucuggggaaggagccagcgcuaugccaggaagcgcuggaucaugccaucuucuaccaggucucuccccacccccaacagaugcucccagcugcacgucccucuuccuggcagucaggugacaggccgguucccgggucccccaccucccucccgccgccgcucccugguugcccugugcggcgucccucgccuuucuccugccccagagucuagaaaaugugcuggagauagaaaagcaguauacguauaugggauuuccccccuucgacccuuuuucaacgggauaaagcugccuugucgucccuaucucacccgccucugccacuuuuuuuuccccuagccacuuugucuagaauagacaaucucucagaacccaggauuucuagauuuauuuugugaaacauuaagacaugaggcguggggggagggguaagaaggguuuucaucuuacagagaaaggaaagaucucuccagcauuuagacaaaagccugaacuagcucaaaauaauucauuuaaccucuccaaaguagaucaaaugaagcccuccuuagguguguaaugucagccagagagcaaggugaggcaaaagggauuuuuaaaaagggauccugacuucagcuugagcucgguguuauacuuacugcuauaacaucuggcacgcuacaguucucaaugguuacauuaaaagguacacguuuugaaaguuuagauuagucuguucaagauuuaggucuacauuuaggcuauaauuauaugcucuuuuaaugguagacaagcauaacauccaaaccaaacaguaguuauuucccaggucuuccuagauugccacacccaccaaauccuaaauugaaaaggauuagcuuuucugguuucuacugagaucuaaaauaaacuuuaaauuggcgcacucguacuuagguaccugugagaaaagccacugcggacccucagccuuuguuuccaucuuuggaccagguuuggaaguuuggccugaauagcaaaguaaaaaagaaaaagaaaaagaaaaagaaaaaagaaaaaagaaaaaaggaacuccggcaaaaggugacuuuugucucuuuauuuguacaguguuugaacuguuugaagaugagggugggcaucaaaugaagcacaaauugacuaacugcaguucucuggccuccauaggccacaucagucuaugaagacuaugaagacuaagugcuaucucuccccaguaguuucuccugauuugaaucccauucccuuucaucuuuuauggacauagucugcugucauuaugcaccuauaccuggacacacguuuuucuuucagagauaaguaauaaaaggaccagauuggcuaag

SEQ ID NO: 7229 - RNA, 884 nt, Mus musculus
gggacugcaggccucugcgauucccguaacgcggcucccggcguccgggauuccggaggcugagccuggucgccuuuccuagacuagaucgaaggcuuccccgccgcacuuggguggguggccggaacggaaaguuccauuuucucuaggguaaugggucgcggacagcaacccaggugccucccgcgaccccucuccccggaccucggcugucucccugggcugucuuccccagagggccugcgagccuccggcgacugcuaggaggcccuugggacucuggaggcaagggaacucccuggggacagggcaggacuuaguggcccugacuguacucgcccauagugaccgcuucggacccaggcuuaaguaaacgaaccuugcuacugugcaauuuuuguuguuguuaguaaaugaguuugggugucauugauugauccgugaacuggugaccugccaagaaacuguuaucuuuuugcgguuugagucgccugaugugugauuagaaauaccaaggaaaaaccuauuucauuguaauccaccacccuucccuugauuggaaaacgaccuuaaggcugcaaugugcgugagugcacgugugugauguguguauguguguaguguguauacaagcaaguugagaaacuuaaaagauaagggauguguaacuguaaagaaacacuccaauuugcauugguuaucuuuuacugagcacggagcccgcccuuggagugcaauugauauaauauauaaucaguguaacuccacugauggaaauugauuuucucauucccaacaucuaccuuuuguuuugcucuaaaggagacaaaugacaggaagcuggacggauggaggggugugugggagaaguugagggaacagca

SEQ ID NO: 7230 - RNA, 45063 nt, Mus musculus
cggggccguggggggcggagcuaggagagcccgggucagcggcggacggaggguggcgugugcggucgggaggccagagcuucgagccauccgggcugcggcuccgcugagggaccgguggugugggccgggauccgcggggcugagggacgcucaggagcggcgaggcucgcguccggaaggugagaagaacagggccccggcgcgggagggugcggguugccuggagcggccgccaccuggcacccgaggcccagcggggccgggcuggaccggcgccgagcgcacgcccggagcuggucgggcuggccugggaauccccgcauuccuucccuccccgcuccgggcuccgacuucccugauguugucacccgccuucuccagccgcguuccugacgcacaguuccgaagcccccgccccaaaguccucucgggaucgcgcguccugggugaccgcguccugcguucuuccaguucccgugccgugcucccugauccuacucuggacauggcccuagaaaguguggucuucugugucccgugaaaugcuaccguucccugcucuugauguuucuuaauccagagcgaacuuuucacccagacaucuuaacauuuaggcguuaaugaaaguccaguguuuauaaauauuaacuuucccuucgguccguacccuuccuaauaaaucccgcgugccuuuacaucccgagagcaagcccaucaucggucuuuagauuuucaccuccuccccuaagcguaaacguguccccuucuccagcuggcagggggcucucuuuuggaugaacaaccaaaauucagaaacucaaagcaaacauaauauaaagggcuugguccacuucuguucuugucauuuuuccauuaagaagaaacucguuuuggcuuaauuuguauaguuauuggacauuacagcagcuguacugcuuaaaaguagucagugagugcuggaaugucagcgcgaaucuucugaaaaaucuuuggucuggucaguguuguaaacaaacucuuuuagaccgugugugacugacugacugccagcuuccaguuggaacgacucuuaauuugaaauuacugacacauuaucaggggaugaucgucaucgucuuaauuuuccaaguuuguguuuauauuuaucauugggaauuauuuuugagcucugaucuggaaugcuacauuuguaggacuaaucugcuagucgguuaaauucuguuuuccacagguuucugggggugggguguguguguguucauuugcuucuacucacaagagaaagagagagaaaaaauuacagugggggaaaggucagcuaaggauaaacuuuauaguagaaauuuguauuguuggcauuagugauuuagaauauuacaaauacuguuacccgcucauuuaaagcaacauucuuauguaacugggcauuuuguucuguuuuauuuaugacuuuguguuuucauuuugaaauaguuuuuccuaagagaauguggcauuucaguucagugcuagaaugaauacugauuauuauauaccuaugaaguggguguuacaauaucuaccuucuagaaaagggaacaggcucaaaaaacauggcuccaaagccugugccuacaaacuguuguguugauggaucucuuaucgcauuccuacaguuuggucuggggaguugaguguuguccacaacccugcagugggagcaggaagggguuuucccuggaagugaucucaggugucauuuugccacacauuugcuucaccuggcccugguacauuugcaacuugucugcuaaggaagcaggaaguucuuaaagcuuucuccucaucuuugauugcaaacguggauugaucacaggugagguuucuggugagaugauuuuaguaagcauucagccugcucuggaauuuauaaaagaugccugagauagcaccuagguuuuucaguuuacaaaaucggguaaacaaacugugugaaaaacuacucggauacgggaguaguuucaaugaaauaaugagugauacagaaaguacuguggguguuuagggauuggaauugaaauauucagugggguucccagaggucagccugggaaccugguuaagguuuggguaaagaggaaacuagagagaucgaaauccggauguagaacugcggcuagaacgggaccaugggacaaaguaaaggacuaccaugugccguuaccacaauauauucaguuuacuaucuacugcuuaggcaacuugguaugucagucacagaacauuuggcuuauguucaugugcccuucaaagccuuauuaaauaguaggucuuacucgccccuuuuauacaaaggcgaacacguuauuaucagauucuauauuuauacauagauuuccugagcucugucugagcccuuaacuguaauacguucuuuuucauaccgaauauaugaauggcagaguaaagugacuauauuagguguuuuaaagcucauguuuacgcugggaauguagccaguagucgagugcaugccuagcaugugccaggcccugggugcaccuucaggcugcauacacgcacauucucugucaguagcacuuacauacggacauacaugugcaaacuaaacguucuuuuaguuguucccuaagugccucaagagucucagcaugugaaguuguguaacuccagugcuacacggugaauccucuuagggaacucugaaagggcccugggaacacagaugucugugaaugugggggaaaucccacagaagagauguccguuuggguuauaaacaguggaacaaggcagagucagcagggcacuggcaccguagaagcaaacuauagcccggguacaggcacacacucccaucaagaaggugugcuggagguuugugguaaccugagcucacccucuagauguggcugcccugggaacugugaaagguaagaccugaugcugaggccacgcaaaaugaggagcuuaaauauuugcuuugcaguuggaaaacgaaaagagucauuucagcauaauuggaauaaaaagccaacuugcuuguaauuuucucccgaauaauagcaugaugguuugagagaaagacaucuaagcauagaguuuuauuuauguggugggcuggggguggaacauugugaaagggccuuuccacauuguaagcaagagcuuugucaacuaugcuguccucucuauuauugguuuuuuguuuuguuuuuuguuuuuuuguuuuuuguuuuuuuuuuuuuuuuugguugguuuuucgagacagggcuucucuguguagcccuggcugaccuggaacucacuuuguagaccaggcuggccucaaacucagacauccgccugccuccgccuccugagugcugggauuaaaggcgugagccacccaccacgcccggcugguauuuuuaaauaaaguugaacauuggagagcgguuggacagugcaggugaugaaagcagcucuuggguucucugguaggugcuggcuuuuaaacagugcuucugaaccucgcucugggaggacaggagcugggagugcagcacugugcugugcucagguccaggaggagguuguggcagaggaggggcugggagcugugguaagugcugugaucaguccagugcaucgagacagacgagaagucuggaugagauuguaacagaaaagucaaguuauaagacaagagaagagccaacuugacugacugaggcagcugauaacguugagugguuuauagguaugugaggggguaauacauuucugugauaaaacugauaacacuguugauacagggugccgguauguguaguugauguguaaguagguauuuuuggggggagauuuauuacauugauuugcaucagaggcagaauaucuaagaugauguauaacuagaauugacgauucaagccagccagaauucuugaauuuggugugaaggcaagguaauaguugaaguuacaugucuucacaguaaauauuuuagaagaaaaguagauccugaguacuuuuuuuuaauauuuauuuauuauuauacauaaguacacugcagcugucuucagaugugccagaagagggcaucagaucucauuaugggugguugugagccaccaagugguugcugggauuugaacucaggaccuucggaagaguggucaaguacuccuaucugcugagccaucucaccagcccaauccugaguacuuuaucuuuggggccauucauggccaggagauaagagcuacugaagaauacagaaaaguagcugaagucgagaaccaccuacauuguauuuaaaccagaaggucugaggacuuugggaaguagagagggugguggaaggcuucagaaccacgggaggugguguccuggggcugugucugugaguauaguauaugugaauauaguaucugugaguagaguauaugugaguagaguauaugugaguagaguagaguauaugugaguagaguauaugugaguagaguauaugugaguagaguauacgugagacuugagaggcugcuuuaaagcccagucuggagcaagaacucaaauuccuuuugguaaaacaaacgaguggcccuguuauaaguugaauguccugccuucagauuuucagaaucucuuuaguagucacauucacccuuuguuuuaaggaagaguagauuaauccuuucuugugaauaguggcuugcauccugcacaauccuuuucuguuuggauggucugucuucuguccauccucugcaggcacaaccucuagugccaguugaacucaagugagcuguauuucaaauggcacaguggugguugggagaccuucucagugguggucuucagucacacauacacuguuuccucauccucagaacgcuuacuuuacagugcucuugagcccccgacuaggaaacucuguucccaaagcacucugcauguauuuuaccuguuagcuuugagcucccuguaagcaggaacuguuggcaucaauuguacuuguagcauuaaauuucuuacgugauggggagaauguggaucuuuaucagaguucucauaaaacucucauuugacugaaauaggcaagauaauuuguaaaagacuuauguccucacaggucauaaaugucucgugcuuucaguauauauaugaucugacuuuugcacguaauucuuuauuaacucuggaauauguuuguauaaaaaauaucuuuuuacauguuugcucauagcacuaguugucccagaguauaucuuugaauaaugauaaaaaauuuuuuaucagauuuugucuuguacauucucccuguguugccagcacuaaccgccaagucuuaaagcagcugauuuuccuuucugagccagcugagacuugcaggugugugcacgaucagcuuauaaauucuuuauuguuuaucugguuguuuguuuguuuguuuucuggucucagagaugaugcacacgagggcagcuguguacucugagcugcaucccaggccuguaagcgauuauguguacuggagucuauuugccuucgggcuguugauuugucuaguccucugugcccaugcaggcuuuaauuaucucucuaguaucucugaaugcucaucugccaaguccuuucuguuguuggaaauuggcuuaguguccauuuucuaauugagauuuuaaucacuguguaaaguucauaauaaacuacuuugcccuuuggguuaaaguuguguggcauuuuuauaucgugaaauucuuuuauaguucugaguagauuuuucugacucuaauguuguuuuugaugcuauuaugagaaauacgguuuucuguuacaugccuugguugguuauugcagaugugcucuggagugcugcuuuuuaaauaaucauuuguuucaauauuacauugaaugucuaggagaccugaugguuuaacauguuauuugucauuguagcagcuacauguuucaaaacugcuaaaaacuauuuaucacaacaguguaaagccauaaaagaaaaaucaaauaaaugggaagaggcaaacuacagcccaccucuucuuuguuuugcuuuccuaaauaaaguauacucaaaacugucaaacuuaauaauaacaaugaaacaaguguaauuaaaaauuagaauauucauaugucauaccuuccagaaagcuguguagcuaaauauuauaccuaucacagggcccaguuaucuauuccuagaauuaacuucucagaauuauagaauguguccacacagacucugcacgaguuaauuugcaguauuauguuauguacacaugcgaauauuguuucuuuaccucaugagcauaucauaugcuacguauggaucugaauccuagagacagguacaaacacagacagaaacugccuccuuugcuuacagucuguuugcguaauacauacaaugugcucauuucuuaggaccaauguaacaaaguacuauacauuuaggugaucuaaaauuacagaaaugauccuguguggugguggagcacgccuguguacuagcacucaggcaggaagagguagaggcagagaccagaggacaggacagaagacagaagacagagaccacaggcagaggcucuucuacaaagugaguuccaggauagccagagcuagcuacacagagaaagccugccaugaaaaagauagagugacaauuugauagguagauagguagggagagauagcgagauagagggggcgggggggagagagagauuaauugauugacuuacagaaaugcuauuuucuccagaagccagaaguccuccugguaagaauccauuggcucuucccagccucuaaugguagccauguguugacuuguuuuuagcuugugacugcagucacuccgguuucugccuucuaucguauggcauuuuucugagucuuucuuauuguucuguacauuugcuaauuacaucagcaaugauccugcuuccaaagagggucauguuucgagguccuaggacuugagugaaccuuuugcaggggacacaguucaacuuugaacaaacagugggcaaaauuagaaaauuauacagcauuuuagaauggggguuggcaaacaauggcaugcagaccaaaucuggcuugcagucuguuuuuggaaggaaagaaagucuaaacauuuaucuggucuauugcagaaacguauuugccaaucuguuauagaugucucaguguucuaaagaagaaaacaaaagccuggagggguaggauaguaaaggcgguuuagagagaacagggaagaccucugugggaagacucagagcacagacugcagacuuagccucugcagggcuuagcgaguucaagccuggggugguccaugaagaaagcauccgagcaacugacaacacucagcacgugugugcgcuuugaaaaguaagaugcgaacacuuacucacacauacagcgaugaagguguagguguagaauuuugugaggcucuccaccaacgucuucacuagcuauuuuucuugguaauauagagacuucccaugcuaccccugccccguuuaucauuugaaauuuuaaaaauuagguuacaaauuuaauuccuuguuauugggucauaucaaagauauaaugcauagaaagcagcaauacaagguucaacacuuugccuaaaugucaaguuauuuaaaaaaaaaauagcugccacggcucaugcuagaauaacuuagugcugugugcacuugaggagucagccauuuuagugccaguaggagaccaaaggagucagccuucugcuaaggaccugcuauggcuuccuucaacaaaaugcccugugccauuacauagacaucaagaggguugaaauggguguaagugaccuuacuguuugcaaggauguaucaaaccagugguucucacccuuccuaaugcuacagcccuuuaauacccuuccuuagguuauggugaccccuaaccauaagauuauuuucauguugcuucauaacugugauuuugcuucuguuaugaauuguaauguacauaucuguguuuucugauggucuuaggugaccccugugaaaggucauugaacucccaaagcagucauaacccacagguugagaaccauuguauuaaacauaacucgugaucccaaaggcucggggcaggacgauuacuugaauuuaguaguuaauggccagccaggacagcauagaaaacccuggugucagagggugcggggagacauagaaauaaccaccccacuguguuacugaguccucucacccaaguacuugggguuauuguguucugaagcuuacgucucuaacaugugcuacuugcugccaaccugccgauguaacaccagugaaggauuuaaagcgcagguguccggguggaucuagaaguucaggaaggacuagggugaauaggaccaaaauacauuguaugccuguaugacguccucaaagacuagcaaagaagacagcacugcagucaaagccagcuucugaacaaggcucuucugucuucacaggaagacccgauagaaggaacaugacaucuagaggcagcgaacuuguuuccgauucaugcuuuaucauuucuuaauuucguauguuggguaaguaauuugucuccucugcauuuucguuucucuuuuguaaaagcccaauaaauaaucccugcccuaccuaucugccucccaaggauacugggaggccuggcuccugcucgcgcagucugacaggaaacagcccaguguuucuuagcaaggacugggaaagagugaggcaaaucaguguaaagggcaccaacacagcggaggacagugcuuugugggugcauucggagugacacagucugaccccuccgaggacagugcuuugcgggugcauucggagugacacagucugaccccuccgaggacagugcuuugcgggugcauucggagugacacagucugaccccuccgaggacagugcuuugcgggugcauucggagugacacagucugaccccucccagcuccccaguggacagagaggagcugagcucuaauucccuucccauaguaacagugacuguaguccuuacucacucuccauacugcucuuggcuuacaucuuaggaauggaaagaaacauaaaggccauaggauaggcacuaaaaguguuuaaaguggcacaguuauuaaguguuaauuagguacaauuaggcugcuuuuuucccuccacuugagaaaaaccuguggauugaaagaacaaacagugcugcggucacugcaugcuuguucggaguuuuccagcaagccguucacaaucugugugauacccauugcucgagaaaaugacuggggcacacuuuccagauguucacugcuguuggcuugccauaucugagcaguuaccaauagagaagagccacuccguucugaaauaaaccuuucuugcaucuucaguuacuagucacguuagcuuuuuaaagcuuccuagauucgaggucagccuggucuacagagugaguuccaagacagccagggcuacacagagaaacccugucucgggaaaaaaaaaaaaaaaacaacaacaaaaaaagcuuccuagaaagccaaguucaaggaagucacuuaaugcagcguuuuugcaauauaugcauauucugcaagaugugugaaauaagaggaacacuuaauauaccuuuaauucaaauuuuuacucucaaaaucaaaugaaaaacguaacagaauccuggccguuuucaaacggguaaaucacaaggacagucaguuguauagaaugcagcacgggguccuuuuguucucggaugccccugccucacaccucagugacaggucuuaaaauuaggaaguaauacuuucuagucaugagagggaaaggcuuuucuguuuccccaugccaugcucagucacaaacccagcugccucauucuggauugaugugagaguuaaccauguccugcaugcuccgacauucuucuugcugauugcuaaggcucuguuugucugguugcuucucgucagguuguguuucgguuuuucuuguugcuggggauuuaaaccuaugcagggcgccugagcuguggaccugccuugggcacccaugaaacauuccuguguguguacauuuggaagacguuagcacguguuucucucaguguguauauauauaaaauguuguuugguuacaauuaagauuuauuguauaaauacuaaaaaaagaaaucugugggucaugauuuuugcauaguauaugucucuuuugcaagcgcguugacugccucacccuuaccgacauuucaaggauguugaaauauugcuucacuugggaaggcuugcuaagauaacgagaauggccccuucuagaguaaaaggcaggcgugcuuccugcucucuguaaggugugaguuccuuccuaaaucugaucuuuguauccuggaagauaacuuacucucggcaggugucaccugaccucacagcacucuguggguuaaacugguaaccagcaaaaagaagcuguugcuacuuuguggcuguugcucagagucgugucuuuuguuucuaacucggaaagucucacaauguuuugcuuauauuggugaaacugcugcauaucagacaaacggagucauagcaauuagggagaagacuguguaaguggcacacacagaaccgcuagauaacagucgaccugguaccacuuaaggaccaaucccggcuuuuguuucuguuuuuuuuuuuuuuuuuuaaauguaaaaucauaccuacuuacguacaaguaacgugagauggaggacuucagacauuuguguagccauaacuuuaguaaacauagagaaauauuccucuucuguauucauauagguguuuuaccaccuuccagaaaauagcuacacaauagaaacaagccuguguuuuagccuaugugaaagagaauggguuuuuacauuaugucuguuacaggaacaucccugcaagaugucagcaccaaggauuuggcuagcgcaagcuuugcuuuuuuuccucaccacugaaucuauagguaagauucaugaaaugucccuacucuacaaauuagacuuucauauuuuaaauauuauauaauuagguuuauguuuaguaaucauauaaguaugcauguauauucuuucuggggucauuacugaaagaaguaucuucaguacaaauaugccugauaauucguuuuguaucauuugaguuucaucaacuguaaaugcuaauuagcucuaccuccauaauguuaagguugggggaugugaaaaaugcuguuuuugaauaaaggacugggagaaaaaucuguuaauuuguaguccuuuucuucuccucaauuuccccaaacucaccaaucagugugguugcuuaccagaaugacguggcggugggggccgauugguaacacuggccugaugguggccugagaccugcugucuacaguguggugcaagaggacauuaagaauuuauauuuggagaacuuaaagaaugggguuuucucuacguggacgccuacucguacaccaccugcaugccugguggcucgggcggcuagaugaguguguggaauccccugggacuggagguacagauugugaguugcuguguggaugcugggaaucgaauccucugcaagauuagcaaguguccuuaaccacugagccaucucuccagcccucagaaaacuuguaacaguuugacauagccaugacaaccgagcauguggccaauggagccagcaaacaaaaguacagaucuauggcagguuggaagaaacaccagaccgcugucccaguuugaaaaguacccauguaggucagcucucuucacacagagggguucagcuuggcucccgugacagaagguuuuauguuaacugaagaccaaauaggaugaauaagagccuagaaacccccuagcaagcauuggccagaacguagccuuaagguggagcuucagagagacauggaaggaccacaaggcauuuggcccaggugaguggacgggaggagagaaguaagaauaagaagugguacguuugagcaaaucaugcugaccuguaucuguaaucuuugcacuuggaaaauugaggcaggaggauuacaaguucaaggucggucuggguuacauagcaaggcccuauauuucaucacuuugaaaauacuuaccauaccaacauuguuugguaccaaaaccagacaacacaaaugugcaagcuauaugcuaauaucaugaggaacauagaugcagaaauuucugauaaaaugcuaggaaugacguuuuaacagcacauuaaaaagacgauuuaaucugauuaaaugcauuuauugcagaggugcaagggcuauucaccauauacagaugaauaagugaacugacagcacuaagagauugaaggaucagcccuauggucaccuuagucggugcacuugauaaaugucaugucaaacuucauaacgggcuggcgagauggcucagugguuaagaguacugacugcucuuccagagguccugaguucaauucccagcaaccacaugguggcuaacaaccaucuguaaugggauccgaugcccucuucuggugugucugaagacugcaacaguguccucacauauauagaauaaaucuuuuuaaaaaaauauuuuaaaaaaccuucauaaccaaaaauaauaaauuagagauagaaagaacauuucuguguaauaagaucuuguaaaagauagaccuguuauuuucacugccuuuauuucuaaccaccucuauuaaauaugcuacuugaagaucuagccagagcagucagacaaaagaaggaauauaaaaagcaucuagguuagaaaagaggauaucagauugucucacuguggauuauaugauauuauuuaucagaaaccccaaagaguacaaaauaaccagaacuaguuaaugaauucagcaaaaguugcugaauacagaauucacauauauaggucaguggcauuuuauaugguaaugauaaauuaccugagaaaacugucuuacuuacgguagcucccaaaauaaaucucaguaaauuuagucagaguuauaauaucuaugaaauauaaauuauaaaaucuaaugaaagaaucauugaaaggacacaaaauauggacagacaguccaugugcuugaacaaaguaguuacagaguuagcaaaaacuucaucagauucauauggagccauaaacacccaaaugcccaaaagaauugugagcaaaauaaguaagaauggaaacauuuuauuuaaaaaucgauugcaaaguuacaguaguuaaaacagcauggugugccccaucccuuaccugaccagcaugagagagcugucuuugauggugugaguaccuucccugggcagcagaguagaguuaccucugguggcagaugugugggugagccaaccccucaccucccaggacaugagcaccggagagcuaucuccaccccuugccagcuacagcacccaggaaaucugcuccgcuccucgccgggccaccacguuggcucugccccucaccugggcagcacuucaguaaagcugauccuggugccaugggaguaggagaucugcucaccaaaucagauucuacccaggcgcagauacagggcacuauguuggcccagcccaacaucuaccccaccuaugaacugcugaagcuuaugaaggggccagcccuauagacccaaagcuacagggucuccaugacccagggcaacaacagaauaucugagagaaguccagggcgaggacucaggauugaugguguagcagaagccagaggccuccaaccagaccagugacucacugcaaagaacauuugcaagcagagagaugugggcaaagggugugcugggcaucaccacaacggccguggugagauuuuuuaauguuuucuuuuguuggggagguugguugccagggcagagaugaagguuggggagguugguugccagggcagagaugaagguuggggagguugguugccagggcagagaugaagguuggggagguugguugccagggcagagaugaagguuggggagguugguugccagggcagagaugaagggcugggaagacaaaugguauugagcuacuacauaaugugaaauuuacaaagaaucaauaaaaaguuuaaagaaaaaaaacccagcguggugugggcauagucaagagugguaaaaagacuagagugcauagaaguaaacucauuauauauagccaccaaucuuugacaggggcacuaagauauuagaggaagcgcagucucuucagaucgaggugugggauaauuggauauccgguucuuccucucuccacauuuugaaaaaucaacucaaaacagauuaaagacauuuauacauuauugguugauugauugagugauugauugauugauugagacacaaucucacuguguagcucugccagccugggaaccugcacuauagauaagcuuguucuugaauucacagagaucugccugccugucucucuagugcugggguaaaggcaugugcgccauacucgacuagaguaaagacuuuaacuauaagccuugaaccucugaaguccuggaauuaaguagggaaaugcuuuaagauacuggagcagguggggaguuucucagugggaucccgaagcacagagaggaaugcaugcaacaugagcagacagacagacagacuaaagcaccacagcacacuuuuagguucaguugagaaagaaggucgacugaguaguacaauuucaaaucuuacacccgauaaggaauuaauacugauuuugugaggaauucaacucaguagaaaaauauaaauaauguuuaaaggcuagcagaccuagguagacauuucugaagagaagacaugcaaauggcuaauaucauauaaucucacuggugaaaucuaaaaaaaaaaaauuauucauagaaaguugagaguagacguucucagaggcuugggguccugacugagggaacaaagaaagggugugcacugggaccccguuguacagagaccugaauaauauaucugcuauucuuuugcacagcaaaguaacuaagugauaauguauugugucuuuucaaaaauaaauaaauaaacaaaagcaacggagacuccaccgguacguguaucuuacaggauauccaaagcagccggaguuacagcugucgcuggcaacagcaguggaaucccuacaaugcaauuguauauuuguuucucucccuauccaauucuuuuuucccuucuuuaaauagaaaguuuuauuccacacacugauagauaaaauuaguacauugcuaaaacuaguccaaguguuuucucagaaaauuguacucccuacccuuuguuaaaucaaucauacuguccaggcuuucugguguggguugcugucuugcugcaguccagauuuuggcagauggacaguguguccaccucucugucccaccauccuaaccuccacuggcuuuuagggcuagagagaaggccgcccaccuaccuguuuuauggaauuuaauuuaggccgucgggggccaaggggugggugggggauggguaggguugacuuuugcuggacucagucuguuuccugagggaaaucagaauauuugaccaugagcucaguaauuuuuaguauuuuauacauuauaacuuguauaguucaccacaauuuuuccaggcuuaaauguucuuuuucuccagugaguuauuauagugaauuuguauagucuacacugaguguugcuauccaaauaccauuuuguacuggaaauacugucuuugagguuuuuguuuuuccuuguuccugucagaguaccaggcauugaacccacggcaucacguguucugggcaaacucagcacaguccauuguucuuuuucaggucaacuuuuggaaccgugugguuacaucuacccugaauuuccaguuguccagcgcggcucgaacuucacugccauuugugugcugaaggaggcgugucugcagcauuacuacgugaaugccagcuacaucguguggaagaccaaccaugcugcuguucccagggagcaggucacugucaucaacagaaccacguccagugucacguucacagacgugguccucccgagcgugcagcucaccugcaacauccuguccuuugggcagaucgagcagaauguguauggagucaccaugcuuucaggcuguaagauuugggucuuuucuucaauuuugucagacucuugaacuacauuuuuaaugguuucuguuagccuucccaaggacagucacugguucaguagcuuuuggaagugcuuauuuuauaaaacaaaacaaaacaaacaaaaaacaaaaaaaaucauuuagaagcaacauguauauuuuuaccauuauacacaaauccagaagagcagcaugggugucauuucuuuguuaaaaacaaacauuuaucagagucuugagaaaugguuuggccugagacucucugugcccccaagaguauuacugaucggcaguuugggucuguugauagcagcuuucugugucuccucauuauugagaaaagaacuaaguuccauaaguuccugaauggaggaaggagaaauacuaaaaagauuugaagggagcaaggaggcacacgggagggcuuggcaggaggaaggggauggagaaaugagguaauuauaguauuuaaaaaauuauucuuaaaaaagaauaacuacacaaagaguggggccagcauuugcuuuuccuucaauccuccaggaagcgauaggacaaacauucccaccggugugauggugagugccagucagcccagcaccugggauguggaucagaagcucagacagaagugugaggccagcuuaggcugcacagaaggacccauuuugaaauacaaaaguaaaauaaaguauaugcaaaacauuuuugcuccuacaacgaccuuuuaauacuaguuauuauuaauuuuagaacacuuaaaagagacauuacugauaauuuuucugguuauaaauaaaaauguauuuuuauauagaaaacuaaaaugaaagcaauuaaagacaguuacacacacacacacacacacauauauauauauauauauauauauauauauauauagaaagagagagagagagagagagagagaggaagagagagagagacaccuaaaaaguauuuaggaguuggaagaaaaauuaacauguuucucauuuugcucauauauuaucuuggguucauuuaucuaauugaggugggucuuagacauuauauaaauuagauaauacuuaucuauauaagacuuuuaaaaguuaaauguuuguuuccuuauaguuccuccagauaaaccuacaaauuugacuugcauugugaaugaggggaagaauaugcugugccagugggaccccggaagggagacuuaccuugaaacaaacuacacuuugaaaucagagugguaaguuacugcagauaugcuggacuaugagacacuguggcugggacuuugauuuugucgguagcaguacugggugacuguuuugggacaucacgugcucugacaguggaguuaugugcucuucaugggcgcuccgagcagugucggcagugagcagugugcacacucuaccccaagcugccuucaagagaagccagccacauucuguccauagauacuguaauaccuagcucuacaugacgacuuucaaacacaaccacaugcuguuucuuagucaguguucucucacugugaagagauaccaugaccauggcaucucauauaaagaaaaacguuuauucagggcugguuuacacucagagcuuuaguccacucuuggcacagcgggaagcauggcagccugcaggcacacauggugcuggaggaacugagagcucuacaucuggaucagcaggcagcaggaagagagagagagacacugggcauguugagcaucugaaaccccagaccuuccuccagugacacccuuccuccaacaaagccacaccuaccccaacaagggcacaucuccuaggagugccacucccuaguggccaagcauucagauagaugagccugugggggccgugccuguuuaaaccaccacacuguugaugcaccucagcaaucugaaauacucuuaauaucaacguuugccuaguaugaauucccucacuucucuccuaaaaugcugucuuacaaaaauguucuagaauugaaauuuuuaaaacauuuuaaaauucucccuaccuuuuaaauugagaauucuucucucucuuaaaugacagauucuacuugcugcuguuuucuuuccaugcaauucagugacuucuuggauauuguuaauauucucccauuccuuuauuuccuaaaaauuguuagguuuauauauuuggguuggauuacuuuuuucaaaaauuuaacucccugcgauggcacauuccuccacuaacauuguuauccuuuuuuuuuuuuuuugucccuaggguuaaguggcagguuggggaggugguugucauagggugcucacugcacaagcaugggcucuuaccucagaccucuaaaacccacacaucagaugacauggcgccguucugugaucccagcucugaggagagagagagauacggagacagguggcagcucacugacuggccagccuaggucauugagcuucagaguccgagugacccugucuuugcucugggaucaaggaagacagcagacacaacugcuggcccgcucacacacacacacugcaccuuggucucuaguauugccagccucauccauucuuacaaauauauuucuugaugcacacaaaagcuggaagaguaguggagccugugcgugccugccacccagacucuagaguucauuuuaugagauuugcuuuaccacauccaugugcugucuccaaagugagcugugggauuaggaauacuuauaauuugacacuucaauguucacgugguuagcaugcauauuuaaguguacugaacuuuguuuguagugagagcacagaucugaggugucggcaacgcaggaguuuugacaagggcguaccccugcagaacucauguguucccugaagucuucucagucaauccuggucccaccccugugagacagcugcugagguuggaccaggccacgucccagcugcuucauucugacgucugagcaccugucaguguuccuuaguuauggaucuccuuuguuuuguuuauguauuuuauuuuacaguucguaggauuaaaagaagugcaucccagauacuuugcaggcacucugccuuucaggucuaucuuuagucucaggguuacuugaauguucuuacacacaaaauuauaaggugcaucuugaguuuacauugauauuuucaacuuugaaaggggacuacaguguauuuuuuuaaauauauaauccaucaagcagcuacauccucuuuucuguaccaaaauucuacuucccagcaauauuaaagcguuauugcuacugucuuucauaauaaacaagaauguaauuuuaaacaccguuccaauauuauugcuggugauauauuucuaaaagcaguuuuaaaauugcuuuucuccacaaauauguaugguugaaucauuguuuuaagacguuugaaacgaaggcuacagagauggcgugguuccgagccugccgcuccuccggggaaagagcuugcuuuaucuucuuaucuuuuacaggcuuauuguaugugacuguuuuaaacugaggcaugacuuugugaguaguguaagcuuucuguagcuggcaaaaccagcaagugguuccccguuuuggcuguaaagguugaagaauuuuggggccgugauagaacuccuucgcugccucaucucuccccuagcauaugcugaauagagaaaggacaaugcugguuugguagggacucuguuccaagaaggaggaaaacuacaaugaauccuguuaaucuguuguuucagucuaaaaguauccaguugacaauuccagaaauaaacaauuccugagccacugcacgcucuucugcauagcuuaaugagauuucagauccuucucaguccgggucccaggagacaugccugccugucgguuacccagagcucaccuuguuuauuugauggugauagcacagugcuuguguuuaaauagaaaagccaguuuuccuuaacaguagucccagagcacagcauuuguauagcgguuuaugcaaagagaaacuauauagugguuuaugcaaagaaagagaaacuauauaguaguuuucuuuaagugaaggacaguucuugagcaaggagagaaaauuuuaaucuaaaguaagcacagauuuacuguuugugauauuaggaagaagaagaaauucaccacaguuacuaccacaguauaagauacuuacucaguuaagauagaaaucauuacaucugugucuggaugacgugaauagaaaucacacuccacacgagagcaagacauugcgcaggaaguacugggucugcaagugauuucccaagggaagcaucaccaagccauuuccuccaagcaaggaggguugugcacauugagaagaaccuaccacagaggcugucuguaagugaagaagacagugcugguacguuugcagguguccaguagaauauacagccuuuaaaguguggagguauaaccaaagcauaaaucagauuugcucugguacuuuguggccacaguucaagccguaugaugaagccuaguauaguguacagagugaagcccaacgugcgcauccuccaguguuguggaguggagcuauaaugugcaggugcuagccuuccugccuggggugguucuagcccugcuuggcagaucccacaagugguacaauccuuggaagaaugaauuaagaagacuuaaagucuaacagcagauggcacauccaacuguuaccaaggugucaaguagugaauugccucuucauauggccuugucccccuagcagaggccacuugguauugauuguaucagucagcuccugauggagacccuaguuuguauacaugcagugcuguagaugaccacuguuucuaggacaguaacacucauggaauugcagugggugaaugcaaacuggaaauggcagaaauuuauagagcgaggccauguugggguuuagucuuuugcuauguuuuguaauacuaaauaucggccccagggccuggcugcucccaagaaugagagaaucugcacauacaaggugaccuugcuccuuaauuuuaagcuauugguuugauaaagaugacgacagccaguagcugggaagaagagauaggcaggguuuggugcuccugggcuuagagccuaaggagaaccacaaggagcgggagaggaaagggagagaagagaagaugcccugcgguaaggaucuucaaauuauggccaugagagcggccgaugggagcuaagagcagcccaacuggaacguagcaagucauauuguggggagauugucagggaaguagacauacuagcaaagacgguagcugucugcccaacuucagugcucauuaaggcucauuauaaaugucaauguuguaugucuuuuuuuaucugggaacugaaugaucaaaggcagacuagaagucccugacugagaguaacuauuucuacagcaggguugagaaugcuuuccagagguuuacagggaagacaggaaauccuuugcacugcagguaaguugguagagaaugauuuacugacagguagcgugaggcucuugaggaaugcuaaugguccaccucauugagucaccuacagaagaugaagaggaaacggagggagaaccagcagugaacuaagguugagagcugagggaggcugcagagugaauacacagacacugaaggacaaaaguauggcauguagauagaccuugcagaaauacacgaucaaaggcaggccuaguccuuggagugacacacauaaaaguaugcuucugcucaccacagauuacagcuuucugagcaaucuccuggugaguuaaagacaagcaaauugcuauuacgguagucuccuagaagcuugccacaaaacaccuuaaacaauaagaucaccgaucauggacguuauccaucugccaccgaugucaucagcugaaaagaugguucuuaucuuaaucuguguucuauugcugggaguagacaccaugaccaaggcaacucucauaacagagaacacuuaaguggggcuggcuuacaguuuuaugggugaggccacuaucaucauggcgagaagcauggugagaggcaggcaggcuuguugcuaaagaaguagcugagacuucgaccucuggauccacuggcaggaggaagagacaaagggccuggcuugggcuuuugaaagcucaaagucuacacucagggacacguugcucuaacaacaccacaccuacuccaacaaggccacagaccaaauucuccucagguagcaccacgugcugcugacuaaagauucaguauaugagccuguggggcguucucacucauaccaccugccuuaggguuucauugcugugagcagacgccaugaccaaggcaacucuucucaaggacaacauuucacuggcgcugcccuacaguuucagaaguucaguccauuaucauggugggaagcauggcagcgucuaggcaggcauggugcuagaauagcugagaguucuacaucuuguucugaaggcaaacaggagaaaggagaaaguuauuuaagcccaucccuacagugacacaccuacuccaacaaugccacgcccacucuaacaaggcuacaccuccuacuauugccacucccugggccaagcauauucaaaccaccgcagcugucuuucuggacuauugucaggucguguccaucagugucucacaggacugauaucauucaccucaauucaaaucaucuuacacuaucaaaagaaaagugaguauuuagggagagauugcauccacuucccuguuagaguuguucaucuaccaugcuaaauucggagauuaaauaccaucauagugaaguguguguaggaaaaccauaggauuccuaggguuugcuguuaccagaguuucaggcgucugcaggggauccugaaacaugccuuuuguuuguuuguuuuguuuuguuuuguuuuuuguuuuuuugagacaggguuucucuguguccccauggcuguccuggaacucacucuguagaccaggcuggccucaaacucagaaauccgccugccucugccucccaagugcugggauuaaaggcaugcgccaccacuauccggccugaaacaugccucuauggcugaguuaaggcugcuauucuaagaccacaaggaaauagaucauuuuuagggggagaauaauuaagggcauagcauaaaauucuaaaaugaaguuuucuuagauuaaaaauguggaaauaauaucauagguguagcucggauacaguuuuucagaugugucaucugucuuugguuagcaacacuucauugcaaaggacagugcaccaaucugggucauauccaaccuuucccagucacccuuucaccuuuauauuuucaaucuauuuuuaauggcugguucuuccacuuuuauacuuagggcaacagagaaguuuccugauugccagucaaagcauggcacuucauguauggucagcuacaugcccaccuauuaugucaacauugaagucuggguggaagcagagaaugcccuugggaaggucuccucagagucuaucaauuuugaccccguggauaaagguacuuagaagccgggauuugagacuuuaucaaacuucucuaugacuuguaaacuauuuuucagauuuugauuaauguagaaauguuuauuaguacagugauuuuuuuaauaaagucuuuuauaauguuauuaaauguaauguggaaacagaaaaauagcuguaguuuagcuauacucauggcuguguuuaguuuacuuuuggaauauuuuaucacugcuguuugucucacgcagcccagacuggcuuuaaauuggccgugugucuaagguuaacuuugaaccugauccacuugccuuccccacuuagaauguuacccuuucauuauucaauuugcaggaccgcaugccacugcagucacagugacuuccuuguuuuauuuuuauuuucuuuuuaaaaaguaacuugcuauagcauuucagcauuuuuuaauaucagcaucugaaaauuaacaaauaugcugagcagacuaggaaaugcuucguugaaucuuucuaugauagggcaaagcaccauucuagagagcuugccuuugguaagagcaaucuuauuaaacagaucaucauguguuugacuuguauauggaacuauaaaaguaaggcauaacuaacuuuaggacuuauuuuauucuucagugaaacccaccccaccauauaauuuaucagugaccaacucagaagaauuauccaguauauuaaagcuaucaugggucaguucagggcugggcggucuuuuagaucuaaagucugacauccaauauaggaccaaagaugccucaacuuggauccagguaaauugaacguugcuguuuaugcuaauaguguugcugccuucguuugugugcuugcuugcuuuguuuguuuugagcacuaauaugaagacuugccuguuuucucaaugucuuaaugugaaacauuucaucugacagacagacaagcagauagaacaguggccuuuaggaaacgaggcagggugaugggaacaggaugcaggaucagcgugcagguggagaggggguuuuaagcgugaaacugagcacagguaguucagacagcuuggcggauuuugcuggaaccguuuguuuguugucuuugggggggggggcuggaguaacagauuuucuggcccccagcucuuaauagaggauuugccaacucuuaaaguccagaaaguuuuaguggggauugcaagccuggaaggggagguggcagguccuugcucucaguggaggagcugucuugggcgguaccacauugacugccugugagauuuugugcugcaauuccauuuauaacuaauagcccacuuuuguguuuguugauugaucgguccauucauuuguuuuacuaccaugguugcaguuaugauccuagagagauaucaauuagcccagagccucugugcuccuuugugaugcuccucuaguuuaccggcucauaauacaaucacaaaaagcaaaacaaaauuggcuucaugacucagacuguacagagaggauguguauuuaaaguucuucuaaguauauuuuaauaucauagaaucuuaacuuaauaaaaaaugcaccaaauuuaacaucuguuuuguaucuaguauugaaaugucagaguggcagaaagaaguaguuaugugugugucuuugguuuccuccccacucccaguucaaggacaaguccauggacuaggcuagcuucugcuuugcuuccucucaacacuuaguguuacuuuuauucauccuguguguacacaucacagcauguauguagacgucacacagcuuacagaaggcagguuucccuucccacuguguggguuccaggcguacguccagcucagguguacucucugagccaugucgccagucccuagcuucuauuuucuuguccccucauuuauauacaccccuuccuucuacacacuguugucaugguuugcuggccuggcugauuccacuguagacuuccauucugucuugcaccccaugagcuacuggacagaaggagcuugaugggaaagaagaggaauagaauugagaacaacacauuuauuuucuucugugcaguaaggucaugacucuuaacgcuguccucccagagucuuuuuuuuuuuuuucccuuugcacauagaguuagcggguauaguacaguuccuagugcacuaagcauucgggauuccaacauuuauucuugccuguuucuuuucacuaagccucugaaguguuuuguuguuguuugugugcuuguuuacauauuuguguuuagcuguugggugggucugguucuuuaagacaggcucucaacuucagauaguguugccuggcuuagaacuugucgcuugcucuaucuucaguaguucaguccucuugucugauacuacaagcaugagucaucgcuuucucguugagacuccugaguauugcaggucucauagaaggaaagacuagguggguggggccuauagauugucauauuguuacugccaugucuucuucuccagugguugaauuuauuaaucuugcauuaaguugauuucuaaaacuaauugauuucuguacucacuuuaggaaccuucucuaucggaggugucgaugacaucacucaauaugcuuuauucucaggucccucuugaagauacaaugucuccucgaacuuccuucacugugcaggaccucaagccuuuuacagaauauguguuuaggauccgguccauuaaggacagugggaagggcuacuggagugacuggagugaggaggcuagugggaccacauacgaagacaguacguaaaaguggugagguggggggagggggagggaaguggaaggccggaaggccagggaggcagaaggccggcugcggauuauguugcccucacugcuguacaugugaucauuugggccaagcuguacuguuguauuauuucacaaaacaaccuugauauauauuauugauaguauaaguguauuugguaccuaaauagguuauacuauaguacaauggaaaaguauuuuuaaaugucauuuaaaaaaacauucgcuuagcuuuguucaaggaagguggucccaagaugccccuuacuagagaauuguauccuaacucauuaaaaucccacugucagagccggcugugguggugcacgccuuuaaucccagcauugagaaggcagaggcaggaugaucucugugaguuuuaguuccagccuagccauggcuacagagugagagccuaucucaaaacuaaaauaaaacacugucuauguuauagaauuuuuugguacuagcauuugauaagcccuugggaaggcugaccugggauucggguugguucgcuguaagugcuuuuuucaucauugaugaaauuauaauuacacauacaguguggauuauaaaagcucaaaaugguguggggucuaaagagggucucuggguuuggagaggugacucagugagccagagaucuugcucuuccgaggccuggaguucaauucaaaucugacgcucucuucugaccuccauggguacugcauauguauagugcauagacauacgcagguaagacacucauacacauacaaaugaauauauacggaaaagauagacuccucccaaagcugcugcauuucugaucuccugugcaccaccagcaaccagucuuuugcuguggacuccucuuuggaccuuuuccuaccauggucucauagcagcagccuuccuuagcuucuagaccccaugccuucaaccaucuugcuagagguuuaggucagugaacuaaaaaugucaaaggcagcagugucccuccuucuguaaggcuuuucucgcucccaugagcacuguagaaagcagucuuacuauggccaguuugcgaaugcgcaguccauuaacuggcuccuuuggcuuaaggagggacauuuugguuuugugggggaggggaggaugaggacguuguacuuugugacccaggcuggccuuggacucucagccuccuucugccuccacgugccaaguguuaggauuguugacggggaaucguaaaguggcuuucagaaguuuauggguccauuuguacaaguucaugaagcgccucaguacggaggcaaaaugugguuaagugugcauucagcgcucucuagagccaccuuaaaagccauuagaugaagcaugucuuuagccuacagugugaagcuucuaggugcugcucguguuaagagguggcucugguucacauccuguguacuucuauauccuuuauuccaucugagugcagucccaugguaguacaguaugugagaucgcagugucugguaccagcagcuuugcaaacagcuuccugccagccugucugucugcuuacucucucccugcguuuguaacuuucucacaaccgacacaaagcuguguggguuucauucaaauacuguuuguuuuaguaaauacaauauuuguagguauucuuaacaaagcucuggaaagucagaacuuauagaaauuuuguuuuguuguuugaaaugggcucuccaguagcccacauucaaaugcacuaaguaguuauggcuggucauaaccuucuaccuccacauguccagugauaaggugcugaggccccgugcuuaccaucccccuggaagaugaggccccaugcuuaccaucccccuggaagaaugcuuugaugcaguuacagagcucaugucuuaucuucagcucugcuggccuuguuuguaguuauuuacaaucucaaaauaguaaaugaaaaauuucagaaauaaagaaccuaacaaucuguaaguuuuaaguaacuucauuauauuuuuauuauuauccauuauuuaauaucauccauuguuguuaguuuauuacuguaccuaauuuacaaguuaaacucuagcaugggcaauguuugcaggaaaagcaguguauaugaaauguucauuacucuucagaguuccugguguccacauggccucuuagaacacacgccaugcagauugugggggcugcuacaucagugcgugugauuggauccucgugcucagagcugucuuuuuauaguaugaccauaccgcuagagaguagacacacaccaacauguguauuuccaauuucaucuuuagcaaaaaguaauacaaauaacucgguuuuauuuuuuuaucacuguuggaagaaaaacuuuauuuuuaagacuuuguucuuccuuguccacuguacuacaugaauacacacacacacacagaguggugcuuuuuuugucuauuuguaggaguauacaucucuaaagaauuuaauuauaaucuauaggcaagcaccauggcacaggccuguagucccaacugcagaaagccaaggcaggagaaucauuugagccuagaagucccaauccacuguggguaacauagcaaaaccccauguuauguuuuguuucauucauucauuuauuuauuuaucuauuuauuuauuuauuuauuuaugaaugagaguguguguguguguguguguguguguguguguguguaugagaugcugauguaaauucucagcugucacccugacuaaugacagacagucauuguuguacauaguacauuguacugcugugggccugcucuuguaaagaggaaugcugugugacugaagggccacagauccuuaagaacagaaagaauuacuucagaauuuuacagcacuguuaagauaaaaagcacuuuguuuuaugaagguuguguuuucuuuaggaccauccagaccaccaaguuucugguauaagacaaauccaucccaugggcaggaauauagaucuguacggcucauauggaagguaaaagaaagauaaaaagauuuauacucauaucucauacaaauguacuuaaaugguauuuuaagucuaacuuuuuaacacuaaaguuuuauucaucauuauuuccuccagacauuuaguaauguuaguguauaaaaacacaaagccuuauuuagcuacugaaaaagccaaccaaguuuaugaacucagcuaauccgucauuuuggauuuggcacaguucauagaaggguaaccucuauaaaaacaagacccuguucuaaaugucucugaacucgcuagggagccaccuaggaaacagagaggcuuagagagaguagaaugugggcuggugaggccacaccuguaccucacacuguaaagauagagagaagaaaagaagaugcugagacacaaaugauagagaccaacagcucagcuugcagagcauugccgagacagaggcuaggccacacugcagagcauugccgagacagagaccacacugcaggccugguucaguugaggcuuuauuuuccuauuuuauuuauuuguuuguuuuuauucuuucuuagcgaguaguacuuaauucagaaugagcucagauugaagaggcagcucggcuguuaugagcccuggcugcucuuccagaguauccagguuugguucuuagcacccacauggcagccugcagcugucuguggggaucuagcacuuucuucugaccuccaggcaggcacacaauacaaggaacagacuugcagguaaaacauuaauauaaaaauaaaucuuuuuuuuuuuuuuuaaaaacgaguuugccuuuuccuuccaauuaaauauuuacagguuugacauacuggcaggaucuguggacaugaaaaguugauuauucaagauucaugaaauaauuuuugguaaacguuuauuauaggcacugccucuuucugaagccaaugggaaaaucuuggauuaugaagugauucuuacgcagucaaaguccgucucacaaacguacacagucacuggcacagagcugaccgugaaucucaccaaugaccgcuaugucgcgucucuagcagcaagaaacaaggugggcaaaucagcugcagcuguccucaccauccccagcccccacgucacaggugcguacugcuaagguggagcgguggcauggaugccaggguuaaggguggacaguguccugggaugguagauaagcugcugucugcuggcagggacgucaugacugcaguccucaggagacgccuuggcccugugcaguuuguuugaacuuugcagcuaguuugcuaauuucuuuaaguacuuccugauaauuuguuuuuuaaauacucuuucaagguucuaggaauuuucuuugcauguggcauacguauauuauuuaucuaauuuaucuagcuguuaaggacaaagacacaguuauaaacuuaaauacauaaaaccuuuggcugugacuguaaaauauugagauaucagauuugucaguguugacugauuuuuauccacauuacuuuuuuuuuaaagcugcuuauucuguagugaaucuuaaagcauuuccaaaagauaaccugcucuggguggaauggacaccuccaccuaaacccgugagcaaguacaucuuagagugguguguguugucagagaacgcacccuguguugaagacuggcagcaggaagacgcuaccgugaaucggacccacuugagagguacaccuacuaagcgcuuaaguagacgguguucgucugcccccaggagacaguguccgucccaggcuguuugucucugucuucuguugucuggguuauugugagucacugaaaagacucgaagccucacugugacuagacgugugacuuugcaaguuacgcuuuaacgcuuaguaucucugaaccacgggcucucuguauggagagaagggccaguacuuuucuaaaagacuaaacuacaaauaaaaacccugguauuaacuuuauuaacaaaaggacccuuacagaacuguacagagaaucuaguucagccuuaacuaccaguuaguuguuuguuacuugugcucaacucaguuaacugucucguuacccagauguaaauuaguucccgaguuuaacuucacagggcuguugagugcuggcagcccagccagagcacagguuccuccuguguuccagguucuaacacagaguggcgauaauagcugcuaauggugcuacacugcauggcuguaaagucguacaauagcauuuaagaaaacaaagcacugcuccauguauguuguuuaauucauagagaaggggaaucacuaggguuggcuguggguagagagcucuugccgagcugcuguccaaucuugauaagcuuagaugucuccuuuauugaccuuagcagauaaaaauccuggggccggggcaggcagccuacgagguauggucagcucucagagacaaaggucucaaggcucagugccccgcaagagucauuauuagagcagaauuuagaauggcuuacuuuuuuaucauagagaucaagaaaagguaaaauugcucuuuuuaggaagacaaaggugcaucuaauguuaugaauguagugaaggaaauagauuccuggagaagguauauacagaguaagaaugaccuuguagguacauaggauauauaucuuauaaaagaccacuuuccuaaaccaugcuucaguugugugauaaaugucuuugauaauuuggaaggauuagaaauaaagaaaguaccauauuuaagauuuuuuucuuuuagaauugagcgggaagcagccuaacucauuuuuuuuucccagcugcucucaccgacacagcugugcauuagugcuccgcccuugaucucacuguuggaccuuggcaggccacaaauuagcuaaaauacuggccuaggguuuccacugcugugagagacaccaugaucgaggcaacucuuagagaggaaacauuuaguuggggcuggcuuccagguucagagguucaguccauugucaucguggaggaugcaggcaggccuggugcaggaggagcugaguguucaacaucucagucugcaggcagcaggaagagacugagucccacacucagcauggcucgaacauaugagaccucaaagccugcucccacggugacacacugccuccaacaaggccacgccuucuaauagugccacucucuaugggucugugggggccauuuucuuucaaaccaccacaaauagcaaagcuguccaagaauaaucugaaguguuuuauuaauccggaacauaaaagcauucacuauuuuuauuagcaauauaaacacuuuuuauacuuucugguucacuguacugacacuaaaaguagccugguguuuuuugucaccuggauagccuugaacucaggguguagcccagacuagcuuccaggucauuguguuccucccacuucagcuguccaaaugauaggauuacacagccaacauuuuacuauaguaaauuuauguugguguauaaaagauuccuuuacauauaaaauugcaguguuuagaagaaaguaaaaccaaauggucauauaauaauaagguaaaaaucucgccugagggaacugcuuucucugcuguucuuguuguaggacgccuccuggagagcaagugcuaucaaaucacaguaacucccguauucgccacggggcccggaggcucugaguccuugaaggcguaccucaaacaagccgguagguccacccuugcuugcauggaaaaugcucuuaacauuuccuaaaacauuuuaucacuuugaaauaagaauccucuaugugcagugguggcagaugccuuuaaucccagggcuggguugcaguuacagguggaucucugugaguuccagccuggucuacagagugcauuccagaagagccaggguuacacagagaaacccuugucuugaagacaaaaccaacaaaaaagcauccucauuaguucaauaauucugccaugaggacccuuacugacuaguguugauuccuaagcacacacuucucaguucgcaaacgcacugacucucuuacagcuccugccagaggaccgacuguucggacaaagaaaguggggaaaaaugaagcugucuuagcgugggaccagauuccuguggacgaccagaauggcuucauuagaaacuacuccauaucuuacagaaccagcgugggaaaggagauggguaauaaaauuguagcaacuaccaagaauauguuacuaaagcuuuuucuuaaguuuuuaaauacuugucucucacauaauguguuugauaguacauagcauccuuagcagauuucugcaaaggucucauauguuuaugacgcuauuuuuuuaaaaauauuguauuguaggugucuuaguuuuacuuagguuuuacugcugugaacagacaccaugaccggugggagcagggcagcauccaggcaggcauggugcaggaggagcugagaguucuaaauucucaucugagugccccuaagagaauaaugacuuccaggcagcaggaugagggucuuaaagcccacacccacaauaacacaucuacuccaacaggaccacaccuccuaauagugccacuccuugggccaagcauauacaaaccaucacuaguaguaguguggcucagcagguaaaggcacuugccaccaaaccuaauggccucucucagugcaaccccuuuggcucacgugguggagggagguggggagcaaguugugaauugauucccaaaaguuguccucucaccuucauuucacacacacacacacacacacacacacacacacacacacagagagagagagagagagagagagagagagagagagagagagagagaaagagagagagagagagaaagguaggggagggagaaaaucauacacagaguaaauaaaugugauuuuacaaagauuuuaagcuuuaaauauacauuguuuuguccuaaaaauuuuuugguuauaaaugcuugcuggaaaaguauuuuuaauauuccacaaugccaaauauaggacagauaagucaaauacuuuggguaaaagaacuguuguuucuccuuccaguugugcauguggauucuucucacacggaguacacgcuguccucucugaguagugauacguuguacaugguccgaauggccgcguacacagaugaaggugggaaagaugggccggaauucacuuuuacaacaccaaaguucgguaagaaaucaggcagcuuuauguuggaaguuuaauuugauuagaaauggauuugcugcgcuaaccugcuguuuucaaguacccuggggauggaggcagcucagaggcagagcacuuaccagcaucaaagcuggcuugagccucagcuuggcuagccggcuaaugggguguguacuguaggguauggagggacgcuugcuuauccgguacagguugcugauguaugugagcucuucgccuuuuggcuccugcuuaccuugguggcugauucaccugcacaucagaucccagagccuaugaccucccuucauggguuccugguuuuucagaguggauuguguaggucuccaucuuugacagguugcuugagaaacuagucugacucauucacuuugcugcugaaaucaguuccuggcccuaccacuccugaggacgcugcccagcguacagauguacauggugacuguucacugagaaagacaggccaagguggagggagccuuggccuagccagugcuggaaccgagcuucaccuucuugcuacucuucagcauaaggugugcuggcccgcuggggcccagggcuuacagcccugccugcguucuccugcucgcaguguuguacuuuuacaugucuggauucugcagagcucucacucucugcccagucgugucuuucuaagggcacagucaucauugacaucauuuacacaagacggccaucuugguggcggcucuguagccucucugacaacuuauuguacaugcuuuuuugaaucauuauagauuuuuuuuaacuuaauugaaacuauuuguaauuccccaaaugcaccaggauuuuguucuauaguauuguccauguucauuguugaauguaaacauaauauaagaaugcaauuucagggcuagagagauggcucagcgguuaagggcacugacuacucucccagagguccugaguuccauucccagcaaccacaugguggcucacaaccauuuguaaugggaucugaugcucucuucaggugugucugaagacagcaacaguauacucauacauuaaaugaauaaauaaaucuuuuuuguuguuuguuuguuuguuuuguuuuucaagacagaguuucucuguauagcccuggcuguccuggaacucacucuguagaccagacucaguaggccucagacucuguaggccucgaacucagaaaucugccugccucugccucccaagugcugggaucaaaggagugcgccaccacgccuggcaaaucuuuuuuuaaaaaaagaaugugauuacauaaaauccuuaucuuuccuacaagggaaaaucaauguacuuucuggaacaagagcccacgugaugacaugcuaauagaucuguaacaguuaauacuuagagcaaucacugcaaaaagauaguaaaacuuuagaaguguuuuccuaguuauaaaaguccuauguacuguaggacacucuuauaauauauuguaaaggagaauguaaauuuguucaaauuccauacucaaauaugaucuagcaauaucucuuugucuguuuacauguuuuaaaaugggucaguaauacuaaaacuacuuuacaauuugacuuguuacuguuguuguuguuguuaccuaugugcgguuuccauucuagcuuccucauguggcaugggagucuugccccaaagacuuagcucaguugaagaaauaccacgaaaaguaaauacacuaauuuaaucaguaaacagugcaagucuacagccauuggcagaggccgccucgccuuuaaagaaggcuuuggacgagagaaagcugcgguuacuguggcacguaggacagaagucaucucagagagcacgcuuugguuuucuguuuucucucccugccaguguuucuuauggucauuauacaccgaggcuugcaguguaaggacaaaucucugggauuaacccaaggacugagaggaagaaaaguaccucagaaccugagagccaccaggguggcaaagggaacguguacuuugucaguagugugcagcgcaggcacuuggaaacagacaggagccugacugggcuccacagugaggccgagccugcugggugcauugcaggacacugucuacagaaacaagaaaaucaggugcuagccagugaggacugcaaugcuuuuuccucucuuucuauggacuaacaguuauuucuuauuauacccuuugguuguuuuagcucaaggagaaauagaagccauagucgugccugugugcuuagccuuccuccugacaacccugcugggcgucuuguucugcuuuaacaaacgagaccuguaaguugcaccuuccauggugguauucagcuguuguuacagccgagcucugguugugcccagugcuugcccacgaccccacacucacccccacuucuaccaaagcacccuuguuugguuuuaguccguccuaucucaccucugccugagcacagguguagcuuugucugaucuggaauuucacacucauggagucagguggcuugcagacccgucacacuuagcaaugucggagcucaguccugcuguugcuuauguuaauuuuuccccuuugugcugcugaagcauggucugcaguguggguguauaaaagaguuuacggguuccuaauucuugcccguuguuuuauaaaacagcugugaauauccacguuccacaugcuauggguacauguucucauggcucucagauaaucauguuaauuuuaucagaagccacuagaaacaggccuguagcuccgggucagcauucauaugacuugugcagggcucuaggcuccauuuccagacccacaagcagaaagaaauagucccaggcuccuguguccccgccaucuugcaagugucccaccaucauuagcauuuggcauggaggcguuguacugagcaggagugcaggacccuguuuucauuuccguccugacaaccagucccuaucuucugaguugcccaacuuguuaucauuaucuauuuaagcccuuuguccagcuuuaaauuggagugguuuuucuuagggguuuuuuuuuuuuguuuguuuguuuguuugguuugguuugguuugguuuugguuuugguuuuuuuuuuuuuuuuuuuucuuuucuuucuugcuauuauugaguuguaaauguucuuuuuguuuggaaacaaacauuuuugucaaauacauguuuugcaaauuuugucccaguuucuguauuuuguuuccuuaaccaucacuuuggggaagcagaaguuuuuaauuuugaaguucccuuucccaggcuuuuccucugguucuuguauuuuguacccuguuuaagaaaucugucuaacccaggguucuguuuucuucuagaaguuuaguaaauuuagcucuagcaucuguaauucauucugaauuaauuuggggauaugauauaagucagaaucaaguuucugccccccaccaaccuauguugauguugaaaauaacuucuuuucaaauaaauguuugucccugauagucuguguuuacuuauaggcucucauuucuguucccuugaacugugugucuucuuuuuuaauuuuugguauuuugagauuggguuuuauauagcccauauuggcccuaaacagcuguucuugcggcuucugccuccugaguguugguuucagcaugaguguguuucugccucaccuggugcaucacucagcucugugacgucaucagucagcucugugacguccuguucuucuuugggaaaacacaaauuuaucuuauuuuacuuggugucaguuaguuaccacuuuuauguaauuuucagacugggaacucuggcuugaaaguuaaagucuuuguauuguuacgugcauucuacauaugccuugcuucuuuuccuuucagaauuaaaaaacacaucuggccuaauguuccugauccuuccaagagucauauugcccaguggucaccucacacccccccaaggguaagauacugucuucuuauuguuucugauagacaggcuaacuuacuaggauucauugauagaguuuaagcaaaagauauuuaggaugagugaaaagaaaauaggauuaacuggcaguugucaaaacauaagugaagcucuccauucuagcacaugucugucugucugucugucugucugucugucugucguaacauguuugugcaaacacuccucacacugcucagugcacacaacaaguacuuuugcugaaaauggaaacugaggaccggcuacacaugggucugugacuggauguuaaguccuggcuaaggucugccggccucaccccugcagaugaguucuggaaacuguacuagacucuucauacuuaacagacccuagaggagaaagccuucuuauuacucuaguaauuaauccuaaacuuaacaaauuauaccuguaaccucguauaguuuacaaaaccucauuuauucaaguuugaguuuuuaauauuuccaaggcuuuuucuuaucuguuuaauucuaggcugccuucuguagcuaugaaauauucaguacuauuuacagccugcuugcuuacaacaguauuaauuuggaaacuggaaaugcagcccgauccagacuucuugguuuauuuuauuuaugugcaguucaucugguuacagagacucugagaugggcgauucucgccccugaaagucacuaaaaagauucaaagaugcacuagccuuuaaaagucaaaagagcuguauuauggggcucagagagauggcucagugguuuaaaaagcugaaauaugccagagugauccuucauuuuucucuuuccagcacaauuuuaacuccaaagaucaaauguacucggacggcaauuucacugauguaagcguuguggaaauagaagcaaacaacaagaagccuuguccagaugaccugaaguccguggaccuguucaagaaggagaaagugaguacagaagggcacagcaguggcaucgggggcucuucaugcauguccuccuccaggcccagcaucuccagcaacgaggagaaugagucugcucagagcaccgccagcacggugcaguacuccacuguggugcacagcggcuacaggcaccaggucccguccgugcaaguguucucaagguccgaguccacccagccccugcuagacucggaggagcggccagaagaccugcagcugguggauaguguagacgguggggaugagaucuugcccaggcaaccguauuucaagcagaacugcagucagccugaagccuguccagagauuucacauuuugaaaggucaaaccagguuuuguccggcaaugaggaggauuuugucagacugaagcagcagcagguuucagaucacauuucucagcccuauggauccgagcaacggaggcuguuucaggaaggcucuacagcggaugcucuuggcacgggggcugauggacagauggagagauuugaaucuguuggaauggagaccacaauugaugaagaaauucccaaaaguuacuugccacagacuguaagacaagguggcuacaugccgcagugaaggacuggcuccugaacuucagcaggaacugcaaaauaaagcuaaagacgaguggcuucagaugagaaacaguccucacucccugaagauaggcauugccucuaaggacaaagucacaccugggccgucuccauuccagaguagcuggaauucuccuucaagcacuacaugaacugacuuuauccucuauagcuggaggacucugugcucuuucagaauguuugcacugccgaaaacaaagugugucugaguuuauaaagcuguugguuugcuacauagaaaacgggggauuuaaaugagccacaaugucauggcaucguucagcugggcugguuuugaugagacugaccauccagaugccagcgagaaggccagcagcaucauuuaaaagugcccuguggcacaguguccagauuaugucaucuagaagacgaaagaauggagggguggcucguuucugggucugucagagaagcauggccugcuccuugcuguugguaucgaugccgguuacuacugaggaagaggauaaacuuuaaagagaagcaacauagaagcacccgcuuucuuauagucaccuacagccucccaagaaacugcuuauuauugaaaaugucuuuccgagucaauuucauccacccuauaguggaccaggcuggccucaaacucagagaucugucugccucugccucugccucugccuccagaguaccgggaugaaaggcagugcaccaccacugcuccacuuacgaagauugcuguuuuuaaagacuuaaguuguugacauuuuucugaacacacauaaccacaccagggacagaugauucuagagacugguugaggaagcacuuuauccagaaugucuucaacuuuaaauuacuuuaauugacuccaccuuguuuugauuuucaagaauagcaggguguuuguugaaggguggcauuucccagagccucaugcagucccagaacacacaucccaaccaugucagcgaccaccacaaugacagaaguccuccuacagagcugaggaagcuggaaggguccugcuaguuugcagggugggcuuugaacccacagcccugugcaugcuagacauucacucuaccgcugagcugcuccuccgcccggcucauuaugucaucuaggcucucgugauccuccuggcccagcuuccugacugucugggacuguggaugugugcugucacacacccaaccaggucuuuuuaauaucugccauuuaugagguagaguuuuuacacgacuuaggacuaucuuaaaccuauuccuucuaguugcuuuauuaaggaauagccuaggcauccaguguuuagcacuaaagccauuaauguauuugugccuaacuucccagugugacauggaggugggggcuaaagguagacacugggcagacaggaauuggcugagcgccguuagaggcugaucacuaagugugcucacaggaaaaggguugaaguuucagagcaugggcacccagaucauuuauagcgguuaccacacagugccuaggaggaguugauaugcacuuaguuggaugcaguuucaccuuuuacucucagaagguuguuuauauucuacuugcugauguguuaucauuuauauuuuuauacuggguaguccuuuucuguguucuuucacauguauaauccucgugagacuguacaugcuuugcucugguauauucaguugccuccuuggcaaaaccagccuggaauugccaaaaugccggaagugaagggagauggugaaagucgggcacaggaaggccaggucaggggcagagagaccagaauucacacuacaaggcuggcaccauugccauucaaguuggacgucaaagccugaucccaguuaggacugaguuuucuauguauauaucugccaggaaguuaacacuugcugaauuucucaucuucucacaguaagcagucuaguuaugggacucuauccauguucagcugugacuucccucauaucagacaguggugcugugaacguugcagugugaagucuguacuggcuagggaugguagcccagcgugaguucaggcaugaacauagaggccacugaaggaagagccuccuggaagcaaguuggcacguuaaaucccagacagaaagugucccagggagccagggccuccgccagcagggagggggugugcucacugcaggaacguucauuuagaagauguaccauggagcaccucccuuugcucuaagagaaaacccaucuuaaaguucaucuugaauacagacuucgcucgagcauguuuuagaauaaucuggaugcuguaccuuguaccuuagguagcagagaaaguaaucuggcgucuuucuguaaaaccgucuaauaaagcuaguucugcccgugggcucguauucuuucguguguaaaaauguaguguaaggcgcaccagagagcagccuggcuuguggccagggcuaguccacugcuucccaugcaguugccucucgaggacucaaagaaaaaggaagguuuaaugcugagucgccguuacaaaaccuagcguucccaucuuuuccucacucaaacauaaaaucucaguccuuugaaaagcaugagucacuacucgggggcacagagaagcagaaguaggaaaagugcagccccugccccccucguucucccgccuucagaucauuccaucucugcacaguucugcuguggucaucagcucggccaggauggacgguuucggggggguuuuguuuguuuguuuuugcuuguuuggguuuguuuuguuuuguuuuucuguuugugguauuuugguuuuuuaagacaggauuuuuccguguugccuuggcuguccuggauccgccugccugcugugccaccacugucuggugagacuguaguucuuauugugaacuuaaaggguuaaagagguagaaggauuuacuggacuguaguuuuugauuuuuuuuuuccucaacccuaauuguaauaaugguucuuaaaugcuuuagccucccuuguagcccaccacccaccagagguaguggaaaagaaaggaugugggggaaguggaccuguuuaaaaaaugguucuuuggagcaacuccugugugcacugucagaaaaucagcuguucaguugacaggucagcaguggcagcuccauccacucgcaaacaugucaaggcuacaccagcaguccaggucgguaguagugucaggauagcagcagcaguggcauaacuagcaggaauggccaggccucggccucagcacaagucaagcaggaagaacucgaaguucucagcugugccucucagugaaacgaagauauguaaggccaucaccauccguugaguccuguauauacucccuccaaauaucaaguguccucgggccugggcucaccucgggucuugugugugagucuguaucagcugacaucacucugccaaucagcccgcgucugcggaagcugcaagccaccagaaccacaucagaaguuuuuaguguuucucucuauggaggcccaacagauggaguucaacaacacuugaggcauguagugaacaaagaacccaucaccugcccguucacaugcauuagcaaagcauccuuucacccguguccacuucagcgaaacguuccuucucgugucugcuuuagcaaaacauccaacacagcugacuuuccaaagaacacuuacguuuccacuucaugggacacuaucaaagcuguuaaaaguaggacugcuaauuagacaucacauacuauuuuuaaagcugucucuuuuuuucuacucacauaauuaguaaauuauggcauaaauuuagaccuaguaaucauaggaugccucauuguuauagacauauauuaaccaaguagaacaagccaguagacuuuagccuauuacguucauucuucuguuucaugucccugaguuucuuuuaaaagcaaguuuuuaacacaacuucugucuaguaaaguuuuuaaugagauaaguagaaucaauaagcugcaaaaaaaaaaguaaauaaaaaguaaaggucaauuauuaaaaauaaccucuugggcuagcuuucggcuauagguacugcugguagguuacuuugcccagguaagauugcauuuuucaaaugugccuuucgaugaguuagaacacagccaucaaauggcaaacgguauaaguaguucauagacaaaaguuuguuuuccugucacaugcagauuagcauaugcucacucaguuaacgaggaaaaggugauggcaggcuccagauguuacucggucuaacucuuagggcuuuuugccaccuguaagcucccacaaacuggucaguuuugguuuuguuguuguuguuguuguuguuguuguuguuuuccuuuuacuuaaccaguugucaaugcuggugagggaggguugggauggaaauguaccaggcugguuggguaggaauucuuaguccugugauugcucgcuuagucugguugcugcagacugcaagugcugcuacguaagcaggacaaugugacgugccagaaagaaagggauguuggagggguuggaagcucuguagccuuaaugcuugugugugauagacuuuaaagcaaaugcacuuugcuagccuggcgcggcaguaggcauuaggcauggcuucuuacaccuuugcucuuagcuguacucca

SEQ ID NO: 7231 - RNA, 45063 nt, Mus musculus
uggaguacagcuaagagcaaagguguaagaagccaugccuaaugccuacugccgcgccaggcuagcaaagugcauuugcuuuaaagucuaucacacacaagcauuaaggcuacagagcuuccaaccccuccaacaucccuuucuuucuggcacgucacauuguccugcuuacguagcagcacuugcagucugcagcaaccagacuaagcgagcaaucacaggacuaagaauuccuacccaaccagccugguacauuuccaucccaacccucccucaccagcauugacaacugguuaaguaaaaggaaaacaacaacaacaacaacaacaacaacaacaaaaccaaaacugaccaguuugugggagcuuacagguggcaaaaagcccuaagaguuagaccgaguaacaucuggagccugccaucaccuuuuccucguuaacugagugagcauaugcuaaucugcaugugacaggaaaacaaacuuuugucuaugaacuacuuauaccguuugccauuugauggcuguguucuaacucaucgaaaggcacauuugaaaaaugcaaucuuaccugggcaaaguaaccuaccagcaguaccuauagccgaaagcuagcccaagagguuauuuuuaauaauugaccuuuacuuuuuauuuacuuuuuuuuuugcagcuuauugauucuacuuaucucauuaaaaacuuuacuagacagaaguuguguuaaaaacuugcuuuuaaaagaaacucagggacaugaaacagaagaaugaacguaauaggcuaaagucuacuggcuuguucuacuugguuaauauaugucuauaacaaugaggcauccuaugauuacuaggucuaaauuuaugccauaauuuacuaauuaugugaguagaaaaaaagagacagcuuuaaaaauaguaugugaugucuaauuagcaguccuacuuuuaacagcuuugauagugucccaugaaguggaaacguaaguguucuuuggaaagucagcuguguuggauguuuugcuaaagcagacacgagaaggaacguuucgcugaaguggacacgggugaaaggaugcuuugcuaaugcaugugaacgggcaggugauggguucuuuguucacuacaugccucaaguguuguugaacuccaucuguugggccuccauagagagaaacacuaaaaacuucugaugugguucugguggcuugcagcuuccgcagacgcgggcugauuggcagagugaugucagcugauacagacucacacacaagacccgaggugagcccaggcccgaggacacuugauauuuggagggaguauauacaggacucaacggauggugauggccuuacauaucuucguuucacugagaggcacagcugagaacuucgaguucuuccugcuugacuugugcugaggccgaggccuggccauuccugcuaguuaugccacugcugcugcuauccugacacuacuaccgaccuggacugcugguguagccuugacauguuugcgaguggauggagcugccacugcugaccugucaacugaacagcugauuuucugacagugcacacaggaguugcuccaaagaaccauuuuuuaaacagguccacuucccccacauccuuucuuuuccacuaccucugguggguggugggcuacaagggaggcuaaagcauuuaagaaccauuauuacaauuaggguugaggaaaaaaaaaaucaaaaacuacaguccaguaaauccuucuaccucuuuaacccuuuaaguucacaauaagaacuacagucucaccagacagugguggcacagcaggcaggcggauccaggacagccaaggcaacacggaaaaauccugucuuaaaaaaccaaaauaccacaaacagaaaaacaaaacaaaacaaacccaaacaagcaaaaacaaacaaacaaaacccccccgaaaccguccauccuggccgagcugaugaccacagcagaacugugcagagauggaaugaucugaaggcgggagaacgaggggggcaggggcugcacuuuuccuacuucugcuucucugugcccccgaguagugacucaugcuuuucaaaggacugagauuuuauguuugagugaggaaaagaugggaacgcuagguuuuguaacggcgacucagcauuaaaccuuccuuuuucuuugaguccucgagaggcaacugcaugggaagcaguggacuagcccuggccacaagccaggcugcucucuggugcgccuuacacuacauuuuuacacacgaaagaauacgagcccacgggcagaacuagcuuuauuagacgguuuuacagaaagacgccagauuacuuucucugcuaccuaagguacaagguacagcauccagauuauucuaaaacaugcucgagcgaagucuguauucaagaugaacuuuaagauggguuuucucuuagagcaaagggaggugcuccaugguacaucuucuaaaugaacguuccugcagugagcacacccccucccugcuggcggaggcccuggcucccugggacacuuucugucugggauuuaacgugccaacuugcuuccaggaggcucuuccuucaguggccucuauguucaugccugaacucacgcugggcuaccaucccuagccaguacagacuucacacugcaacguucacagcaccacugucugauaugagggaagucacagcugaacauggauagagucccauaacuagacugcuuacugugagaagaugagaaauucagcaaguguuaacuuccuggcagauauauacauagaaaacucaguccuaacugggaucaggcuuugacguccaacuugaauggcaauggugccagccuuguagugugaauucuggucucucugccccugaccuggccuuccugugcccgacuuucaccaucucccuucacuuccggcauuuuggcaauuccaggcugguuuugccaaggaggcaacugaauauaccagagcaaagcauguacagucucacgaggauuauacaugugaaagaacacagaaaaggacuacccaguauaaaaauauaaaugauaacacaucagcaaguagaauauaaacaaccuucugagaguaaaaggugaaacugcauccaacuaagugcauaucaacuccuccuaggcacugugugguaaccgcuauaaaugaucugggugcccaugcucugaaacuucaacccuuuuccugugagcacacuuagugaucagccucuaacggcgcucagccaauuccugucugcccagugucuaccuuuagcccccaccuccaugucacacugggaaguuaggcacaaauacauuaauggcuuuagugcuaaacacuggaugccuaggcuauuccuuaauaaagcaacuagaaggaauagguuuaagauaguccuaagucguguaaaaacucuaccucauaaauggcagauauuaaaaagaccugguugggugugugacagcacacauccacagucccagacagucaggaagcugggccaggaggaucacgagagccuagaugacauaaugagccgggcggaggagcagcucagcgguagagugaaugucuagcaugcacagggcuguggguucaaagcccacccugcaaacuagcaggacccuuccagcuuccucagcucuguaggaggacuucugucauugugguggucgcugacaugguugggauguguguucugggacugcaugaggcucugggaaaugccacccuucaacaaacacccugcuauucuugaaaaucaaaacaagguggagucaauuaaaguaauuuaaaguugaagacauucuggauaaagugcuuccucaaccagucucuagaaucaucugucccuggugugguuauguguguucagaaaaaugucaacaacuuaagucuuuaaaaacagcaaucuucguaaguggagcagugguggugcacugccuuucaucccgguacucuggaggcagaggcagaggcagaggcagacagaucucugaguuugaggccagccugguccacuauaggguggaugaaauugacucggaaagacauuuucaauaauaagcaguuucuugggaggcuguaggugacuauaagaaagcgggugcuucuauguugcuucucuuuaaaguuuauccucuuccucaguaguaaccggcaucgauaccaacagcaaggagcaggccaugcuucucugacagacccagaaacgagccaccccuccauucuuucgucuucuagaugacauaaucuggacacugugccacagggcacuuuuaaaugaugcugcuggccuucucgcuggcaucuggauggucagucucaucaaaaccagcccagcugaacgaugccaugacauuguggcucauuuaaaucccccguuuucuauguagcaaaccaacagcuuuauaaacucagacacacuuuguuuucggcagugcaaacauucugaaagagcacagaguccuccagcuauagaggauaaagucaguucauguagugcuugaaggagaauuccagcuacucuggaauggagacggcccaggugugacuuuguccuuagaggcaaugccuaucuucagggagugaggacuguuucucaucugaagccacucgucuuuagcuuuauuuugcaguuccugcugaaguucaggagccaguccuucacugcggcauguagccaccuugucuuacagucuguggcaaguaacuuuugggaauuucuucaucaauuguggucuccauuccaacagauucaaaucucuccaucuguccaucagcccccgugccaagagcauccgcuguagagccuuccugaaacagccuccguugcucggauccauagggcugagaaaugugaucugaaaccugcugcugcuucagucugacaaaauccuccucauugccggacaaaaccugguuugaccuuucaaaaugugaaaucucuggacaggcuucaggcugacugcaguucugcuugaaauacgguugccugggcaagaucucauccccaccgucuacacuauccaccagcugcaggucuucuggccgcuccuccgagucuagcaggggcuggguggacucggaccuugagaacacuugcacggacgggaccuggugccuguagccgcugugcaccacaguggaguacugcaccgugcuggcggugcucugagcagacucauucuccucguugcuggagaugcugggccuggaggaggacaugcaugaagagcccccgaugccacugcugugcccuucuguacucacuuucuccuucuugaacagguccacggacuucaggucaucuggacaaggcuucuuguuguuugcuucuauuuccacaacgcuuacaucagugaaauugccguccgaguacauuugaucuuuggaguuaaaauugugcuggaaagagaaaaaugaaggaucacucuggcauauuucagcuuuuuaaaccacugagccaucucucugagccccauaauacagcucuuuugacuuuuaaaggcuagugcaucuuugaaucuuuuuagugacuuucaggggcgagaaucgcccaucucagagucucuguaaccagaugaacugcacauaaauaaaauaaaccaagaagucuggaucgggcugcauuuccaguuuccaaauuaauacuguuguaagcaagcaggcuguaaauaguacugaauauuucauagcuacagaaggcagccuagaauuaaacagauaagaaaaagccuuggaaauauuaaaaacucaaacuugaauaaaugagguuuuguaaacuauacgagguuacagguauaauuuguuaaguuuaggauuaauuacuagaguaauaagaaggcuuucuccucuagggucuguuaaguaugaagagucuaguacaguuuccagaacucaucugcaggggugaggccggcagaccuuagccaggacuuaacauccagucacagacccauguguagccgguccucaguuuccauuuucagcaaaaguacuuguugugugcacugagcagugugaggaguguuugcacaaacauguuacgacagacagacagacagacagacagacagacagacaugugcuagaauggagagcuucacuuauguuuugacaacugccaguuaauccuauuuucuuuucacucauccuaaauaucuuuugcuuaaacucuaucaaugaauccuaguaaguuagccugucuaucagaaacaauaagaagacaguaucuuacccuugggggggugugaggugaccacugggcaauaugacucuuggaaggaucaggaacauuaggccagauguguuuuuuaauucugaaaggaaaagaagcaaggcauauguagaaugcacguaacaauacaaagacuuuaacuuucaagccagaguucccagucugaaaauuacauaaaagugguaacuaacugacaccaaguaaaauaagauaaauuuguguuuucccaaagaagaacaggacgucacagagcugacugaugacgucacagagcugagugaugcaccaggugaggcagaaacacacucaugcugaaaccaacacucaggaggcagaagccgcaagaacagcuguuuagggccaauaugggcuauauaaaacccaaucucaaaauaccaaaaauuaaaaaagaagacacacaguucaagggaacagaaaugagagccuauaaguaaacacagacuaucagggacaaacauuuauuugaaaagaaguuauuuucaacaucaacauagguugguggggggcagaaacuugauucugacuuauaucauauccccaaauuaauucagaaugaauuacagaugcuagagcuaaauuuacuaaacuucuagaagaaaacagaacccuggguuagacagauuucuuaaacaggguacaaaauacaagaaccagaggaaaagccugggaaagggaacuucaaaauuaaaaacuucugcuuccccaaagugaugguuaaggaaacaaaauacagaaacugggacaaaauuugcaaaacauguauuugacaaaaauguuuguuuccaaacaaaaagaacauuuacaacucaauaauagcaagaaagaaaagaaaaaaaaaaaaaaaaaaaaccaaaaccaaaaccaaaccaaaccaaaccaaacaaacaaacaaacaaaaaaaaaaaaccccuaagaaaaaccacuccaauuuaaagcuggacaaagggcuuaaauagauaaugauaacaaguugggcaacucagaagauagggacugguugucaggacggaaaugaaaacaggguccugcacuccugcucaguacaacgccuccaugccaaaugcuaaugauggugggacacuugcaagauggcggggacacaggagccugggacuauuucuuucugcuugugggucuggaaauggagccuagagcccugcacaagucauaugaaugcugacccggagcuacaggccuguuucuaguggcuucugauaaaauuaacaugauuaucugagagccaugagaacauguacccauagcauguggaacguggauauucacagcuguuuuauaaaacaacgggcaagaauuaggaacccguaaacucuuuuauacacccacacugcagaccaugcuucagcagcacaaaggggaaaaauuaacauaagcaacagcaggacugagcuccgacauugcuaagugugacgggucugcaagccaccugacuccaugagugugaaauuccagaucagacaaagcuacaccugugcucaggcagaggugagauaggacggacuaaaaccaaacaagggugcuuugguagaagugggggugaguguggggucgugggcaagcacugggcacaaccagagcucggcuguaacaacagcugaauaccaccauggaaggugcaacuuacaggucucguuuguuaaagcagaacaagacgcccagcaggguugucaggaggaaggcuaagcacacaggcacgacuauggcuucuauuucuccuugagcuaaaacaaccaaaggguauaauaagaaauaacuguuaguccauagaaagagaggaaaaagcauugcaguccucacuggcuagcaccugauuuucuuguuucuguagacaguguccugcaaugcacccagcaggcucggccucacuguggagcccagucaggcuccugucuguuuccaagugccugcgcugcacacuacugacaaaguacacguucccuuugccacccugguggcucucagguucugagguacuuuucuuccucucaguccuuggguuaaucccagagauuuguccuuacacugcaagccucgguguauaaugaccauaagaaacacuggcagggagagaaaacagaaaaccaaagcgugcucucugagaugacuucuguccuacgugccacaguaaccgcagcuuucucucguccaaagccuucuuuaaaggcgaggcggccucugccaauggcuguagacuugcacuguuuacugauuaaauuaguguauuuacuuuucgugguauuucuucaacugagcuaagucuuuggggcaagacucccaugccacaugaggaagcuagaauggaaaccgcacauagguaacaacaacaacaacaguaacaagucaaauuguaaaguaguuuuaguauuacugacccauuuuaaaacauguaaacagacaaagagauauugcuagaucauauuugaguauggaauuugaacaaauuuacauucuccuuuacaauauauuauaagaguguccuacaguacauaggacuuuuauaacuaggaaaacacuucuaaaguuuuacuaucuuuuugcagugauugcucuaaguauuaacuguuacagaucuauuagcaugucaucacgugggcucuuguuccagaaaguacauugauuuucccuuguaggaaagauaaggauuuuauguaaucacauucuuuuuuuaaaaaaagauuugccaggcgugguggcgcacuccuuugaucccagcacuugggaggcagaggcaggcagauuucugaguucgaggccuacagagucugaggccuacugagucuggucuacagagugaguuccaggacagccagggcuauacagagaaacucugucuugaaaaacaaaacaaacaaacaaacaacaaaaaagauuuauuuauucauuuaauguaugaguauacuguugcugucuucagacacaccugaagagagcaucagaucccauuacaaaugguugugagccaccaugugguugcugggaauggaacucaggaccucugggagaguagucagugcccuuaaccgcugagccaucucucuagcccugaaauugcauucuuauauuauguuuacauucaacaaugaacauggacaauacuauagaacaaaauccuggugcauuuggggaauuacaaauaguuucaauuaaguuaaaaaaaaucuauaaugauucaaaaaagcauguacaauaaguugucagagaggcuacagagccgccaccaagauggccgucuuguguaaaugaugucaaugaugacugugcccuuagaaagacacgacugggcagagagugagagcucugcagaauccagacauguaaaaguacaacacugcgagcaggagaacgcaggcagggcuguaagcccugggccccagcgggccagcacaccuuaugcugaagaguagcaagaaggugaagcucgguuccagcacuggcuaggccaaggcucccuccaccuuggccugucuuucucagugaacagucaccauguacaucuguacgcugggcagcguccucaggagugguagggccaggaacugauuucagcagcaaagugaaugagucagacuaguuucucaagcaaccugucaaagauggagaccuacacaauccacucugaaaaaccaggaacccaugaagggaggucauaggcucugggaucugaugugcaggugaaucagccaccaagguaagcaggagccaaaaggcgaagagcucacauacaucagcaaccuguaccggauaagcaagcgucccuccauacccuacaguacacaccccauuagccggcuagccaagcugaggcucaagccagcuuugaugcugguaagugcucugccucugagcugccuccauccccaggguacuugaaaacagcagguuagcgcagcaaauccauuucuaaucaaauuaaacuuccaacauaaagcugccugauuucuuaccgaacuuugguguuguaaaagugaauuccggcccaucuuucccaccuucaucuguguacgcggccauucggaccauguacaacguaucacuacucagagaggacagcguguacuccgugugagaagaauccacaugcacaacuggaaggagaaacaacaguucuuuuacccaaaguauuugacuuaucuguccuauauuuggcauuguggaauauuaaaaauacuuuuccagcaagcauuuauaaccaaaaaauuuuuaggacaaaacaauguauauuuaaagcuuaaaaucuuuguaaaaucacauuuauuuacucuguguaugauuuucucccuccccuaccuuucucucucucucucucuuucucucucucucucucucucucucucucucucucucucucucucucugugugugugugugugugugugugugugugugugugugugaaaugaaggugagaggacaacuuuugggaaucaauucacaacuugcuccccaccucccuccaccacgugagccaaagggguugcacugagagaggccauuagguuugguggcaagugccuuuaccugcugagccacacuacuacuagugaugguuuguauaugcuuggcccaaggaguggcacuauuaggaggugugguccuguuggaguagauguguuauugugggugugggcuuuaagacccucauccugcugccuggaagucauuauucucuuaggggcacucagaugagaauuuagaacucucagcuccuccugcaccaugccugccuggaugcugcccugcucccaccggucauggugucuguucacagcaguaaaaccuaaguaaaacuaagacaccuacaauacaauauuuuuaaaaaaauagcgucauaaacauaugagaccuuugcagaaaucugcuaaggaugcuauguacuaucaaacacauuaugugagagacaaguauuuaaaaacuuaagaaaaagcuuuaguaacauauucuugguaguugcuacaauuuuauuacccaucuccuuucccacgcugguucuguaagauauggaguaguuucuaaugaagccauucuggucguccacaggaaucuggucccacgcuaagacagcuucauuuuuccccacuuucuuuguccgaacagucgguccucuggcaggagcuguaagagagucagugcguuugcgaacugagaagugugugcuuaggaaucaacacuagucaguaaggguccucauggcagaauuauugaacuaaugaggaugcuuuuuuguugguuuugucuucaagacaaggguuucucuguguaacccuggcucuucuggaaugcacucuguagaccaggcuggaacucacagagauccaccuguaacugcaacccagcccugggauuaaaggcaucugccaccacugcacauagaggauucuuauuucaaagugauaaaauguuuuaggaaauguuaagagcauuuuccaugcaagcaaggguggaccuaccggcuuguuugagguacgccuucaaggacucagagccuccgggccccguggcgaauacgggaguuacugugauuugauagcacuugcucuccaggaggcguccuacaacaagaacagcagagaaagcaguucccucaggcgagauuuuuaccuuauuauuauaugaccauuugguuuuacuuucuucuaaacacugcaauuuuauauguaaaggaaucuuuuauacaccaacauaaauuuacuauaguaaaauguuggcuguguaauccuaucauuuggacagcugaagugggaggaacacaaugaccuggaagcuagucugggcuacacccugaguucaaggcuauccaggugacaaaaaacaccaggcuacuuuuagugucaguacagugaaccagaaaguauaaaaaguguuuauauugcuaauaaaaauagugaaugcuuuuauguuccggauuaauaaaacacuucagauuauucuuggacagcuuugcuauuuguggugguuugaaagaaaauggcccccacagacccauagagaguggcacuauuagaaggcguggccuuguuggaggcagugugucaccgugggagcaggcuuugaggucucauauguucgagccaugcugagugugggacucagucucuuccugcugccugcagacugagauguugaacacucagcuccuccugcaccaggccugccugcauccuccacgaugacaauggacugaaccucugaaccuggaagccagccccaacuaaauguuuccucucuaagaguugccucgaucauggugucucucacagcaguggaaacccuaggccaguauuuuagcuaauuuguggccugccaagguccaacagugagaucaagggcggagcacuaaugcacagcugugucggugagagcagcugggaaaaaaaaaugaguuaggcugcuucccgcucaauucuaaaagaaaaaaaucuuaaauaugguacuuucuuuauuucuaauccuuccaaauuaucaaagacauuuaucacacaacugaagcaugguuuaggaaaguggucuuuuauaagauauauauccuauguaccuacaaggucauucuuacucuguauauaccuucuccaggaaucuauuuccuucacuacauucauaacauuagaugcaccuuugucuuccuaaaaagagcaauuuuaccuuuucuugaucucuaugauaaaaaaguaagccauucuaaauucugcucuaauaaugacucuugcggggcacugagccuugagaccuuugucucugagagcugaccauaccucguaggcugccugccccggccccaggauuuuuaucugcuaaggucaauaaaggagacaucuaagcuuaucaagauuggacagcagcucggcaagagcucucuacccacagccaacccuagugauuccccuucucuaugaauuaaacaacauacauggagcagugcuuuguuuucuuaaaugcuauuguacgacuuuacagccaugcaguguagcaccauuagcagcuauuaucgccacucuguguuagaaccuggaacacaggaggaaccugugcucuggcugggcugccagcacucaacagcccugugaaguuaaacucgggaacuaauuuacaucuggguaacgagacaguuaacugaguugagcacaaguaacaaacaacuaacugguaguuaaggcugaacuagauucucuguacaguucuguaaggguccuuuuguuaauaaaguuaauaccaggguuuuuauuuguaguuuagucuuuuagaaaaguacuggcccuucucuccauacagagagcccgugguucagagauacuaagcguuaaagcguaacuugcaaagucacacgucuagucacagugaggcuucgagucuuuucagugacucacaauaacccagacaacagaagacagagacaaacagccugggacggacacugucuccugggggcagacgaacaccgucuacuuaagcgcuuaguagguguaccucucaaguggguccgauucacgguagcgucuuccugcugccagucuucaacacagggugcguucucugacaacacacaccacucuaagauguacuugcucacggguuuagguggagguguccauuccacccagagcagguuaucuuuuggaaaugcuuuaagauucacuacagaauaagcagcuuuaaaaaaaaaguaauguggauaaaaaucagucaacacugacaaaucugauaucucaauauuuuacagucacagccaaagguuuuauguauuuaaguuuauaacugugucuuuguccuuaacagcuagauaaauuagauaaauaauauacguaugccacaugcaaagaaaauuccuagaaccuugaaagaguauuuaaaaaacaaauuaucaggaaguacuuaaagaaauuagcaaacuagcugcaaaguucaaacaaacugcacagggccaaggcgucuccugaggacugcagucaugacgucccugccagcagacagcagcuuaucuaccaucccaggacacuguccacccuuaacccuggcauccaugccaccgcuccaccuuagcaguacgcaccugugacgugggggcuggggauggugaggacagcugcagcugauuugcccaccuuguuucuugcugcuagagacgcgacauagcggucauuggugagauucacggucagcucugugccagugacuguguacguuugugagacggacuuugacugcguaagaaucacuucauaauccaagauuuucccauuggcuucagaaagaggcagugccuauaauaaacguuuaccaaaaauuauuucaugaaucuugaauaaucaacuuuucauguccacagauccugccaguaugucaaaccuguaaauauuuaauuggaaggaaaaggcaaacucguuuuuaaaaaaaaaaaaaaagauuuauuuuuauauuaauguuuuaccugcaagucuguuccuuguauugugugccugccuggaggucagaagaaagugcuagauccccacagacagcugcaggcugccaugugggugcuaagaaccaaaccuggauacucuggaagagcagccagggcucauaacagccgagcugccucuucaaucugagcucauucugaauuaaguacuacucgcuaagaaagaauaaaaacaaacaaauaaauaaaauaggaaaauaaagccucaacugaaccaggccugcaguguggucucugucucggcaaugcucugcaguguggccuagccucugucucggcaaugcucugcaagcugagcuguuggucucuaucauuugugucucagcaucuucuuuucuucucucuaucuuuacagugugagguacagguguggccucaccagcccacauucuacucucucuaagccucucuguuuccuagguggcucccuagcgaguucagagacauuuagaacagggucuuguuuuuauagagguuacccuucuaugaacugugccaaauccaaaaugacggauuagcugaguucauaaacuugguuggcuuuuucaguagcuaaauaaggcuuuguguuuuuauacacuaacauuacuaaaugucuggaggaaauaaugaugaauaaaacuuuaguguuaaaaaguuagacuuaaaauaccauuuaaguacauuuguaugagauaugaguauaaaucuuuuuaucuuucuuuuaccuuccauaugagccguacagaucuauauuccugcccaugggauggauuugucuuauaccagaaacuugguggucuggaugguccuaaagaaaacacaaccuucauaaaacaaagugcuuuuuaucuuaacagugcuguaaaauucugaaguaauucuuucuguucuuaaggaucuguggcccuucagucacacagcauuccucuuuacaagagcaggcccacagcaguacaauguacuauguacaacaaugacugucugucauuagucagggugacagcugagaauuuacaucagcaucucauacacacacacacacacacacacacacacacacacacucucauucauaaauaaauaaauaaauaaauagauaaauaaauaaaugaaugaaugaaacaaaacauaacaugggguuuugcuauguuacccacaguggauugggacuucuaggcucaaaugauucuccugccuuggcuuucugcaguugggacuacaggccugugccauggugcuugccuauagauuauaauuaaauucuuuagagauguauacuccuacaaauagacaaaaaaagcaccacucuguguguguguguguauucauguaguacaguggacaaggaagaacaaagucuuaaaaauaaaguuuuucuuccaacagugauaaaaaaauaaaaccgaguuauuuguauuacuuuuugcuaaagaugaaauuggaaauacacauguuggugugugucuacucucuagcgguauggucauacuauaaaaagacagcucugagcacgaggauccaaucacacgcacugauguagcagcccccacaaucugcauggcguguguucuaagaggccauguggacaccaggaacucugaagaguaaugaacauuucauauacacugcuuuuccugcaaacauugcccaugcuagaguuuaacuuguaaauuagguacaguaauaaacuaacaacaauggaugauauuaaauaauggauaauaauaaaaauauaaugaaguuacuuaaaacuuacagauuguuagguucuuuauuucugaaauuuuucauuuacuauuuugagauuguaaauaacuacaaacaaggccagcagagcugaagauaagacaugagcucuguaacugcaucaaagcauucuuccagggggaugguaagcauggggccucaucuuccagggggaugguaagcacggggccucagcaccuuaucacuggacauguggagguagaagguuaugaccagccauaacuacuuagugcauuugaaugugggcuacuggagagcccauuucaaacaacaaaacaaaauuucuauaaguucugacuuuccagagcuuuguuaagaauaccuacaaauauuguauuuacuaaaacaaacaguauuugaaugaaacccacacagcuuugugucgguugugagaaaguuacaaacgcagggagagaguaagcagacagacaggcuggcaggaagcuguuugcaaagcugcugguaccagacacugcgaucucacauacuguacuaccaugggacugcacucagauggaauaaaggauauagaaguacacaggaugugaaccagagccaccucuuaacacgagcagcaccuagaagcuucacacuguaggcuaaagacaugcuucaucuaauggcuuuuaagguggcucuagagagcgcugaaugcacacuuaaccacauuuugccuccguacugaggcgcuucaugaacuuguacaaauggacccauaaacuucugaaagccacuuuacgauuccccgucaacaauccuaacacuuggcacguggaggcagaaggaggcugagaguccaaggccagccugggucacaaaguacaacguccucauccuccccucccccacaaaaccaaaaugucccuccuuaagccaaaggagccaguuaauggacugcgcauucgcaaacuggccauaguaagacugcuuucuacagugcucaugggagcgagaaaagccuuacagaaggagggacacugcugccuuugacauuuuuaguucacugaccuaaaccucuagcaagaugguugaaggcauggggucuagaagcuaaggaaggcugcugcuaugagaccaugguaggaaaagguccaaagaggaguccacagcaaaagacugguugcugguggugcacaggagaucagaaaugcagcagcuuugggaggagucuaucuuuuccguauauauucauuuguauguguaugagugucuuaccugcguaugucuaugcacuauacauaugcaguacccauggaggucagaagagagcgucagauuugaauugaacuccaggccucggaagagcaagaucucuggcucacugagucaccucuccaaacccagagacccucuuuagaccccacaccauuuugagcuuuuauaauccacacuguauguguaauuauaauuucaucaaugaugaaaaaagcacuuacagcgaaccaacccgaaucccaggucagccuucccaagggcuuaucaaaugcuaguaccaaaaaauucuauaacauagacaguguuuuauuuuaguuuugagauaggcucucacucuguagccauggcuaggcuggaacuaaaacucacagagaucauccugccucugccuucucaaugcugggauuaaaggcgugcaccaccacagccggcucugacagugggauuuuaaugaguuaggauacaauucucuaguaaggggcaucuugggaccaccuuccuugaacaaagcuaagcgaauguuuuuuuaaaugacauuuaaaaauacuuuuccauuguacuauaguauaaccuauuuagguaccaaauacacuuauacuaucaauaauauauaucaagguuguuuugugaaauaauacaacaguacagcuuggcccaaaugaucacauguacagcagugagggcaacauaauccgcagccggccuucugccucccuggccuuccggccuuccacuucccucccccuccccccaccucaccacuuuuacguacugucuucguauguggucccacuagccuccucacuccagucacuccaguagcccuucccacuguccuuaauggaccggauccuaaacacauauucuguaaaaggcuugagguccugcacagugaaggaaguucgaggagacauuguaucuucaagagggaccugagaauaaagcauauugagugaugucaucgacaccuccgauagagaagguuccuaaagugaguacagaaaucaauuaguuuuagaaaucaacuuaaugcaagauuaauaaauucaaccacuggagaagaagacauggcaguaacaauaugacaaucuauaggccccacccaccuagucuuuccuucuaugagaccugcaauacucaggagucucaacgagaaagcgaugacucaugcuuguaguaucagacaagaggacugaacuacugaagauagagcaagcgacaaguucuaagccaggcaacacuaucugaaguugagagccugucuuaaagaaccagacccacccaacagcuaaacacaaauauguaaacaagcacacaaacaacaacaaaacacuucagaggcuuagugaaaagaaacaggcaagaauaaauguuggaaucccgaaugcuuagugcacuaggaacuguacuauacccgcuaacucuaugugcaaagggaaaaaaaaaaaaaagacucugggaggacagcguuaagagucaugaccuuacugcacagaagaaaauaaauguguuguucucaauucuauuccucuucuuucccaucaagcuccuucuguccaguagcucauggggugcaagacagaauggaagucuacaguggaaucagccaggccagcaaaccaugacaacaguguguagaaggaagggguguauauaaaugaggggacaagaaaauagaagcuagggacuggcgacauggcucagagaguacaccugagcuggacguacgccuggaacccacacagugggaagggaaaccugccuucuguaagcugugugacgucuacauacaugcugugauguguacacacaggaugaauaaaaguaacacuaaguguugagaggaagcaaagcagaagcuagccuaguccauggacuuguccuugaacugggaguggggaggaaaccaaagacacacacauaacuacuucuuucugccacucugacauuucaauacuagauacaaaacagauguuaaauuuggugcauuuuuuauuaaguuaagauucuaugauauuaaaauauacuuagaagaacuuuaaauacacauccucucuguacagucugagucaugaagccaauuuuguuuugcuuuuugugauuguauuaugagccgguaaacuagaggagcaucacaaaggagcacagaggcucugggcuaauugauaucucucuaggaucauaacugcaaccaugguaguaaaacaaaugaauggaccgaucaaucaacaaacacaaaagugggcuauuaguuauaaauggaauugcagcacaaaaucucacaggcagucaaugugguaccgcccaagacagcuccuccacugagagcaaggaccugccaccuccccuuccaggcuugcaauccccacuaaaacuuucuggacuuuaagaguuggcaaauccucuauuaagagcugggggccagaaaaucuguuacuccagcccccccccccaaagacaacaaacaaacgguuccagcaaaauccgccaagcugucugaacuaccugugcucaguuucacgcuuaaaacccccucuccaccugcacgcugauccugcauccuguucccaucacccugccucguuuccuaaaggccacuguucuaucugcuugucugucugucagaugaaauguuucacauuaagacauugagaaaacaggcaagucuucauauuagugcucaaaacaaacaaagcaagcaagcacacaaacgaaggcagcaacacuauuagcauaaacagcaacguucaauuuaccuggauccaaguugaggcaucuuugguccuauauuggaugucagacuuuagaucuaaaagaccgcccagcccugaacugacccaugauagcuuuaauauacuggauaauucuucugaguuggucacugauaaauuauauggugggguggguuucacugaagaauaaaauaaguccuaaaguuaguuaugccuuacuuuuauaguuccauauacaagucaaacacaugaugaucuguuuaauaagauugcucuuaccaaaggcaagcucucuagaauggugcuuugcccuaucauagaaagauucaacgaagcauuuccuagucugcucagcauauuuguuaauuuucagaugcugauauuaaaaaaugcugaaaugcuauagcaaguuacuuuuuaaaaagaaaauaaaaauaaaacaaggaagucacugugacugcaguggcaugcgguccugcaaauugaauaaugaaaggguaacauucuaaguggggaaggcaaguggaucagguucaaaguuaaccuuagacacacggccaauuuaaagccagucugggcugcgugagacaaacagcagugauaaaauauuccaaaaguaaacuaaacacagccaugaguauagcuaaacuacagcuauuuuucuguuuccacauuacauuuaauaacauuauaaaagacuuuauuaaaaaaaucacuguacuaauaaacauuucuacauuaaucaaaaucugaaaaauaguuuacaagucauagagaaguuugauaaagucucaaaucccggcuucuaaguaccuuuauccacggggucaaaauugauagacucugaggagaccuucccaagggcauucucugcuuccacccagacuucaauguugacauaauaggugggcauguagcugaccauacaugaagugccaugcuuugacuggcaaucaggaaacuucucuguugcccuaaguauaaaaguggaagaaccagccauuaaaaauagauugaaaauauaaaggugaaagggugacugggaaagguuggauaugacccagauuggugcacuguccuuugcaaugaaguguugcuaaccaaagacagaugacacaucugaaaaacuguauccgagcuacaccuaugauauuauuuccacauuuuuaaucuaagaaaacuucauuuuagaauuuuaugcuaugcccuuaauuauucucccccuaaaaaugaucuauuuccuuguggucuuagaauagcagccuuaacucagccauagaggcauguuucaggccggauagugguggcgcaugccuuuaaucccagcacuugggaggcagaggcaggcggauuucugaguuugaggccagccuggucuacagagugaguuccaggacagccauggggacacagagaaacccugucucaaaaaaacaaaaaacaaaacaaaacaaaacaaacaaacaaaaggcauguuucaggauccccugcagacgccugaaacucugguaacagcaaacccuaggaauccuaugguuuuccuacacacacuucacuaugaugguauuuaaucuccgaauuuagcaugguagaugaacaacucuaacagggaaguggaugcaaucucucccuaaauacucacuuuucuuuugauaguguaagaugauuugaauugaggugaaugauaucaguccugugagacacugauggacacgaccugacaauaguccagaaagacagcugcggugguuugaauaugcuuggcccagggaguggcaauaguaggagguguagccuuguuagagugggcguggcauuguuggaguaggugugucacuguagggaugggcuuaaauaacuuucuccuuucuccuguuugccuucagaacaagauguagaacucucagcuauucuagcaccaugccugccuagacgcugccaugcuucccaccaugauaauggacugaacuucugaaacuguagggcagcgccagugaaauguuguccuugagaagaguugccuuggucauggcgucugcucacagcaaugaaacccuaaggcaggugguaugagugagaacgccccacaggcucauauacugaaucuuuagucagcagcacguggugcuaccugaggagaauuuggucuguggccuuguuggaguaggugugguguuguuagagcaacgugucccugaguguagacuuugagcuuucaaaagcccaagccaggcccuuugucucuuccuccugccaguggauccagaggucgaagucucagcuacuucuuuagcaacaagccugccugccucucaccaugcuucucgccaugaugauaguggccucacccauaaaacuguaagccagccccacuuaaguguucucuguuaugagaguugccuuggucauggugucuacucccagcaauagaacacagauuaagauaagaaccaucuuuucagcugaugacaucgguggcagauggauaacguccaugaucggugaucuuauuguuuaagguguuuuguggcaagcuucuaggagacuaccguaauagcaauuugcuugucuuuaacucaccaggagauugcucagaaagcuguaaucuguggugagcagaagcauacuuuuaugugugucacuccaaggacuaggccugccuuugaucguguauuucugcaaggucuaucuacaugccauacuuuuguccuucagugucuguguauucacucugcagccucccucagcucucaaccuuaguucacugcugguucucccuccguuuccucuucaucuucuguaggugacucaaugagguggaccauuagcauuccucaagagccucacgcuaccugucaguaaaucauucucuaccaacuuaccugcagugcaaaggauuuccugucuucccuguaaaccucuggaaagcauucucaacccugcuguagaaauaguuacucucagucagggacuucuagucugccuuugaucauucaguucccagauaaaaaaagacauacaacauugacauuuauaaugagccuuaaugagcacugaaguugggcagacagcuaccgucuuugcuaguaugucuacuucccugacaaucuccccacaauaugacuugcuacguuccaguugggcugcucuuagcucccaucggccgcucucauggccauaauuugaagauccuuaccgcagggcaucuucucuucucucccuuuccucucccgcuccuugugguucuccuuaggcucuaagcccaggagcaccaaacccugccuaucucuucuucccagcuacuggcugucgucaucuuuaucaaaccaauagcuuaaaauuaaggagcaaggucaccuuguaugugcagauucucucauucuugggagcagccaggcccuggggccgauauuuaguauuacaaaacauagcaaaagacuaaaccccaacauggccucgcucuauaaauuucugccauuuccaguuugcauucacccacugcaauuccaugaguguuacuguccuagaaacaguggucaucuacagcacugcauguauacaaacuagggucuccaucaggagcugacugauacaaucaauaccaaguggccucugcuagggggacaaggccauaugaagaggcaauucacuacuugacaccuugguaacaguuggaugugccaucugcuguuagacuuuaagucuucuuaauucauucuuccaaggauuguaccacuugugggaucugccaagcagggcuagaaccaccccaggcaggaaggcuagcaccugcacauuauagcuccacuccacaacacuggaggaugcgcacguugggcuucacucuguacacuauacuaggcuucaucauacggcuugaacuguggccacaaaguaccagagcaaaucugauuuaugcuuugguuauaccuccacacuuuaaaggcuguauauucuacuggacaccugcaaacguaccagcacugucuucuucacuuacagacagccucugugguagguucuucucaaugugcacaacccuccuugcuuggaggaaauggcuuggugaugcuucccuugggaaaucacuugcagacccaguacuuccugcgcaaugucuugcucucguguggagugugauuucuauucacgucauccagacacagauguaaugauuucuaucuuaacugaguaaguaucuuauacugugguaguaacuguggugaauuucuucuucuuccuaauaucacaaacaguaaaucugugcuuacuuuagauuaaaauuuucucuccuugcucaagaacuguccuucacuuaaagaaaacuacuauauaguuucucuuucuuugcauaaaccacuauauaguuucucuuugcauaaaccgcuauacaaaugcugugcucugggacuacuguuaaggaaaacuggcuuuucuauuuaaacacaagcacugugcuaucaccaucaaauaaacaaggugagcucuggguaaccgacaggcaggcaugucuccugggacccggacugagaaggaucugaaaucucauuaagcuaugcagaagagcgugcaguggcucaggaauuguuuauuucuggaauugucaacuggauacuuuuagacugaaacaacagauuaacaggauucauuguaguuuuccuccuucuuggaacagagucccuaccaaaccagcauuguccuuucucuauucagcauaugcuaggggagagaugaggcagcgaaggaguucuaucacggccccaaaauucuucaaccuuuacagccaaaacggggaaccacuugcugguuuugccagcuacagaaagcuuacacuacucacaaagucaugccucaguuuaaaacagucacauacaauaagccuguaaaagauaagaagauaaagcaagcucuuuccccggaggagcggcaggcucggaaccacgccaucucuguagccuucguuucaaacgucuuaaaacaaugauucaaccauacauauuuguggagaaaagcaauuuuaaaacugcuuuuagaaauauaucaccagcaauaauauuggaacgguguuuaaaauuacauucuuguuuauuaugaaagacaguagcaauaacgcuuuaauauugcugggaaguagaauuuugguacagaaaagaggauguagcugcuugauggauuauauauuuaaaaaaauacacuguaguccccuuucaaaguugaaaauaucaauguaaacucaagaugcaccuuauaauuuuguguguaagaacauucaaguaacccugagacuaaagauagaccugaaaggcagagugccugcaaaguaucugggaugcacuucuuuuaauccuacgaacuguaaaauaaaauacauaaacaaaacaaaggagauccauaacuaaggaacacugacaggugcucagacgucagaaugaagcagcugggacguggccugguccaaccucagcagcugucucacaggggugggaccaggauugacugagaagacuucagggaacacaugaguucugcagggguacgcccuugucaaaacuccugcguugccgacaccucagaucugugcucucacuacaaacaaaguucaguacacuuaaauaugcaugcuaaccacgugaacauugaagugucaaauuauaaguauuccuaaucccacagcucacuuuggagacagcacauggaugugguaaagcaaaucucauaaaaugaacucuagagucuggguggcaggcacgcacaggcuccacuacucuuccagcuuuugugugcaucaagaaauauauuuguaagaauggaugaggcuggcaauacuagagaccaaggugcagugugugugugugagcgggccagcaguugugucugcugucuuccuugaucccagagcaaagacagggucacucggacucugaagcucaaugaccuaggcuggccagucagugagcugccaccugucuccguaucucucucucuccucagagcugggaucacagaacggcgccaugucaucugauguguggguuuuagaggucugagguaagagcccaugcuugugcagugagcacccuaugacaaccaccuccccaaccugccacuuaacccuagggacaaaaaaaaaaaaaaaggauaacaauguuaguggaggaaugugccaucgcagggaguuaaauuuuugaaaaaaguaauccaacccaaauauauaaaccuaacaauuuuuaggaaauaaaggaaugggagaauauuaacaauauccaagaagucacugaauugcauggaaagaaaacagcagcaaguagaaucugucauuuaagagagagaagaauucucaauuuaaaagguagggagaauuuuaaaauguuuuaaaaauuucaauucuagaacauuuuuguaagacagcauuuuaggagagaagugagggaauucauacuaggcaaacguugauauuaagaguauuucagauugcugaggugcaucaacaguguggugguuuaaacaggcacggcccccacaggcucaucuaucugaaugcuuggccacuagggaguggcacuccuaggagaugugcccuuguugggguagguguggcuuuguuggaggaagggugucacuggaggaaggucugggguuucagaugcucaacaugcccagugucucucucucucuuccugcugccugcugauccagauguagagcucucaguuccuccagcaccaugugugccugcaggcugccaugcuucccgcugugccaagaguggacuaaagcucugaguguaaaccagcccugaauaaacguuuuucuuuauaugagaugccauggucaugguaucucuucacagugagagaacacugacuaagaaacagcaugugguuguguuugaaagucgucauguagagcuagguauuacaguaucuauggacagaauguggcuggcuucucuugaaggcagcuugggguagagugugcacacugcucacugccgacacugcucggagcgcccaugaagagcacauaacuccacugucagagcacgugaugucccaaaacagucacccaguacugcuaccgacaaaaucaaagucccagccacagugucucauaguccagcauaucugcaguaacuuaccacucugauuucaaaguguaguuuguuucaagguaagucucccuuccggggucccacuggcacagcauauucuuccccucauucacaaugcaagucaaauuuguagguuuaucuggaggaacuauaaggaaacaaacauuuaacuuuuaaaagucuuauauagauaaguauuaucuaauuuauauaaugucuaagacccaccucaauuagauaaaugaacccaagauaauauaugagcaaaaugagaaacauguuaauuuuucuuccaacuccuaaauacuuuuuaggugucucucucucucuuccucucucucucucucucucucucucuuucuauauauauauauauauauauauauauauauauauguguguguguguguguguguaacugucuuuaauugcuuucauuuuaguuuucuauauaaaaauacauuuuuauuuauaaccagaaaaauuaucaguaaugucucuuuuaaguguucuaaaauuaauaauaacuaguauuaaaaggucguuguaggagcaaaaauguuuugcauauacuuuauuuuacuuuuguauuucaaaauggguccuucugugcagccuaagcuggccucacacuucugucugagcuucugauccacaucccaggugcugggcugacuggcacucaccaucacaccggugggaauguuuguccuaucgcuuccuggaggauugaaggaaaagcaaaugcuggccccacucuuuguguaguuauucuuuuuuaagaauaauuuuuuaaauacuauaauuaccucauuucuccauccccuuccuccugccaagcccucccgugugccuccuugcucccuucaaaucuuuuuaguauuucuccuuccuccauucaggaacuuauggaacuuaguucuuuucucaauaaugaggagacacagaaagcugcuaucaacagacccaaacugccgaucaguaauacucuugggggcacagagagucucaggccaaaccauuucucaagacucugauaaauguuuguuuuuaacaaagaaaugacacccaugcugcucuucuggauuuguguauaaugguaaaaauauacauguugcuucuaaaugauuuuuuuuguuuuuuguuuguuuuguuuuguuuuauaaaauaagcacuuccaaaagcuacugaaccagugacuguccuugggaaggcuaacagaaaccauuaaaaauguaguucaagagucugacaaaauugaagaaaagacccaaaucuuacagccugaaagcauggugacuccauacacauucugcucgaucugcccaaaggacaggauguugcaggugagcugcacgcucgggaggaccacgucugugaacgugacacuggacgugguucuguugaugacagugaccugcucccugggaacagcagcaugguuggucuuccacacgauguagcuggcauucacguaguaaugcugcagacacgccuccuucagcacacaaauggcagugaaguucgagccgcgcuggacaacuggaaauucaggguagauguaaccacacgguuccaaaaguugaccugaaaaagaacaauggacugugcugaguuugcccagaacacgugaugccguggguucaaugccugguacucugacaggaacaaggaaaaacaaaaaccucaaagacaguauuuccaguacaaaaugguauuuggauagcaacacucaguguagacuauacaaauucacuauaauaacucacuggagaaaaagaacauuuaagccuggaaaaauuguggugaacuauacaaguuauaauguauaaaauacuaaaaauuacugagcucauggucaaauauucugauuucccucaggaaacagacugaguccagcaaaagucaacccuacccaucccccacccaccccuuggcccccgacggccuaaauuaaauuccauaaaacagguaggugggcggccuucucucuagcccuaaaagccaguggagguuaggauggugggacagagagguggacacacuguccaucugccaaaaucuggacugcagcaagacagcaacccacaccagaaagccuggacaguaugauugauuuaacaaaggguagggaguacaauuuucugagaaaacacuuggacuaguuuuagcaauguacuaauuuuaucuaucaguguguggaauaaaacuuucuauuuaaagaagggaaaaaagaauuggauagggagagaaacaaauauacaauugcauuguagggauuccacugcuguugccagcgacagcuguaacuccggcugcuuuggauauccuguaagauacacguaccgguggagucuccguugcuuuuguuuauuuauuuauuuuugaaaagacacaauacauuaucacuuaguuacuuugcugugcaaaagaauagcagauauauuauucaggucucuguacaacggggucccagugcacacccuuucuuuguucccucagucaggaccccaagccucugagaacgucuacucucaacuuucuaugaauaauuuuuuuuuuuuagauuucaccagugagauuauaugauauuagccauuugcaugucuucucuucagaaaugucuaccuaggucugcuagccuuuaaacauuauuuauauuuuucuacugaguugaauuccucacaaaaucaguauuaauuccuuaucggguguaagauuugaaauuguacuacucagucgaccuucuuucucaacugaaccuaaaagugugcuguggugcuuuagucugucugucugucugcucauguugcaugcauuccucucugugcuucgggaucccacugagaaacuccccaccugcuccaguaucuuaaagcauuucccuacuuaauuccaggacuucagagguucaaggcuuauaguuaaagucuuuacucuagucgaguauggcgcacaugccuuuaccccagcacuagagagacaggcaggcagaucucugugaauucaagaacaagcuuaucuauagugcagguucccaggcuggcagagcuacacagugagauugugucucaaucaaucaaucaaucacucaaucaaucaaccaauaauguauaaaugucuuuaaucuguuuugaguugauuuuucaaaauguggagagaggaagaaccggauauccaauuaucccacaccucgaucugaagagacugcgcuuccucuaauaucuuagugccccugucaaagauugguggcuauauauaaugaguuuacuucuaugcacucuagucuuuuuaccacucuugacuaugcccacaccacgcuggguuuuuuuucuuuaaacuuuuuauugauucuuuguaaauuucacauuauguaguagcucaauaccauuugucuucccagcccuucaucucugcccuggcaaccaaccuccccaaccuucaucucugcccuggcaaccaaccuccccaaccuucaucucugcccuggcaaccaaccuccccaaccuucaucucugcccuggcaaccaaccuccccaaccuucaucucugcccuggcaaccaaccuccccaacaaaagaaaacauuaaaaaaucucaccacggccguuguggugaugcccagcacacccuuugcccacaucucucugcuugcaaauguucuuugcagugagucacuggucugguuggaggccucuggcuucugcuacaccaucaauccugaguccucgcccuggacuucucucagauauucuguuguugcccugggucauggagacccuguagcuuugggucuauagggcuggccccuucauaagcuucagcaguucauaggugggguagauguugggcugggccaacauagugcccuguaucugcgccuggguagaaucugauuuggugagcagaucuccuacucccauggcaccaggaucagcuuuacugaagugcugcccaggugaggggcagagccaacgugguggcccggcgaggagcggagcagauuuccugggugcuguagcuggcaagggguggagauagcucuccggugcucauguccugggaggugagggguuggcucacccacacaucugccaccagagguaacucuacucugcugcccagggaagguacucacaccaucaaagacagcucucucaugcuggucagguaagggauggggcacaccaugcuguuuuaacuacuguaacuuugcaaucgauuuuuaaauaaaauguuuccauucuuacuuauuuugcucacaauucuuuugggcauuuggguguuuauggcuccauaugaaucugaugaaguuuuugcuaacucuguaacuacuuuguucaagcacauggacugucuguccauauuuuguguccuuucaaugauucuuucauuagauuuuauaauuuauauuucauagauauuauaacucugacuaaauuuacugagauuuauuuugggagcuaccguaaguaagacaguuuucucagguaauuuaucauuaccauauaaaaugccacugaccuauauaugugaauucuguauucagcaacuuuugcugaauucauuaacuaguucugguuauuuuguacucuuugggguuucugauaaauaauaucauauaauccacagugagacaaucugauauccucuuuucuaaccuagaugcuuuuuauauuccuucuuuugucugacugcucuggcuagaucuucaaguagcauauuuaauagaggugguuagaaauaaaggcagugaaaauaacaggucuaucuuuuacaagaucuuauuacacagaaauguucuuucuaucucuaauuuauuauuuuugguuaugaagguuuuuuaaaauauuuuuuuaaaaagauuuauucuauauaugugaggacacuguugcagucuucagacacaccagaagagggcaucggaucccauuacagaugguuguuagccaccaugugguugcugggaauugaacucaggaccucuggaagagcagucaguacucuuaaccacugagccaucucgccagcccguuaugaaguuugacaugacauuuaucaagugcaccgacuaaggugaccauagggcugauccuucaaucucuuagugcugucaguucacuuauucaucuguauauggugaauagcccuugcaccucugcaauaaaugcauuuaaucagauuaaaucgucuuuuuaaugugcuguuaaaacgucauuccuagcauuuuaucagaaauuucugcaucuauguuccucaugauauuagcauauagcuugcacauuuguguugucugguuuugguaccaaacaauguugguaugguaaguauuuucaaagugaugaaauauagggccuugcuauguaacccagaccgaccuugaacuuguaauccuccugccucaauuuuccaagugcaaagauuacagauacaggucagcaugauuugcucaaacguaccacuucuuauucuuacuucucuccucccguccacucaccugggccaaaugccuugugguccuuccaugucucucugaagcuccaccuuaaggcuacguucuggccaaugcuugcuaggggguuucuaggcucuuauucauccuauuuggucuucaguuaacauaaaaccuucugucacgggagccaagcugaaccccucugugugaagagagcugaccuacauggguacuuuucaaacugggacagcggucugguguuucuuccaaccugccauagaucuguacuuuuguuugcuggcuccauuggccacaugcucgguugucauggcuaugucaaacuguuacaaguuuucugagggcuggagagauggcucagugguuaaggacacuugcuaaucuugcagaggauucgauucccagcauccacacagcaacucacaaucuguaccuccagucccaggggauuccacacacucaucuagccgcccgagccaccaggcaugcaggugguguacgaguaggcguccacguagagaaaaccccauucuuuaaguucuccaaauauaaauucuuaauguccucuugcaccacacuguagacagcaggucucaggccaccaucaggccaguguuaccaaucggcccccaccgccacgucauucugguaagcaaccacacugauuggugaguuuggggaaauugaggagaagaaaaggacuacaaauuaacagauuuuucucccaguccuuuauucaaaaacagcauuuuucacaucccccaaccuuaacauuauggagguagagcuaauuagcauuuacaguugaugaaacucaaaugauacaaaacgaauuaucaggcauauuuguacugaagauacuucuuucaguaaugaccccagaaagaauauacaugcauacuuauaugauuacuaaacauaaaccuaauuauauaauauuuaaaauaugaaagucuaauuuguagaguagggacauuucaugaaucuuaccuauagauucaguggugaggaaaaaaagcaaagcuugcgcuagccaaauccuuggugcugacaucuugcagggauguuccuguaacagacauaauguaaaaacccauucucuuucacauaggcuaaaacacaggcuuguuucuauuguguagcuauuuucuggaaggugguaaaacaccuauaugaauacagaagaggaauauuucucuauguuuacuaaaguuauggcuacacaaaugucugaaguccuccaucucacguuacuuguacguaaguagguaugauuuuacauuuaaaaaaaaaaaaaaaaaacagaaacaaaagccgggauugguccuuaagugguaccaggucgacuguuaucuagcgguucugugugugccacuuacacagucuucucccuaauugcuaugacuccguuugucugauaugcagcaguuucaccaauauaagcaaaacauugugagacuuuccgaguuagaaacaaaagacacgacucugagcaacagccacaaaguagcaacagcuucuuuuugcugguuaccaguuuaacccacagagugcugugaggucaggugacaccugccgagaguaaguuaucuuccaggauacaaagaucagauuuaggaaggaacucacaccuuacagagagcaggaagcacgccugccuuuuacucuagaaggggccauucucguuaucuuagcaagccuucccaagugaagcaauauuucaacauccuugaaaugucgguaagggugaggcagucaacgcgcuugcaaaagagacauauacuaugcaaaaaucaugacccacagauuucuuuuuuuaguauuuauacaauaaaucuuaauuguaaccaaacaacauuuuauauauauacacacugagagaaacacgugcuaacgucuuccaaauguacacacacaggaauguuucaugggugcccaaggcagguccacagcucaggcgcccugcauagguuuaaauccccagcaacaagaaaaaccgaaacacaaccugacgagaagcaaccagacaaacagagccuuagcaaucagcaagaagaaugucggagcaugcaggacaugguuaacucucacaucaauccagaaugaggcagcuggguuugugacugagcauggcauggggaaacagaaaagccuuucccucucaugacuagaaaguauuacuuccuaauuuuaagaccugucacugaggugugaggcaggggcauccgagaacaaaaggaccccgugcugcauucuauacaacugacuguccuugugauuuacccguuugaaaacggccaggauucuguuacguuuuucauuugauuuugagaguaaaaauuugaauuaaagguauauuaaguguuccucuuauuucacacaucuugcagaauaugcauauauugcaaaaacgcugcauuaagugacuuccuugaacuuggcuuucuaggaagcuuuuuuuguuguuguuuuuuuuuuuuuuuucccgagacaggguuucucuguguagcccuggcugucuuggaacucacucuguagaccaggcugaccucgaaucuaggaagcuuuaaaaagcuaacgugacuaguaacugaagaugcaagaaagguuuauuucagaacggaguggcucuucucuauugguaacugcucagauauggcaagccaacagcagugaacaucuggaaagugugccccagucauuuucucgagcaauggguaucacacagauugugaacggcuugcuggaaaacuccgaacaagcaugcagugaccgcagcacuguuuguucuuucaauccacagguuuuucucaaguggagggaaaaaagcagccuaauuguaccuaauuaacacuuaauaacugugccacuuuaaacacuuuuagugccuauccuauggccuuuauguuucuuuccauuccuaagauguaagccaagagcaguauggagagugaguaaggacuacagucacuguuacuaugggaagggaauuagagcucagcuccucucuguccacuggggagcugggaggggucagacugugucacuccgaaugcacccgcaaagcacuguccucggaggggucagacugugucacuccgaaugcacccgcaaagcacuguccucggaggggucagacugugucacuccgaaugcacccgcaaagcacuguccucggaggggucagacugugucacuccgaaugcacccacaaagcacuguccuccgcuguguuggugcccuuuacacugauuugccucacucuuucccaguccuugcuaagaaacacugggcuguuuccugucagacugcgcgagcaggagccaggccucccaguauccuugggaggcagauagguagggcagggauuauuuauugggcuuuuacaaaagagaaacgaaaaugcagaggagacaaauuacuuacccaacauacgaaauuaagaaaugauaaagcaugaaucggaaacaaguucgcugccucuagaugucauguuccuucuaucgggucuuccugugaagacagaagagccuuguucagaagcuggcuuugacugcagugcugucuucuuugcuagucuuugaggacgucauacaggcauacaauguauuuugguccuauucacccuaguccuuccugaacuucuagauccacccggacaccugcgcuuuaaauccuucacugguguuacaucggcagguuggcagcaaguagcacauguuagagacguaagcuucagaacacaauaaccccaaguacuugggugagaggacucaguaacacaguggggugguuauuucuaugucuccccgcacccucugacaccaggguuuucuaugcuguccuggcuggccauuaacuacuaaauucaaguaaucguccugccccgagccuuugggaucacgaguuauguuuaauacaaugguucucaaccuguggguuaugacugcuuugggaguucaaugaccuuucacaggggucaccuaagaccaucagaaaacacagauauguacauuacaauucauaacagaagcaaaaucacaguuaugaagcaacaugaaaauaaucuuaugguuaggggucaccauaaccuaaggaaggguauuaaagggcuguagcauuaggaagggugagaaccacugguuugauacauccuugcaaacaguaaggucacuuacacccauuucaacccucuugaugucuauguaauggcacagggcauuuuguugaaggaagccauagcagguccuuagcagaaggcugacuccuuuggucuccuacuggcacuaaaauggcugacuccucaagugcacacagcacuaaguuauucuagcaugagccguggcagcuauuuuuuuuuuaaauaacuugacauuuaggcaaaguguugaaccuuguauugcugcuuucuaugcauuauaucuuugauaugacccaauaacaaggaauuaaauuuguaaccuaauuuuuaaaauuucaaaugauaaacggggcagggguagcaugggaagucucuauauuaccaagaaaaauagcuagugaagacguugguggagagccucacaaaauucuacaccuacaccuucaucgcuguaugugugaguaaguguucgcaucuuacuuuucaaagcgcacacacgugcugaguguugucaguugcucggaugcuuucuucauggaccaccccaggcuugaacucgcuaagcccugcagaggcuaagucugcagucugugcucugagucuucccacagaggucuucccuguucucucuaaaccgccuuuacuauccuaccccuccaggcuuuuguuuucuucuuuagaacacugagacaucuauaacagauuggcaaauacguuucugcaauagaccagauaaauguuuagacuuucuuuccuuccaaaaacagacugcaagccagauuuggucugcaugccauuguuugccaacccccauucuaaaaugcuguauaauuuucuaauuuugcccacuguuuguucaaaguugaacuguguccccugcaaaagguucacucaaguccuaggaccucgaaacaugacccucuuuggaagcaggaucauugcugauguaauuagcaaauguacagaacaauaagaaagacucagaaaaaugccauacgauagaaggcagaaaccggagugacugcagucacaagcuaaaaacaagucaacacauggcuaccauuagaggcugggaagagccaauggauucuuaccaggaggacuucuggcuucuggagaaaauagcauuucuguaagucaaucaauuaaucucucucucccccccgcccccucuaucucgcuaucucucccuaccuaucuaccuaucaaauugucacucuaucuuuuucauggcaggcuuucucuguguagcuagcucuggcuauccuggaacucacuuuguagaagagccucugccuguggucucugucuucugucuucuguccuguccucuggucucugccucuaccucuuccugccugagugcuaguacacaggcgugcuccaccaccacacaggaucauuucuguaauuuuagaucaccuaaauguauaguacuuuguuacauugguccuaagaaaugagcacauuguauguauuacgcaaacagacuguaagcaaaggaggcaguuucugucuguguuuguaccugucucuaggauucagauccauacguagcauaugauaugcucaugagguaaagaaacaauauucgcauguguacauaacauaauacugcaaauuaacucgugcagagucuguguggacacauucuauaauucugagaaguuaauucuaggaauagauaacugggcccugugauagguauaauauuuagcuacacagcuuucuggaagguaugacauaugaauauucuaauuuuuaauuacacuuguuucauuguuauuauuaaguuugacaguuuugaguauacuuuauuuaggaaagcaaaacaaagaagaggugggcuguaguuugccucuucccauuuauuugauuuuucuuuuauggcuuuacacuguugugauaaauaguuuuuagcaguuuugaaacauguagcugcuacaaugacaaauaacauguuaaaccaucaggucuccuagacauucaauguaauauugaaacaaaugauuauuuaaaaagcagcacuccagagcacaucugcaauaaccaaccaaggcauguaacagaaaaccguauuucucauaauagcaucaaaaacaacauuagagucagaaaaaucuacucagaacuauaaaagaauuucacgauauaaaaaugccacacaacuuuaacccaaagggcaaaguaguuuauuaugaacuuuacacagugauuaaaaucucaauuagaaaauggacacuaagccaauuuccaacaacagaaaggacuuggcagaugagcauucagagauacuagagagauaauuaaagccugcaugggcacagaggacuagacaaaucaacagcccgaaggcaaauagacuccaguacacauaaucgcuuacaggccugggaugcagcucagaguacacagcugcccucgugugcaucaucucugagaccagaaaacaaacaaacaaacaaccagauaaacaauaaagaauuuauaagcugaucgugcacacaccugcaagucucagcuggcucagaaaggaaaaucagcugcuuuaagacuuggcgguuagugcuggcaacacagggagaauguacaagacaaaaucugauaaaaaauuuuuuaucauuauucaaagauauacucugggacaacuagugcuaugagcaaacauguaaaaagauauuuuuuauacaaacauauuccagaguuaauaaagaauuacgugcaaaagucagaucauauauauacugaaagcacgagacauuuaugaccugugaggacauaagucuuuuacaaauuaucuugccuauuucagucaaaugagaguuuuaugagaacucugauaaagauccacauucuccccaucacguaagaaauuuaaugcuacaaguacaauugaugccaacaguuccugcuuacagggagcucaaagcuaacagguaaaauacaugcagagugcuuugggaacagaguuuccuagucgggggcucaagagcacuguaaaguaagcguucugaggaugaggaaacaguguaugugugacugaagaccaccacugagaaggucucccaaccaccacugugccauuugaaauacagcucacuugaguucaacuggcacuagagguugugccugcagaggauggacagaagacagaccauccaaacagaaaaggauugugcaggaugcaagccacuauucacaagaaaggauuaaucuacucuuccuuaaaacaaagggugaaugugacuacuaaagagauucugaaaaucugaaggcaggacauucaacuuauaacagggccacucguuuguuuuaccaaaaggaauuugaguucuugcuccagacugggcuuuaaagcagccucucaagucucacguauacucuacucacauauacucuacucacauauacucuacucacauauacucuacucuacucacauauacucuacucacauauacucuacucacagauacuauauucacauauacuauacucacagacacagccccaggacaccaccucccgugguucugaagccuuccaccacccucucuacuucccaaaguccucagaccuucugguuuaaauacaauguaggugguucucgacuucagcuacuuuucuguauucuucaguagcucuuaucuccuggccaugaauggccccaaagauaaaguacucaggauugggcuggugagauggcucagcagauaggaguacuugaccacucuuccgaagguccugaguucaaaucccagcaaccacuugguggcucacaaccacccauaaugagaucugaugcccucuucuggcacaucugaagacagcugcaguguacuuauguauaauaauaaauaaauauuaaaaaaaaguacucaggaucuacuuuucuucuaaaauauuuacugugaagacauguaacuucaacuauuaccuugccuucacaccaaauucaagaauucuggcuggcuugaaucgucaauucuaguuauacaucaucuuagauauucugccucugaugcaaaucaauguaauaaaucuccccccaaaaauaccuacuuacacaucaacuacacauaccggcacccuguaucaacaguguuaucaguuuuaucacagaaauguauuacccccucacauaccuauaaaccacucaacguuaucagcugccucagucagucaaguuggcucuucucuugucuuauaacuugacuuuucuguuacaaucucauccagacuucucgucugucucgaugcacuggacugaucacagcacuuaccacagcucccagccccuccucugccacaaccuccuccuggaccugagcacagcacagugcugcacucccagcuccuguccucccagagcgagguucagaagcacuguuuaaaagccagcaccuaccagagaacccaagagcugcuuucaucaccugcacuguccaaccgcucuccaauguucaacuuuauuuaaaaauaccagccgggcgugguggguggcucacgccuuuaaucccagcacucaggaggcggaggcaggcggaugucugaguuugaggccagccuggucuacaaagugaguuccaggucagccagggcuacacagagaagcccugucucgaaaaaccaaccaaaaaaaaaaaaaaaaacaaaaaacaaaaaaacaaaaaacaaaacaaaaaaccaauaauagagaggacagcauaguugacaaagcucuugcuuacaauguggaaaggcccuuucacaauguuccacccccagcccaccacauaaauaaaacucuaugcuuagaugucuuucucucaaaccaucaugcuauuauucgggagaaaauuacaagcaaguuggcuuuuuauuccaauuaugcugaaaugacucuuuucguuuuccaacugcaaagcaaauauuuaagcuccucauuuugcguggccucagcaucaggucuuaccuuucacaguucccagggcagccacaucuagagggugagcucagguuaccacaaaccuccagcacaccuucuugaugggagugugugccuguacccgggcuauaguuugcuucuacggugccagugcccugcugacucugccuuguuccacuguuuauaacccaaacggacaucucuucugugggauuucccccacauucacagacaucuguguucccagggcccuuucagaguucccuaagaggauucaccguguagcacuggaguuacacaacuucacaugcugagacucuugaggcacuuagggaacaacuaaaagaacguuuaguuugcacauguauguccguauguaagugcuacugacagagaaugugcguguaugcagccugaaggugcacccagggccuggcacaugcuaggcaugcacucgacuacuggcuacauucccagcguaaacaugagcuuuaaaacaccuaauauagucacuuuacucugccauucauauauucgguaugaaaaagaacguauuacaguuaagggcucagacagagcucaggaaaucuauguauaaauauagaaucugauaauaacguguucgccuuuguauaaaaggggcgaguaagaccuacuauuuaauaaggcuuugaagggcacaugaacauaagccaaauguucugugacugacauaccaaguugccuaagcaguagauaguaaacugaauauauugugguaacggcacaugguaguccuuuacuuugucccauggucccguucuagccgcaguucuacauccggauuucgaucucucuaguuuccucuuuacccaaaccuuaaccagguucccaggcugaccucugggaaccccacugaauauuucaauuccaaucccuaaacacccacaguacuuucuguaucacucauuauuucauugaaacuacucccguauccgaguaguuuuucacacaguuuguuuacccgauuuuguaaacugaaaaaccuaggugcuaucucaggcaucuuuuauaaauuccagagcaggcugaaugcuuacuaaaaucaucucaccagaaaccucaccugugaucaauccacguuugcaaucaaagaugaggagaaagcuuuaagaacuuccugcuuccuuagcagacaaguugcaaauguaccagggccaggugaagcaaauguguggcaaaaugacaccugagaucacuuccagggaaaaccccuuccugcucccacugcaggguuguggacaacacucaacuccccagaccaaacuguaggaaugcgauaagagauccaucaacacaacaguuuguaggcacaggcuuuggagccauguuuuuugagccuguucccuuuucuagaagguagauauuguaacacccacuucauagguauauaauaaucaguauucauucuagcacugaacugaaaugccacauucucuuaggaaaaacuauuucaaaaugaaaacacaaagucauaaauaaaacagaacaaaaugcccaguuacauaagaauguugcuuuaaaugagcggguaacaguauuuguaauauucuaaaucacuaaugccaacaauacaaauuucuacuauaaaguuuauccuuagcugaccuuucccccacuguaauuuuuucucucucuuucucuugugaguagaagcaaaugaacacacacacaccccacccccagaaaccuguggaaaacagaauuuaaccgacuagcagauuaguccuacaaauguagcauuccagaucagagcucaaaaauaauucccaaugauaaauauaaacacaaacuuggaaaauuaagacgaugacgaucauccccugauaaugugucaguaauuucaaauuaagagucguuccaacuggaagcuggcagucagucagucacacacggucuaaaagaguuuguuuacaacacugaccagaccaaagauuuuucagaagauucgcgcugacauuccagcacucacugacuacuuuuaagcaguacagcugcuguaauguccaauaacuauacaaauuaagccaaaacgaguuucuucuuaauggaaaaaugacaagaacagaaguggaccaagcccuuuauauuauguuugcuuugaguuucugaauuuugguuguucauccaaaagagagcccccugccagcuggagaaggggacacguuuacgcuuaggggaggaggugaaaaucuaaagaccgaugaugggcuugcucucgggauguaaaggcacgcgggauuuauuaggaaggguacggaccgaagggaaaguuaauauuuauaaacacuggacuuucauuaacgccuaaauguuaagaugucugggugaaaaguucgcucuggauuaagaaacaucaagagcagggaacgguagcauuucacgggacacagaagaccacacuuucuagggccauguccagaguaggaucagggagcacggcacgggaacuggaagaacgcaggacgcggucacccaggacgcgcgaucccgagaggacuuuggggcgggggcuucggaacugugcgucaggaacgcggcuggagaaggcgggugacaacaucagggaagucggagcccggagcggggagggaaggaaugcggggauucccaggccagcccgaccagcuccgggcgugcgcucggcgccgguccagcccggccccgcugggccucgggugccagguggcggccgcuccaggcaacccgcacccucccgcgccggggcccuguucuucucaccuuccggacgcgagccucgccgcuccugagcgucccucagccccgcggaucccggcccacaccaccggucccucagcggagccgcagcccggauggcucgaagcucuggccucccgaccgcacacgccacccuccguccgccgcugacccgggcucuccuagcuccgccccccacggccccg

SEQ ID NO: 7232 - RNA, 9612 nt, Mus musculus
cacaauuguaagguguuuuggaaaguuuggagcuguauucauagcucuugcaagacaggcaggagacgcuuuaauuaaaguaagagcaacaaugggaaaguauuuuggaaaagguaggugugugcguguguacguguguguugagccaaguaucuucaccaaauuccaacuggcauagauagcugcauaugaacauuuuuuuccuucucauuucugauuauagauagauaacuaaguaaaaacuuugggaacacccauucuauucagaacacaauaucggacugucccccuuuaaaguucaaaacaagcugcuaauuccaucagcccaauagcugggcauggcauucccuuguuaacagccaucugugaguauagauuggcucugaguuaacucuaaaauuaugugguguuugauggcaugauuuaucacagauuugcaguugacuacaagaugaaaguaggucuaugacacaaagccaccaagaaaagggugucuggguucccuacuucuggcuucuaggaaaggcuguuaggagggaaaccaaauccuaagaacacaguugagaacacaguuguaccguccccucuggcacagcuugguaagagaugaauucucaggauagcucuguuucuacuugacuauaaaaccuaacucuauuuuuuuacuucucuuuucaauuacuuguagagccagggagccugauacagaagugagggugggauaagaauuaucuaagaggauucuucaaucacaugcuugucuuugaaaaguaaguaacuucuuccaaagagcugauugguucaaccacagcccacaucaggaggagaccccagaccaaauaaauucccaaugcuugccuaaggacaaacccacggaaggaggauggggcucaagggggaacagauggguccuaauuguugccugaagcuguuugguaagaucuuuuuggcauagacuuuauuauuauuauuuuuaagucucuuaucuguggaaccagcugaguuuuuugaaaugucacuuccucuuggcaucuccaaggaggacuaaagcugaguuuacugacuguccaaacacaaggugaaguggagaauguaggaaaagacacugggugacuuggccccaaaagaccucuuucgguaacuuagagucuguuucagacacgucccccucccagucacuggaguaaaauggacagaggcugaacaguccagguagcuccaagcuuugcacuuacaguuugggaugguguccguagucuuucaaaaugucggauucucuaaauauugauugacuuaucuugguggguagugugcuuauucucaugugugacugcagucacaugugugucauggcuugccuguggagaugagagaacaacuucccaugucaguccacagugaaaggcaccuuguuugagguaaugucucugguuguuaaaccacuucacaagcuaggucaccuggcucacaggcuucggggauguuucugucucugcucccaucuucccuguagaacauugggguuaugggugcauauuacugugucugccuuuguauggauucuggggacccauacacucaguccuuaaaccuugugagguauugaauccuuccucuaucuggauucuuuaaauuuuauaugguuaaaaauauuauuggggggugauauauauauauaucaagaugguugcugggaauugaacucaggacccuguugaagagcagccagugcuuucaaccuccgagccaucucuccagcccccuuauauauguucuuaaaguuaaaucuauugucaucaaaccaccaacuauucauuucugaaccuucagaaacauaguaugaaaugcuaggugcauguggcucuauuccuaacuggugugcccuuaucuaacacuagguacaugguacaaccaccaaugauaaacuguauugcuauuucuuuaaaugaaaauuuuuauugagauaacacugaaauaggcagacacgugugaucccagcacuuggaaggcugaggaagaaggaucacugcaagguugaggccaacauggucuacauagccagccuugggccagacaguacuacauagaaagauccugucucaaagacaaacuacagauaaacaaacgagaaaauguaauauacuauguuccauguauuuuugagaauucuauauaugaauacaguguaguuccuaaaacuugugaucauuauuuaacuuaauuaauuaauuaauuaaaauaauuaauuagugugagugugagagauggcuuuagucaguaaguguagacucugacgccaucgccuacauuuaaauuccaguucuuccuccaugcucuauuauuuauucauucgccuauuguuguuaaggaaauaggacaugcauuguccagcugaccccuaacuccugggcccaagugauccuccugccucagccucugaaaucacagggacuacagaggcacucggugcuauuccugucuaugauucgcugugauacuuauaaaaucuuugugccauugccauucuugcucccuuuucauuuugaggcaacugaccuuugaggaaaugaagcaugguccguuugccugaguuaaacacuaauagaugcucaaacuaagacccaaagccuguucugucugucuuagccaaaggcuaaggacugagaccaggucugucuugccccaggcacauguauuuuuccaccacagacauauauauccauuacaagcauccagugacggcauguccuguuauagucacucuguuuuuucucaaaugcacccuucuacagcuuucuacacaacauaguuccucuuuguuggcuuguucccugguugugccugccaauagggacugcugguaagcaagaccuuguuucuuccaguugcuuuuugugucacuagaaucaacccaccacccuggcaguagcacauccuuccaguaacaauaauguauuccaauuugcauguuguccaucacacuaaaccaacacaacugcaccccugagugagaccaguaccaucugacucuauuccucucuccugaacccugagaggccagcagccuucuuacccuacacccaauguucccaucuaaguaaucagcaucucucucaucauuucuucagcucuaaugacaauugucacuuccugaagccacuaguucuaugacagcauaauguucuccuuuuguuuuucuagcucuagagacuuggcaaacaagucuuuacauuaucacuaucguuugucuccugguuguacucuggaugacacagcagugaacuuacaacguggaaauuuauuuacaagucuacccaacauugcguauaaaguucuacucuagcaaauaggacccguuaugguauaauuaaguggaaaaggagaaauuaucauuaagacaagaugacuguauacuaguaucuuaauggcauuguuugugacaccaacucagagccaugucuccucagugacaggaacuuuucuuuaccuuuccacuuaauuaauuccuaccccauaaaguuagacauaugugaccggguggauauguaaauuauguccuagaauacauguggguaauucuuaguggauggaaaaggaaauuccaaagauucguauuauucuguaggacauuagccaaacuuuuaaauugaauagacacuauucacuucuuagaaauuuuagguuugcuaacacagugaacacauaguauuaauugcuccugcuuuccuucuuucuccucuuuguucccucaguuuuccugaucauaucuuauuuuagucuuaucauugaugaaccaauauugguacaucucuguuaauacugguuaauaaacguauuuauuggcucucugugugcaugcacacuugugccaauaggagcacaugugacccugugagcauguggaaaucgaagcauuauucucaggaguuguuuuucuccuuuccuuguaggauucaggauaaaacucaggcgguugaaauugguggcagguacauuuaccugcuugcuaagcgauuuccccagccaagaccauucuuuauacuguagaguuucaugauguuaacaaaacacacaguggcauuguguagagugguuccacuggccugaagaaucuaugauucaugagcuaucaucuccacccugaauccuggcaaccacugagcuuuauuuucuugucauuauaguuugccuuuucuaugaugucacagagccgaaguagaacuauguagucuucuuaaaugggcuucuuucacugggcaauacgcgucuacgaaucuuccgucuggggauguagcuugcugaaggagcccuugccuaguguguuugcagcucuggguuugauucccaucucugcaaaaguaaauacauaacucuucuacgucugcauaugccucuguaguuuguuucauuuucagguugaauuuuauuucauuguuugcacauauagaugucaguuuagccauuuaacuaucaagagagauguuaguuacauguaauuuuugccucucuuagaguuaccauugacuuacacgugcaggguuuucuauggagauggauuuuuaucucuuuuagguaaacagggagagaauguagcccaauguaagacugucugccuugcauguauagaaggcccuggguuugaucccaggcaccacuuaggcucacuccuagguauuuaccuaggggcauaauugcuggauugugugguaagaguauauuuagccuugaaggguguggugguuugaaugagaaugguccccauagucucguauauuugaauuuuuaguucuaguuguuagacuguuuguuaaaaacuaggagcagaggccuuacaggaguaugugucacugggguggaucuugagguuucaaaaguucacacuaggccugguccuccccuccucauccucagaucaggauguaagcucuuggcuacugcucaggcuacaaccaugcccccaccacaugccccccacaaucccccucaccgugaugucauagacuuuccuuuaaaaguugccuugguguugcuguucugucacagcaacagaacaugagugaagaugaagggaauugcuaaaugcugacuaaagugacuguacaauuugacuuucguuuuuguagcucaauugggagaauauuugcccagcacacgugaagucauggauucaaucccuagcucugcaugcaacaggugugguggcacauacccauaaucccagggagacaugagaaucaaaaguucaaggcuauccuuggcuauguagggaguuaaaggccagccugggcuacaugagaccuguguuaaauaauagaaauacugauacuaaugaugaugauacaucaauuuuacuggaauaaucuagauucuuucuuucaguguguguguaugugucuguguucauauauguauguaguauguuuaugugcauguacucugacucuuaaauuuuccuaaaaugugcaacaucauuaguucuggaacuuaggcagagggaguuggauuucugugaguuggaguccagcuugaucuacauagugaguuguaggacagccagagcuacauaauaucaaaacucugucucaaguauauacacacaugcaugaaagguacucuaacucaucugccauagggagaaaaauuuugucaucucuaauccuguugauaccuuggcaguggcccuaagauuuccugagagucaacucacacacacgcuggcucaaccucccuuuuaaaugcuaauauuuuacaauuacaaagagaauccagaguacauuccagugaagugaccagcagacucauuuacaaagcauucaacauggaagccagucaccaggauaaaugcuaaaucacccuggcacgaagccaacaaaaguaagacuucaagccacgcccucuuuuguuauguauuuaaacaacugcuguggccaagggagaaaauugagaccaacccuguacaacuaggucucaggcuuaucuccaagaaauaagauccucuuugguuuugagguccacaggcugacuucugacacugcccagaacuugcagaggccgggcaguggggguagaauuaccaucugguaggagguugugcguguuuugaaugucaagggcacuccugggcucgcuguaagccuccuuccgauuuguacauuuguugaacugaagccugcuuccuuggaguguuaaguuauuccagaccacaaauagaaugauuugcucuucccaccucccuaaagguggggccacaggacagagucgacuaauguacaggucccaauguagcacacacacacacacagucgauuaauguacaggucccaauauaaacaccccuucucuaaaccaguccagagauuuugaaaggcuuugguucuugagggguggggcgggagucagauugugucagcugcagucuugcuccuguuuugugauuaaaagaaaagguguguggggauguggcucaguagcgcagugcuugccuagcauguacaagcuuaaaauuugaucccuggcagagagagagagagagagagagagagagagagagagagagagagagagagagagagagagagagagaauaugcauacucauuucuuccuuccacauucugugaaguuccgaaaaauaacaaggaucccucagcuugccucauugguggaaaugccugguuggaacauuccuuuggccacuuuagcugaaaacugcauaccuaggagacugaagcaucccugcuccagccuccugucucagaacugacugaaaacugucuccaaagauaggacgacucugugaaaaaaaaaaaaaaaaaaaaaaaaaagcccccagagaaaacagcacgaaaccacaccugaucccacacggaggcuugccagagcccaaacaggaccgcguugguagcaucaucccugccccccucgggggugggauggggguggggaggacucuuucuuuuucuuucuuuuuuuuuuuuuuucccagaacugcuuguuucugucucaaucacauccaaggacaucuagaugaucccuuuggcugucagaaaacaguuuugagcacgacacaccguagaagccuucuccauccaaacuuggguucuagucacuggaaaaaccucucuagggaagacggaaaagcugagccacccguuucugucugggacagcuuugcucccggccccuuuuccugcaucagcuuuuacuuaauggguuguuuuauuuggcaaugaccaagcaaggaaaccaaggauauuaauaaugauaaucgacauuugaacuuccuggguacgacguguacuuugugcccaagugcugaauagauuuuuuuguuuaaaaaaaaaauuguacaugcauggaugagacuaaaaacugucacagacuuaaauaauauuuuugucuuugugccauuugaaccaacucuucuuucuuuuccuagcuuugguccuuggaaagguucgaggucccaaagcaacguuauuuaugccggcugcaacccuugccacgaagccuugaggcaucccaauuacuaauucaacggcggggagcugaagcaauccggugauuuuccaucaauaagaugguuuccaucagcaaaaccccauggggaaugauagggcuacucggugacucgagcgcagauaucaucauaaaucugauuuuuuuuucuuucuuucugcuuuuugcaaaggaaaccccaccugcugguguguggguuauugacacagcagcccuuuugguucuagugccaauucuuccugaauuagaagggaaauccaaggggaggccauaagugcgaggaaacagagggccugcaagaagugguucacuuuaacucauugugaucugugcaguucaaguccuggggcaucacaaaccuacagcaaauauuugcugggcacacuaaagucugcccacaagacaauuuaucaggaaacaaucccugagguggagaaccaaugcccacauuuauuuauuuauuuauuuauuuguuuguuuguuuguuuguuuguuuggcaugggaauggucuacauuucugagaaaaacuaagccgugagaacuucuacgaagugagcugauaccguggggaugagaacacacgagccugagacucuaacgcucccgacgggcucuggccuggagucggucccacgugcugacacuucuuacaaaccaauggagaaacugcucccuuaggagugaguaucccuaagaagaauuuucagugucggugguguguaugaauagcaccguagugaccacacauucuguggaaauccccagugaaagcaucuuaugcauuugccuuccgagccuugaaacuuuucccccagucauuuggccuuuuaaagcuuccugagccuccccauucuguuuccugcgcucugaaauuuuuuacuggugauuagaaagcgugaagcuagauccugccaacaccccaggagaaaaucgaaggugaucugagaaccauccagaccaugcuuagguauguaagucaccccuaaacacuccugcccuucucgccugcuuugucuccuuuuuuggguacaaaguaugauacccacacagagccuaguuuguugaagcaauaguaauuuuuuuaaaacuuucacaauucccugauggagaaacaacuauuggaaucauacauuaguguauuucucuuuagcuauuuuuucugugcugauaaguuaguauguuauaaucauguucauuaugaauuauguuauguuauaauguguguuaagccagcaugaucacuauaaacaauucacacacagaaaugaauaaaggauaaacaucuccuagaaucugaauccuggagauaauuauugaggcaguuuuaccuauguuaaucaguugcauucauuaucuugauagaaguaucugugucaguuauauuccuauuacauauuagauacacuuacuugauuuucuaccaaguggcuuauauuauauacucuauucuauaauuucuuuuauucacacuaugacaacagaaccagauauccuuucaaguucaccuauguguaaugauucugcuuucaaaaugacuacccagcauuucauggaaugaagauacuauaccuuuuaaaguguaagcccuacugggaguugcuauuucuaguuuuuugcagcuaugaauggugcaauagacaucugauguauuugucuuugcaugccugucugggaagcagagcuacuagaucuaauaugugagcgugcauguuuucacgugagugugaugguuacaucauauuuaauuguguccucccacuaguuccaugaaauauuauaugauuuaaugguaccacaauaauauugcagauucaauuuaauaguuacauggucucccucuaagggacaaggacucaugcugagucauauaaauaugaccaacacuguaugggagacaauagucucucacuguuuucaccacuagcagcuggccuuaaccacaucuuggguggaauuugauguguuucuagaauaucuugaucaaggagaaaaagauauguaagugauuuuugugggaaaacugcauuauguuuauaaagggaggcaaaagguuccguaauuuugcaaagaaaauaaaccaauauuucaaaggug

SEQ ID NO: 7233 - RNA, 3613 nt, Mus musculus
cuugugcgacggucauuugaaguaacuuccuacguuuuuggaucacaaauaccugucugacaggacgggcucccacauacuuaacagacguuagcgacgcgccaaaguucuccuucccugggccagcggaaugaaauaaaauagucgcaaaucaaguccuuuuaugggucacugaagaaaaccuagccugaucuugguccggagcucagaggcggacccaccuggaugaggguuggcauaaaagaugaucacaccaggccagacaaucuaaccaaggaccagguuccccggagcagccuuucccuuuuuccgggggcggcugaaccgcucagacggcccauggcuccccuagguggccagugaucuuuacgcucuuccaccgagcucaagcagcuggcgccaggacccgggcugcgguugccacggugacgacagacgcgcggagccugcagcugaaggcgggugagaggcgggaguugcaacgccuccucccccugcaaccagcgcgggggccacgcguugcucgcacgcgagggguguggcucugccuccgggaaagcgcggcccgugggcggcucggggcucagccagugagaggccgggggagugguggagggaaggcacaguccggguacuuagagcugcgccgccagcgggaccggaucuuccucgcagcucucgcgccgacgcuccgggcgucguagacgcuaggagcgcuacccgauuguaacaugguuaccccuugcccugccagcccgggcagccccgccgcgggagccgggaggcgagacagccaccagaaccuccgcgccccagugaagaagagcagacgcccgugccuccggagaaagaagccgcugcggccgcugaacgcguguucgcucccgggagacucgggcgucugugaccuuuucgagucccccagcuccagcucggacggcgccgacagccccgcagugucugcggcgcgggacugcagcucccuacucaacccugcccagcccuugacagcgcuggaucuccagaccuuccgagaauacggccagagcugcuacgacuuccgaaaggcgcaggagaaucuuuuccacccgcgggagucgcuggcgcgccagccacaagugaggcgcuggcaagagccagacccggggccgucgcgcuucugucucucccaggcuagcucgcucucuccauggcugcuggcugcccuucgcacagcccuagucauugcagcccauuaucugccaucaguaggagcaauugggaccuucaaggauuggcccacugaccuauuuagauggagaaagguuguggguggagagguggauaucggaaguuauaggggguggguagaggaguuuuauuauaacgcaguucgacagcuucuacgucagauccagaacuccuaaauuugcuugcacuucuguuuaaaaaaaaaacaaaaacuuuaccccccaccccccaccccuuauagucccuuugacuugcugagaggguuagacuggguagugugcccuaaugcacugugcacaauaccaggcgcgagcccaaacguucccaggcguuccggaacgccugguuuaaggcaggcccguaccucccccccucccccccacgugccuccuauuuuucagucauuuagcguuuuccccuuugccucucugccucucuggauuguuuuguucgggcgcgcgcuucagcacacucccccucucgcucccggccaggugacugccgaaucgcgcuguaaacugcucagcuggcuccugcaaguccaccgccaguucggccucucuuucgagucgcugugucugaccgugaauacucuggaccguuuucuccucacgaccccuguugcugcagacugcuuccagcugcucggggucaccugucugcucaucgcuugcaagcagguaccaccaggcgaaagagugcgauguguuugcagccagcgccccccuuccccaacucgugcauggcuuagggcuggguugcuuggcuuaucugggcagaugcucgaagaucuuuccaugucauagccuuaacuucucuuaccacucacagcaacaauccuuucagacuacaaagagguuaggcuguagcuggccgcccaaccaaagcuuugugguacuugucucuggaaaagaugcuuuuaaagucaaucucucucucucucucucucucucucucucucacacacacacacacacacacacauuuuaaaguuggguuguagauagagaaggugcacuagcagcuguggguggggggagagguuucaggagcggaauuguggaaguggaaggaauauagaguucgagucccaguuuucucccggguuuuaggcuggauggauuugggucccagguacccaccaguccggaacuggagcacacucuguguugcagguagaggugcacccaccucgcuugaaacagcuccuggcccugugcggcggugcguucucccggcagcagcugugcaaccuggagugcaucgugcugcauaagcuccacuucagccugggcgcgcccaccaucaacuucuuccuggagcacuucacucaguggcgcauggaagccggccaggcugaggucaccgaagcucuagaggcucaaacccuggcccggggaguggcggagcugagccuaacggauuacgcguucacuaccuacacgccgucccugauggcuaucugcugccuggcgcuggcugacggauugcugcagcaccagcacgagauggaccugcgccugggagagcacccagaggccacacugcaagacugucugggcaagcugcagacgcuaguguccaucaauagcagcucccugccucgcauucugccuccccagaucugggagaggugcagccugccccagaguuggcaauaaaaagcacccccuugagcuccuuuuuaaaauucccuggucccugcuccgugccuuaaggagaauaugcaguacagauccaaagagaaguugaggucuccuaccuguaaauacuguacaauaacggauucuuuauuuauuuuguaguacacaagggcaggggugacaguucuggcuugucuaaaugcugcuguuggcaugccugacugucugcuuuucccaggcgaaguccaucacgagguagccaauuccggaggcucuucccugcucccacaguuuuacuuuguaguuagcucugugaaaacaaccuggcaagauuuuauaugccacuguuccagaaagcagacaagucaagguggcuuguccguaucuuaacccccuccagucaggaggcugaguucccucccccaugccaguggcccaaggagaaugagacaggguuagaagucagaguggucugugcuguccggaaaggcaguggcugcacuaacugauguggagcugggaagcuuuggggaccgggcagccauacuagcagugggugaagcaagagacagucccuggugcaacacaggaaaugcuggaaugccuuuugcguauuguuauagcuguugcaaccugggucauuuccucugcagcuacacucaugguucaguuuauacugcagcaugagcccaggguaauucugguacggcaguaauaaauauuauacuauuugcaacaua

SEQ ID NO: 7234 - RNA, 3216 nt, Mus musculus
cgacaccccagacuugacgucaucgaggcgcuggccuguggcgggaccgacggaaggagguucccgcuuugauugccgccccgcgggcuuuuuaaagguuacccuggggaauacgcuccaggagcugugggaggagcgagggucucggggguaggagggcagguuugauggguuuagggggacgaggcuagcgguuugggaagucgugguccugcuuagccccugagggggagaggcaaggcguccaggaacagcgcacucacucggagauggaguggaaacugcaacgcaccgcccggaggaagauccggacggaagaagagauguugugggugcguaccauccuuuucuuucuugacccaacccucccauggggcuucuugcagaagguacgguuuguaauacccaguaaggaccaaaagaugccaugaaauucuacagccuaguuuaaauuuugaacggugugaaauuuaaguucuggagauaccugguugcuuuagaaagaaugagugaaucagcaaacccaggauucaaaacaauuccccacucuccgugacgauuuuccuagaguuuucucccuucuuauguuaaucuauuuccaaaggagaacaucaugcgggugcucgccaacggcaugaagcagcagcgaaaucaagguucccccaaggugaguuuucugggcuugcccuucugucuucauucugaucucgagcaaauuaauucuugcuauagaaggcauuugcaggaauuaugggagaauuaauacaaauuaaaaaccuuuacagaaucugaagacuuaagaaauggauucucacaacugauguagcuacuuauaccugcuuagcgggcgcuucccaguguccggcuccacagaggaugaagugugggugugucaggcaggcagugcauugcuagcuggcuguuagaacuuuaucccaacaguugcuagcugcacuacccucugcugcacucagaagcaugcaaagacguggaaauagugccaucugguggauaaggaggugucuucaagacagcuacuaaaagcuggauccaauauaguauuucugccccuuaaagcucuaacccaaagcuugcaguucuuuuuaaaagaguguucuuuugaaacucauuuuuauuaccuuguguuuauuuaccugcacuuauaucugugcaucacgugugugcgugguguccgcggagcucagaagagggcuucugaucgccuggaacuggaguuucaggcuuuugggggccgcccuguugguguugagaaucuaaucuguguucucuggaggagcagccagugcucuuuucagccgcugagccaucucuccagcuccuguacuuucuuuaauggaugaaaaaguuaaauccucaucugacucacaucucuagcaccacuuacuucucuuuacaccaaauagcccacaugcuuuuaaauuuagauuauuagcuaaaaucucaccauuugaauauuuuucuagauaacauacauuuuucuauauucaaucagugacgcuugaaaucaaauauauagcuggccuuuuaaaaugcagugacuaaugucaccuauagagaaauaacauuuaaaagccuuuacauugugucuuuaguuauguuuccugcccaaauuauuuuaucuucuagauacuuuacugccuaauucaauugaacuuuuguuaauucauuuuuacuuugcuaacaucuuuaacuuaacauuaaauuuggaaaacccaaguauaagaauacagaguucuuagucaagcacuuaaugccagcacuugggaggcagaggcagguggaucucccggcuccaggccagccuggucuacacagcaguuccacaucagccagggcuacaaaaaaaaaaaaaaaaaaaaaaaaaaacacaaaaacaaccugucuagaaaaaaauuagccaaucaaccccccacccccaagggggaaaaacaaacaaaacaucaaaaaccacauuuaaaguucuuaaaaguuuuuuuuuuuaaaacauggguauagcuugguaauauaaauuuuguuucuuauaguuuaggagacauuaaacaagguuucucuauaaauccucuucaguuacuaagauuagaguucugggguuggcaagaagguucaguaaaggcacuuacugccaugcuaucccaggaauucacaugguggaaggagaaaacuggcucccucagaguucccuugcucuccguauccacgccaccacacuccagcagcucugcagcagugucuuucuguuagaaacuuagccucagccacuccacagacugugaaaauccgaacuugccagacucggguaggcaguguuguuagcuggcugcguugggucaggccagcagccacagcuacccugccacuuccuucuggcuggguucuucuuguuaaugaggugcgcugucuugccugugugugauggcuuggcaguguauuguuagcugguugaguaugugagcggcaccagcuaacaugcgacugcucuccuauugcacacacaaucaccaccagcaugcauuuacagcucauguaugugcuuugccaugaagagggguacuauuaugauaacagcuauuaguggcuuggggugacacaaggacauauuuauagcagugaaaguacuaaccauuguuacuuuaaaaacucaaguaauauuuucugaguccuagcuugacauuaucaaagcauuuauaaaguuauguguuuguuguuuuaacacaagauuuagaauaaaauggaaagccuuguguauuugcccaaguuuccaacuaaaucaguuucaugauagaguagagcaggucucuccaacuuuauguauacaccaaguggagggagaauuuguguuaacuuucaaaaugacccacacguuaaaacaucuucacuagaaguaucuagacaauuugggauaucuuggggaugugguagggaugggcuuauuuauuuggggagacaacucaguucuuccauuuuguauaaaauauugcaaauauuuuuuacaauaauuggaaggacaugagaucuaguuuauaaagaaagaagaagagcuggccauaaauauuauuuaaaauacuuccucauucuuuggaaggccguuugauucacggaacagagucagaggucauauggugaccucagguggacaucugcaggaaaucaccagaacucacugugguguacuggugacuacuagagacauagaag

SEQ ID NO: 7235 - RNA, 3662 nt, Mus musculus
cuuuauauuuugcaacauucauuguauauuuuauuacagcuagaguuaguuacuccaaaaauggcacccucacaguguuccgggucccauguggugugugcuuuucccacaagguuaauccuagagaaaguuaaguuggacaacagugaaggguauuggugacugaacauucuagauuuuuccuucuggucaauagaaguaauauacuucaucauggguuggccuccaagccucuuucuucccucuauagguaacauuucuaucuuggggacagccauuacaucugaguaguauaguaagauggccuuaaacaucuuuuuuguaccguauguuuuggaaucuaaaaccucuguccuguuguacuggccugacuccacggugguuucauagauccucuuucuuuuuaagaauaauuugcccaaucauuugugauacaugaggucugauggcuucaagggguucuucuggccuccagaacuucacgacuugucccucaggguugaccagauacuuccaaaaauuccaccuuggcuccuucuuggaagaaucuaaaacauucagaauauauuuccaugagugugauuuuauuuuuuguugauaaauuuucaguuuucuuagcauaugcauaagugacaauauuauaaccagguauuaggauuguccuaauaucauuaauaacaagaagaacaaaauaaaacaccacagagagcagaggucagagcuuuaauaaucagacuucauagguagcuguccugaucuagaguugagacaugaaacaaaguuguauaguuuagauguguugaucuaaagacauuuucucuuuuugucugcuauguagcccaagcugcauuugaacuuauguucuucccgacucagccccuugaaugcugggacucacaggugagugccaccaggccuagcaagaccgaacaaauuuaaucuuuaguucuuaauguucauguagcccaggcuggccucaaauucacuacauagcucaggcuaacucugaacucacuauauagccaaagcuaaccuugaacucuuaauucuccaaggcuccaccuaucuaguagugggauucuagguguuugcuaccacaucagucuguuuuuaacauuuuaaauauauaaaauauucuaaaguccuugguaauaggaguguaugaacugaucuuucauauuuaauguacuaagguuucaaauauugcuaugaaugaaauagcugaaaaugguaggggacuugagauaaccacugaaaaacaacaauagucuuuugauaaaucuuaauguaaauguuuucauuuauauaauucgggaucugugucccuaauauugaugaauaugagaaaaagagauguuaacuagggguuggagagauaguucuguggucaagagugagugccgcucuugcagacgaccuggguuggauccccagcacccaugugguggcccacaacugccugugacuccaguuucaggugacuggguacccucuucuggccuccuuggaaaccaggcacacaaguacaaagacauacacgcaggcaaaacacucauauacauaaaaauaaaaauaucucuuaaaaaagauacaucaacuaaaacuaaaaucauuaagucccgauucugugccuagccaagcacgcucagcauucagcuuguucucacagcccccagaggugggcauugcuauccucaauguucuguguaggagacaagugaaggccuaaaguugaugauuuguagcuggucagugguggaggcagaguugauaccuucuuccggaaucuagacuuuaccucuagguucuuacucuccugucuacggucagugagaucucacauacuguuugucgcauuuuugguuauaugaggugaguuagguuccacaagcucccccccuuccccccccccccccccccccgcucccaguaagagcuguagagcuguagagcuauaguguuugacagaguucuuguuagauuuuacuuggaugcuuugcucaagaaagaguuccuguccuaccuuuucuguauaccccagaaauaaaagccacaggguuccuguucauugucuuacaagugcuuuagcuugcuuuaaauagauggccguggaaauagauucccguggcuacuuuaauuauagaggaacccucacaugacuggguuuugaaaauaaguuauuuugcuuuggaucucugcaaaacccuggcaaacugacaggucaaccuugaggauaaugacucagauaaagaggccaccauaaaaguaagcauaaagacauacucaguuaaugaugugcugccaucagguaucccugaagugugcagcauuaguacaaggcagggagacugccccaaagggcaguuagauuacuggagaguugaaguaucugggaaagcaggcauggccacgcuucacauuaggccuucaccaugauggucacaggaguaaaaacauaucaaaguagaauucuuuaccaucccagaagucagaacaucgaguuagaaaguggcaaagggcgagguucuggauccuugacaguuuuaugaaaacuucccaguaaaauaaacgaaauaugagcucuagcccuaaaaguaucuauuuaucuuucucuauaucauucauauguaauguaugaaaugagaagaaugaacaacauugaggcagaguagauauuuaccaacaauaaaucuaaacgcagguucugcuuccggcccuaaaaucuuaaucuuguggaagauggggaaugugacuccguaguucugucucgcaaaagauucuaccuccuugcuggacuugggcuccgauucuccaaacugauugcacggaaaagccaggacguugaagugauagggcccgaacuccuuguguagcucccugagagucugguaacucuugucugugaagcggcagucacuagccacguuuacaaccagggaagccucccggaaaaagaaaaaaagaaaaaaaaaagacccaccggaaagagaagcaaaagauuaaaaaaaaaaucuucauacagcuaaaauccuaagccauuuuggcagacuacgaagucugauagauuccauauuuuuagacagauccaacuuuauugaaaaccauaacccaaaugaauggucgaagacugugacaaaguuuuaguuagguuauguaaagaacacucuuaguagcgggucucaaagcaucuccuagauaauacagcaucguuuccucacaaaagagaagacagcuuucgagaaaaacaguugcuuuguggaguggaaguuuaaagcucuuagaauucugauaacuaaaaggaccacuaacgauauuacuuugaagacuacauuccaacuuauggcugugccgaaccccacucuaugcugagaauaagugucagggccaaggaacaacagaaauaaaagccggaagacuuacuuugccuuugaacuuuuccagagacacgguccuuccuuuggcauccuuuacuucaaaggaguagaagcuguugguucucggcuucaggaauuuuaacugaaggagaaaaagcaucacggugcacagaaccauagagagcaaaacugcaaauaucuuugcuuugggcccggaacauuuuaauggguaggcagcgaaaggcuccauuuuggacgauccugggagucucagcaggcuggaaugca

SEQ ID NO: 7236 - RNA, 3662 nt, Mus musculus
ugcauuccagccugcugagacucccaggaucguccaaaauggagccuuucgcugccuacccauuaaaauguuccgggcccaaagcaaagauauuugcaguuuugcucucuaugguucugugcaccgugaugcuuuuucuccuucaguuaaaauuccugaagccgagaaccaacagcuucuacuccuuugaaguaaaggaugccaaaggaaggaccgugucucuggaaaaguucaaaggcaaaguaagucuuccggcuuuuauuucuguuguuccuuggcccugacacuuauucucagcauagagugggguucggcacagccauaaguuggaauguagucuucaaaguaauaucguuagugguccuuuuaguuaucagaauucuaagagcuuuaaacuuccacuccacaaagcaacuguuuuucucgaaagcugucuucucuuuugugaggaaacgaugcuguauuaucuaggagaugcuuugagacccgcuacuaagaguguucuuuacauaaccuaacuaaaacuuugucacagucuucgaccauucauuuggguuaugguuuucaauaaaguuggaucugucuaaaaauauggaaucuaucagacuucguagucugccaaaauggcuuaggauuuuagcuguaugaagauuuuuuuuuuaaucuuuugcuucucuuuccggugggucuuuuuuuuuucuuuuuuucuuuuuccgggaggcuucccugguuguaaacguggcuagugacugccgcuucacagacaagaguuaccagacucucagggagcuacacaaggaguucgggcccuaucacuucaacguccuggcuuuuccgugcaaucaguuuggagaaucggagcccaaguccagcaaggagguagaaucuuuugcgagacagaacuacggagucacauuccccaucuuccacaagauuaagauuuuagggccggaagcagaaccugcguuuagauuuauuguugguaaauaucuacucugccucaauguuguucauucuucucauuucauacauuacauaugaaugauauagagaaagauaaauagauacuuuuagggcuagagcucauauuucguuuauuuuacugggaaguuuucauaaaacugucaaggauccagaaccucgcccuuugccacuuucuaacucgauguucugacuucugggaugguaaagaauucuacuuugauauguuuuuacuccugugaccaucauggugaaggccuaaugugaagcguggccaugccugcuuucccagauacuucaacucuccaguaaucuaacugcccuuuggggcagucucccugccuuguacuaaugcugcacacuucagggauaccugauggcagcacaucauuaacugaguaugucuuuaugcuuacuuuuaugguggccucuuuaucugagucauuauccucaagguugaccugucaguuugccaggguuuugcagagauccaaagcaaaauaacuuauuuucaaaacccagucaugugaggguuccucuauaauuaaaguagccacgggaaucuauuuccacggccaucuauuuaaagcaagcuaaagcacuuguaagacaaugaacaggaacccuguggcuuuuauuucugggguauacagaaaagguaggacaggaacucuuucuugagcaaagcauccaaguaaaaucuaacaagaacucugucaaacacuauagcucuacagcucuacagcucuuacugggagcggggggggggggggggggggaagggggggagcuuguggaaccuaacucaccucauauaaccaaaaaugcgacaaacaguaugugagaucucacugaccguagacaggagaguaagaaccuagagguaaagucuagauuccggaagaagguaucaacucugccuccaccacugaccagcuacaaaucaucaacuuuaggccuucacuugucuccuacacagaacauugaggauagcaaugcccaccucugggggcugugagaacaagcugaaugcugagcgugcuuggcuaggcacagaaucgggacuuaaugauuuuaguuuuaguugauguaucuuuuuuaagagauauuuuuauuuuuauguauaugaguguuuugccugcguguaugucuuuguacuugugugccugguuuccaaggaggccagaagaggguacccagucaccugaaacuggagucacaggcaguugugggccaccacaugggugcuggggauccaacccaggucgucugcaagagcggcacucacucuugaccacagaacuaucucuccaaccccuaguuaacaucucuuuuucucauauucaucaauauuagggacacagaucccgaauuauauaaaugaaaacauuuacauuaagauuuaucaaaagacuauuguuguuuuucagugguuaucucaaguccccuaccauuuucagcuauuucauucauagcaauauuugaaaccuuaguacauuaaauaugaaagaucaguucauacacuccuauuaccaaggacuuuagaauauuuuauauauuuaaaauguuaaaaacagacugaugugguagcaaacaccuagaaucccacuacuagauagguggagccuuggagaauuaagaguucaagguuagcuuuggcuauauagugaguucagaguuagccugagcuauguagugaauuugaggccagccugggcuacaugaacauuaagaacuaaagauuaaauuuguucggucuugcuaggccugguggcacucaccugugagucccagcauucaaggggcugagucgggaagaacauaaguucaaaugcagcuugggcuacauagcagacaaaaagagaaaaugucuuuagaucaacacaucuaaacuauacaacuuuguuucaugucucaacucuagaucaggacagcuaccuaugaagucugauuauuaaagcucugaccucugcucucugugguguuuuauuuuguucuucuuguuauuaaugauauuaggacaauccuaauaccugguuauaauauugucacuuaugcauaugcuaagaaaacugaaaauuuaucaacaaaaaauaaaaucacacucauggaaauauauucugaauguuuuagauucuuccaagaaggagccaagguggaauuuuuggaaguaucuggucaacccugagggacaagucgugaaguucuggaggccagaagaaccccuugaagccaucagaccucauguaucacaaaugauugggcaaauuauucuuaaaaagaaagaggaucuaugaaaccaccguggagucaggccaguacaacaggacagagguuuuagauuccaaaacauacgguacaaaaaagauguuuaaggccaucuuacuauacuacucagauguaauggcuguccccaagauagaaauguuaccuauagagggaagaaagaggcuuggaggccaacccaugaugaaguauauuacuucuauugaccagaaggaaaaaucuagaauguucagucaccaauacccuucacuguuguccaacuuaacuuucucuaggauuaaccuugugggaaaagcacacaccacaugggacccggaacacugugagggugccauuuuuggaguaacuaacucuagcuguaauaaaauauacaaugaauguugcaaaauauaaag

SEQ ID NO: 7237 - RNA, 63183 nt, Mus musculus
uaugcacucugucacuacuaugccaccucaguucauagccagagggacuuuggugucucugccagguuuccugggccccaccugucgacagcgacauucauccauuaucaucucaguugagggugguucagagucaacucccucccagggucacuaucuaaggccacuuuuacuaccaguuagguucccugggaagcuaagccacaguugaaacuuaacacgcaagagguuuauuagagggagccccgaaccagcccccgcagacagcaaggugccagacuuguggggaugagggauuugagcugcuucugcaccagggagaaccuuggcagcuccuuuagaggguucuaacgaagaagagaccucucagagcugucccgggguggguaagagaaagcuaagcuuuuguauggaaugcugggucuguggagcacccuagggagcaggaguggccuuuggggaggcagcuuucuucagcagggucagucuaugaagaggaaggauauaaugcauaggcauugcguaguacauguccugacuugugcuuuucuuccccguagcaucuuuuuauggggaaagcuacguggggcucagcaccaccgagguuuucccugagcugucgcuucaguuaagauuucaaaccagcaagccacaaggcuuacucuuccuugcagccgggaaaaccgacuauugccugauagaacuucugucaggaauauuacagguaugcuuuugaaaaaaaaaaucuuuaaaauauguaagcauucgguuccuagagaacaccaagcaacagaaagagaacaaacuggaauaauuuguagaauaagaugacacguacguagggugggauugucucugguuuuucuagcaugucuuaaauauuaccugcuuucuaacaacccccucuuauguuccaguccauucuguaagggaacccacucucuggaaggucauugcauuaaccccucuaaacaaccuaauggcuucuuuggggccucagcaccucucgaccugcuggguuggggauugaagccucaacuaugaguuuuaguaggggucaguccauagcaaccccuuccccaagagcacagggaugaacaucuugaugggugucauuaauuauggcucuggucucuuucaggugaaaauaaacauggguacggggcaagaaauccuccuuucugagcaaagacuucguguggacgauuuggcuuggcauucguuggagcugcgcuauggcaaggaugcuguucucuuggucauugacaagcacuuugagacaaccguccggcuggcgggugggcugcguaacuucaccuuucaccauggaaucuauauaggaggccguggggggcucagugucccuuaccuggacaggaagauccccaacuuccggggaugcauggaggauguggcguuuaaccagagggagauccuuacgucccuuaggucauacccuggcuuuaagaaggugucugaggugucgcugggguguaacgaugaguuuuuugcugggaaggaugaagcuauuagcuuuuucagcucuagguccuauguuaccuuuccagaauggaagguacacggggaaggguuccugagauuugcugugcaaacuggaacccugcaggcuuugcuuuuauuucaguccggcagaggaagagauuuuguugccuuggaaauccaugagggucuacugaaggcucacguaggaaggggcggaacaaaaacucaacucucuucauucagcuugguuagugacaacaaguggcacguuguucagcuuaaagucaccgggaggcacguggacaucaugguggaugaacacagggaaagggcggggcugccucugcaaagccaagcguuuguauccgaaggcccccuguucauggguggccuggaugaccggaugugggaaacugugcgcggcuuagaaguugugucuaugccugggaaaucuguucgagguaugucucugaaaggaugccugcgagccuuagaagccaauuuggaaaagagagcauuacgggaugcucuugucuccagagacauuucggcugggugcacaagugagggucuccgugguacagauccuucuguggcaggggaagaccuguuuccaccagagccauccucucccacgaccauucccaguucuccucugaaaauucaaaguggcagcuuuuugguuuugaauaaguuagaaguccaagaagguggacgggccuuacugggacaaaggcauauagaaguagauguggacuuuauggaucuggguaucaauucuucucagauacuguuuaagauacaggaaaugccagcucauggguuccuucaaauagaugcuuggccugcacaggaaauggagaggacuuuuacucugucagauuugaggcaugggaaagugugguauguccacgaugguucagaagagccuacagauucguuuacguuuugggcuuuuucuaguagcaagcaggcacugcugucccagcugcaggcuccuguuccacauguguuuaacauuacuguccuuccagugaaugaccccccauaucuuaagcuuccagaaggacaccugcuucucuuugagaacacuaagcaacgacuaacacccagggugauacagguguuagaucccgacaccgauucucggcggcucagguuuucuguucuuaacaacuucaauucagaggcuggguuuuuagaaaaugccagggagcccgggagagccaucacugguuuuacagacauggauuuacaagauggcaacauuuucuaugugcacagggguccucgaaacucucgaguugcucuaagagcaacugauggugagcugguuagcaauacugugguguugcgggucauggcugucccuugggacuuugaaguggcugauaggacuggcguggugguaccacaaggugguaccauucucaucacucggaacaacuugucugugaaggugaaugguggacaacaugagcuggacacucucuaugacaucacacauccaccucaguuuggccaaauucagcaccggggauccaacggagaguggaaaccaguuaggaccuuuucucaacguuccauugaccagagucagauccgauacuauaguucauucaagggauugcagcaagaaaaugugacggaucacuuuaaguuuagaguuaacauagagggaagaguaggcagagagcuccuguucccugugacugugcaguggcugcaguugacacuucugaaaaauauuccucuagagauuagcaacgcaaacaagaaaguauuggauucuggccaucugcaggcugcagcagggaguguggcagcaccugagaggggacuccauuucaagcuacugauuccaccuaagagaggaagacugcuacuuggcaauaaaguucuuaaauccgguucaauguucagucaaaaaaacauugcagacucuaaggugagcuaugaaccucaggggaugccugggcaagacucacaggauucuuuuaguuucucaauuguuguaaaacagguagaaucuaaagaucacaccuuuaggauagaccuuaaagcagauaagacacaugucacuauaaccaacacuggacuguauguuaaagagggggaaaggacaauaauuacaaaaucagaauuauuuguucaaacacuggauaaucaugucuuccaauauaaagucaccaagaguccucagcauggggaacugaaauuggucagcucgucugcuucucugggaagugacaauagggccacuggauucacagacgaagacauagugagugggaggcuggucuauguucaugaugacucugaggcccagugggaugaauucauccuucuggccucugccacaggucugggccaacagggaggggucagaagucuugacucugagcacacgucuacagagaucaaagucagcguuucuguugaguugaagaaugaugagaagccggugcgugugguggauaagaucuuucacguugugcgggacagccagcgcuuacugacacuagcagaucucuguuaccaugaccccgacauagauuuugacgauggccaguugcucuacacucggcauggcauacccaauggagauuuggugaaagcugcugacccaauucggaagcucuaccaguucagacaagaggaccuacgggaagggcgugugcucuucaggcaccacgguccagauuucgcucgguuccugauuuuugugacagaugguguccauuacacaucaucccuuuucgaggucagugugucagaggccuauguccgcauagucaacaacacagggcugcuugugcacagagggagggacagcuuucuaacaacagccaaccugagcgucaccacaaaccaagaugucagaacagaccaugaguuugaauuccacaucgugcaacccccaaaacauggcagacuccuggucaacaauucuaccuuucacucauuuucccagcaugaccuaaagcagggacgugugauuuauagguaugacggggauggcaaccucgauaucuuuaaccugacagugaaaguuaaagaugccuaccuagaugugagcaucaggguccaagugucgucagaaggucgccaacguuccacuccgauucugcacagcaggagccuuauaguugaagaaggaaaaccaguaaaacugagcagaggaaagcuccagguaagugauagccaaagccuugagcuuucuuacuggcuuagacuaguaggggcuuauaauccauuuguuugcuucugagagcacccucucugugucucugugucucugucucucucugucucccugucucucucacuguguuucaugguacuggguauacuucuaauguaugugcaugugcacacacuuaugugcauaucuaugugccacugagaugaaagguugggagguuuucaguuugaaucuaccaguuuucugacgguugggaauaaaaucugcacaauguucagccuuauuuuaaagccguguuuacauacacagucaugugugugcccguguguagugcaguaugaacuaggacuuagggagggacguuuauauuaugauaaauuaagagcucuuuauuuugauuugcuaacaguagcgccagcaacguuucauuugacacggguuagucuaugaugggaaaaaguauuagcagacguaaaaaggauuccccaaacaacggaggacagcauuguguggucucuuucuugacgucuggauguggccuuggauaggauggauaaaaccgaucuugaccaguagaguaaugccaggguuagagcagagccacacauuuuccuccagcuucuucuaccuugaaacauaguccuguggauccguguaaccaggcucaguuuuggggggaauuuccuccaggguauaggaugugcaagcuguacuuuuugacggcugcccacccaugcaggcuguucugccuuugccguagggacuugaggcaggcuuccaagugcaaccggucacaucagagcugaguuugagcuagagucagguuggugaauagcgagucuucccuaagggaauagaaggcaccagagucucacaauucuuuuccaagcuuacagaauucgugcauuucaccacaagguggcguguucagccuugugaugaaaugaguugcaaauaggguucggggauggucuuugcugaaucaauacaaugaaaacucauaggaagugcugagcuagugaggguagagcuaaaaaaggaaagagcccuuuccucuacaguugggagauguugcugagucaacuguucuuucuucugccaccuuugauucuuuauaaucuuuccaccauggugcuaaggaucaaauucauggcccuguaaacacuagaugcaaggcaaaccuccagcccucuccuuauuuaauuuuuuuuccaucuaaauuuuuagacuauucaggguuuuuagugcugugugcagguacuucauaacuguugacuauuaauuuuuuaauauuuauuuauuuuugugaccagagcugauauuccaaauauuggcauggaucagaccugacuuugaacugcgugacaacccugcuuguaacuuaagccacuuguugauguuaagugaagucuugugguucgucaacggcuuugauugccucuuacaguucuucauaugcuuuuuuuuucuugugugucugugugcuauguuggggaacacaaggcugggaaugaagaagauauuccuucagaggcaguguucacagucagaacuccacccguacacggauaccuccaaauauccacagcagaagacggcaucgcgggugcagaugugaugcccacucugaacuucacccagcaagauguugaugauggccauguccucuauguccagacagcucccggccagcaaaaggaccaguucacccucgaugugacaaaggacucccggguuauaaggagaguggaggugcucuuggagcccauccccaaguggauuccucucaaggugcagaaucucacaguucaagaagggggcuccaagguacuucugcaggaucaccuccaaauugcaagcaaguauuuggagggucuugacugugaauucauucuccucgaaccgccaaagcacgguuaugucgaaagcuccaaguuuccaagagugaagcuaaugaaauuuuccaggagagagguaauacaucucagcugauauguuugagcugugccagagggggggcuggcuagaacugacucuguaucauuuagacucacaggcucugucagugaugcgauuuuagaguccaacuucccacaagaugcuaguaucgccugugucccuguagaaacuguguuaacauuguuuaaaaaucuucagugauggacuauucaugacuucuugagaggacccuuuguaguuaaaagcacuuuaacauuucuuuucacugaccugaauuuagaaauuucuauuagauccugccucucuugagggauuacccccgaagcaaaccaucccucgccucauagacccuuuaauaguugaaagaggaguugucagaugcccuugaacuuugucuuuuuuguuacauucuccuagucuucugacuugccuguacacccggaauugauuugcauccugacugaccaccucuacaugagcgccuggucccucucauugaucccaggaacacucaucuuuuagcgaacauuuuucauucaugucuccauucauccaaucaccacauguuuguacuguauucuaaacauggaccacggguguccagaguggcucagucccaguaaucccaaacuggauacaacugguccucuggcauccagaugagagcggaugaaaauaaccaaagucaccucaagguugcuaucugguucuuuucuuggucuuauuauuaagacuuugguuucuuaucaugagucaaugaaugauuucccauuuguuuuugaacuuugaaaauugaccuacagauuuccuuggcaauauagacucucuggguuggaaaccacaaacaaccucccaccaucuuugccugccuuugccucuccuucuaaaaacacauguauguugcuucauuuugucuuuaagaauucgaaguuagggacugaagaguuggcucagcaguuaagugcacugauuacucuuccaggggacccagguucaauucccaacauccacauggugacucacaaccaucugccaguccaguuaaaggacauggccaucaggcaugcaagugguacacaagacguauguacaggcaaaacacccaaauguacaauuaaauacaaaucugaaaauccaagucaugggauuuuuaauggauccaaauccaguuucuaaaggcuuguuccauuugaguuacugugcguuaccaugguaacugaaacauuuccuugccucaggaaaugccauggaggagccagacauuucaucuuuaaugaggaugcucucuucuugucucucauguuguauuucacgguaguguuguaggagagcagaauugacaaauccaauucuaauuggagagcaaggagaagacauaagugauucuuugcaaagggacaauguuuaguguagacuuugaugaguuagauaaagagugcagaagaaacagauuaggaaccagaaaaaggcagcgcaaguuaaaggagcagccuagccaagaauguggaggccugagagaugggggccauguggguagcugaggaguacuccacaggcugaggagggcaaagguuguuugaagcuacauuuggaggguugcuaccucugucuacaccaacugucagggaggcuagacaggugccaucaggacgccaugaaggaugcagaggguaagaaagcagcaagcagcucccccugugucccagagaaggugacuguuuauccacauuaugagugguucuuugcuucggucuuaugcuuuggucagccauggcuucucucucaaaggcuggaaagcccagcauuggcagccuucuucugcuuugguguaaguucaaucaaaugcccuuuauaccauguaccgaguccugccucagucaagucagugacugacuggcuucauaagaauauuguugguugaacucuguguguggauacauauguucccuggggcaucuguguuauugagcagccuguuuauagacacguggcaaggucacaugaacuuguuugccaagugauuccuuauacuuucuuuaucucucucccucucucucccucucucucccucucucucucucucucucucucucucucuauauauauauauauauauguauauauauauauauauaaugccuguagucuccagguuuugagauguugucauuuuuacuuaaagugacacaaaucccaugugucuauagccuucagugucuuagaggaaagucccuggguucauuuguuaaauaaguuugggagugucuugugucagaguuucuagacccaggugauggagagaaaguggugagcuaaucagacccucccccucaucugugugaaguuuucuccccagguuugagaaagagggaggcagagagacaagaaacaugugaaauccauaacauguugagugaagauuaguaguauaggaaaaaauaaguacaccagaaaagcagauaucuuacugacuuuugaaagguaggaaugcacacacccuuucucagcuuucagucauuaucaugaacugguaugugaguuuuggaacgaacuccucauuaaaggcuaugugauuuggcagaagggaugcauuucuccaggaaaagugucccagaagugagugcuguccacgucccuacagugcucucccucuugaggucucucaucuguggccagucccucuccuugugugcucacaaguagcuuaacacagcauauuucaggaaugugagguuaggccuguuaucuggaaucuucuacccauggaacuccaaagaaacucucauagcaccuguguaugaguggcugugauuuucccuugagacccuaucuaaacuuuucaacccuugucagaaauaccccuguaagaucaaaagacuucgcuuaaaggaagugcgcuacaggaaugggcaaagcugaacugcuaaaaaguuuuggcuaaauuuugucaaaacaaacacagccccagagacuuguucugaauuccagaaacuccuuugggguauugggaguucucaccauuguguuugggucacggacucauugaagcuaaauucccauucggcuugaguguccucuggucugaacccugcucaccaguguuuccaguacagucaagaggaaaggaauuugaucagaauuuuggugucuaugaaucaaagagaaauaacuaaaucauccaguggcuguuucagaauugaaauuaaauagauggaaucuaaccgggauaaaacugaauauuugcauuugcuuuauuaccaugaaacaguucuuccaugguggaauaauuugauuguaaugcauucuguccacaggagauguauauuagcguuaaagacacacaauuuauuaugaaggcgagggaacgagauucggagguagcaggcuauccuaguuacauuucuguugcuaugauaaaauacccugacaaaaagugauuggcagagaaagggguuuguuuccauauacaauuccagguuagaguccgucauagcaggagagccacaguggcaggaaguuauaucacauacauaaucaagagcagaaauaaauaaauacaugcauguugcuagcuuacuugccugugcuuagcuuugcuucucaacucuuaaauaguccaggacccugugcauagggaauggugcuacccacaguggguugggucuuccuacaucaguaaacuuaauugagaccaccucagagauaugcccaaaggccaacccaauggagacaauccaucacugacacucccuuucaggguaaauccaggcugugucaaguuaauuaaaccucacaaucacacauaaccucagacacagagaacaauuaaggaaucagugccuucuuaguucaaaaaaauaugcucaggugaacuuaguugcccugauccguauauguuuccaaggaagagaaaugaaaccucagaggagccuaaaucuaaccauucaaauugucaaauaaaaccaucaaaaccuucauaacuuagucacuuucaguagaacuugacacuuuauuuuguugccccauuaguaggaaggcuggguuaugcacgcucaguacucguuacuguuagaggugggauuuaaacucacgaauucugcuaccaacccggcauucucguuacuacaccacauugcguuuuuuuuuuuuuuuuuucccuuaaaccuauuccuagggugaagugguguuucacugauuucuagggugaagugugaugcuauccaucacagcuccucucaggcuucgugggaugaagacaugcuucugugcuuuagggauucuuaagcuguuuuuuuauuuuuauuuauuuauauuuauuugcagucccgucacgguuugggcuggaguuucagcuggcuggugcuuuuguugguuuugguuucagguggcgcaggaguugauuuacuauguucaugacggcagugaggaguuucucgacagccucaccauccuggcgaacagcucugagcuuggcaagcagaguccaccucagacccuguuugugacuguugagucugugaacgacgaggcuccaguaguaacagccaauaacauccuccaggugagggccccaugguuuugauuugacauaagaacuucagggcaaauaaauggguucuuauuuauaucauugcuauuguaaaacagcaaggcacauguauggccauggacauaugguagugugucuccacuacggcgaagaauuauuagcuauacuugccaauauccucuuggauacuguuggcaggcaauacuuucuguauuucuuuuuacuugucuuuuuuuuuuuuaacacuuauucauuugacucugugugugugugugugugugugugugugugguguuuacauauauacauacaguaugguacauuuguggagguuagagaacaacuugugggagcuacuuuucuccuuuuaccagguagguuucaggaaucuagcucaagucaucgagucaucaggcuugguggcaagugccugcugagccaucuuacuggccugguuuucugaauuucuugagcuggugccacucacagcguucuugcugagacauggucuucuugugguagguuagggaggugucugcacacggccaggucucccuaggcugguaacacagugguuaagagaguaagguuugcaggagcuauauaugauaagaguccugacuccacuguuggaugugugacccugugucuuaguugugugaauugcuaugaacagacaccauggcagcucuuauaaaagaacauuuuaauuggggcuggcuuauaauuuagagauuuagucccuuagugucauggcaggaagcaugguggcauacaggcagacauggugcuggagauggaacugggaguuuuacaucuuuaucugaacguagcaggaagugacugugauccaugagacccagcuugaggcucugagaucucaaaguucuccccuaguaaugcguucccuccaacaaagccacaccuacuccaacaagaaccuuugggggugccuuuuuauucaaacuaccauaugcuacucccuggcccccauagacuuguagccauaucauaauacaaaaugcauuuuauccaacuucuaaaaguccucauagucuauaacaguaucaagcuuguguaaagauucaaagucucuucugagacgcauggaaucucuuaacuguaauucucuguaaaaucaaaauggaaaaaaaagcagauugcaugcuuccaauaucacaggauauuaaauuaccauuccaaaacagaugaaagagagcauagugagaaaacacugacccacaacaaaaccaaaacccagcugggcaaacuccaaacucugcaucuccacggcugaggucaaaauguucuucauaccuucaacuccuuucagcuuuguuaacagcaacacacuucuuucucuugggcugguuccacuuucuguuauuagcuuuccuuggcagccaucacacagcucugguaucuccaacaucuuagagucuccaaggcaauccaggcuucaccuuuacagcuucacacgguggccucucuaggccuccaugcaaagacacccaugacacagaccuggccucaguagcuuuccuuaaucuuggagaaagauuccauaacuucguuuaguaaccagacuuuuggcuacuuuguggguuccugaugcuguaaauuguuaacccacucuaaacucccagagggugugugcuccuacucuccaccugcccaaauguuuuagauucaugaaugaaagacacacacacauacacacacacacacacacacacacacacccugucauggcuaacacacuccccuccaauauuccugaguuaauacuuacuaaaucuguauuuuaucuuugcugcccuggacccugcugggcagccuccuggggcugcuuuccucuugcaccuacauuucagccaucuuacccuucugcacuuuccuggcaugguccaccuccccuuguuauagccgaauccccuaugccucuccuugguuucuugccagggaauccaaaaguccugccuucaucucccugcccagccaccggcagcuggcaacuuuauuucccaaucagagccaacuggggacaaggacccucagcguagauguguggguuccuguaugauauugggaaccaaauuaacacaaauagcauuagagccaaucccuaacagguuucuuuuucuuccacccuucuccaucccucuucuuauucccuuucaauguccuaacacuagguaggauagaaaaaaaggauagaaggaaaagagggcaaagauauaaguagacuacuuccugcucauuaggggugucaaguuccuuggggcaaauuugaucuucccauuagcauaucuaauuucuuccuugcuuugcacacaauugugugauaaacugcgaucaacagcacccaguuaccaaccagccccuuguauuggggcucuagcauuuauauauccucugaaaagcccccagaauuccaaaugucacacacuugcagaaucuaucugcagcuggaggagcuauuccccuauuaaagcauggggcaaaucacagucaccugcugugaagcagccccauauccccauaccagggauucaaacaaaaacauauucccauaauauuucugugcuuuaguuuucgaagaaaucaaaauucucauuauuccuuucuucuacucuugacucuaaagccagaaccuuguggccaaagcuuccaaguucugcuacuugcucauucuggaacucaauuacaugcucaccaucuuucuguuuuuuguuaguauccuuaacugccuaaacuuggcuguccuggaacucacucuguagaccagacucaucucaaaaucaagcugccucugccuccccagugcugggauuaagggugugugucagcauaccagaccugaagccauucucuaauuccuuuucacaaguuggaagcuuaacugggccuugcccugggucacucccuuuauuccauuuaacagcagucuuuucuguauucuguuuaucuccuugaacacaggauuuagguucauuccacuuccuggugccccuuuuuuccuugaacugcacacuguauuuucccuagcuuagcuugcuccuuuucaguauagaucuuuauuagacugaacaccaguaaccacacaacaaagucaauacaaggcugucuugaaauuuccccugccaacacaaauaaucuaauacucuucaaauuagcuuuaagcagacuuuucagacaaggguaaaaagcauuuuuuuccccaaauauuaccagaauagucucuaggccacauacuaguauucuuuuccucagaaaccucuuaaaccagacccauaguucaaaucaugaagucuuccauguuuuuacuuaggauggccccauuaaucccacuuaaagcauccaacugcuuuucuaagccaaagucccaaggcccacauuccuccaaacaaaagcauagucggauuuaucacagcaauaccaaagucucugguaccaacaucugccuuuuuuuguuuuguuuuguuuuguuuuuucgagacaggguuucucuguauagcucuggcugucguggaacucacucuguagaccaggcuggccucgaacucagaaauccaccugccucugccucccaagugcugggauuaaaggcaugcgccaccaccacccggcccaacuucugucuuaauuaggguuuuauuguuguaaggagacaccaugaccacaacaacucuuauaaaggaaaacauuucauugaggauggcuuacaguuucagagguuuagucuauuaucaucauggcaggaaacacgaugcuaugcagguacacaugguguuagagaaagagcugaguucuacuucaacaaucaagaugaguucuacaucuugauaugaaaggcagcaauaaaagagaauaaaccacugggccuuccugagcuucugaagcccuacagccuacccccaaugacauacuuucuccaacagagccaccccuacuccaacaaggccacacuuccuaauagugccacucccuaugaaccuaucauuuucauucaaaacacaauauaccacucucucaagacucagagauucucccagauuugauuuuccagauaugacaggacaggugcacauaugaccucagcaauuguggcagcuugcauaaggcuuuugaaagcuccagccagacaaaaucccaauauacauagggaaggcagacuuguaauccugugauuaacugaagaacuaucaacguuuaauagcuauugggaggagaguuaguuuucuuuaaugauugcaguuucuccuuuuaaaacggagccuccaugucuugguuaggaagugaauacuuggggagaaaugagaauccugguuagggguuugcugugaguucgguugacuucugcugcaagaaucuucacacuaacugugugcuuuuuuuggggaggaauuuuagacaucuacuauuuuuaauuuaaaggauguuguucuuuggugucuaaauggugucggaguucucagggccuugcucaugcuagccaaguacuucagcuuauuuuuuaagcaguaaguuucuagcccaacaugccaugaaaugcuauagcauaucagcauuuaugaacaaccguugaagcaaacaggaaaggcccuuuguugacagugguggccagauaagugacagagaagaacagggagaaaggaguaaccauagaauaggaagcaguaaaccgugcccucaguuuaugaagcauuccaggagcaguuaguccagugugcaggcagcccgggggcccaccgugggcugggcuagguagccaggcuugcauugcuaacagggggcagcggguccagggaauaggcuuuuuagagcuuugcuuauuuuacagcuuggugaguuauucaccucugcguuucaugaggaaagugcuucugccuuuggaacgugugagucugagcuuucuuugcaggcuuuacccggcucuccuggaacaucgugcacuggguggcuguacuggcugguuuugugugucaacuugacacagcuggaguuaucacagagaaaggagcuucaguugaggaaaugccucuaugagauccagcuguaaggcauuuucucaauuagugaucaagggggaaaggccccuugugggugggaccaucucugggcugguagucuugguucuauaagacagcaggcugagcaagccaggggaagcaagccaguaaggaacaucccuccauggccucugcuuucugaccugcuugaguuccaguccugacuuccuuggugaugaacagcaguauggaaguauaagcuaaauaaaccuuuuccuccccaacuugcuucuuggucaugauguuugugcaggaauagagacccugacuaagaguggccaagacucuagacacccuguggucaguuacaguucucccccuccccuaugugggcucuucucuagcaguucccacagagguugcuuugcagagucaucugagaaagaaguuguggcugucaguggugguuaaacacugcuaucaaaguuugcaugcauuguauguucccuguguccuggucccuucuguaaacguugucuucauggcccccugaaggagcagaagagugaccuugaagccgagucucucuccaccauucagaugcccucuccaccauucaggauggcucugcucagagggugaggacauugcagaaagggaagcucucuccaagggcaggacuuuuucguggaggcacguguguuaggggaaccaaggccucuccuagguggcauuggcauaccuuggcuaagauuucuuuggaggaaacaaacaauacagagucagcaaagggaggcagcgcuuggguggagcccagugguaacugggucagcucucgagugcuuucccagugaagucaagagucaguuggcccagugaguaacaacaugugacaacaugagacaacacaugcaaagcagauucuaucacgaagcucauuaguugcugaguggucaagcuaucuucagggacucgucagguaggcaagcacucucugccugguaaaaauccaaaucccagacucccagaaaagcaggaguccaucacagaccacgugacacuaacaguuuagacauggugagccccaguuaucauuuggggaguauuuugagccaggguagcaaacugguuaaucggcuguucauuccugugaacucuuacgagcaaagauagggcucguguacuuggauaacccaucuguaugcauaugaggggaaagagucuuccuggccaaggaauauuccagaacaaauauaaucaaucugaaguaagccuggcaugaaaaccccagagcggugggugggaggaaaagaauaauaaauauuagcuccguguugagaguugauuucugagcauaaggaucccucagcaugacgcagguuuguucuuuugguuuccagagauacuaguagguggcagccagcauuucugagccacaccccuccaucccucacgagucaggcgcagcuauaaauguaccacuuaacugaugaaaugauuccucauuuaauccuuuucaugauucuuguaaucaaaggaggguugcaauaaauauuugaggcaaggaaaauuuaaggcacuugacaaaugacaaaguuagcaaaaguaggauuugagccuggguggucugagcucagaguccacaccugcuacccauagugggaaugaucaggagguuauagguccuaugguaccaaaacaauauuuuaaaaucauguuaagugaaauagaauguguaauaccaaauuaucuugugucuaacacacacacauacacaccccacauggacaguauguaaaauguguuaauuacuuuggcuaauugaaaggcacugcaagccaugaaacuaacaaagcuagauguuuauauauauggaaaaaugcccccuccauuacucuuacuguuucuggaaauguguggucugucuguaauauguacaugggcauuugugaggguguacacuuguauauagaauucuguaugaaguucagcauuggguauucuucauccacauauccuccaccucuuuuuuuuuuuuuuuuuuuuuuugggcagucuuucacugaccugaagcucacacuuggucuagccugucucccuggccaggcuagggagccuauaaacuaggaauuccuuugucuuucccccuccgauguugggauuacaggcacaugccagacaaacuuggcuuuguaugugggugcuggagauugucgaaguccuccagcuuguguggcaugcacuucacugacugagccauugucucucccggaaacaugaccuuuuaugaguugagucaaguucuaggaguucaucuguugaaagugcuaaauccugaacucccagaaacugauaccauagggugauaaugaagccacuagguaccugcuauaauaacugcacccuccgcaccuaauacugccagaguucuuuacuacauuaagagucgucucacuuccaggcagggaagucugcuuguuguccucaucuuugaagucuccuaaugacuguucaauguccuagcucugccagacuaauuaaccccgccugcucauugcccguucacacaggcuugcccuucccagcuagaaaguaggcugggauggggaacaguacguaucugcuuucaaaccuggccaucucacuuuauggauugugguggucauucaaagucauggucaugauggaagaaaaauaacaaaugacaaggauuuaaacauuggaaguaaaggggguaaaguugaggggacacacacacauacacacacacaaacacacacacugagagagagagagagagagagagagagagagagagagagagagagauugccuaaaggucuucgaacaauguagucuugugcauugaaauuuugaagcacaaugauaauaucuauuaucaaucucaacuuaauuucaaauagaaaaagagccaagcagcagccaggaauuagccuucgucucuuagaaagucugcucuaggcaguucacaggauccaagauaugcuauuaguuucugcccccaguuaucuuuguuuucaagcuauuucucccuuucccaccagaguggcuggcaaugauggcaaauuagcauggaacagcuaagcgcauugaccacacugcagggagugucaugaaucaacucccaauaauauuaaaggauuaucaggucuguccauuuuucuggaugugaauguggacagcauaugcacuuaguuaaagccacggcuaacugagcacacugucuaguagcagauguguggguaguuccucucaaauguagggaucauuucugacagcagcauuucuucucuuuauuucagagcaauugguugaugaagauaaugaccacuuucuggucacacgguagcuaauacugcugaaauguuuauucugugccugguauugggcucagccugugacacaagccuucaacaacucuguaggguaucguuuuuauuugaaaaaaggggaaaacuauagcacaggagacucuuggcuaagauugcaagagagacagacuggcugacagacagacagagccucggggauauagcagaguuaaggugugaacuugugaucacaaugaagcacuacugcuuucuccugcacaguuacaguauaggaacccaagaaccuggaggaaguaugagcuucccacagaguuaaggguaggggugaaguaaagggcugggguguggcuuggagguaagcuacuucuauaaugagcauggucugggcuggagagacuaguggugggaugugugauaugggcaguagauaugacuagcccaaauaacaacauuaagcagagagagaaucugggacagaggcaaaaugugacuuccacaaggccuucagauuuauggguuuuuaaaaucacauugauuuauuugggauauacgguaaagggaccacacacacacacacacacacacacacacacaccauacacaaguauugaugucagaagacaacuugcaaagaguugguuuccccuucgacuaugcaggucccaggggcacacucagacccucagguugguagcagguaccuuuuccugacccagauuucauguucucuccaaucugcauuuuauuaaagcuuucaggugaccuuauauggcuuucuuccucccagucuugccagggccuguagauagcaaggguguccaccccagucugcuuuggagaagagcgugggagaggugggaauugauccugguggcaugguggacucugguuggggauucagagcagagucuaagcauugccuucucugguguaggguuucaagugaggccuuucuccugcaggaacaagacacauccuuaaacugcagggcuggcgggcgggcccaucucuaagggaauugggggccaugaauggggucauuuauuugugcucugacaaagcagauucagaguuaugcuaucccuagugacuccuuuguauucugcucugaaauccauccuucuuuuuuuguuguugucguucgauuuuuaaaauuacuuuauuagauauuuucuucacuuacauuucaaauccauucuuaagagugcuuuugaguuuaagugguguuuuacacaggccacauaaaauucuggccacgagggggcuucauuuucccauuuuucaaaaaagaccuguaauauaauacuauaaugcuuugccuuguuuuuacuuuaaagauaggcuuggcuuggcuuuguauggugcuggggauugaacccaggacccagugugugcaaaucaaggacugucccuuggagauacaccccccacacacacuuauuuguuuuuggcaauuauuuagaauaacuagaaggagcuuugcaaaccaggugcaguggaagcguggaggcuguaaaagucaguggccuuccagaaugccacacagcagggcagcucaucagaguacucuauacaacuccccugaaaccugauccaaaggccagagucuuuaaauguugauagcacaacuaugaugacauuggguagacacaguugguaacucaggaggucagccucucuuccucuaacaagcagaggugaauuuucguguacuacccccaggggcaagugcggcuuguccucagggcaaguguggcuuguccucagggcaagugugguuuguccucagacacuugcuuauugaaccuuacauaacuuucaaaucuggcuucaagguugagcucauugcugucccucucuccacauaucugaaguuacugugacccaaugcugggcucuaaacuagagcuucccuugaagcaaugggacugcuaauugagcuagugacagguuccccauuuguuuuagaaggugguauauuccagaggugacaggggaaagcaguguuuggccuuagaggaacuacaguggaaaaauaacucuucuaagcuccugauugggaaaaaauaaucagggucuacaaguuacaggaaggaaaaugacagcacauucucaaguuaauuuucauuccugaagaaauaaaaauaagcuacagggaaugauuuaaaaauguaaagccugaaacuggcagucaugguacuguuaaacaggcccacguauauauuuuauagaaaccguggcuuuuccacaaguuaaauuaagccuacguccuuguaaucugagcacacuguuaauuuuguauuuccaguagacacugaaaagcuauuguccuuagacugagagagaaacagucagaaauuaaguuguuaacagguaaaugcccccucccaugauggguaaugugaaguaaagcaauauaugcagugugugauaggaaauagccuucaugauguuaauggaacugggcuggcuuuaguauaguguuaaaguagaguaguguuaaagaacaauacacucaauggcuugagaagauggccuacugauuaggacacuuucggcucuugcaggcugcaguuugccuuccagcauccacauugcagaguucaagacuaccuauaacucuagcuucaggggaucagauucccucugcuggcuccccagggcaccugcacacauauguguaugcauagacaugcauacauacaaauaaaguaaaucuaauauuuuuggaaguuacauuugggcugaguguguaucuuuggugauacacacacagaagaaccuagcuugccacauaguaccauaacacaacagccagauauggucuuauccucagagccaaaucuugugaagaaaaugggcuacccaaagcuaguauuuacuaaagacuugcuguaugucaggugagguugugcuaaguacaacauagauaauauccccauuauuccuuuuuacugaugaagaaauuagaacccagagagauuaagagauguggacaagguuauauugcuaggaaauaugaacacagugacuugaacccugguuaucauuggacaaaaccaaaauccaauguuuuugcacaaaaauaauuugaacucaagaauuugaauuuuuagcagugcuguuuuuauuggcaugaguuauucuucaagauagugaauugccuuaguugcguucguauugcugugaagagaaaccaugaccaaggaaucuaacaaaagaaaaugcuuaacugcaaguuuuugaguccaaggcuccaccuccuaauccuucccaaauaguuccaccaacuagggaucaagcauucaaacagaugagucuauggggccauuuuuauugaaaccaccacaguagccuuauagaguugaacacagauuuguauguauaaguucugguguguguguguguguguguauuuaugcauguguauauaaauuuuauguauaauuuaugaucauagcugucagcauucaccaaguuagaggauuauucacaaaagagguuuuuucuuguaaucuguauggcacuuuggaugugauuaugaugaugaugaugaugaugaugaugaugaugaugaugauugcuaucugugugacacuuuggaugugauuggaaugacuuuuauuguccggauaucagguuugguaugaaaacuuaaaaagcccuauauaccuucuggacucccauucaaacucucuuucaguggcaugggaugugagcugucacugcaaaagcgccuccuuuucuguggaaaaggaaaauuguuccuuuugagcaugcgacauaacaauuuaacgguuuaggagagaagcuuuagauucucugcuaggaagcauagaagcagaugcaguguuggucugccaguaaagauggcacauagacucaggagugugcacaugaugucucuguguucugcaagcaauagccauagguaaaggugugaaaauugagcuaaugauaaagccacuuguuuuggugcuggugaaacgccaugugucuuagucacugugaagagacacaaugaccaaggccucucuuacaaaaccaaagcauuaaucuggaggcuugcuuauaguuucauuauuaucaugggagggagcauggcagcaggcauggugcuggagaaguaguugagagcuacauucugaucucagggagagagagagagagacagagacagugagagagagagagagagacagagagagacagagacagagacacagagagauauagagagagacagagagagacagagagagagacagagacagacacagagagagauagagaaugggcugaacauggcuuuucaaaccuuaaagcucaccccuagcgacauacuucauucaacaaggccacaccuccuaauccuccuaauucuaucaaagaguucgacucccuggugauuaaacauucaaauauggggggggggggcauuucccacaucaugugacucccugauuuuaaaacuucugauaucugauuccauccggugagacucauuuuagaagcaacagugagcuccugcucuccgcuguccacuccccaugaggcugucucccuuucaauggugggcaacguuuccuugucacugggaaaguguguugucagcccccugccuuuccuuccucuguaacucucaugucuaagcccucaccaccguuagcagacacccagauccagcccacuucccauccugcuguggcuuccccacugucauucuuuguagauuucucauagucagucaaccacugacugguuuccugcuucuacagaccaucaugacauaaaggccaggcuggccacaagucaagacuguacuuggauuuucccccuggccuccaggacaagguggcauucagacagugcagauuuguggaccaucucuuguguuuugagacauuuucuuucuucuuuaucuugcuuauuuucuuucugccauaaugaccucuucaccccuccuccaaccccgucuacccccagugucccauguucuuuuucuguuccuggauaugcagauaugugcauggcuucuuuuuugcccuauguggccuuccucuaacaagccuccugcuuuaauagucuacaucccagaacccccuacugugguucauuguuuuugugguauagggauuuuauaacucacuacauuguucauuccuauuaggccuguucccuccucucuuguguucuuuucugcccucugcccacaaaggcaugacuccuuuuguuucauucacugcuacagugcaagcauccaaaacauuugcuggcacaugguggaugagcaauauuuuugguuaaguguugaguacaguugguaaaguccccagcauccacaaaaaaccaucagccagccacagugaugcauuuguaaucccaguucuucagaggugaagaugggcagaucccuggagcucucuggacaguuagcccagccuaguucaugucccucugagagacuuugucuaaaaaauaaacgaagugcaucacccugaagaaagacaccuuagguuuuccucuggccuccacaggcaugugcacacccaugaacaugcaaacauaucugcacacauacacacacacaccugaacacacauggagugcggaagagacggggauaagcaagagacugagugagcacaggagacacacagagaaauguucaggcaguguaaauagauuuuuaacaggaagaggagaaagcagccauguuucuuagccaugguuacagaugugaaccaucaguacagcaaacagcacaagaacaaagaaagcgggcccucguuuucauguaagacaggaagaauagagggaacggcaaacgugcaaugugcauucuucuucaacuguuuaaagcuggugacacagcuacugauagcgguguguagagauccucaggccaaccggagaaaguagcugcugcauuguuuggcauuccaugugguguauuuagcauauggauagcacauaagaugcuuuguagccaguggcuguauagcuagauauuuacaucagugccuauacacuauugaguaguuaauuuugaguaaacaauuaguuaaaacuuuuaaucuaaaucacggacacuggcauguacauggugcauagacauacgugcaggcaaaacaccuauaugcguaaaaaguaacuccauucuuuaaaaaccucgggugagucaguuuaguuuuuccaucuucucacgugggguccacgguccugaugaugaggguggacuggaauugguucucuucucuuuaaggugugggugaauucugucacugaggugaccagaggggaccugugugcaggagauggggacucuuccccacaggacuuggucuacugggucacuccucccagcaacgggcaucuggcucucaaguccacuccuggcagaaggauccagaacuucacucaggcucagauugacgagggucagcugguguucgugcacacugguaagucacagaacaaagcggugucgaucgaggacauguguucugaggaucgagugagguggcugucagaccuaagaguugcugacugaaaaucacagaucauagaaacuucccaaagucuguguuuuuuucugaaagcaacaugcuucggagagccaaugaaagcauuagagccugcccgagccuccugaggcuuacucagaagggcacagaaggucaggccuuccaugagagcccacuccucccucucucugugguucuccgcccuugcuuuggcugugagaagacuugggccuguuuguuuucucccuuucccaugacagcacaagccuucuaagaaagggcagagacugguauccucagccccucaaacagugacuagaacauaguagaugcuuaacaaauaaaaugguuuugaacaaaugaaguauuuuuuuuuuuaacuacaaaacaccaacuauguaccagguaguaacauugcagacacugaggauacaaagcaguuuuuguacaaggauuguauucaugaaugaaugaauguaacuauaaucaugagagauccuaauguugguuagaaggcucuuucugcuuccugcuagucuucagugaaucaauacugacaacguuugcuagaaaucugcugaaaugguagcccaggaacucagccaggguagccuggcuuuguugugagacuggccucgucaguggaccaggcugggcagcugccggaaggaggcaugaggaaggcauaugacccaggaaugcaugaccuaaaagcucaaaucuuaccuuucccccaguugguuugaacuauauuacuugagacuauaauaaagaaaagaaagauaggacaccuuuuaaacucagagacaaugauacccugauuaucuauaauauacuuagcacccagguuucccaaagaaucugaaaacaaauuugcauauggaugcucucauuugguggccacagacuggagcccagggccuggggcuuagaugucuuuugcacucuccuaaaucacuuccauuccucaggaggugcagcacacagaauaugucguuucacgaguacuccgcaggccucugagccauacacaguugugaccccauuuuugagaugagaaaacuuacgacacaaaaagaugcaaccuggccugacccuuaaggguguggcaggugggaggacccggauuccuauuagcagcacaggauggaaacaacaguuaucucucgggguuaauugacuugucagcuaccaggucaguaucugcuuuuagcagauagagaaaauaacaucuacgaaauaaggaaagaaggguggaggccaggauaccaugaggacuaauccauuauagcuccuaaguggacacugaggccagcugggaacucucagagcaacuggggcccagcugcaggugacuuguugaaaccagcugcccaucugccuaucaccagccccaaacaaaggugaaguuuaacuaaucucauuuagcaucuuacaucugcaaagugcucugcuguaaucuaauucgccagaccauacaacagccuaaggaguuggauucagccaagacguggcagccaaggucuuuuucacuugcccuccuggugguacccuagggaaaacucagagcucugcuauagaaaauccgcaggucacccuguaugucugcuuucuuccuugucuuccugugguccuacuuaguuagaucucacuauguguaacacucuuuauuuguucugauauaaucucuuauggacaucacagaaauggagauggaccagcaucgacccaacuccccgggguguuuuaacagucugacucacaaggcaggggcaagaucaagauucaggagguacuuccaggauuccuagggguaaaggcauucccucuuuaauuuugcguuucguggaaaauuuaaacaauaacacaacuuugaaaaucuauuucuaggaaagcaagcagaagcagaacauuagggugcaggcccugugaggaguagggcauacucugugucuuucucccucucucgaguucuuuaauggugaccuaugaauauguugguuaaaaaaaauacucacccccuguaaacguucuucugaggaaucggagcuuccuaaugaggaauccaagccuugcuuaucuaaggcuuagacggugucaaacaugaaccugccugcugugcugugagucagucugugucaguaaggggggacugcacguaauugcagucugaccauacagccuugguuccuugccuuauuuccccagcagcaacaaagacacaacuuuuacccagcacauucugugagggucugugagcuuuuaauuuacucacauuuucagagagugacagggauguggccaccagucucccugcauagagaucuugccccugccuugugagucagacuguuaaaacaccccggggaguugggucgaugcugguccaucuccauuucugugauguccauaaguuaguuuuccacuuuacggguauccuucgucucugacagagggugggggugggaucugcuugccgauccucaaugaagaccaggucaugucuuccccuuccuuucucucccacguuuagaguaugguuagcuugagauagauuuugcuuguuuauuucuuuuauuuuuuugcaauuauaauuauauaauuucucccuagccuuucuuccuccccaaaccucccauauaccccuucccaacucucuuucaaauucagggccucuuuuuuucuauuguuacaugcauauggguauguuuauauguauauguguuuucaggguugacuauucaguauuggauagcuaauuagugugcucuuuccugggaaaggcuauuucucaagcucucaggauuccuuaguugccuauguucguugugcagggcagagcugcaaucuucccaccccucucuucugcauauuuuguuaagaguauaacuguuuguaacuaguugcaggaugauaaauauucccuucccuuaaguuucaauuuucaguauuaagcuuuaucaaauucuuaaaaauuauuugugugguuauagguacccauuaacauuauugauauaauuuauugauagcauaauaaaauacgggucauguauauuuuuuaaaauuucaaaaauuccucagugguaacaccugugcuuuguuuuaauacgucagcgcucuagggaaccugcacgggaaccuuuauugaugugucucagucuugauucuugucaauaauccgaucaagcaucacuuaaagucagggaguuugcagcccaauaggaagaacaacaauaucaaccagccagaacccccaaagcucccagggacuaagccaccgacaacggaguacacaguggcuccagcugcauauguagcaaaggauggucuugucauacaccaaugggaggaagggcccuugguccuaugaaggcucaauagaagguccuaugaagaaucgaaggcagggaggugggaguggggguggguggguggaggaacacccucauagaagcagggagagggaggaugggauaggggguuucugggaggggggaaucagaaaaaggggauaacauuugaaauguaaauagagaaaauaucuaauuaaaaaaaggaagaaagaaagaaagucagagacacagucugagaauuauuucaucagugugcaaauaucaugaaacuuccuuacaaaacuaagcaggcuaugacaucucugggugauacaguaugugggaccacagucuuacaggcuggcuguuauggauucaaacgcuacucugcagcugcauuuaauucagcaagcucaguggguaauuaacacauuauggaauuguucuggcuuauuuuucaggggaccguggaaggagauagaauggagguaggugacuuuuuuucaggauaaucacauugaccagagcguauuuucuucuucugaaggagcaaugucagguggcuuuaauuuccaggugacugacggucugaauuuugcgccucggcaaaucuuuagcaucacugcccgagcucugaucauuagcuuagaagucaacagaggauugagcaucuucccagguaagaggcuuggcaggggggugggugggggagggguaaguguuuuccuaaucaauuagagaauccacuuguauggcauaaagugguaucucuuacuguagaaugacucucgaaacaucuauuaagccagccccuggcccacacagaauucucagcagaaauuugacagcagcaaagcuggcacucggcagccuuucugucccuuccuugccuuuuccccagaaaaggaaggcuacagagcagaggcaggaaucgugaaaggaaauguccuuccuguuagugugcgucacucuucucuccuaagucuuuacaaaccccagauuucuguuuaguuguguauuuaugucuguuauguauauauuuagagauauaucucuccuguagcucaggcuggccuugaacccacuguccgcagaugaccuugaauuucuaaccuuccugccuuggcuucucuagugcuggcauuacacgcuuguaccacucugcccaguuuacguggugccgggaacugaacucggggccuugugcaugcuaggcaagcacugcgccaucugagccacaucccugucugcguuuacauucucaagccgcucguguuucgaauagaaaaauucccugcagcacccagggcuugccaggguuuucuguuaguacuggcucugaguggcuguuugccaauaaucuaaaccagaccgauggaguaggagccgugagaccuucuggcuaacaaccuuaggaaagggggaaauguguccaguggcaagggcaauuaaaauuaaaaaaaaaaaaaauggaggaaaaaaaaaaaaccaagcuggaacuuauuucccaaaaggcauugagaugcagacauaggaagcaagaacaucucaacauggccuggauguugugaagcaccagagcaacccugcacccgauaaacccgcuuaaaaggacagacaugagccaucaaacauagaagggaaacgaugcuggugaucuuauuuaaaaugguccaacuagccccggauccuaaaauuaacagugccugccucucagaaguugaaugggaaucucugaaaugggcuuagcucauuaaacuauccuuuuagauuuauuuauuacguucuauguguguaaguguuuugucugcuuguacgucugagcaccaugugaaggcugugccuucagaggucagagagcaucagauccccuggaacuggggucacagauggucguaggacaucaugugguucugagaauuacugagccaucuuguccauuuuuuuuuuuuuaaacuuuaguuggccuuaauggggaacuaguuuuggauccgccggauuagauggacuccuguguuugugagcuagguaauaaguucucgggaaguuggugggcucugugagguaaaguggaaacacaaacccagcaaccaggggcggagagagauuccugcuuccaaaaccgacuucaaggaggaggaugcuuuguucgcaguuguuacacaguaacugcugggaugcuuuuugcuaauuuuuauugugaugcugguagaaagcaaggcagcccucuaccccggagcaguuuccucugccuuuaaguguucauuuugaaguucuccucagcuuuugaguuugggggggggggguggggagccucucaagaugcaucgagggcugcguccccuaggauccuucugguguaagacuuuauguugcccuugcucuguccauuuccccuaugaacgagugggaagcuuccaccauuucccccucaaggcacuuaggaagccauuuagugcuuuaaaaaaaacauaaucagccacaucgcaguaaccagaaaaacauagcaaucuauuuuuaaaauuccaaaacuagaguaauucugcugcugcgaaagauuaaguuccuuucaucuggugcggcugagucuggcuuaauaacugaugacggucguauucaaggaaagacaggaacccuguaacuuagaguuuauggcggauauuuuacugaaucaaugaggccggaaaagaauccaugaagguggucagacuccuucuuuauuuucagaagacugugucagacuugcagcucuguguguguuguuggccacugucccacuaaugcuaagguuucuuuuccuagcaaaccuuacuucugcugcaacccagccccugugugccuccagaacucacuccugaaacucgcuuuacuaacccuuccuggccaguuagcucaguugauguucuuagucaccacuaucuccacccugucuuguguccuauuccagcucuuggccuggaggaaggaagguggaucuucauguccaugucucucgaguggcacugauauucacggaaaucuuacaacuguggaaucagaaguccuagagugcagguggaccuuaguggccaccuggucccauucuucuuacuguuuuccuguguuaguuuucccaaguagcaggggccaccaugauuccuauagcuuuuaucauauugugcccuuucagggacucaccugagccuugcucagcauggcuucuucaguagucacccgugggcucuuuguccucgcugcugugugugaggcuggaaggugacaauaaaugccgcauucuguaucuuccuucagagcccccaucuuuguccugcuaugugaugucccaugaagggcgaggaggcacucugcauccuaccuagggugugauguaagguguguguucagugucagcuauugcagacccaugcagucagaacuucuauauguuaaaguaccagggaaaaguccauuguuuuugugaaggcauaauuuguucuagcacuguugcaggaguagaaaaucuauuccuaauacaggcugggcauucagauaguuauucuuuauauuuauauauuuauagcauuuuauauuuuuaauuaccauguuguguuuuuaagaguuuaaaggaaauaguguaugaauaaacuuuuguuuaggcaguguuguuguuugacuuuaaucccagcacuugggagacagaggcagguggaucacugaguuugaggcaagccuggucuacacagugaguucuaggacagccaaggcuacacaaagggacccugucucucaacuccccuuauacucccaauaccccacaacuuuugaauauccugauugccagguaaaagauauggaggcauggggcucucagugucucaugucuaauagacauugccuucaggcaauguggcaauucugaucgcaaaucuagaacuuguaucaggcaguccuucuccuuuagguguaggccagcaucccagggugucuuuauuauaguaugccucuucucugagacaggaacaauaggguaacuguuuauuuuuuuuauuuugucuccuaggcauuacacacacacacacacacaacacagcaaguuaauagacuaauagccacaccaauuauguaguaauguuacuguuacauguuuuaaucucuuuaguugggggaaguauugcagacaggcauaaguuagcagcaaccaacggaaaucaagccuuuaagaacuuaaugcacacuucguccacuugaacuccucugugguucaucagacuucggaaguuucugcguuggugccuugggacacucagcccuggauugaugcuuagaaaaucugcauggcaagccaaguaguuauuagaauacacagugugugaauguuuaagacuuuauagcguccauauuuugccaaauuugaguaucaguuuuuaacacgguuacuuuaaggacuguacuucuaagugaaauuuugugugugaacuaaguaauggauuuaaaguauauuuuuauuguauuuuucaauuuuucauuuugucuuauuguaaauauguacguauagcaugaguguguacauguauauacacauauguauauauaguagguauuuauauaauuuaaucaacauguguucuguuuucuucucugucauucuccaagaaaaaguuuuguaagagguuuuaccuugcucuugcuuucuugcuugguccucuugccccuucccccucucuucuauuccccucccccucucuuuccauaugcucauggcgggcuucugcuucucucucucucucucucucucucucucucucucucucucucucucucuccauccucucaacuucccucuccaugcccugaauaaacuuuauucuaugguuuaaaaaaaaaagagguuuuacauugcaaucuagcauagauuuuguuuguuuaacuuuagugauggcauaugagaauauacuguggccuuaggcuguaggguuuuugcuuacucaauuguacuuggcuccuuuucaaggaauguuggucuugacucuuggagggaauuucccggaaaguuuggcuguaaugcuauagaagcaacucuguagguccguagaggagcagcucaucaacaaagaaucauuguccugagucccgagaggauggcaccaagagcccaccucucccucaucgcaggaacugaaagaaaggagcagggcucgccggauucagaucccaugagcuagaggaugaucuuucaaccccaaccccuggcguucgcaugaccugcgauacaggccugggaggcucccuggguguguuuaggagccagccccacccuccuaggaaccccaguuucuuguuuucccagcaccacacaagcggauuuuucuuuccauacccaggguugagccacagaggccuuauuuggcacgaaugccuuucucugggcaacuaaacagaagugagggcauagcuggaggagaagcacucauuucugcuguggcucaggagcaaaccaugcccaugagaaaauagccaggcaucgcuagccucccacugcccauagcuccccauucauauccaugaacucuccaggcaguuuucagaagucuagaaagaccaaggagccaacccccuuugugcagguuguaguuauauucauauuucaauuuuagguuccacaaagccacuuucgucucaugaccugagagccgugaccaaugaugacaaggcaggaaacagaacuguaacauuuacaguugucagguccccuaaacucgggaggcugcugaagaugaacccggauaaccgcacagaggauguuuccacuuuuacccaaugucuggugagucccgacauccauuuugugccacugagugggacugcgagucugagcagagaggaccucucauuugucuucagccugcuaaaccaauuagacaugggccauggcucaggccacuucuacgucauuuaaaacgggguucauuuuagggagcagaacaugagauagaugucagaaaacaccauugcugauucugaaaguaucaaauuuaaaaauguacucagagcuggagagauggcucagugguuaagagcaaauacugcucuugcagaagacucaaguucaagucccaccaugcuggggagcucacaacauucuguaacuccaucuccaagagcucccuaacuuuuucucuuuuggauucugcaugcacacacacucacaugcacuacaugugcucugcacacacaggcacgugcacacacacacacacacacacacacacacuuaaaaauaaggaaauauuuuuaaggggguccuuuaaaagaaaauccaaaguguauauauauuuacaucuaacauguacucauuauguacuguauuauaauugugugaauauguaauuuauauccagggacuuuguaacuuugcugguuuacauaucuucuuauugaaaugaauaagcacucaaaauauuuuuugccuucuggccaggaauugggugaaccaaaacaugauuguuuauguguuauuucaccuuuuaaaggugaugugcccuaaaugcaauucuuuaauuuaagcauuccuuugguugguaaucugucauccucuuuuuguccuagaauaccggucugaaaauuuauuuggcuauagcuuugaguaacugaagaauuuucugaaucucaagucauguuucgaggaaaucgaguucuuuaccuuugaacucguucuguauggugugaggagaguggccguggcuuuugcuuuucaguugucugugcguuugagggaguggauugugaggcaagcaucguaagcuuccaguguaacacugaaaagaagaaguauaaugucugcaguuugcaguuuuuuccaagacacagaacaaaagcuuggaaugaaaacuccauuguguagggaauuaagaugugcccagaagcaucaacacaugcccggggucaguuugccuuuggaauacuaacaagaaugauguuauuucucaaagaguauguuggcgcuagccccaguucuuuuaaagaacaaaacaagacaaaacauuuugacuauuauuuccaagagcuuuuaauuucaaauauguggcauuuuuagauuaagauugauauauccaaaauaaguguuagugaauauagaagcuagaacuaaguagcuuuugcugcaauaacaagaaacccucaagucccagugucuuaugauaaccagccugcccuucucacuugcacuaucugacaaccguggguuggcuguggucuguuguucauaccuucguucuuucagaaucuagcuacuggaacagccucgcucuagucaugcguggaaggcaguaaagggcagugugaugguggaccaugggaaacugugcagcuuguauucuagaacguccuuuguauucacauaccacaggagguagcuugugaccagugugguggauaaacugaauauuuggaacuguguucuaacugcuauggugcacugacaugcaaacggaaaacuguguauaauacuggaagccagguauguuuuccuaagaaaacaaaccaccuuuagccuagaacacauuuaugaauaggaaauuaacacaccaagccaacuagaaggucccaggcaagcaaggucuugauuaaauaaaauccaguugcuuccagauuugaauuguuugcugccccuucugauuucuucugccuuugugaacacauaggagguaccugacaaacuugucagcgauggcagauaugggccagagcaggagagguguucuaugggagcucagugcugcacaaggaaacggaggcaggcucuagucgggaaacaaccagucccaggccacagaucaggggacacagugucugguuuguccccucccauggcccuuucuucugcagaacaugugccugccauuccagaggugugguugaaaacuuagaaucaaaggacaaagaagaaauuauuuuaucauuugaaagguuguauacaaagacuguguaucuggcuuuguacacaaggcacgccccugauauaauaauuucuuucucccugaaaccuugucucagauauaguuguaguucguagaauuuccacacgacagccaucugguggcuuuguuguuugguauguggagagauuuuauaguuuagguaucugagaccuacugguaacuucugggacuguacagaaguuuuuuggcacaacaccaggagaucuaggcucccucugugacucagcaaaucacauagguguuaaaccuguuuuguugucuugaaaacgggaggagucauagcagugauuguugaaaccauguucauguaugcagacucagaccuaaagcaugcauguucgcaugguuacacagccuauugauagcagagccaagacuggagcccagggcucuggauucuaggucaugcuccugucaaauuaaccagggcuuuccccuaaccgguuaaauguggcuaagacaguaauagauguaaagaguauagcauguuucccacacuuaauugaggguuguggagauggaaaguauucuucuaaugaucaggagagacacaagcuagaaacacuauauuauuuguacaucauaugggcaccugguacacccaaaggccaugugcauacaaagucaggaagcacacacagagagagagacacucaaagaccaagcuucuguuggauccagaguguuguccaagcagcuuuuccaagggggcauuugaguggguaagaugaaaucagacagguacuuguuccaggaggccacaugguaacuuagagguagucaugugaccuacccucaggugggucugagcuucaaggggucagucauagaggcuacauuagcuguccccuagggggguggacaucacagagcaguugcuuaaggugaccugugugggccaugcuaaagacuuucacugaggagagcuggcaucacgaugacugagaaaguccagcugguauucaagauggguggugaggugaccggacauccuaaggauuauaaacacuaauuagaugggguuugaggcugaugcuuagcuuuuuguucuuggaaaugugaaaagucccuuucuauuucucauauuuaaaaggaguuucccaggggaaggcaauuuucugcuacacuggaacuggcugguguuugcccugaugugcaacagucauuuaaugaauggaaaugaggucaucagaggagaaugacauuugcuccaccuaugacccacuuauuguuuccuuuagagaguuccuaguguucucaaauacauuucccuaggggaugaugagagaagagagcuaaggaaauagaagaggucucaugcagggaccaaguguuccaucccuggccagagcccaggcugccaggcugggggaacaaaggggccugaggacggacgucuccaaggacuuguucugacagggcaagagggaugugcggggaggaggggagccgcugggagcugcugcugacaagcucaggguuuuccaacaucuauguuugucacuuuugaauaccuugucucucuuuacgccucaaccgucauaaagaaagucaaugaugugaggaagacuacagagaaauccagggaaaacucugguccuuucgggcucauagauagcuuuggugugauagugccuauuacacacacacacacacacacacacacacacacacacacacacacacggcauucaagggcuuucugaugcuguaacagaguaucugagaggaaucguguggaggggaacagguuuauuuuggcucggcugcugaagcuucaguccuuugucagcugucacuugcuuuaaggcuugagaggcagagcauccuggugaggcacacagguagagaaaugcuuacuuccugaaggcugggaagcacaaagagagaagacaggacauggaggcgaagguugcaauguccccucaggggcucauucccacucaccuaacucacccucaaugguuucuccaccucuucaaggucccacccccaccccaauaacuccaaagccagggaaccccaguaauucaaaagccagagaacaaaccuuaacacaugggguucugggggacauuucagauccaaacuacagugcauacuuuauaaaagcaaggccagaaaacaacaaaauguuaaauuuauaucaagacagagaggaauaccaccaacuaauauaguaaacaugcauugaucugaauguauuccagggauaaggacauggcucuagggcuaagagcaucugcugugcaagcagaaggccugaguucacauucccagcagacacauaaaaggacuguucugaccucugcauguguaagcauggguuaaagcauauacacacuuaugugugcacacacacacacacacacacacauuacaccacguauacacauuaaacaacacugaaaacauuccaauccugguuagcauauauguuuagaaaugggcauuuucuguaugguuugagaacagaaagaaauuagccuuucuucuugccccucccacacacugccuccuuuuccacaugcagauggcgagggggcuuuggcaccgccugaaguuuauaacuucuaucaagugguacccaggucaguucccagucaucguaugacagcucagauugaccaucagucagcuuuagaacauuugggaagucaaagaacgguggagaggacagggggccuuucucuuggacugggguuugcucagucgugcagcaguccugccugaggcuguaugcucaacagagugcgggaagcuugccucugaaauccuccaugaaguuccugauuagcacauaugugcuuuuaucuggccucuucaaugugauggggagaaaaaagagagagagagagauaacacucaggaaguaauuucaacuauguaaagaguucagagcuauuuagcccuguguagcuuaauaauggcuaauuaccaguagacuuucuagaccagcuuuucuucucaagagucaguucuagccaagugaccugcuaagcauucaauagggacauuguaggcaguugauggcugagugcucuuucacccuuuaacggaaggaauuaauuuguccuuggcucucuaccugcacggacuggauggagguugaaaguacugcaccauuugcauauaaaacauacacuuuucuugcuugugaagaaaugaccauuuaaaauuaguacuuacgaagaaaacagcucaugagaaaccgcgacugcauugugcuucauauacgucagcaaaagaacucuaagaaaguauuugugauguccuugcccaacgcuagucucuuagcccagacuaaguucacuauguuuucugugucauaucagccuaccaagacaagcaaguggccgcuuuguuuuucagugucaaauccuaagggguuaagcgaacccacaggaagcaagcauaggauguauccacagagaagacaaccaccaggcucccauggcgcgaaagugcucugacacuggagaagguucuguucgcuuccaagaacccgugaacaaagcaagcugcagaguccagggaacacacugauggcuuccaggugaagccaauugagugauuuucauuccggugcuuggagagauaauuuagagucauuaaaacagcgaaguguucuagcuuugagguuuaugacagccggccucuuuucuuuucgacaaagccaguaauugcaucucggcuauuguacuuuugugggcccgaugccauccgucuuggucuccguugcuucugcagcacagauaaugguuucccgggaacacauuuagaaaaaucacaaagccaugcugggcuauuaauuuuuguccaauuacuccuccccaaaucuggacuuacugcuuucauaauauauacauguuuuagagaauuauagacacauuucucaaaggcuggaaauuaacuuguuauaauuuaauagggaguaaaaucagcuuaaugucucauuaggcuuuugucuuugaaucugcagaguugggaggggccagccuuccugucauucaugguccuacccacccaucaugugccucuuugggcucacugguucagucgcaaucaggccuacuugucuuuguggacauucuccacugauauuuuucuuacagcaguuuuguuuugcaucacacuucucugaguuauguggagaguauuguuccacauguuggagauuauuguauugucauguagucgucgauccaucacuugaauuuaaacuuggcugguaacucuuggccccguggcuuugaauaguguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguuguauaagagagcaggcugagcaagccagaggaggcaagcuaguaaggaacgucccuccauggccucugcaucagcuccugcuuccugaccugcuugaguuccagaccuggcuuccuuuggugaugaacagcaguauggaaguguaagccgaauaaacccuuuccuccccaacuugcuucuuggucaugauguuugugcaggaauagagacccugacuaagacaaauagucaaaauguucuguucuguuacaaugguuggcucuuucuaugaaaaggcagacagcacucauuuccguuuaaugagcguggcuuauuucuucuccuucuauucagucuccauggccacuguaauacaguaccguaagcaggaugguguuucugguuagcuuuugucaauuugacacaaacuaaaaacuaaaaccuaagaagaggggaacucauuugagaaacugccucccuaacguugggcuauaggcaugucugugaggcauuuucuugauugaugacugaugugggauagaugacccagcucacugucgcugaugucaccccuggacagguguuauaggauuauaugcaaguugagcaaacuuugagaagcaaaccagugagucccugaacuccuacucuggcuuccauggcguuagacugugauacggaaguguaagucagauccuuucugugcuacauggaaguuaaacuaaauaaacucuuuguuccccaugucauuuugggucaguguuauuuaacaaaaaccaaaaccaaacuagaacagugacuaagucuucuuucauagcuaugcuguccagagucugaacuccauccuucuggcccuaaauccuaaauccucuuggaguguguuaccuuuccaccagaagggccaccaucauggcucuagagaacaauggggcauaagcacagcaagauuucuauaacugaggcacagggugucauggcuacagaauucccaggggacaggcuguauaagugaggcugauucuccuuaguaaggaugagcagaaaaggaauuccuagaugauaacacuuagaaauaucuagcuagagauuggcaacagaauaucacacccaaauaauuaucagugauucaugccucugaaugacucuauuggucucggcagcaacuuacuagaaagaaaaucucugcaaggacuccagaaauauaucuguaaguauuacuuucucuccagagaggauuaaaucuucauuuaagagucucuagggacucauguuacucuuaaguauguagcucuuuaauaccuuaaccaaaugagaccacacaacguguuauaauuuggaaagagcaaaagguagcauuggacaucuugauuuaguuucauacaagugcaggaacuucugaaaauagugggucauggccucuggaacuugugaaugaaugaccccuuucucggcagacuuugaagaugcaguuaacagucauaggcuuagaagaguggccuggacuaucuagauggcccuaagugccaucaucugugccuuuucaagagggaggcagaaggagauuuacauagacagaugagaaaagccagcugaccacagaggaaguuaaauauugcagccacagaucaaggaaugcuuguagccaggcaagcugaaaaaggcaaggaagccaugcaucuuuggagagcugaggggauggaugcaguaguugacuccaccaagccuggcacauucaagagccuucuucauucuuucccagugggugacucuuugauccauaagcacuaaagaccguuggcucucuggcucuauauuuaugaagcagcugucagcuggucuccuugaggccuccaaucagaaauugaucaaaagggaaaaaacaaaaagacucccuuuuuguccuauccaacccucuaccuccuagugucuuauaaguuucuacgugauuuaaaaaacaaaaacaucgucaguguagaucugguauacugccucucuguuguugugugcgguauaugaauauguguacacguguugaugguauaugcccaugcacacacauaggggccagaggugggugucgguuguucaccucuacuguccaccauuguauccuuugagauaggaguucucacugacccugggcuaaccgauuggcuagccuaacuggacagugucugggauuugcgugccucugccccuauaacacugggguuaccagugcaggucaccauccccagcuuuucguguggaugcugagggucagcuuuagcacuucuuacccacggagccaucuccccagccccaauacugccuuucuuuaaaucaucagucaugauaaacgcaggcuguuggaagaguuauuccucagaaccacugcagaucaauacgaguucugguuaauaacugauggccuuggccagaccacacaaugaaguggcauuuguucacucuggucacacuuuguagcuggcucuccccauuccugagcucccuggaucugcagcacauauccuaugaauuucuuuguagccuauaaucucaguguuccacagugccacaguguggaugcaguccuuagauuguggaaauagcuugaacuugggaguuucacagaacuagguaugaaacuaagccacuaaaauaaagugccuuguggagugccugcuaucuguagaauucuaauaaaggcuagguauuuucucuguuguuguuaaauacauacaaauauaagaaauacccugaguugccuuccuucugucuauauaagguuauaagcauauaaacuugacaaugaaauguuguaaaacagcuucaauguagauauuugcucauuaaacacauguuuauuuaaaugcuuauucuaaaugguuaaaaaaaacguauuuauaaagcaacaggaaaugagcuuuccaaacauguuuuagaaaauauucaccuugugaagcccgggcuagaacucucugggcguuuaauauuaugcugcaauucaguguaagaacuguguauguccuuucacccaacucagaacccaguuagaaauccgugagugagaacuagaaugcucuggaaagaccuagaaaugcccagggccuggcauuuugaucacugaaaugguaacacacuagcaaggggaaauacagauccacaagaagauauuauuuuacauuucaguauacagauagggcauagagagaagcuagcugauuugcacaaacagugcugaauacuauauacauuugaauuuuggucuggccaauccagguuucaaaauccacugcaucuuuuuuuuuucuuuuuugguuuuuccagguaggguuucucuguauagcccugacuguccuggaacucacuuuguagaccaggcuggccucgaacucagaaaucugccugccucugccucccgagggcaucuugauacauccauuuuuauauuaauaucuauucucuuccauggcagaagaagagcagaaauccaggcaguugggaacaaagcaaccuccaaaaaggacugaggacaaagcuccuagaugaaccaggcaaucugggcuguucccagcucugcagucaacuaaccuuguguagucacuauuguauuguuauugcuaucacaaaguaucugacaaaaaaaaaaacaaccuaagaagcguuuauuuggacuuacaguucaugggaaacaguccaucaugacaaggaagucaugggguacagagucaggaagcagagaaaaaguacacaccgguguccagacugcugcugcuucuuuuuccaaaccucagccauaggaaugacaucagggugacaucaggguagcuuuaacaccucaguuaaccuaaaguagaaagucccucuuagaauaaucaaacagauuuaucuucaugguaauucuaagacccaucaaacuguaauggagauuaauugucacacccuaaguuggaggaagggcagaguucuccagcuguuuaucuuucucaccuucccagcugccucucaguuguaaacuguaggccauugcagagagcccaguagggccucuggcaccuucugagagccaaauauuucuccuuagcguuugacuauuauuugaggacauauagagaaaucaaggacaugagauagaaauuugaucauagaaacccaaagaaugcuuuaucuucccuucaaaaaaagcuacuugugaagaguuuuaaaauuuggaaccagugcuggaggaaggaguagaguagccacugguaacuuaccuaugcucccucccuuucccucccucccucccucccucccucccucccucccucccucccucccucccucccccacacacaccucaaaguaggagggaaauuuuuguugggaagauaacaaauucacugggaguggaaagggauuggagaugauuacagagcugguugcucacaacuuuaaucccagcacucaggagucagaggaaggcggaucugugagcucaaggccaaccuggacaacugagugagacccaggacagccagggcuacacagagaauuacuguuuugaaaaaccaagagggggggggggcggaauaaugggaugaauaugauugaauacauuauauacaugugugaaauugucagagaaugaauaaaagauuuuaagcuuuggaaguauauagacuucuaauguaauauuggauuacagccuuguuaaaaguccacagaaggaccaaguugggggucauagggauagagaugaaaacuuggaggguggggacagaccagugugacagcacaggagguggccucuugucuucaguguacaaggcuuuuauggguguguuucuugcccucauucuguuuguauugguaaucauaaaagagaaugcuaucuccuucccaaaacuuaucgaaaaaaaugagaauuauuuacuguauuuaauuuuguauuugaaauaaguuauaagguaauuacuaaaaguauaaggaguccacuauuccuccauauucccaaagugcuagucuuuaacaagacuuaggcuaucauuucuuuacacacuugucuuugcagugacaauuucuaaaauuaaggcaaucucauauaaucacaguguaauuuucaaauuuauaauuuuaacauugcuacaaugucaauaugcaauuuauauaucauauuaaacuuuccuaaauuguuccaacaaaugucuuuaauaggaaagagaaaauuauccaccacauagaacauagcauccauaguuauccaguuucuuuaguuuccuucaauuuggaaccauucuuuacuuaucaauauaaugucuuuuaugaccuugucaauagaguaauuuaugacauuuauuaugacaggauguacauguggaugucagagaacaacuugugagaguuaguucucuccuuccaccuuggggauggaacuuaggucauugagcuugguggccauuuugccagcugaacuuaagaguacaggacaguuucuccagccuuccucacugugcauucuguguagagauucaaguugugaauucugggcaaggauucaggcuaugcauccucugcauagauucaacaaccucugcauucugggcaggaauaccacggggcugcuggguucuucucagcuuccugcugguccaccaugaugcucaccuuguccuaggguuguaguuggcuuuuauauucaccauaccauucaucgcucccuggguuuacaguuucuccacuuucaaugcauaauccucucuugugauuugugcccccaugucccaugaggacaugcuuggugaccguuuccagcaugucguguuuaucacuacacuuuagcucauuaguuucagcaaccauuuuaggacccuuaccugaauuguuauggccgucaguuaccaagugauaguuucucucauuuuaguuuucuugcuucauuuauuaguugagauuccauuggcuuucugaugauauuuugaugacuucugcaagagggaaaacagcuggacaaaucuaaauugauaggagagaaaaccccaucaccuucccuucuucagccccagagcccagguacucagcuaacuccguuauccauaugcacuucaugcagugcaaacagacaguuaccugaaguuguuccuggggccauuuugauuuggcugaccaaauuccuaaccaucuguaagcucuuugcucccucacaauucaucucacagaauccuaguuucagucucucugggccuucucucaacacacgcacacgcacacgcacacgcacacgcacacacgcacaccacguaaaaaguagggacuuacagaugaaaaggcaccuaugagaauggauggccuucuaagggucuugacucagacaaaagcagucauguguauguauauggauuuuguuuguuucuuuugucuugucuuuguuuuugcuuuauuuuuaucagguugauagagaaauuuggacacuggcugcauauuugcuaaugucaguuaguuauuuuuaaucuugagguacaaugcuuuggaaagucacaucacacagguacuuccugaaggauguauagauaagcucauauaaugucuaagaguugaucacaaauagacagcgggacagaaaguggacagcacuaucugagaaacgaggccugucauaugagcuaauaauggcugacacugucaagcaaggagcauuuaguaugccugugggacauuggacuauacacagacaggcuggucuccaguugagcugaggugaaaccccggaguggugauaauucacuuacaugcuccuggaacucuggcuccugucgaaguuaccacccccucagcccccacaagagaagcaagguuaguagucacauaggcaaugucccaagcuucugaccuucaggcuagacuccuccccaguuaccuagcaacagaaaagauagcagcauauuuuaagaggggcugcuuggccccuccucaaucucucacuccucuuguucucuugcucuugcuccucuccucuuacucuccucucuccucucacccucuuccucucucucccucuuacucucuagccuuucuucucucucuccuuuuccccuuugucuccucuuggccauggcuggucucucucuuucuuuccaccuucucuccuuucucccugcuuuucuauaauaaagcuuuaaaaccauagacggucucuguucaucaaggcccucuguguagacucucaccugugugggaaccucucuccucucagcccucucucccauaacgcugaggcuacagggugucaccccguggccccuugguuucaggggcugccccuugucuccuccccccuccgaguggggucaguggcuuagaugcccaccuggggcuaaguggaaagcgucuggcagcccuccugugucugucugcccagagccuagggggaacuauggcuggacaugggcuacccuccuuccccacuccuuccccagcccccuuuaaguucccacauauacccuuuccauaagaaaagcacaccagggcaauggccaucucagagucaacgggcuucucucugauggcuagaucagguuugaaauacgaucuccuugcugugaagaggaggucaccacauuuucauguuuuuuuuuccuuuauacaaauacaugaaauaauuuaagcaugaguauaguaagcccuacaaagagcaugccuccuccauuuagaauguguguugacuguuguaucauccaggaagcuuggcccuaauuguacuuccuucuguccaggugagcgaagggcugauacucuaccagcauguggaucuugagagcacggggugggccucagaagacuccuucacauucacagcaucuuccccuccagcggagcugggccccgaggcuuuucggaucaccauuucauaugaagugaaugagucaggucgacagagccggcugcgugcaaauacagguacugccaacaaaccgaggcuagugcuuugucuauagaagagagaaaaauguggaaauccgccuuucccuuuuagaccaugcuucacauucauccucugggauaagacggacacaguuacagccagugguggcuacucugacaugagccuuguggcaaggaguggcaguuggcucuaaagagucucuuugugccuccacugggagcuuuaucaugcccagacugaagguuguugauacaaaugaaaaggaugaguagaaaaggauuacuaagagccgguccugucuauagcaggagagcuuuagccauggggcaguuagggaaguaacaucauauacguggaugugcaguuuuuaaagauuccuugccugaaaugcuggccuccuggcuuaaugguuguuugcauucacuucccaaccgcucuccucccacuuccuguguccuugccugcuccagcccugcuccuuuuuucccucagugcaguucccaccucugccuuccugccacauggaaguguuaucacuucccaucgcugucaggaggccacugcuguacugugaggaccucugaaugcacauaaauacacacacacacacacacacacacacacacacacacacacacacaucucaguucugcaagagaaaacaugugacauuugucauucugaguuucacuaauuuaaccuaagaaaaucaucuccaauugcaugcaugccccccugcccccacaaugucaccacuucucuucucuuuauauuauauuuuauauauauauauauauauauauauauauauauauauauauauauaucucacauuuucuuugccauucaucuauguauggacaucuagccugaucuuauuuucugucuacugugaauagugcagcaguaaauguaggugugcagguaacucuguggacugcuaagagucccuugaguacauauccaacaguguauagcugacuuauauagcaguucuguuuucacuuugguuuuuguuuuguuuuuugagggaccucuguaucggcuucuauaggaauguguuuguguuuaaauuuuauuuuugaugcuaauuuagauacuugagcaaccugcuguuuagacucauccaccgagagguauucuuaggagagaaagcucuaugaccuucauuaagugucugauuaaaugucucuuuguucuguaacuguuucaauaggagccucugucaaggagggagauaaaguucucauugaccaaucaaaauuagaugccuccaaccucuuacuucagcuaccccaaccucagcguucuucccaugaaaucugguuccagguuacggcucuuccucaccauggaaccauuaugguuggagagagaaacauuaccacagggagacccuacuucucccagcacacaguuaauguauuuggagccgcguaucuucaugacgacuccgaaucacuggcugauaauuuuaccuuugcuguuuggccaaacccaaagaauaaguccaccagcaagccagaggcuggcuuucuggaagagauguucaacaucaccaucaccccugugaaugaucagccuccagaauuaaagaccaaagggcugcgguugacaguucugcagggcgauagguugguugugggaccugaaauccucaauguagaagauauagauaguccuccaaaugaaauccaauaugagaucauccgucaucccaacaauggcuucuuagccauggcucacgauccagaugccacugcucaccauuuuacacaggcggacaucaauaacgcucaggugugguucauacaagauagaagcccauccucgggaguguuuuauuuuagugugacugacggcaaacaccgcccucucuacaagcucuuccaccuggaugucacccccauuuccaucacucuugugaaccucacagaccugcuucucccacaaggccagaacacuguccccaucaccaauacucaucucucagcagugaccaaugguaggagccuccagaucaucuacagaaugacacagccccuccaaagcggccacuugcugauugaaaaccagguggucaacagcuuugggcaggaggauuuggauucuggaagacucucuuaccacaugaccaaucucacagccuccgaagaucagcugagggucucacuguuuacaacggagugcaacuugacggagcagacacugaacaucagggugcagccuuuguuguggguuauagcaaacuugaaagugaccaacagaguggcucaccagcuuaggacagaggaucuagaugcaaccgagcuugcuaacaggacuaauagugaucccauguuugaagugauacaaccccuaguccauggacgacucguucgaagagcaguugauagcccugugauggaagaaaucacucaguucacccagacagacaucaaccaagggcagcuggugcuugagccacaugcuaaucuaacaggcacccacacacugaaugacuccuucaccuucuugcucagugcagaccaugugcagccagcagcagguuaucuagccuuuaccauagugccaccagaccccuuaccuuuacagacauuuacaccagaugugccuuuauuugucacuggagagacccucguggccucuguuuccucucagaaaaaacuuagggcuucuauuaaaaaacagacagaaacuccggggaaucugacccagggcagauggcaggggacagauuccuggggucaacucaguggcaaagagccaaauauagaugccaaggucucucccaccagggucauuuggccauaugcugccaccaaagugggggagucccuuuccgggggagccaugcagccggaaaugagccgucacccucugguggucaucauaccuuuggcugcuguguuccuccuccugcuggugacugugguggcccuguguguuuggcuacugagccgaaaggaggacaaacccaaaccacuuacccagccaaagacaaaccugaaguccccauccacaggcucuagagcagagaggaguggagccauucccacggucacggugacaccccuuauuagaagcagccuggcuccuagucuguuccagacccaauccuaugaucggccagccccucugggggcggagccuguggagaaaugugcuccuugggacgcaugggugaacuuggauccugacauggccaagcucugucgacaaaccaaccccgcacugaaacacaaccaguacuggguauaaauggggagccccccuccuacaccaccucauacucauucucucuccuucgcucccccccaccucucucucccccuuuaccccccuuuccacuuucccaucucuccccuuuuccgcucuccuccccucccccaucucuugcuguuacugaccacuuacuguguauagguacgaagaucaacucaggguuauaacgaugaaggaaugcgcuucgaaucaaggaaagcuguccauuagguguaguuacacacagggcccacucacagcccagugcuguuggugagugccguaccuugcacuccugggccuuccacaguggucccuugccaggaccugccacucuguuaagaauuaaacuggacuaagguacugcugagcagugggaccucauuggaagcagugccuuuaacuuggagcucggaguuaagggaggacggugugggugcuuuucaugggagauucacccucacggugagucagcaggaggugccgggucucucuccacacaagaugccauuuauuacaucggcgaguuuguuuauggaauauuuauguguguggagucuccucagguugguuuccucgugcaggaaacgccuuguucagauuacagggcaaacugaccuccuuugaggauaguccuuaaauccgacguauuuuuauccagaggcauuguuuacagaaggaucuguaaagucaagaaauaucugaagcucugagguguagaaagguguguuaaaagcuuuuuauuuuuugaugccuuaguuuggcaucuuuuuacaauaaauggaaguaauggcaaauuuguauuugaauugucuacuugaaccguuguccaccauuaguuucuguaagucuaaaaugaagcuuucaguacuuacacuaaggcagccuugggcugcagaguauaacacacccacaaaugugagacugaggcuugcacaaaugauucagauuuuucugugaagaguaauauaguaaagauuuuagguuugugggcuacacauggucucugucauuuguuguucuuguguucaucuuuccuaaaacaaaguuuguuuuaagagaauauacaaaaagaaauccuuagcucuugaguuuggcccauacguuauguagucuuugccaggcuuugcuuuaggcagcuggagugugcugaauuaugucaacuagugaacucaguagagaugagcauuccgaagguggcucugggacucagaauuaucaggggugguagcucuuuugucccuucugcucugccauccucaggcucuuuaugguuaugagauggcugccccagcaccccagcagaguggacauauucaaggcagaaucacacagcacaguggcuuuuuguuugagagacucauuuuauguguauuaguuguuuucuaguaaggagacuuucuucccauuucauuagcucucguaccuuaucgucuaaaccaagccacgugcuuucugcccuuucacccaccaccggcagagcgaauaagaacgcaugacugacaucucucccagggucacccucaagacugaggaucucucccaaggucacccgucugcccacuguggauguagaggaggguggaggagcagguagacagaaaugggccuauuaaaauacuugucacguauuguaauccgugagacacaacacuucugcuuuucacauagguguccgcugcuuuuucauguugaaugguguucuuaaagccggagcccaugauugagggauaaggguaguaccaguuuuaggacaaaagucucagguaugagagucccaacaaagcuuagucacuugucccagugcaccaacugaagauauaaacagagcuggguaugguggcccaugucugcauucccagcacuuggaaggcagaggcaggaggaucacugcaguuuugaggccagccuaggcuacuuggcaaauuucaggccagccugugaucuagaacaacaacaaccaaucaaacaacaaggaaacaaagacagaaacaaaaaccaaacaguagacagacgagacagccacacugggaagaacaguaagggggugggugucgcccauccccacaucugccuuccugguuucaacagaggaagaacuaaggcagggaacaaaaagucugcauaaagaagcaguccuacuucaaguguggucugguugguccuuaucucaguacuggcucugcaagcugacuccaagacauucuuauugcuugaagcggguaucugguucccaugagaugagugcuacggcugggggcugaugucagggaauguucuaccugcagaggcuguuccuggagugcaaggggaaguacagggcuaaggcauagacuggagacuuccaggcaucuucaugggagucuguaaaaaguugaugguaugguccccuaggcuuugaucucugugaguucaaagcagucaggacuauauauauauauauauauauauauauauauauauauauauauacacacacauauauauauacacacauauauauauacguauauauauauauacacauacauauauauacauauauauauacauauauauauauauauacacacacacauacauguauacuauguguauacacauauacauauauacauauacgcauaguauacuuguguguguguguguauguguguguguguguguccuaggcucuuuuuaugugccuucagccuugaaggggagugagagggaaagcaucacuggcauuuggauacugcuugaguggucagcaugccuccaugcaggauuaagcaggaaucugaaccgccgucuuaagcgagagggcagaugcaaaaugaaggaggaggagugguggugugcaccuacuccacauuuuacuaccuagguccuagcacuuucuagcaaaagugguucugaguucccguuacaggaugguggggcugugaauagaucugugaggggaaagaugcucccugggacauuugaaaaugguuggagagagugugcuuuuuugcauucuaucaguagaggccaaauagacaacaaaccccuaccccagacaaagaaccaucugauccugucccagaugucaguguggcugggacagaaaugaccaggugagccaucgugaagcagcaucuuguauaccugacggagaauuaauagacucaugacuaaguguaggcaaaagaguauguucuaaaaacagaaugggggugggguaccauaauauguuugaaacucuggcaugcauggacauucuuacuuaaaggauauauuaaaaaucaaacaaaaccugacagacaaaugcuuucuauucauucuuuguuuaaggggaauauuacaccuucuauuaaaagguagaacacguggguuggggaucacaagguagacgcgaggccaagcaucagacugguaagugucagucaggccucagagcugguugcaucuggucuacuuuuuaugaaacaugcuuuuggucucaucucccucugcuccuugaagggucacuucccucccucccagcugcuccuucagaaacagcuucacagucuucagaccacauggcgacagggcucacuuagccaaaaagacaacugcuaugucuuauuucaauucuugccucauggaaauucacguuacuggagcugcuaggguccgagcccaggcccugggaguccuaacaaggggaggggggcgggcugugccaccuacccucaguaggcuaauuaaagacacaaaauaauagggaaaaauaaaaaaaaauagauguauuuaauguggccacauugggaaaggaaacaaggacguccagcuacaccacccaucuccuagguccugccauggagaugucggcuuaaacagaagccaagagcuacugcccagcauugacaaugcccucaugguguaugggaccugucuguccugcaauuggugugacagauugucaggacuacagggaaucucugagagggaugugcccucuggcuggcaccagauucagccucuuccuuugcccagagugagcuuccuggguaaacguccaguugcuggggguguguaaaaggaggaacacgaaugucuccucacaauaucuauuuccuccagggcuguuacacuaaugcucugcucuccuucugaaagugcuuaucccugcaugguuccaugucucucacucauaaauugccccgucccagcuuuucuguuugagggaggaggaagauuaggagucuuaaugcaggguuggcuugaucucagugugacucagaauuguucuuagcccggucuaacccaugcacccuacagaacagugacaucacauacaccgcacauaaggcagagacugaggaacaucugcacccauuagguggguuucgcucuuccuugacuggucagugccugcucuuuguggacgagccagauguccuuggcucaccgagccuauuggcugcugcuuugcuucagccauaagcucuuuagagcuaggauugccagccuggccaaacacaggauccgcuccucaacccguucuccugcuaaucuugugacuccaaacacagacaauuccuguccauauuggaaagagauacagaggcacuugaagcaguaacucacguucuuguacacaagugugccugcuagagccaggacagcgugagagccagaugccaaagugcacucauuaaucaaguaauccauacagaguuuggaaaguccccccccccccuuccagaggcucuggaacagucugguuugcagauggagucaauuaagaggaaacaaugucuaccauuuggugcuggcucaaagaaagcauaaaauuaaagaaaaaaauuggcaaagucuuguucagcauugaaaauugaaguucugggaauggaaacuggguugaaauggcuccccccauaggagggcuauaacugaauaguuauaacucggucgugaugagucuagugcuucuagacaggugacugggaagagcggaaguaugcagggagagagcaggagaguggcugguuucugccuaagaacaggaugcucugggauggguagggagugagagauuuucuuuucuuucuuuucuuccuugcuucuccucaucuauuccaccccccagcccagcacagcuucccacaaaugccuuuuccuaucaagauucagugacagguucugcaguucuggacccccuuuaggggucccucuucaaacaccccgaugcaugccuucuucacaguauggcauuaacuggaugggggaggaaggagcccuuguccucugguucuacaaagagagcaugcauccacacagaaauuauagaagaaagauguccaccgucccagaagacccauaggagcucuuagauagccugaaguauuuacaaaaggagaugacagauucuaagcccaugccagcaacaccaaucagaaagcagcuuuccuguuccccagucuaccaguucuaccugccagcugugaaggagcugaaguuagggugaucugggaaggggugcgaggaaggagagccucuccuaucuucacguuaggccuaagcuguaugggaguggcaggccaaggaucccucagcuugaaagaacauuugaaauuuugacuaguauccaagccuggacauuuuaaggcuaauuucacacuguuaauuuaaaaauccuaaaagugcuucugcaaggcaaaagacaccgucaauaagacaaaaaggccaccaacagauugggaaaggaucuuuaccuauccuaaaucagauaggggacuaauauccaauauauauaaagaacucaagaagguggacuucagaaaaucaaauaaccccauuaaaaaauggagcucagagcugaacaaagaauucucaccugaggaauaccaaauggcugagaagcaccugaaaaaauguucaacauccuuaaucaucagagaaaugcaaaucaaaacaaccuugagauucuaccucacaucagucagaauggcuaagaucaaaaauucaggugacagcagaugcuggcgaggauguggagaaaggggaacacuccuccauuguuggugggauugcaagcuuguacaaccacucuggaaaucagucuggcaguuccucagaaaauuggacauaguacuaccggaggauccugcaauaccucuccugggcauauauccagaagaugucccaaccuguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuccuaggcaaauggauggaccuggagggcaucauccugagugagguaacacauucacaaaggaacucacacaauauguacucacugauaaguggauauuagcccaaaacuuagaauacccaagauaaaagauacaauuugcuaaaugcaugaaacucaagaagaaugaagaccaaaguguggaaacugugccccuucuuagaauugggaacaaaacacccauggaaggaauuacagagacaaaguuuggagcugugacaaaaggauggaccaucuagagacugccauauccagggauccaccccauaaucagcuuccaacgcugacaccauugcauacacuagcaagauuuugcugaaaggacccagauauagcugucucuugugagacuaugccggggccuagcaaacacauaaguggaugcucacagucagcuaguggauggaucacagggcucccaauggaggagcuagagaaaguacccaaggagcuaaagggaucugcaacccuauagguggaacaacaauaugaacuaaccaguaccccggagcucuugacucuagcugcauauguaucaaaagauggccuagucggccaucacuggaaagagaggcccaauggacaugcaaacuuuauaugccccaguacaggggaacgccagggccaaaaaaauggggaugggcggguagggaaguugggggggaggguaugggggacuuuugggauagcauuggaaauguaauugaggaaaauauguaauaaaaaauauuaaaaaucaaaaaaaaagaaaaaaaacccuaaaaguauauuucacacaggauuggcugacccugacagaaaacagcuugcagagcugugaagggcuauaggagacaagaaguaagucuucuguacacaugccacagccugccuuuuccaacagaacguuuacauggaacaaucauuucuguugucaaagcccucccucuucuacaggaagaccagauaccguugcuauauuuucaauucuaauucauuuucacaaaaccaaucuaucuucgcucuuuuccucugagauguccgcugugacuguuccaguuagaugcugcuucauucaccacccucaccuuugcugacacggugcuggaagccccuucccguguuugggaagcccuuccuuccuaggcacacucagggauaaaagcaagugccagaauccagccuccuuccagccaaugugcgaguuguuccugaacaccgaggccuaugacagguaaaagcagaagauaccugcagucuguuuuggugaccaguagcaguaucggagcagcaggggcucuauggaguucucagaggugggaauggcauagagcgaugugccgguguggaaaguggagccugcagcgacugcgaccaucuuggaugggccaguucuguagggugaauugugccuccauagcugccaagacuggcuggcucucugaugcuucuagagagucaguacgcuucucugggguccuuaaaaauaauuccaaacuuuccauggcugcaaagacacccguauggcuuauucuaacauaccauguuuguaagcgugaugcuguuauuaaaaacaaaagauccauccuauccuugauacaacauuauuaucuaacugggccuguuaguuggauuucccuaccaaggccccuuuuauacuuuaaaacccaacucaagauaccuguugcuuucaguugcuauuucuccuuagucaucccgucucuuuccguguuucaaauagauggugcuggucaguuauuuuguacagugucccuugaucuagacuuucucaucauuggauuggagauaauggauuugaggaggaaauaccacacagaccaagugccuggauucuaugaugccggguaaaugauacccacgugaccuaaggagucacuguuaaccuuaaguagcugauuaaagugcuauuucccaggcccgaccacuuugaaguuauuauucuuucagccccauccccaccgccacccuuguuuccccucugaauguuacagggcguugccgaguccaguccauuugagggaguggagugaguuucuaucuccuggaaagggacaugcaugguuuucgaauucuccugaaaagaauucccaucuccucuacuuacuaugcaguccuuaguguagcacaagaaaaggacauuuguugaccaaggaaaaagucacagcugcucuuagaacaugacauaguguguaauaaccaucauggccgggccugaagagguauuagaaacuaagacaagagcccacgugugagacacaugaguggcuauggugggcuguccuccccuuugccagagggcuggcuucugccacuagggucuucauuuugauuuccuccuagccugaaauagcugcugccucugguggccugggugucuccauccuaugcuccaugguucuguaucacucagggcaucacacaaccaugacugaaggucacccggcccagauucucaagagacagaaacuccuuuugucagcccggacuuuugcuucauucuucuuggaccaauugucuccuugugcccaucuguguggccagaaguaggguggaaguacuuccuccuuaucaggauccuagggaggagucaacucugaaaggagggaggacagcaggguggcgcuacagagugcuccucuugugacuucucccugagaugagucuuguuccuaaaauagcagcagaaacugcauuuguaucaaagcuugcacauggauuccuugcuccacaaguucuaggcccuucuucauuuucuagugucuugacauugcuuucucaaacucguagagcaggcagaguuagccaugggcuuguguccuccuuuccuguccuaccuguuguccccagaggcugucaagaucuuccucagaguacggcuuuagggagguggaccggguauguuuccaaauugaaguuucuaaguuagcuuccucuucaagauuacauugagggacucugagaaguucagaauucccugacccagaccuucaugagcaugaacauggcagcaggaaacaagaaaaguccaaauuggguagcauagcugaggcacacugaauaagagaguugguagagaugggagcagaacuaggaaaagugaguauggcuuggggucaugugggcuugccacagcagugagaacaaagaaagaccagcuguccugagcuaagcuagaugcucacgugcugggagcugugaucuucauagcuagaggcagccaaccccggugagaaggagugggaggaauugaggaacuggugccuucaucgugcccucccuucugcuccccuccaaauacuuucacugacugacucaguucagaagucaggggguggcuugcuucugauccaguccauugcaagcagccgccuggggaaggagccagauggagagugggcguuauggcucgaggugcguucagcagguguccggcacaagucagacagcaguguuguagcugaaggucaagcacucccuucuaacuccaaucacugucuucuuuuuacuuccucacagugcagccuucucauacugucuuaccccgagcagcuccaagacuccuugagugucacagacaggaggaacagaugaugguuauagaaaccguaaggggcccauuugggccugccuuucacauuguuuaggaaagaaagacuugaccccuuucuccugccuuucuuggguuuucucccaggucuagaagcccagaguccaucucauccaauaccuuguggccuugcuuuuccguagugagcuuuggagaacagcuccugaugggcacaggaaggucccccacaguuuuugaguacauaugcaaugugga

SEQ ID NO: 7238 - RNA, 26388 nt, Mus musculus
ccgaguugcagucgcugcugcgagccgagccgagcugcacggagggcgagagcggagcggggagcggaccggugcgcugcccuccaggcuucccuucggcguucgggggggggauccugacugcaggggcccucggaccggcccgagcucggggcgccgggcucgggaccauggcgcugcgcgcccgggcgcucuacgacuuuaaguccgagaaccccggugagaucucccugcgggagcacgaggugcugagccugugcagcgagcaggacaucgagggcuggcucgaagggaucaacagccgcggcgaccgcggccucuucccggccuccuacgugcaggugauccgugcgccggagccuggcccuccggccgacggcggcccgggagcuccggcccgcuacgccaacgugccgcccggcggcuucgagccucugcccgccgcgccacccgccgccuucccgccgcugcugcagccgcaggcgucacccgguuccuuccagccgccgggcgccggcuuucccuacggcgggggcgcccugcagccgucgccccagcagcucuacgguggauaccaggccagccugggcagcgacgaugacugggacgacgagugggacgacagcuccacgguggccgaugagccaggcgcgcugggcagcggcgcguacccggaccucgacggcucgucgucggcgggcggcggugcggccggccgcuaccgccuguccacccgcucggaccugucucugggcucccgcggcgucucggcgcccccggcgcaccaagcgucuggagccaagagcucggccacggugagccgcaaccucaaucgcuucuccaccuucgucaagucgggcggggaggccuucgugcugggagaggcgucaggcuucgugaaggauggggacaagcugugcguggugcugggucccuacggccccgaguggcaggagaaccccuaccccuuccagugcaccaucgacgaccccaccaagcagaccaaguucaagggcaugaagagcuacaucucuuacaagcuggugcccacgcauacccaggugcccgugcacaggcgcuauaagcacuucgauuggcuguaugcgcgccuggcggagaaauucccagucaucucggugccccaucugccugagaagcaggccaccgggcgcuucgaagaggacuucaucuccaaacgcaggaagggucugaucugguggaugaaccacauggccagccacccggugcuggcgcagugcgacgucuuccagcauuuccugaccugccccagcagcacugaugagaaggccuggaaacaggguaagcggaaggcugagaaggaugagauggugggcgccaacuucuuccucacucugagcaccccaccugccgccgcccuggaccugcaggagguggagagcaagauagauggcuucaaaugcuucaccaagaagauggacgacagugcguugcagcucaaccacaccgccaacgaguuugcgcgcaagcaggugacuggcuucaagaaggaguaucagaaggugggccaguccuuccggggucucagccaagccuuugagcuggaucagcaggccuucuccgugggucugaaucaggccauugccuucacuggagacgccuacgacgccaucggcgaacucuucgcugagcagcccaggcaggaccuggacccagucauggaccuguuagcacuguaucaggggcaccuggccaacuucccagacaucauccauguucagaaagguaaagcuuggccuguagggccgguggcacgggguguuuuuuuaagguagaaaguggugacuuggauaggcauaccacugccggguuucaggcuccuggugguucuccgugucuggggaucuuaggguuguggacuguugggauuuuccuuuccgaguguucaguggauuguuagaaugcuccuucuagucagggacugccugccacucuuuagagggcuagauuuucagaccguguugucacuucagaauuugaauaggcagaggaaucagcuguucugauguauaagcuugugggcugggcagaauuggcaggggcacccaagccagacuaggcagcccuuugaacacugcagggcuggcagagaugggagaggcaguaggaagaauggaugccugggaauaaagguaaggcaggcuuuccccuccauuccugcuguggcaagggaguuuggccagcccuguucacagugcuggggcagcacaggaacuuccugugucagcuugcaggacggccuaaaggcucucgaccuucaggaacucagcucuccuuucucuggguuuggaguuuauuaaccagcugacauuuggacuguucuuuaggaaagugaugugggagacuagcugggugaaguaggaguguugugucugagagcacgaauucgcugucccagcgacagagugcuuuaguaguuuggugugucgcuggcuuuuguuaaagcacugacuuugcaaaugauuuuuuuuuuuguaaacaucagcagucaugccuggcugaccugaaguuacucacuagcuggccuucugauauaauggcuccauugauugagagagagagagaugggagguguugcuauuaagaacauggccuugcuucuggagguccggugugggggagguggcagucaccuacuguagcguccugggcugguggaaggcugcuuggauaaccagaucuggccuuggguaggggggugaccugcucacuugccggccacguggaacagagcauuugugaacacaucuggucuuuggcuuugucuuucuuauauucagccaaguccuuucucgauuggcucucaggacgcaaacagaacaaaucugugucaagccuucagccguuuggaaauagcggucggucucuuugccaucuccuuccucucugcacuuuccuuccccuccucugugugacaaggccucggacucuuaaauaggguggggggaugggaggaaguucaaagguccugaguccauucuugcugcuucgaaacacagugcugccguuaucuguggaacuggucuccuagaguagagcaacuuuuuuuuuugacaauuucuaaggcugaguuagcucucggagcaauacuauugcugcuggccuggguuuaacccucaucugcaaucaguauguuuuuaagugguuaugaauccuuaccuucugggcgacugcuagugacacugacacuuugagucuuuaaugcaagaugauaccauuucgauuccauuguauuacuucggucaggucacaugcuggcugccuacuuaggaaugucccugaguuuguacagagcgccggcagucaccgaaggagccccagcacaggcacccgugggggcgggcaggugucuguuugcuccaccucugugugggcucauucguggguuuuacugucaaucaggccuuuggcauguccugcuguggaaacuguauaucagaaaagcuguguuuguccaaagggcugcuugaaugugcgguugguucuuuuagucuagucagccauugaacuuuuuuuucccuaaauccuaaaacuuggauugucuccuguugcuuaggcucuggaaauccuuccuuucaaaaccagggccguuucaugugguuuaagcaguucuagagauuaaacaucuguacgcauuggcagcgaauuuuguuucugcugucgccuugguguguaaugucuagaugacucgccuuaagaacggugccaccuagucccgugcauacgucccguguaagcgucugcuuacaggccauaucugcuaaggaaguacagaugagguuaaaauccugccccagccugggugaagcuuuuucagcaugcuaggggacuuggcgacuccccucaacugcauagcugcuguuguguuggaaugacucuuuucaaccugagcacuuaggaguuuguuuacugcuugaggguuuauuuuuuccauccaaggucucaaaguguaaucacaucaaagacuuuugagauuagcaacagaaaaaaaaaaaaaaaaaagacaaacaagaaaaacucacaguggcucuccaguauuucgcuguaggugauccaaaguucacauuucuguuuaggaagaaaucuuagaguuaagaaauucaaaacaguugucuuaccccuggugugcucauuguuuaaggaaaggacagugcuucguuguacguacgcgguaaauuaaaauuaaaucugaugaaaacgucaguuucucacgcuaguggucuucaaguaacaagugcugaaaugguuugcgaugagaaggucgggcaggaaacgcaggcauuuccaucauuguucagaguuccauugaacagcccugcccagcaggcuguggcuucagcaaccccuuuccuaagauucucgggccaguuaguaaucuuuccgugaguuuucaugguaguuuucuuucucuuggguaauccuguggcaauacuuaacuucccuagugaguguaacugcucaagcccgggucggaaacagguucugcuggaucccuguugcaaucuucccaguccuuccuucgcccugggagcauugugucucagaacacaacgcuggccuccuuugggacuaagccaucccggaggggacccccaccauuacagaaugaggguggguacuccuaaauaugcugggcuagcuuuugcuuaggcuaauaaaggucuuaguuuaaugcuuugagcaaaggugaagagagccauauggucccaucagcuaaaugauaauucuagaauuguguuuuuaaaucagcuaauggacucuuagcuaaauagaccugcuuaguuuaauggaguggagcggaggcugaagggggugggguguuguagucuguaguaauguuggauggaaauguagaacaugcucagguuggcagugguaguuuuucuugacuuaacaggaguccucucagcucgguagacaucuguaggccgugugugcucagcucucacuggccuggaaacccagaggcucugauuuugcuucccuccgcggugggguuuucuuuccucucuguuuaucauuccugcccgcagugugcuuugaugaugccggagcccggagacucugcggcaguacaugggagaggguuuauugugcgagucacagcacauucagccugcuuuccaaagauacgcugagcuucuccggcuaauaaaagccacaucuggauggcagaaagccacaguuuaaaguuuuacauuuaucuccugggugucacagccggggacgaccauaaugguaaaaugaggagacccggguuuucaucuucucugauaaauacggacugcaggccuggagggagucacacagagcugccucguuauuccaaagaaaaaggcaucaggccauggugcacucugaaaguuugaaggagaaucuuaggaaaggaguuuccagagcuacagcagugcuacccaguggaacuuucagcaaugacagaggagaugucugccggugagaccucaucugugccucggugagaccucaucugugccucguugugaccagagaaauagagucuugccuuucgaauucuuugcuugaugcugcaaacucugacuucuuugcucucuaaauguuccagauggcacugccuuuucaaccaaaaacuaagccccggaccugaggugcgguggcggccagaagccggccuguccguccugccggguaggauuucaccacuguaccugccuuucacccgccuggggaggguggguccuguggccucagacauuaauuaaagauagccaggcagggcaggcaaggugaggccguggugcuccggcauucguucagugccccugucuccugugcugaaaauagccugaagaaggcggugccaggaguacagagaaagggccaagggggcgggcgggcugugugcagguucguccuucugaaaccccccugggccagaaacugaagccaggccuucuuugaguuuaacuguuucaucucgacuggaucguuucucucuucuccuaccuccaccucagcuguugacuucauuucucgaugugaccuuugccccaguuugcccuuuucuuccuuugguuuuugaaguugaggaaucaguugcuugguuaaagcuugaaugugacuggcgaggaccacuucuccucccgauccgcggcuguccugcccugguagcuggauggaugccucuccauucucccggccagugguuucuaaacuuugaacccugaaguccugucugucccacggggaagccaaucacagcuggacugagaggaggcaggagacuuccauuccuugccagucccaccaggaacucuugucacccagggguuccguggggcaucccuucuugaugggaaaugacaccugucaggucaccuuaggaucuccuagcacaagaaauucuaugauucacuaggaaacaagacauuucccuuacaccuagguuccuuuuuggcagcuguauaagaaucugcuguauuauuucuaauguuuuaaaaccagaguuuaggauuaaguuggguuguaucauuucugaagcccauaauguaugauugucaccaguaaaguggucuggaggcugaccuguguuuacugcgguuguauccagaaggcagaggcuggaccaccuggcagcugggguucagacagccagaccagauuuacugaggcauggauagcacccuuggauucucagugaguccucugcugugggaaagugguggugcgucagguuucggagagccuggggguggggguggggggccacaauggaaacaagguguguucuuaguguaccgguggcacuagggagguugcagggcuugggucugacagcugagcugcaguagccaagaagucuugugugcagcuucacggcugugcaccaggccugucuguagacgagcguggugugcucuggugggccuuauacacgagugaguggaugcaacuuugaagaguaauuggaaccuccacaaucuucaguggcaaggagggagaccucccucaaggucgucaugaagacuauguuuucuggugcucaguagcuacuuacuaaguguuuggugaugagaaccggaaggugcuuuaaaagaaugggaauuuccacugaaacacaauucaaauaagcguagcuucccuccaagcagcccgguaaccgucagagcugcagacacaggggcaagagcugggggaaucgccagcucgggguguucugguuuaaucagguuauucucuagugagaccagaaguacuacuggcaucagagggauaaaugcagaugcuaucuggagugguugcuauuguucacauuggauaguuuauguaaauucucucuggucagcccuccuccuaccucagauuaauuugugcaggagcagauugcuucagcauuucugagcauccuuccccacgucugugcagagaugauguucugcauuuccuagauacugcuuuuguuuagaugauuuuuuacuuuguuaaauaacauaauuucuauauugaaagcaaaacagcccaagacugcagucaacguuuagacauugucacaggcugguuucaggaguguuuugucugcccaugugaccacaagcugggagcaugaaagcccuuuaucagcggacaguguugaggacauuaaguucagaucaguaaacaugggucccuggcuucauucaucagaugcuucuagagggaaggaaggcaccuggccucccggcugccggggaggaagguaccuggccucccagccaacgucugcaaguucuagaacgcagaugaggguucuagugaauggguucuagugaggguugucaugaaaggggccacaaagcagucaguuggaaugcucuuuuucuucugucugcaaagagaacuuuauuuugaacucuaaauacugucuccuuucccgaaguaagagaaaaucaaguaaauaguuuacuuuucauguugugaccaagcaucugauaagaagggaagaagggcuugcuuuuacuuguguuugaaagugaaaaccucacccugggagaggagacacaguggguagacaugguggguccgugauggcugcaguguacaguugagauucuugccugcuuccaacucuggaacaggaagcagaggggaagucucgggcuuucucacucuucucuucagucagugugagaccuacccagccucuauguggucuucaguuuaucuuucuuauuagccccucacagacacgccuaaagaugugugucacgaaugccuuuaguccagucaaacugacagucaaaacuagcccuccccgugguguauagucugacuaaacuggugcgaguacuucgaccagaguguccauuccuacccuguuccuuacagcuuuguaacucuugcugugauuggauuuuccucuguguauucaguggaaugggugauggucacugggagaaaggcaaaaucauuaaguuuauacauaggagccucuaaaagauaaacucgauuuuuauugcauaaauauuuaaguagacaucauaaccuaagcacugccaagauuacaucauugacccaagugacugcugcccuugguugcuuacauucuagcaggggggagacacagugagagacaaacacagcaaaccguagugcacaacacacacacacacacacacacacacacacacacacacguguguguguucagaaguggggcaggggagggaggguguagaagacaggauggagcacagagaaguauggccaauguggaccucacugaggaggugggguuugagugcacugugaaggaggggagaggagggaaguuacagguauugcaguagaggguuguugggcaggcaggggguucaucuauaacaaggcccuggauaguugugggcuaggaagguugaagaauagccaggaggucaaagguugggucuagaggcuguccuaguaggagaagccaucacagaaaauugcauugguauggcuuugugggucauugucgggaccuguuaaaaauucaagcaagauggaagcucuucaggaucuugagugaagggacagcauccauuuguacguuuccuaguuaugccgaguaaaagaaugacucagacuggagcagguacaaacaggaaagcaguagaaaugguaaggaagucccaggccacccgagaucuguguugaaggugcagucugcaggguagaaggaacuuuuguuugagccugguagauacauugggcccugcaucuccuuuccacacaagcgcaggcagaaaccccagaucuggaccuagugcuuggagucuccuauuuauugagggugcaucccuugauagcaguucaguguagggcuuggugauugucugcuauuuggugucucccuuuuguguuccugcauuauauagcuacacuaacugauguguuugugggaagugcuuaauacacguugguugaguuaaugaaacaggcacuuacugauacacuacuuggcugacuuugagagagauguuuucagugacuuaggaaaugcucuuguuuucucauuuaaaagugcacaggaucugaagauagaaucuacauauauuuuauggauggagucauuaauaugugagugauuuuaaggucuuagauuuacguggcuuugaauugacuauucaaaauucaucggaggaagaaaaaugaauaugccccucaugauauuucuuugugugggcugcuggguguuugaacauggagagacauaguucgagcgcacacacacuucuuuauggggccccccuuuguuuaauuuggagaacgaagacgugugugcauuggcgugauggauggccuuggaauccuggagcucagacgcugagcagguggugccucugggaauucacuguucuguuggguaggauguguguauggaggacgcagauaaaaggcaaauucaccucagaaugaguguaugaacauccaggagguggagagagaaggcuugccagcuugcauuaguggucuguguggucugggcagaggguacucgguuucuacucugaugaaagauauucacauuugacuuuuggaagaacacggauggagaguacccgcuuggucuuggacaugcuucagaauggguguaacaaaagcguuacagcugggccauucauuggugccacugaagucugaaggaacgucacguaggacacacacagucaaggcauacacugauagaagugcaucaggagaagguuuucuugguuugguuuuugguuuuagagcuuuauuguagaaaggcagagagagagagaagguagagaaggagaggccggccauggucacguggagagagaggagagcgagagggcuagagaagccagagaggagaagguguucucccccccucccccaagacaggguuucucuguguagcccuggcuguccuggaacucacacuguagaccagguuguccuugaacucagaaauccaccugccuuugccucuggagugcugggauuaaaggcuaggagaagguguucuuaguugcacaguuugguucaaagauaaguuuugaaagcaauuguaaauugggagggaaccucccagacuaaaggaaccgcguaugcaaaaaucaguccuggcagccucucagaaucagcugggacccacccagcuauugaaucugaaugucaaaugcuugcuguguggccuuuagugcuuauauuagcguuaagcuucugggguuuacaguugcuguuuggggguggugggggagucuuauagaagguggguauuaauauggccagguuagcauguccgugggacagguguuuggugugagaagcuuuuugaaguaauugaggcaagacauaguaaaaucuugaauggagcucagugacacaggauggagaagagacaggaacuugugucugcagaaguggagagagggggacauaagaugaccuguugagcgugcaguguggagccaccaguguagaugcuggcagggcagauagcuuuaagcggaagucuguaggcugcagccccugggcagguguacgaaagugcucguugacggcacuugagcuaaggauggcucucaaugguucuguaagcgcauguauaguaaccccaguucugcuuguuggucugcaaagccuaaaauguuuacugucuccccucaaaggaaaugcuugcugagccucuuguuaaaggacaagcagguuagugggauggagauauaagcggcgauguugcuguuuaucgaguuugcucugugauuuucgcuauuucaggcauacggggguggggggugggggggcauuacgucauaguuguuuaaaacgugccucccaucucuguuguaauggaauccaugcuuaauguuuuuaagcauugguguuagcuccuguauugguuuccucgggcggcuuuaacagguuccugagaucugggugugucccguuacacuucugcagacuggcuguccuaaacgaagguguugguggaaccauugcucccucugcagagaccacuuccguuccugguuacgggccugccucagaguggccuggcuauagguggucacuccagccuuuacccaucgugacauggcauuaucccuguguaacugacugacugacuggcuggcucugugccccguuccuuccugccugcucugucacauuugacaucagcucucuaguuacaugugcagagacgggcuccagguggacaaggauggggcgaugcgcuuuaauccagugcaguuagcuagccccccacccucacccccccaacaggaguauuauuauuaccuccugaggcugagagguugagugaguccuguaucacaccacugucaaggcaaaggcaggauuugaauugaucuuucuuccuugaaacuguugugcuuuucacugccagaauccuugcuaggaaauacaguugacuuuuuuuuuuuuuggggggggggcaguuggcaaccaguagagguuuuucaacuaaauagugacacccugcccauuuucaaaguagcuagcauaguuugaaggcugaccauguaccaagcaugcauggcacguccuguucuacauucacuauaccugcuugaaccucagggagcuuuugagguagacacuccacaauucucgcugcuucaccgccuggaagcccgaggccccgcuuacuuccugguguucccuguagaucaacuuuaggaagcuccgcccaugcacgcggaggggcggaggcuguugagugcgucugugaugcgcgcagcuuuggaaagagcggguggacuugagacaucugcuagcuccaguggaagcacuugguguggugcuggcuguggcagcagccuguguuaccuuagguguuaaguuggaaacgcugaagccagcaguagggacagaugagagaggaggaguggggugaggagacaggaguggggcugaaaggaauuaugggaacuccugcagccaggcugcuuucuuuguuuuguuuucagacugguccgguaaguagcccagguuuaccuugaauuuauggaugucuccugcccuagcuucacgccgggauugcaggcgugcgccacuauggccaccaucauuguucuaauuaaaggaaaaacuccaguuucuuuugaucuacaccgguaaagggaggcucuggcuaaaauaaacggguaucaaagccccgccuccugaggcuggcagcauaaaugagugauuccagcucuugacagugaccaacaaacagagccuuccaggagccuggggguuuaugccuuugucucacagggcacucaguuccugcucugcaccacgggauacccguaaccagugcagcaugggucaucucuuaauguucuugcuagacauuuucuaggucuuccguuuuggucucugguugguugguuguucuuuuguuaucuuacccaaggacgugccagaggaaagaguaaagccagggacucuugguccuggccagcacugggaagcagggaaaccacagggggggggggugguggugguggugaaggggcuucaguuuaaaguggcugacuuaggaacugccuccccccgccccccaaucuuagugauccuuccucagguggugagcaggagcaacccucauggagugggcacagugaaagaaggaagagcagaccugagccgcuuuccuugugugguggggguuguaacucagcuauaagcuggacacucugagagaaaaaauacuagacagcaaaaauacauccucuggaacuacuccugugguuccagguuagcacugcccuccugggagccuucacagcccugccuccugggaggccuuggcucugggcuuccagcuucccacuagaucuggccugccccguggggagugucuccucuguuuagcaggcuguagagauucgguuuuagcccaagcuccauuuuaucuucccagaacaaaagaaaccaagauuuuacuccaauuaaaaguacuuucugaguccacuucucacugguagccaaccauuccuggcguuguuuggggagggucugcuaaauguaagugugggcagcuggcuggcacggcuuagugggauuguguggccagaaaacacucaagaaaagaaauaauacuugcuuugccuuuuuuauacucagaguuuuaaagucuuuaucuguauuuguugauguagagggugcucagcccggaaccuggucuuccaaaguaaaggcguaaaagcguaaaggcguaaaggcguacuguauguagcccggugcugugaggccuccuugguuccagagcucuaccucaggcuuugcucgaggagcguggcuccccgcugagcugcuucacccagguuuaguauuucucaggagcucaggcuucaucagaaucuuuaugaaguuccagcuacgaacauucuguuuaacaacuucaagggccccauggcucugggcuucauggggaaggaggcaaacggagcaguuagugaguuagugagugugccuccugauguucucaugugcacuaggguccuucuaccuguggaccucguggaccucggucacuggggugcagcugagccagcaaagcucugcuagcggccaucaggcuguagcagggcuuuuguaccaccaacaagcaacuucuuuuuuauuuuuagggccaaaccgaacuuagagaauggaauucuuuaaauggaauucuugaaaguucuuuuuuuguuguuccccuguuaacacacagccaggauucacucacucuuguccuggcucucuugaaauagcuccagacuucccuucauuuagugcaguuccaaguucaaagugaauucaaauuaauuuaccuuuaaauauuuuagugcuugguuuucguggccagcuuaagccccuucaaaaccuuguuuggggacugggcauuguaauccuaggauucugagagacugaauuuuagaggauugugaauucaagaguaggcugggcuaccuaguagguccaugucuggaaaacagauacaagcugacaaagugcuugcucaccagggcaguguguguaagugugcucaaacccuccucugacuugaggcaguuuggaugacggcuaccugugacugggcaagggaguuccuaccaggcuguggucaaacaaacuucccagcuuccuacgauccaguggguggagacccaaaaagaagguggggaacaggcugauggagggaggggggcuguaaggggguggggaccaggaggaggaggagaagaaggaaguaggccaccuugguuaaauuagcauuuucuuucagcaucuguagcauaggggaaugaaaauaacccaucccugccauccacaccucccaucccugcgcucuguccucugccuugccccuuaaccuugaggccucuguuuccugagaaagcccauaggaagaccaaaaaucuaccuuguguuuuuggcaccuuggugauuucaaaauucagugaguuuuuccaccacuccccuuuucucuuucaagggaaaaagcagccuuuggauggaucccuguugcuuagugacugggcuuuuuguguagauggcuuuugagggacaaaaccgggaaggcugaggugcggagggagaauguggggggcacaaagugccccgcaccagcccuggcgagguuuucagugggguuggggcagcccuugaggcaguagagcggcugugauguguggaggggcuuuuccugucucuugcuggguugguuaugcgaggaaaguugccuguccccuuagaggccagcgagacaccaggcggcuugcccaggcccuuguugacuuggcccaguuuagguagcuugucaguguucacuaaaaccagagcugcggcgcucccgaggucuccaaaggcggugaccugaaaugcuuggggggcaguagcuuuuuacagaggggauucaugcagugacaccgucguauguaaauagugucgcgcucugucacguggcgccgacuuccuugaccauuagucauuuguagaauuugaguccucaauguagugauauuaauaaacuuuguuaauaauuaauucuuuuggcucaguauucaugguaaacacgaggaccauguuccugauaagggagcgugugcagagacucgccucucuggcuuugcugguggauaagacuucacaaggggcccuacccugguggcacacuaacauaggaaggggauggaagugaaucugagaccucgggcgucuguggagcugauucuaauguuggaaaugcgggguaaaguuccuuccaaaggugauaggaguggggcaggugugagaaugaaccuugcugaauuuugcaguuacagagucugccuuggaguuuaggagauuuuguucauaacagcaaaguuaaaacauugguuuacuuccucuuaacucucaaaauauggaacaugaaaggguccccuuugggcuuuuaggacuaccuggucucuguagccuaggcuggucuugaauucacuauauuguuccagugccuuugagcuaaugugagcuuccugcuucugcucccaacuccugggaugcaggugugagcuugcgugcuagcuugagaugcucagcucacguuguaccuguagaugcccauaaaguugucagcaguccccuggagacaccuguguaggaugaaagcgacaagugccaggcuggcugccaggugggaauggugggcccuuugaaacacauagcucugggacauucuggaccagugacaaccucuuacuuguaagauucuagaauuauaccaagaacuuccaagcaccuuucggcuuuaaauaaauaaggaaggaaaccuggcaccagcgcuacucugugcaccugggccagagcugaagcucgccucucaagucugucaggccuggagggaugggguugguaauccaucggccacugaauaaaaauggcccccauaggcccacagagagcagcacuguuaggaaguguggccuuguuggaggaagugucucugucccuuccuguugccuugaccucaggggucagggugcgccuuuagaaauaaaucauuagcugggugaacuuuuggucuuauuagagaggacuccggauaguuugucaaacuaacucaauaaaccaaccacucacuguacuacucacuguaaauaucccuuucgacacaugucuuaguuaggguuccgcugcugugaagaaacacagugaccacgacaacucuuuuaaggacauuuaauuggggcugguuuacaguuucaaagguuuaguccauuaucgucauggcaggaagcauggcagcuugcaggcagacauggugcuagagaacgagcugagaguucuacaucucuuuguuuuuguuuguucuuuugagacauguuuucucuguguagcccuggcuguccuggaacucuguggaccaugcuagccuagaacucacagagaucugccugucucugccuccugaaugcugggagguauacaaccaucuccugacucgaguucuacaucuugauccaaaggcaacaggaagggacagagacacuuccuccaacaaggccacacuuccuaacagugcugcuuccugugggccugugggggccauuuuuauucagucgaccgcaguguaagcuuuuuauguguuuucuccugccccuuugaccuacucggggagccucuccuaggaaggggcuuuuagaguguccuagaggccgggcugcugcucugggacagccugugcuaccucugccuucugggcagguugcucaaguguugaccucacuucaggccccuuccugugcuuggagccugugucagggcacguuuccugugggugacucaggcugcugguuucaccaccuuccuguaagaagcaaguccucugacccacacggccccauaucucugcugaagagcaaaccaugcucuguaguagacccuuuaaagucagcgugccuccuggucagguuauuccaggcaaguaaggucccauuagaaaccauccccacccaucacuuauacacuuuccugucauuuaugcacagguucacgauaugggaacaggauuucacugugacuuuuuauacacguugggaauauacuuugagcauagucccacccucuuauuucuaccccuuccucccauguaguuccccuucuacuuuuaugucuuccuuuaaaaaaaaaaaaaaaaaacccuagauuuuuuuuucaugagagacgugugauauuugucuuuuaugucaugucucacuuaacgugggauuccccugcagcagacaggguguugcaaugcuucugugugcuccaguguguacuucuguuagaucucucauugaaucuggagcucagacuuggcuagacugccaaagagacucuccccuagccaggagccccuccugccucugccccuccggcgcggggcgguauguggggcguguggcaagggcaccccucugugucuaccucuuccgugggcugugggugucagggauuuagcuuaaguccucaggcuugcagggaccuggcuugagccgucccugcagccccaguuuguacuucuuuauggcagaauaauauuccguucucuaugcccgccacaucgcccuuauucaugcauuucuugagggccccugugauuaaagcuguaguaauugugagggguaucuaugguaugguaugcgcgcucauuuuuccagaggcugcagugccuuggagucccucaaccuuguguaagccccgcccccaaacaccacgugcucuccgaauucgcuuuaugucuucccgguggcuaagaauuuuuuucauguguaucuugucugcuuguuuacaucuuugagaacuguucacuugccaauuuuugguccgaccuguauguccuuuucuuucuuugagaaacugccgcccuaaacgugggcaucacgggaccuuugguauaacagugcucccuugacuuuagaccuugccacauauuuucucccccccccccccuuucauuucccucuucgguuuuaaagcaacauggcaauacuaugggagggacccggucccuccuaaaggagccacuuaaggagcagagccucugaaaccuucgccuguuucccccgucgauucgcugauggaaauguguggccccuuugcuguucuguucugggcaggguuuuuagcuuucauuuuaccggccuccuggguuggagacagcuucaggucugccuuccugugacagcaggcugcagugugcaccucugcaguugucccugaagccauucaaaguacagcccuuuucagagaaggagcaagccagcauuggcauuaaucugacuccgcccacuuuuccucucugggucucuuuacauauuagauuugcuggaaaauuuugcaagcugcuuuuauuuugauauuuaccauguuaaacacgagaugauguaaagggcugcucagaguucccagcucgagaaccaucagcuucgggaaugagcaaccgaacagaacccaaguccuagcccaguaacccugguaguucacuucggcggucaggaaaauguguuugcucugcucagugagugcagguugggcacucugggaccauaaaaguagucguguuucccuuuccuguguucacgcaccccugaaguacgcguuucucagugcucuacuuacucccagucuggauuaggaaaguaacugguaauauuuaaucuuggucauagaaaggaaaacacuccagcuaccugucuaucugguagagguuauaaaacacaacauuuuaauagcuuucuuguaccaaaaaaauuacuuuuuaaggaaaaaaaaaaaaaaaacaaccuauauguugcuucagauguagaagccccugaauugugacucuggacuuuguaggcaggccaggcugcaggucccacacugaagcugagcuguagaaugcuugugguugucuuccauuuuauuucucaguauaauucugucaguuuguuuugucuuuaaucaucuugcuuucuuuugacaaguaguucugggaggagccaagcgacguuucauuuaaaaggcaucauuuaaagagacugcgcuacaccccgagcgacagagccagugguacaguuugaggcagggucuuacugugugggccagaggccugggaugugcgauccaccucagaacacagcucuugccggugugagugcacguucacaccuccacauacuguuuaccuggucucaccuauuucaggugugugugccuuguuaccucaaaaaugauuugagcccuugcacgggggccacauguuucauggacaugucuccugcucaucucucuguggcagacuugacccaguaugccagcaaacuugaaguaagugggucaccugggauccaaguggaacuggcuccuggcgcucauucuucccucaguccuguccuuuuacagcccugaguugucuuugcagaauguuaccguuugcccaucaaaugaacccauacauucccgaagcaacuguguaguaauauuuaggguuggagucugacaaucugugucaacuucugaagcaucuaaguagauggaggaaaaaaaagaaaagaaaaacauaaacucccucccauauuugaguuuguguuuagacuuucgaauaccguaguguguaccuuuucaauauuuaagauaagaaaaccauacaucuuaaaguauaaaagguuuuacagguucaguuaguaaguugaauuaggucaguaaaaggaaagugucacacauaaacaaauaguuuccuguauacauucagaguaccuuuugaauuacgcguuugaaaaugucaggggcuggagggguggcucuuuguguaagagcugagcaggagccgagcgccaggaucugaguuuggaucucagcaucuguuucacaaagcuggguacggcuucagcugccggggaucccaguacucugggaagagaggagccagcaaggucaccgcgccugcuaacucuggucuugcuccaaguucagugagauaauguuauaagggaauaagguagagaaugauaaaauaggacaccacacucacauacauccuugauauccauccucccucgacauacacguaugugugcauggaugugugagcgcagcacacaccguguacaccacacaagccugugugagcacaccagcagucugcagccagaagggagcaacauuggcugaccuguaggcaggacgggcuccccucugcccaccgucccugcuugccuguccaggcacucgcuccuuuucugcugagucaggguauuugcucugaaaucagguacacauucagaccccaccucuuacuacgggguuaccugggugacucucagguucacguagggagcagcucuccauuucccuuguucaaguaggaguaguaauaucugcuguaagcuguagcaagggcaggagcagugugcauggugccuagccuauaccggggcuguuuuugacaaugaucccuuaauuuaucuccuuccuauauccccacuacccuuaucacaacacauggcaucuugcugacccuuugagcaaccguagugaagcuagccuguggggcauuuucugucaugacauacuugugguaccuuugggaaggcacaucuggcucccauucagaauucugagcuuuguaguauugugucacugagucuggcuggugugccaguccugagugugcuugccugccacaugguccccuggugagcucacagaggguuggggcuagaguacgcguguuagauuuuaccuguucugcagagucagcauguuaaacccguuagguuugcuugccaucgguauuccuuaacugcguuaaggccauuacauggguuguaaaaauaaccgcucuguacuguuuaccuaacagagucacagguggaagaacacucaguccugaauuuuuuucuuggccccuugaacaaacacucacacuuggaagccuuggcaauucugucuguucagaguuccuuauccuuuagcuuagaggacauucacccgcuccugggccauguuucacuccugagcucucuugacggcugggagccagaacaccgcagugagacaaauguuauauacugcacaggcaccugagcagggcgugcacugugcagccauggggagcacacauggcucgguggucagugguagagcucaucucuuguguuugcguccuggacuauggucuccagaagcacacagucaaaucacaaaggccuccccucuucccuccaugucauuuuaaaacguggauuuuuuuuuaucuuugggagucuuuugagauuuuuuuuuucucuagaguguugccucucugaguucccggucuuuucauuuuuuauaucuguacauacaugggaagccugcacaaacguaacagagacacucacuguauuacaaaacugcaugcggcugggaggggucuuuuuaccaugaagcaggcagggccaggcacggugcacaucuuuaauuccgcacucaggagguagaggcagaccuuucucuguggguuuccucucccccuucccccagucuacaaagggaguuccaggccagcuaggaguuuacaguaagacccugucucaaaacacacaagcaacgauacagagcaggcacaugcuaaaacuucacugaugcugucaggcuaggagaaagguugaaggugucauacuuccuuagcugagcagggguaaggggcagucuugaaaccaugaguugcuucagggggauccuugccgccucucugccuagcaaagcaucuuucucagugacaggguggaaugaugcccgcacggaugucugccccugcugggcugugcccugcugcucugggacucugcccaucucagugaaagaucucauuuagaaagagcucaugaaaaaugugugguauguacguuccuccacagacgugcauuucucuugguaaaaucugcuguuggcggguuuucacuuccacucuggauagugugaagcagggcggggccaccccagagcgcagugguagaagaguguggcauaugugaggugagccugcauuuucuacaaaaaguacuaacauagcauuuugaaaagcacacuguuuauuuagccuuaguugaauacugguuugcucucuuaauuuucagauuugaggguaauuagagacaaggugagcuccggguaaacgcaagcucauaacugaauagguuucuccucgacauugcacucacagacugcugggucacccuccuggcuuccacguucucuagucucugccuuuuagauugcuuaaguuguaugaguucuagaugccuuugacaucuccauucuaaaacugcugaaaugugcucagaccaugugagcgucaaccuuguucagcccugaagccaguagauacuuucauguccugccuccucugccuuccguguggcaugugcuucggagggagagucaccucuuguguggccccugccaaaaugaccgaucccacccugcccagcaguacuagauaagaagcugugguacccuuggugaccuucugaagcagucauuagagcaaacuuaaaacccacgcaagucucccagacgaugcugcugccagacuaggcauccguuacccccuccccauccccccgcugcugucaggcacaucauguaggcucgggcucuggguaaaccuggcaugaacuugggugcccugacagcuucauuguacccuggcaacacuacccagacacccucccuucccccaccaucguuugauuuccagcuugaguugguauugacaggcuucagagacggcucugaccuuauacaguagcacuguggugacauuucuuuuccucaggaaaggggacucagccuuuauaagguauuauaaugauucucuuaauaugcagggguauaauagucuuaagcacuguaaaaacgaaaaguaugguuuggggguuuaucuuuaggacaaauuuuuguaccuuuuuguuaaguacagaggcuuggucagcauggaacauugguuggagcgcuggucaggcugcuuuauaaauugguauuuacagucaccauuuugaauuccaaaggcugcugaaaaaguuuaggcaaauacugacgguacccaaguuccuguuacuuagcuaugucauugggauuugugcauguguguguguguguguguguguguguguguguguauguauuuuaauuaauuguugucuuugaccacaggagcucuuaccaaaguaaaggagaguaggcgacacguggaagaagggaagauggagguccaaaaagcugacggcauucaagaccgcuguaacacuauuuccuucgccacguuggccgagauucaucacuuccaucaaauuagaguaagagacuuuaaaucacagaugcaacauuuuuuacaacaacaaauaauauuuuuccaaaaagugacccagaaguuggaagaggcgcuucacaaauacgacagcgucuaaugacugcacaugggaccgcgcucuuguuuucaguugaacgauaauuuccacagcagaacaaaaccugccuucucagagcuguugccaacucuaggugguacaaggacggcuuuguguucagccgaaaccggcuggauauauaauuauguaggaaagaagcaguuaauauggcuauguagcagaaacaguaccacacuuuguaacuaaauuauacuauguaugccuacacuaccauuguaacuuuuggauaaugauuauacuauuugccuuauugcuuuuugaaguauggguauauuaguguauacuuuguagaccucaaaacccaugaagagucucaaagaagcuggcuggauaaaagccugcuguggaugccuuuuuagucucagagaucgagacuaccuaaauccaaccuauucucuguuuacaaacuccaaccggagcagcuaugcgacuuugugccuuuaguccgcuuguuuuccuuucugucccaccuggguucgagcccccaacguuucugauggaaagagcaaagggcgggcauguuggugacaagccgaugacaagcucccauuucuggggguggugggagaaccaguggccaucacuuugcacaggaagcaucgccugguaagaugcuggcaguuacagaggcaggagacgcuucugccgucucuggaugugaagucucguaggggagaaggcagugugccauauucccucacaucuguaguucacggccucgacucaagggucgcacggauugggccugaggauuucggcagugcccugagcacguggagaaggaggaauccgaucggggauaaagaacagaaacagugggugacaacgcacuccaucuuaguuugggggagggucuccugucuuccuuuuucuuuuuucuuuuuucuuuuauagcuugaaauuuuaauguucagcuuuuuguuucgguuucaaauggaucuacacuguuaacugaaugagacuccacugugauucacucguuuacuuaaucaaaaaaaauuucagggaugucuguaaauuucaguguuguacgcgaugagaagugcuguugguugauuuaaggagggaccagaaauaauuucuacuauuccaguacugaaagaaaaaaaaaauacugauuuauacuguuuuuaaaaacuaaguauugauaaagccccccucagaacauuuaaccuuaaaauuauuuugaauaucgccuuuuauuauuagaagggagcugcaaaugacugacaaauaccaaaaagauuuacaugcaggcuucaucuaaaaagcacaaagagguucuggugugaaaugcccaaaucucaacuguuuuuuguaguugcugagcuaaauaaugugauucuugaguuuacagauguaagagcugucacugaaggcugaggucccugcaucugcugucccugugaacuacuuccaccaccccggaaacccugguccugacaugguaacguggggguacagaggccaggcucagagggggugagccacaguuauccgaaagggucagcuugcagaagggucaagcaaggaaaggcgagugggauaauuacuucacagcacauucacucucuacaaagaaaucacauauggguugacauuuuaagaacggaugaugaucauuuugaccucuggucaaauccuugugcuucagaacucugaggcggacguggcauccuguggcgcugucuuuacuacaggcacgugggacugccgccaaaagccaugcucucuuaaaaagcaacuuccucucuuggauugcaaaguacagcgagauaaagaaaacgcauauauauuuaaaaauuaauuuuauuccagaauuuuggagguuacaaugauagcauuuaaguuugaauugguguugaagaagcaagcucucugcguuucagaugauuugagcgucccauuuauuugccucuuuguuuugauggugguuugauuuuuuuuuucuuuuaauaaaauuacuaaacuugugcaauaguagcaaggacauccaucaccugaggugucugauugugcuuuagccaggguggacauagcuuaaaucauaaacuaagauuaaaguccagagaaguggaaagcugaugcugccuccugcugagauagcguuuguccucccuaaccacacagcaucaucucaccggcucgugggacuugacgugaauucuguggguuaaugcaccaggcuuacuaguguccauuuucauccaagauccuuacucucuaacguucuugguccuauugaagcauuucaguaucuaagcauacugcaauguuaauacccaagagaaaagccauuacguacguauucuggucacacgaucgguguggcaccguuuuauuuguuacuguuguuguuuuauuuuguuguuucuguuuuuuaaauaaacuaucacacccuccaagccau

SEQ ID NO: 7239 - RNA, 2135 nt, Mus musculus
aaugaaaucagacguuuuaggcaaaaggugagugaaugauucuuuccucccaagaaacucagaaucgggaguucagagggcucccccuugcaguauuuauaaacagagaaggaagugacuuuagucuaauugguuaccauuagguauuugcuuuauccugaguguggcgugaugagacacugcuuuaucuagacagaguugaaucugauuggcuagggccauacucaaguuguugcugcaguuagcuaauacugagggguacugaguugcuguaggcgacucagccugguccugcuuaaaagaucugggauacgcaguguucuauguugugucuggccaguagaucacaaccuggguucuagccuggaaaggcauuuuggaaaccuggaagagaagaggggcugggcuacgugagauaaggaaggaaccaagacaaagcucucuguucaagguucaauucuuacuauuuuggcacuccguuauaaaggaagggggaggggcccaauucccgccaaauaaucuugagguccaguagcaggucacgugauagcuucggaauagcaaagcggcagguuucagcaguggguguggcagaaagauugagcgggaagcuccaccccugagcaagcagguuucaggcugggggaggggagacuacaguucuagaguuuucucgucuuucauaccacugucuacaguaagccuuucauuuuagguugucauagcacacgugcaggcucucuaggaagcuaaauccucgaagauuaggggaaagauagguauuaguucuaacauugaauuagcaugauaaugcggucucccugauuguguuacucaacgcuuugggggcacuuguuucuacauuuaugaugaguaaaauuguaugggagauacgggcuuguaagagagaucacaggaaauaguuucugucaggauccuagcccaacaaaacgcccaaguguuagaaguuaggagacugcaggggugaugauaauuuuuggaggcugggaagauggcucaguagagaaaguguuugcuguguguagugguuugaacagaaauagcccccauuggcucauagauuuguauacuuggucauuagggagcgauagccacauuugacagggauuaggagguuuggccuuguuggaggagguguggccuuguuggaggagguaugucacugaagaugaucuuuaggguuucaauugcucaagccaggcccagcauuucugccuuucccugcugccuaucuggauauagaccucugagcuaucucuacagcaucaggucugccuccauaccgccaugcuucccacugugacgauaaugaacuaaaccgcugaauguaagcaaguucucuuuuaugagaauugcuguagucaagugucaacaauggccccaagugucuauaagaacuugguuccuaagccugcaccaccucccuccaagcccaacgcccggaaagcuaacagaauggagcacaaaucuggaucacuuugcucaagccgggagucugcuuuuaccaauccaauuucuguugcuaaaccagugguacuggcugcuggugcaggucuccgcucucccaaagagagucccuccgggaccaccccuccaauugagaucagcuccccucgccugaccaaacugaccccacgaaccacggacaggaagagugaguucccgaagacucugaaggaugaacgaaauggagacugcucagaaaguagagacugugacaagcuggaggggcuaagauuggagggcagccacacauccgaaccaaaggaaaauggagaacaagguugucuucagaacggucuuucucuacccaugguagaggaaggggagguucugucacacucucugggagcagagcacagguuauuaaaagcaaugggauggcaggaauacccugaaaaugaugagaguugccuuccacucacagcaaugggauacgcucaaggaguuccacgugagaacagagcagcuacgaagacauggguuuggaaagauacaaaaccguagcugcagcuguucuccccguggagacagcacuugcauugcggagugugaggacucagacacggagacaagcagcggagagacggcagacgaugaugccuggaaguaga

SEQ ID NO: 7240 - RNA, 6692 nt, Mus musculus
cuggcuuuuacauuuuuuuuuuauuuuuucacucaucauuuaucuacaaauacacauuauaacuuuuauauacauugcacauuuacaugguagaaaaguacaaaacuauauauuuaaaugaauuuauauuuaacuugccauguuugaaaauauaaaauugcaucagaaaaaaguauuaugaaaagcaagaaacuugaacugauaaagcuuugauggaacuuuuagugacacauugguugaaaaagaacuaauugaaaagguacagcugacuaagcucaaaagaaacgcugaaugacagguugaaagugugccuuucaccucucuucagucuccugacacccacaucacucuaugucuuuggaucuguaacaucauaaaagcacaucuccagaauuuuaaugucucucucauccucucucccaacguucaccagaacgaggggacggaagcagacauuuccucuaagaugcccauacucuguaccuuguacuguggcagaguuacaaugccuuuuggucagucaagauuccuuguaaacaaaacccgagggaucagguauguacagauuaggcagcugagaauccaauaaauaaacaugacagaaacugacaugcaaauuuguuaaaaagguggaaaagaaucuaacagugagaugcggagagagacaggugggugugcauagugaggaauggacuuaaaugguuuacaagggggaaaaaaaaaacaguuuuacuuuacaagcaagagaccucacaauaaauaacaacugcucuuccuuucacgaauaaauuucuucaaaaaaacaagguguacagucaaccagacauuuuauguauaaauuauaaaacaugacacaguauaaauaaaugucuacaagucucaacuauaggccucauccaguagaccacgaaaugaccaucucuccaugcccagugaauaacaacguggccugggagagagcuuaggacaaagguccuuuaauguauaguuuuccccccaaauaaauaagcauacacuuauuuacauuaugaacaauauauuuuucuuuuucuuaucuucuuuucuaucuuuuuucuuuccuuuauuauuuauuauuauuauuuauuuuguuguguuucguuuugcccaaaggcuaugucaacacugaacauugguggagaguuuaccacucuagaauggaagagauaggaaagcuguaguccuggucuuccuccuccuccucuuccuccguuucuuccgagauggcuagauggggaauacagggggagcuguuguuuaaauacggaucacaacagcgcagaagcagcucacuguacguuuucaaagcccucugacacagccacauuacagcguugcauuuuuacaugacuugcagugugaugcuuuuuuuguuuguuuguuuguuuguuuguuuuuuuugguuugggccucugcaguuacgcaauaaguuuacuuuuaagaaaaacaacaaaccaccacaaucuaugaagucaaaauugcagaaaguucugaagaaucaauggcucagguuuuacaggcagauuccugaaaucagauaaaaagcgcucuuguguucuagguauaacuacuuuggcuccuuaauucagaguuaguagguggcaacugcguuaagccgcagcccaggugugauaauauauaaagcugucuuggaaagaacgaaacaaaacaaccaaacuuuugaacauuugaagccguuaguuuaagauuccaguguuaaugaggcaacagcaaagcaaagugccagaaggaaggaaugagcaucaaacaaugggacaaagaauuuucauaggcaaccgacccaguggcaggccaccagguagauccauccuaaaagccaggaaacacugcagagcauuuuggcugaggaucaagggguugcuggugaaauuuagcagcuaccuaaccagguuuucacagcgaggucugagcuguccauuccccaggcagggcuggccuggaaaugcccuacauggcagcaagguuagaaaucacacuuacaguugcaagauccagaaugcuucacuucaagaagcacgccagaagagcaggcagcuuccuucauggcacacucgcuggcguauguggcauugucacuggcacagaccggcucauccgacuuacugucaggacacagcucaucgcagagagagcagcgaccucugccaaccuuggaaucccauaggcauuuuuucccgccgccacacuggauaucuucacaggacuuugcuucuaggauauaacacaccugugaugagcaaacugagugucucguuguuuuucucccuuucuuccauucccuagccauccauccauccauccauccauccauccaucuaucuaucuauaaaaucaauaauggguuaauagcaguguuauacaaaacugcucuuucacauacacccacacaaacacacaguaugcuuucuuggaucuuauagaaccacacuaaaaauaauauucuuugggucagaaucucacagucuccuugaguuaacuaugcaucugauuauuuccuacaagugggauaaaaaaaaaaaaacaaauuccaucaauuacuggaauccgguaacagguuuuaagaacuguuaaguaauuauuuuucgcuuccagcaagucuggcacuuaaaaaaaauguguaaaauugugugaguucuaaguuuucuaagauagaaaaacuguuuucugcuucuugcuggcgugucaaugcaacuucuaggagacaguggcuuuucaggaggaauguuuaauggauuuguucauugguuagcccccacacuauuaaaucagauuuuuuuuuaaucucccgucuuuuuuccucuccucaauccagaauaccuacugauacacuuucccucauaggcuaauccaauggaucugcccagcaagcagguggccuuucucagguggcaggcgcuggaguaagucacuccaucauuuccacaaagguacuguucagaagaggagggcucugggcaaauccgauuacaggucacacaguaggcauuauuggucugauccaccacacaaguggagcugccuggacaaaaaacaucccuacaagucucuggagaaaaagaaaaaaaaagaaaaaagaagaagaugaugacauuucaaacggcaucuucugguccuuggggaguaagcagcugauauuaugaaggaaaucauuaaaagcaaaauauccacaucuuagcaggcaucuggggagccuggcuguuucccagaggaucuaugacuccaggcuggcuccuucauuaauuauccuuuaggaauuagauaagagccccuuuauuugguauuacuauuccaauucccgggcucuuuauguaaacuguacuaucuaucgcccuugggucuucaaagaucuuugaauguauagagaugcugaaggguaggaccuacuuuuacauuugcccugguacuguacuucuaguuccggcugcucuuugcaucuggccuugaggagugcacauucguugcgguagguuuucccauccagcccacacacugggcccuuccaggugauguuggaacagucuggggcacagacgcagcgggguuuauucuucuuguucauucgacauuuuuucccagguccgcaguccacguucucacacguuucuaggaguuggaaagaggcacacauucaaaccaaggccaggcaguuggagggucagccuggggcggagugggguggacugguggucucagaugucuugagcaaucaugcauccgagauggagggccccagacugucuccuggaagggauaaggggguuggggaccucaggccaaguccuguauccaaauucucucaaagaccacacugguuggucgcuuucauuaucauucucggcuaagaagcccggggacugaccucuuccgaccuuguuuugccuccagcgcgagcagaggcagauuccacuagcuaacuccacuccggguagaauuugaaaaaaaaaaaaaaaaaggagaaacugaacaaaacucugccaauccuaagcuucagucagcuaguaggaacgcugagggcaagacgcccucuacugagggccugccgccuaggggagaggaggcccaccuuuacaagggaugcaguugggggcgcccccguugaaaaucauccacuugaagagaguauugucguucacauccuccucgguccaugaggugcucagccggccggugcugcaacacucuuccuugcucaguucugucuuauacaggaccuggcagcggccguucuuugcuuggcggagccagcaauucccagcugugaagagacagggaucaguaggugaaugagugagccgugggguagcgggaaggaaggcugcuuagagcugggcaaagaggccugguggggcggggagcaagugauugggggaaggggagcaggagagggacagugggaugugagagggagagagggaugugggaggaagggagggagggagggagggagggagagagagagagagagagagagagagagagagagagagagagagagagagagagaauaugaaucuccaaaggggagaguggggaaggacccgucaccgaggugggaggugggaggugggcuagagcggccgccgcugcgccccagccauaucaaugucaguuaccagugacccagacacaacacgugcagcuugcauugacuuuuacuagacuguuuacuuuuauucgucccauuucauaaccugcagcgacuggaagaccagauuaaagaaccugacaaaaacaggaugcgacggauguuuuuacaugucgguuucauguaggcgguaagagaauuauuugugacagggguuaagaaaguaagagaggggagacguggaagggaggggaggagggaggggagaggggggaguguagggagaaugaauaugaaucugcaggaacagaucaagcauaaagauacuugugaaaaaugaaaggaaaaaaaaaagcagucgggcccagccuggaucugcccugagcggccucgaggcgcagcccgcccgacgggcccguuuugcaauccgccagcccggagcacgcccgcagccaccgcggucuuucgaaauuuccgagggcugcuuucucuggcgcccacgucccggcacccaggcagcgccccuaucagcaaggcugguagcccagccuagugucgggcagacggcuaggaccggugccggggagggcagcuuacgacacacaaaaccuuaccgcuccaacaggcaacgcagcaggguuagaacccggaggcgucuaccgggucacacauaccuaccuuaugucucccaagaaccucuuuacaaauaguuucuuucucugucccuauuuaauguguucggacuuugggcaagcagacgucucaugaaucaccaaagugacucgagaguaauugucgugaagcugcgggguuaccacuauuuuuaaaaaagaaauccagccuggagacuaauuguaauaaaaucaauucauuuuuaauuuuagaagauaaacuucagaaauuugcucuuuaauccaggucggagucuaaauagcuugugggcugcuugguucacagaaguuaacaggaaugaggcaaaguggagaaaacuguaaaguacuuaaaacacuucgggcuaauaauuugguuugucuuucuucuuuuucgcggggcuugggggaaagaggcagaaggagcauccgcuaagcguaaaacuaccucccucuaaaaauuucaguacccacauuuccaaguuugggcaaaguuucugaaaccacgucccccggccacccaagaaaauucgguaucucccaucccccaccccgucauuuuuuuuuuaaagagucuccaaaagauauggaaggaagauggauagauugcuaguaggucgacuguaaucuccaggcuacggaugcucgcccuucucccgagccagccaggggagauaacaucuaaagucauuaggaccagaacuuggagcaucuaccccuaacuacugaggcuccagcuccuccacucaagcccuuuccuuuuugaggguaaccuggcucuaaacuccgcucucuauccuaaagugucacugccuucagucuuucccucccguuccguucuacaggaguagccgggugguuccaacaucuuccgagagcagcguaggucagaacagaccaaguggagacagcagaaaaguagaaccccugccccagccgagccucugggcgcaucccuuccacucacccugggcgcugcgguccuccaugaacuggcagaguagcagcagcaggaggcagagcccgccgggcuggugccuggcgcagaccauccuggggcaggcgcggggcgaggagcgcggcggcggguggcucgggcgagcggcgcgcgucgcagaggcgagcggcggagggcgcagcgaucccggcgcagccccgcgcucgccaccggccgcccgcgcgauucaauggacgucagaagccgggcgcagccgcgcuuuaaaucuagacgggggucuccgagguuugcggugggcggucucccaguguguggggcugugggagggcggccgcgaccgagggugugccggcucuuuggggguggggagcuuuuaaaaguucagugugaaucaggugacauuucccaccuucuggaaacccuucccaauuaucugucggaggugcccgaaaucaaagcg

SEQ ID NO: 7241 - RNA, 6692 nt, Mus musculus
cgcuuugauuucgggcaccuccgacagauaauugggaaggguuuccagaaggugggaaaugucaccugauucacacugaacuuuuaaaagcuccccacccccaaagagccggcacacccucggucgcggccgcccucccacagccccacacacugggagaccgcccaccgcaaaccucggagacccccgucuagauuuaaagcgcggcugcgcccggcuucugacguccauugaaucgcgcgggcggccgguggcgagcgcggggcugcgccgggaucgcugcgcccuccgccgcucgccucugcgacgcgcgccgcucgcccgagccacccgccgccgcgcuccucgccccgcgccugccccaggauggucugcgccaggcaccagcccggcgggcucugccuccugcugcugcuacucugccaguucauggaggaccgcagcgcccagggugaguggaagggaugcgcccagaggcucggcuggggcagggguucuacuuuucugcugucuccacuuggucuguucugaccuacgcugcucucggaagauguuggaaccacccggcuacuccuguagaacggaacgggagggaaagacugaaggcagugacacuuuaggauagagagcggaguuuagagccagguuacccucaaaaaggaaagggcuugaguggaggagcuggagccucaguaguuagggguagaugcuccaaguucugguccuaaugacuuuagauguuaucuccccuggcuggcucgggagaagggcgagcauccguagccuggagauuacagucgaccuacuagcaaucuauccaucuuccuuccauaucuuuuggagacucuuuaaaaaaaaaaugacggggugggggaugggagauaccgaauuuucuuggguggccgggggacgugguuucagaaacuuugcccaaacuuggaaauguggguacugaaauuuuuagagggagguaguuuuacgcuuagcggaugcuccuucugccucuuucccccaagccccgcgaaaaagaagaaagacaaaccaaauuauuagcccgaaguguuuuaaguacuuuacaguuuucuccacuuugccucauuccuguuaacuucugugaaccaagcagcccacaagcuauuuagacuccgaccuggauuaaagagcaaauuucugaaguuuaucuucuaaaauuaaaaaugaauugauuuuauuacaauuagucuccaggcuggauuucuuuuuuaaaaauagugguaaccccgcagcuucacgacaauuacucucgagucacuuuggugauucaugagacgucugcuugcccaaaguccgaacacauuaaauagggacagagaaagaaacuauuuguaaagagguucuugggagacauaagguagguaugugugacccgguagacgccuccggguucuaacccugcugcguugccuguuggagcgguaagguuuugugugucguaagcugcccuccccggcaccgguccuagccgucugcccgacacuaggcugggcuaccagccuugcugauaggggcgcugccugggugccgggacgugggcgccagagaaagcagcccucggaaauuucgaaagaccgcgguggcugcgggcgugcuccgggcuggcggauugcaaaacgggcccgucgggcgggcugcgccucgaggccgcucagggcagauccaggcugggcccgacugcuuuuuuuuuuccuuucauuuuucacaaguaucuuuaugcuugaucuguuccugcagauucauauucauucucccuacacuccccccucuccccucccuccuccccucccuuccacgucuccccucucuuacuuucuuaaccccugucacaaauaauucucuuaccgccuacaugaaaccgacauguaaaaacauccgucgcauccuguuuuugucagguucuuuaaucuggucuuccagucgcugcagguuaugaaaugggacgaauaaaaguaaacagucuaguaaaagucaaugcaagcugcacguguugugucugggucacugguaacugacauugauauggcuggggcgcagcggcggccgcucuagcccaccucccaccucccaccucggugacggguccuuccccacucuccccuuuggagauucauauucucucucucucucucucucucucucucucucucucucucucucucucucucucucccucccucccucccucccucccuuccucccacaucccucucucccucucacaucccacugucccucuccugcuccccuucccccaaucacuugcuccccgccccaccaggccucuuugcccagcucuaagcagccuuccuucccgcuaccccacggcucacucauucaccuacugaucccugucucuucacagcugggaauugcuggcuccgccaagcaaagaacggccgcugccagguccuguauaagacagaacugagcaaggaagaguguugcagcaccggccggcugagcaccucauggaccgaggaggaugugaacgacaauacucucuucaaguggaugauuuucaacgggggcgcccccaacugcaucccuuguaaaggugggccuccucuccccuaggcggcaggcccucaguagagggcgucuugcccucagcguuccuacuagcugacugaagcuuaggauuggcagaguuuuguucaguuucuccuuuuuuuuuuuuuuuuucaaauucuacccggaguggaguuagcuaguggaaucugccucugcucgcgcuggaggcaaaacaaggucggaagaggucaguccccgggcuucuuagccgagaaugauaaugaaagcgaccaaccaguguggucuuugagagaauuuggauacaggacuuggccugagguccccaacccccuuaucccuuccaggagacagucuggggcccuccaucucggaugcaugauugcucaagacaucugagaccaccaguccaccccacuccgccccaggcugacccuccaacugccuggccuugguuugaaugugugccucuuuccaacuccuagaaacgugugagaacguggacugcggaccugggaaaaaaugucgaaugaacaagaagaauaaaccccgcugcgucugugccccagacuguuccaacaucaccuggaagggcccagugugugggcuggaugggaaaaccuaccgcaacgaaugugcacuccucaaggccagaugcaaagagcagccggaacuagaaguacaguaccagggcaaauguaaaaguagguccuacccuucagcaucucuauacauucaaagaucuuugaagacccaagggcgauagauaguacaguuuacauaaagagcccgggaauuggaauaguaauaccaaauaaaggggcucuuaucuaauuccuaaaggauaauuaaugaaggagccagccuggagucauagauccucugggaaacagccaggcuccccagaugccugcuaagauguggauauuuugcuuuuaaugauuuccuucauaauaucagcugcuuacuccccaaggaccagaagaugccguuugaaaugucaucaucuucuucuuuuuucuuuuuuuuucuuuuucuccagagacuuguagggauguuuuuuguccaggcagcuccacuugugugguggaucagaccaauaaugccuacugugugaccuguaaucggauuugcccagagcccuccucuucugaacaguaccuuuguggaaaugauggagugacuuacuccagcgccugccaccugagaaaggccaccugcuugcugggcagauccauuggauuagccuaugagggaaaguguaucaguagguauucuggauugaggagaggaaaaaagacgggagauuaaaaaaaaaucugauuuaauagugugggggcuaaccaaugaacaaauccauuaaacauuccuccugaaaagccacugucuccuagaaguugcauugacacgccagcaagaagcagaaaacaguuuuucuaucuuagaaaacuuagaacucacacaauuuuacacauuuuuuuuaagugccagacuugcuggaagcgaaaaauaauuacuuaacaguucuuaaaaccuguuaccggauuccaguaauugauggaauuuguuuuuuuuuuuuuaucccacuuguaggaaauaaucagaugcauaguuaacucaaggagacugugagauucugacccaaagaauauuauuuuuagugugguucuauaagauccaagaaagcauacuguguguuuguguggguguaugugaaagagcaguuuuguauaacacugcuauuaacccauuauugauuuuauagauagauagauggauggauggauggauggauggauggauggcuagggaauggaagaaagggagaaaaacaacgagacacucaguuugcucaucacagguguguuauauccuagaagcaaaguccugugaagauauccaguguggcggcgggaaaaaaugccuaugggauuccaagguuggcagaggucgcugcucucucugcgaugagcuguguccugacaguaagucggaugagccggucugugccagugacaaugccacauacgccagcgagugugccaugaaggaagcugccugcucuucuggcgugcuucuugaagugaagcauucuggaucuugcaacuguaagugugauuucuaaccuugcugccauguagggcauuuccaggccagcccugccuggggaauggacagcucagaccucgcugugaaaaccugguuagguagcugcuaaauuucaccagcaaccccuugauccucagccaaaaugcucugcaguguuuccuggcuuuuaggauggaucuaccugguggccugccacugggucgguugccuaugaaaauucuuugucccauuguuugaugcucauuccuuccuucuggcacuuugcuuugcuguugccucauuaacacuggaaucuuaaacuaacggcuucaaauguucaaaaguuugguuguuuuguuucguucuuuccaagacagcuuuauauauuaucacaccugggcugcggcuuaacgcaguugccaccuacuaacucugaauuaaggagccaaaguaguuauaccuagaacacaagagcgcuuuuuaucugauuucaggaaucugccuguaaaaccugagccauugauucuucagaacuuucugcaauuuugacuucauagauuguggugguuuguuguuuuucuuaaaaguaaacuuauugcguaacugcagaggcccaaaccaaaaaaaacaaacaaacaaacaaacaaacaaaaaaagcaucacacugcaagucauguaaaaaugcaacgcuguaauguggcugugucagagggcuuugaaaacguacagugagcugcuucugcgcuguugugauccguauuuaaacaacagcucccccuguauuccccaucuagccaucucggaagaaacggaggaagaggaggaggaggaagaccaggacuacagcuuuccuaucucuuccauucuagagugguaaacucuccaccaauguucaguguugacauagccuuugggcaaaacgaaacacaacaaaauaaauaauaauaauaaauaauaaaggaaagaaaaaagauagaaaagaagauaagaaaaagaaaaauauauuguucauaauguaaauaaguguaugcuuauuuauuuggggggaaaacuauacauuaaaggaccuuuguccuaagcucucucccaggccacguuguuauucacugggcauggagagauggucauuucguggucuacuggaugaggccuauaguugagacuuguagacauuuauuuauacugugucauguuuuauaauuuauacauaaaaugucugguugacuguacaccuuguuuuuuugaagaaauuuauucgugaaaggaagagcaguuguuauuuauugugaggucucuugcuuguaaaguaaaacuguuuuuuuuuucccccuuguaaaccauuuaaguccauuccucacuaugcacacccaccugucucucuccgcaucucacuguuagauucuuuuccaccuuuuuaacaaauuugcaugucaguuucugucauguuuauuuauuggauucucagcugccuaaucuguacauaccugaucccucggguuuuguuuacaaggaaucuugacugaccaaaaggcauuguaacucugccacaguacaagguacagaguaugggcaucuuagaggaaaugucugcuuccguccccucguucuggugaacguugggagagaggaugagagagacauuaaaauucuggagaugugcuuuuaugauguuacagauccaaagacauagagugaugugggugucaggagacugaagagaggugaaaggcacacuuucaaccugucauucagcguuucuuuugagcuuagucagcuguaccuuuucaauuaguucuuuuucaaccaaugugucacuaaaaguuccaucaaagcuuuaucaguucaaguuucuugcuuuucauaauacuuuuuucugaugcaauuuuauauuuucaaacauggcaaguuaaauauaaauucauuuaaauauauaguuuuguacuuuucuaccauguaaaugugcaauguauauaaaaguuauaauguguauuuguagauaaaugaugagugaaaaaauaaaaaaaaaauguaaaagccag

SEQ ID NO: 7242 - RNA, 11497 nt, Mus musculus
cggcugcgcaugcgcucugagucaccggcgccucuagggguuggagaacuggcuucgcgguguguagcgggaugguuccuaggugccagguaagaguugguucgcgcggcuggggcgccccuuccucucuaacuccucccggguuccgggucuugcgccugcugcucgcugaaugucaaguucuguccccgaacucugguguccaggucauggccuucacgaccgauuaccuagacgguuuuuuucccuaccauuccggaugauuuauuuugacacuuuuuaaaauuaaaacgcuccuaguuaggaauuauugugaggaaaugcgcaucacccaaugauugacaggcucaggauaguuugcagcagccgugauuauuguggagagaccgaguuguacugagugacaggugagaccuugugcacagucaggucccuuaguucccaggcugauuacacggguuuggccuagaaacuaccaguugauccuguaauucaagcccauuugcuuugcugcaugucaaauguucuguguuuuguaacucaaucguaauguaggacggaaucaaaggucauuugaccacugugaaaugaaagcuaggccuuugcugacuggguuauuuaauuuacuuguguaauccacccccugacucagaccucugucucugcuucgcggcugauggaagaaucgauuccgugucaagucagacuuagcauguuuucuaaggaaauuuaguaggauuuuaaugcugccacacaagcuugagauugugagaggucugaacaguaggcagaaaucagaagugauuuuaaagcguuugucucaaauaugaaucuauagauauauggaaguguuuuguuuguuuguuuauguuuuucgagacaggguuucucuguguaguccuggcucuccagaacuacacucugguagaccaggcuugucuugaacucacauagaucugacugcuucugccuccccaguucuggguuuaaagacaugugucaccaccaccaggccaauacugaaguuuugugagccauugcauuuggggagcgaggagccuucuuggugcggguuauuuagacuauccucucuccuuucagauugacguguuguauuuugcaaaaagugcugaaauagccggaguucgcucggagaccauuucugugccacaggaaaucaaagcgucagagcuguggaaggagcuagagagucuccauccuggguagcuaacguuauagagugcauaugaugaacauguaaagguuucuaaaauguguaaauuacgugugagugugcguauguguguucucacacaagaguacuaguucuuuuaaaauucuugaaaauuuaaaacucugguauuuagaaacauccaaguaccacaaggaacaccauagauaauuuacuagaaaagcagucaaguggaugcccccuagauauguuuauguaauuuacaaucauuuuucuaauuucuaagacagaaaaaugcaaguucugccuuuuauagccuaagaugaaaaauugaaagaugcuguuaaaaagauacauuauaaaccuuucuguccuuuucucucuuuuaaaauacucaaaaguuucugagauugaaagaaaaaugaaguauaacagacccuacaugcuucugagcuuggguuuuauaauauuugaaaauuucucacuggccccugaaaaucugaaaugaaacuuauuauuuuucccugaagcccugucgggaugagcuauagaauggcuggacacugucccaggaacacgaguggugcugcuucagccugcggagagagguuucccccagagcucugcucugugcggaaggugcuauaccaguagcucccaaccugucgguggcgaccccccccccaaggggucgaaugaccuuuacacaagggucaccuauuagauagcauaucagauauuuucauuacgauucauaacggcggcaaaaaugacaguuaugaaguagcaaugaaguaauuguguggcugggggucaccacgaugugaggaacuguauuaaaaaggguggcgccguucggaagguugugccacacugugugcucagaagggcugcaugcuucucccuggcuaggaaccacucaagucaccuuuucccucugugaaagguuggcaagcccuuugugcuguuucaccuaccuguaagccagcagccggcuucauacgaaaaggcuguguucucguugggaaguuuuuguuuugauuuuuuuuuucuucuuuucuccaaaguuuugaauauaggucuguaaacuuuucuguccuuuucucuucuuuagaauacucaaaagguuucugagguuaaaggaaaagcggacggagaauaacaaaccccacgcacugcugagcuuggguuuuaugauaguuccuaucuucccacuggccuuagcuuuagaguaaccucacauaucuuuggggucaaguguguucuacguagugagaguuaggucaguaccuucgugaaugaaguauuacuuaaugcagcugaggaggugugaggagcaguucacagggucuaaccagggccguuucuccuucagguuggcugauguuagaaaccaggugauauuugcuguucgucaagaguaugucgagcuuggagaucagcaacuccugcuucagcccggagaugagguugccaucaucccgccaaucaguggaggauaaugcaucugagccaucuggguauguggugaaggaccagccucaggauaccuugcgcaugguuugcucuuacugucuauucugugugaggcugacugcaccaguccuuuaccgaggcagcagcaacugggauuucuauacugaugcuagguugugaugaauacugucuaccgucucccaugaccccuagaguaagcaguuugauguguucauuauauucauuuaacauuucucauugagaucuuaugaugcauguguuuugauggugggaaaacaaacucagagaaauuuuaaaauaccuugucuuuagggacugggcaggugccucccuuugugaagugcuuguaugaaugagcaugaggccuuauuagggaccuagaaccucuguagaagccagauguggcaacacauuauuuuagccccagcccuggaaggcagagacagauggaucccuaaggaugugcaggccagugaaguccagauuaacugagagacucuuguuucaaaacauaagauggaaagcaauugaggaagacaccaguguugccauuuggccuccgccuaaaugugcacaguguucagguucaugaacacacacacacacacacacauacaugcacauacaaacgaaagcuuguuuuggccacguguggccacacauggccuuuccucacaguggcaggaccaaaauuugaauuuaccuuuguaguaugaccuuguuuacuuuuuaacaaaugugguugcuuauaccugauaauagcuucccuggauguaaacuguauaaguaggaaguuaaaaggauugucccugaagagacagucaacuacuguccagcacagaggagcagcuucucagcuguguggucgugggacucucgggucaacuuaguccauggaagagugggaugcguauaaacauucuucaggguagugugggagcgcccggcuaaggacugagucagaauagcuuguuuuauugucaacugaagaauaaauacacugcaagguaaacuguuuuugaauaagaacucuuuaagguauagauaaaaaaaaaaagagauaggaaagaaaaaagaucucccgaaagcaacaguaaauauccuucacagaagcaaagguucagccccauuaaagacaagccagagaugucuguuuucucugccucccuuuccuggaaagcuguguagcaggugccagcauguucacacuuagggaacuuucucaggccugcugucuggacacucuaggauucccuguggaagauauaucuuaguuucgugaucacauucugaucagccuauuucagaguuaauucagagagcaagcauacugcuuuuaaaagcccacgcgugugacugcagcaauucagaaaggugagagcgauuguuaauaggauuguacaauguuugagugagcucaaacuuugagucagccugaguuaucuugguugguguuagaacccacaagccauguuugaguugucuuuacagucagaggugcgggaacucaguaugguuggaaacacgauuuggguuugguguuuucagaaagaaaaaaaaaugaugugucaagcaacgguucuuggccccuuugggaucaaacaacccuuucccaagggcugcauaucagauguccugcaugucagauauuuacaauuuuuaacagcaguaaaguuagugaugaaguagcaacaaagugauguuaugguuggggucgccacagcaugaggaccuguacugaagaguuaggaagguugagagccacggugugaccuguacugaagaguuaggaagguugagagccacggugugaaggguguaaguuccucagguggcacacagagaaggugagaaauccgggugccacgugcugguuugcuuuuuguuuuuguuuuguuuuauuuuuguuuuuuguuuuuguucuuuuuuuuagcuggagauagagaaacaaacacugaguuaagacuucuugaauucucagcacuuugcccaggucucugauaacuucucuuucauuuuuuucuauucauaugaacuuucacaggacuucuaauuauacaucucauggcauguagcacaagguccccuuucuuggccagccucaagcuagccucucuccuuuacuccugagcacaucauauuuuuuauugccccauaaucuugaaauuugccgcucccuuucauggccugcacccugucccuuuuucuccgugucacuucuuauugcucagaucucaacuuugaacauuaccucuucagaaagaccuuugggguccccuuuaucuauaguagucccuaagaccuaucacagauguuuacuuauuuccauuaaguuaucucagugugguagggguguguguguguguguaaauguacacaugccacaggguguauaugaaaguuaaaggacagcuuaugggagucgauuuuuuuccuuucaccauuuuauguggaugaagcuugguaguuagccuuggugacaaggaccuuuaccuacucagcaacuuuccuggaccuguggcucuucauugguuugcuuauccuauucaaagacaagcgcucugaggucaggagccugggcuuuuggguaccugcagaucagugccuaggguacuucuggcucguagucauuugucguaguuaggauuucuauuccugugaugaaacacugugccccaaagcaaguuggaaacuaaggaguuugugucuguuuaccacucugggucacacgccaucacugagggaaaccaaggcuggaccuggagcagaaguccuguuggaauacugcuuacuccuugguccucauggcuuacucauuaugguuugcuucaucugcuuucuuguagcacccagaaccacuaaccuagggcuggcacaccccacacugagcuggguccucccaccucaaucaucaauaaagaaaaugccccacagacuuccuuaccuacagaccagucuuuuggcagccugugguucccucaucccagcuugugucaaguuggcauaaaacuacccaccauaguauaagcagauggcgugggaaugcuguuuagugaauaaauguaaaacuccaaaagacuucauaccguaccuggaggguaggugcacaguuaccuuuuuccucugucacuuacuugguuugagcuagguugugaagggcucauuguucccguagaauuaucaucucuucccuuuuccgucucucgcuugaaggaaaaggccauucuguguguacgacaggcuuacaaagugguuagugauguucuggguguggggcucccuuacacagugguuagugguguuccaggugugguuacacagucauuagugaugacauacuuagagcuauaaguggugguacuuugugucgugcugagagaugagcagcaguuacauucuuugguuagauuggccuauccuguggacacgugugagugaugaugcuuaaguagaguuccuguagauucccgagggaguguaauaauuguuuuaguuuauucaaaccuuggacuuaauuuuuaucacucaagucaaauccucgucuucccaccuaauguagaaaaaguggacauggaaacaauguguaagucgaacgucuuacuucugccacucuugcuaaggguuguugacaucuuauuucuaggaaagauguggacgauguccaggagaaaccuaaagacauaauacaguucacugccgagaagcucucugugggggaagugucacaguuggugguguccccucuguguggugcagugucucucuuuguaggugaguuugugauuucugaacuucuauagaguagaagccagugagugcucucuauguuggauguacaauacugagugacaagccaaaacugcccacggaggggacagaaacuucccaguuuuaguuuuaucuuaguuauuuuuuuuauuaacaagccauauuaaauuacagggaugacaaagcaugauaaaaaucaacacuaagagagaaauuuuguacauuccaaauguugagauaaaauauacauuuauagauauaacaaauguuuuccuuuuaagugugaagugcugcuggugagaagccaaguacagcuugucuguccuacgaugcugucaggaagcuugcuuaguuauuguuauuaucaucuuggagcaauucuuguuugcucuccuagucaaguuucuuuguaaguuagaaauaauucuuuuaaaaaaauauguaaaugaaguauuucuguuguaggggaaaucuuauucucauugugugauuuuuuuguuuguuuguuuuguuuuuuagggacuacaagaaauaacuuugaaggcaagaaagucauuagcuuagaauaugaagcguauguaccgauggcagaaaaugaaaucagaaaaauuuguaaugacauuagacagaaauggcccgugagacacauagcaguauuccaucggcuuggguaggaucuuuuuaucuuuugaauggugaauaugguuuucccugagggcaguggagagugcguccagcauucaccuugauugcugugggauugcagcuucaggugcccucgccaccucuucugcuauaacgaaaugugccaagaccuucaggucccagccugaagugccugugggaaugucugccuaaauccuugaccauagacaguuguucugggcucuuagcucagaguauggugagaguuggcuccagaucugaagccauuaaaaacaguuggcuugucaucccaccaaaaagaguggcguuccaggauuucaaaagaagccaucaauuaagacaucugucauuguuauuagccauaauuuuauuacuaaccgcuaaugcuacuggguguugccaguccuguugcuuaagauucauugguauauaauguuuuuaaugcggcauuaaguauauguggucccuguguagucuguuuuagacagcaucucaugcugugccuuguuugagucagguuuauugaauuauagagaagaccuuuuugucuucauccccaucaaagaguuuuuaauguauagaugcuaauuuccacugaauauaacugagauaaauuaucauuuucuaguuaaacuagauauuuaaauacaauagaauuacuauauauaguaauuagguacauauauauauaugcacauauauauacauacauauaauauauaguguuuuuaacauuuuuaggguuucuuugauguaugagucaggagauaaugguaauuuuuuuugccaucuuguuaaaguuugguuccagugucagaagcaagcacaguuauugcugugucuucagcucacagagccgcgucccucgaagccgugagcuacgccauugauucuuuaaaagccaaggugcccauauggaaaaaggugagugaggaaaauaccucauuuugucacggggagaugauuuuauucuuagauaaaagaguguucagaauuuggcuucauaugccuugcuuaccuauagaauccuguucuucucagcuguaaaauagcacauuuauguagugaccguuuuccaaguuuaaccauauauaauauaauauauauauauauauauauauauauauauauauauauauauauauauauauguuacauaaccauauauauauauuuguaccccaaggagcacaugguauagagcaggccuccacaagggcuggugguuagaaucucuaauccacacuuucuguggcuccaaggguaaauuucccuucaguuaggauuuuauucaacuagaggucuuucuuuggaaaguaagaauaauguugguuucuuagucucuggccaaaaagcaaucccucagggcaaaagagcauuugccuagugguuuucuuuucagaggagacugugucugagaaaaugcuuaauggauggauuagaaaacgaauagguaccaggcacggugucucucauccacauucccggcacuguaggaagaccacaaguuuaaucugccauaggcucguagaucccaucucagaaacauacauaaaaauugaaagcaucacuaggacaugcugaggccuuuucugccuuuacgucaagucaaacaagagcaagucgcucugguuaaaugggcauuuugcauggccagccucugcuccccaccguaggguagcagcauugggggacaguucugcacaugcgaauguguacuuaugcaucugagucuaagagcccaaguggcccucagcaguguggcuguuccaaagccaagaaacuaauggcagcuccaagguuggaagaagcucacacagggccaggaccaugcugaaagcaguggcugccucagucagugggaaagaugagcaagcaggaccauggucugugaaauuuagugggcaucguauuuucugaguaaaaccugauccucucugugggcuaaagacuuuaggaacuacauuggaauuacaagguaggguauguguccauggagcucguguucugagagaaugugaggcaagcccaggcaaggggaagggguugagacugcuccaaucaagguuccagccagauggcaacaauagcugucuuuucugcagaggagaggauaacagggagaaccucagaggaggcucugcccugaagugagagcaggcagugagugggcacacacucucacuuuaugccuggagggcugggccagugcgggugcucagaggcaggcagacagagcagggaacccggaccuugucugggaacaaacaggacacuggugaccuaccccaugaggugcagcgcagacccgacacaccaaagauuucaauagcugcugugaggaaacccagaaagaaauucagcaguuuagcacuuggguuuaucccacugcaggaaugagaucgagccaagagguguuggcuuucuacuuccuguucagagcucaggucggauucuuugccuagcccacaugugaagaucaucugagacacaggaaaaggggcuguaggcagguuagggcacugcacagagguccuaccagacugaagcacaggccucucuaaucacuucccugugcucauguagcuucaugacugaugggaauccaguccacccuuucucuuagugauguucaagucggugcguuugcgaagaaguacaguuuaaagcuaaaggcauuccgcuuauccucuucuguaacugcaucaugucuugugacagcuucuggucugucaccuccugauuggaguuagaggagccugcauaggggacauguauuuauguccguguucucugugccucaugucccuuauguuguuagaaagagugcacaucuacauauagaugugcuauuuacugggcucauuuguucagaguauuuuauucucauuaacaugcauuuugaauaccugcucucguucugguuuuuaggaaauauaugaagaaucaaccucaucuuggaaaagaaacaaagagugcuucugggcagcuggugacuagucaaguguggugcgcuaagucuaaaauuugauaaucucauagcuaacacaaacggagaauagccaagugcaugagugugugggaugaggggcugccuaggacuuaaagauggggagaaagggcuugacuuaaaccugugauaagaugucugcaauagacucagccuucugugacuaacuccuaacuaaccagcucgcagugcgcugcagccuuccuuuuaccuucagcugucucaggaagaccuugcugucccagaguguacugagagcaucacuaucaggcauguguuaccaaaaaacuggcagaaucagaaacucauuuacauaauguaaaagugaaucuaaauaaaucaugauuuaaacagucuaaaaauagauccugucuccuuuuuagucaaugauaauaaccuaagggauuaguugucaauauucucaucacuguacaaauuagcauaaaauuguuauaaaacuaacuagcaacaaggugguuuauguuaaaaugauguauguuuaaaaguuggcccacaauugcuugaggagauugugcaguuauuuguuaaaguaguuuagauaguuuucauaauguuuauguaacaauagccugugugaaguuaagacuaaacaaauuaaauuuucugcaagauauuuauacuaagcauccaguuuuugauuggugaauuuaucauggcagguuugaauauacaaaucucguacacuuuguguuuccagcuuuauugacauauauuugacaagugaaauacacuuagguucuauaauguggugucgugaugcuuguguuguggugagaucgucacaacccagacgauuaacauguccaucaccucagacagguucacugggaagacugaagguacauucuaagcucagaaagaacuaaaauacuagcagggcuagagagauggcucagcaguuaagagcacuggcugcucuuccagaggacccagguucaauucccagcacucacuuggcagaucacacuagucuguaaguccaguuccaggguugcugaggcauuuauauauauauaauaaauauauaauaucaaaauaugugauaaauugugugaauauauauacacauacacacacacauauucauugucauagaauuauccuugcucacaaugagaauaaaaacuacuuuuaaacacuuagauugaaaggauuuucucuuguuuugaaagguuauuccugugauauccaggaaaaacacauuuuuaccuaauuagcgcauauauucaaggacuguuuucagacugccuaugcucugacaacccugcccuccaccuuuacugucaugggaagaucaucuguccugaguggcugugagugacaggacaguugugcagcuucag

SEQ ID NO: 7243 - RNA, 2617 nt, Mus musculus
gucuaaaagcaaaggaagaaaugaccccugggacuuagcuuaaugguagaguucuuguuuaguggcaucuuaaaagaaaugaaguagauaaaagguaugcuuucuuacuaugagcaugcuugaaaugcucggauaaccaagagaacccuuuuauuuaacuaaccugcuccccuuuccugcugccucugugacagaaaccccugcagccugccuuucuccccggcaguuauccacuuuccucuauccaccgccuacaucuccuacagcauggauaccaacccaacgccaccccuacacacacacacacacacacacacacacacacacacacacacaauuccagguguugagcugagaaaguccucuguuuaucucccacaccugugugauuauacaccccuaaacuuuagggagcuaguuucauuugcugcuaaacaaguaauuaaacuacaccugaauuuguagcuguuaccuguuauauauaaaaauaauacauaaauggaaaggcucgggagggguuguaagcuggagcagcagcagaaaucacuaccuuggcaggaacauccucuguacuggguucaggugggcacaacucuucagcccuaacucuugaaacucuggguugacagaagggccaacagccuacauuuugacaaccucucaggccuugugauguaaacagacucacuccagggaggagugguccuuuccuaccguuugccccucauuucccagacuagacauucucuagaagagagugggaacagggggguucagggacagcuguaaaacucacuuugucacacacuuuaugcaaaaagcuuuggccuggucucuaggaacuucauuguucuccuuaugaaagaggaagucaggguuagggcuagccagugacucaaucuuaaaagccacccuuaagaauuucuacauccuccaaaaauaagaccuagagaugucagagaaaaaaacaacuuguccacguguggauggauggcucugacugccuucgugccaagccccuggguggcaguccagagcuacuuggaccacuuaauggcucacuccagccuugauaaagccaaauaaacaaggaaaaaaaauauuagcuguaaaugucagagagguacagcaaaaacagcuugguacucuuuuaguuacgugauccagauucuuuuaacggcugugucauucuaaccaaaauuuuaaagggugcagaaaccagucauuagguugcuagagaauauuucacacagcauguuaauuuauugcacacucguguguauguguguguguguguguguguguguguuagccugguuacaacuaagacucagacacaguccugucagccauuucucaacccacccucagcgcuuugagcuuagcaguauuguaguauugccauuuugaagcagacaguuuuaggagagaaagggcuaccucacaccuugcaagguuuuaagcagccaucccuggccucuacugacuccuucucccaugauuuugacaauaacaaauauccccaggucuuacuaaaugacuccuguauuuuucaaggaauuuuaagcaaagauguuucuaagaaauuauugggggucagguagauuguauuugagaggaaauuaugugguccauucaaccacagcuuugcuuuauaggacucaaaguugucaggguaaaauauacaucucauaaaugguagaucacaaaaugugaucuuaagaaccugaguggcuucuugcauggccaccacacgacagcaacacagugacacagucuaauaaagaaaugggacucacuuaaaagucacacagcacucauuguagcagcaagcuaugaccgucuaacugggcagaugccuuucuaguuagcaguguuauuuuuacacgacagugaaacuugccucuuuaacugugaagaauaaagacaacuaggccaauuuacucuagucaccucagugauuauuccugauacauagcugaacccgacaugugaaaaucucacuaagauuucauugaacagaaggcaggauucucagcugagcucccucaucuaucuccaugcacacagagaacaacucuacacacaaaagggacucacccuucauguacuuucaggaagggcggagccaucagcaggaaaaacauccagaggcaaaagauaaacauggggggaaaguuggaaguacaauauuuacuacuuuaaaguauaaagacauagccauuguguaaauauauagauuguauuguuuguacuugauuuuggcaaaggaagccgagacguaaauguauauauugcacagcuguauuagaauugucuauuuuuuaaagaggaaacuguccuauuucucaacugauaaguacuccugguaagauguaauauuugcugguuuuaauuaaaugugucuugucauuuuucucuccaccaaaaguauauaagauggauguauuuccuuguguaucaacuuagugaauuuaucugacuucuuaaaaacaaucaaacuguaguaauugacauaaagaaaagcccaagagccagacagaaacguuuuauuuaacuguaaaucauccuuuucauacccuguuguuaaguaucauuaaaaguguuuugacaguac

SEQ ID NO: 7244 - RNA, 3111 nt, Mus musculus
acugaauggcagccauugguugccaaggacuguguuuuuccauagcaacuucucuaccgaacauaccaccaguuucacaugaaauuccuauccuguucugccacagugaugagcaaacugaagaagacccaggcccagaccugucucaugucccaggcucagaccugucucauguaccagggacauguucccaucccaauaaaguggcuucuggaaaauuagauguuuaaaauagcauuuuaggcacuucucauucauugcccagaccucccaagcacucuucccccauugcucuucucaaauaaagguuucaggaagacugcauugguacccugucacuaagacaaguacuccuuuugcugcaaaugccaacuucacugaacagaucauucauucagguuuuccaacccaguuuccuauaaugacacuccaaaggguugguguguaguauauuguacuucugagaugcagcauccuuccugaagacguuuacaaccacuugggugacuguucucuguaguucuguggaagaaaugggagggaguuagaccuucggcuacugcucuuaaguauucuacauucucuauccucagccaaaggccaguucuaaaaccugaaggaagggcauuuugcucaagcugaugcugcuuuaaaauugugaccuacaaauuaauugcauauaaaagacuuuaaauguagacacaacuucaaaaugaguacccugggcuccaacuuccaauuggacaguggcccccacagcuccaucuacucagaauccagaaaccaccacuacccauucauucuguacugaaaggaaagucagagcccauugcaaaaggccacaugcaaggcuggguguagcccaguggcugagugcagagcgaacucaugcaaggcccuagguuucagcucaagcaccgcauaaggcgaaagagccugaucaugccaccauuucucaaauggaaguacucugauacaacacuauuuuuaaaaaaaauacacaaauuuccuuugaaaucuuaggagaaaaagcaauggcauuaaacuacagcauugugucuuguuugcuaacgggcgucuuucaucuucguauuaaaacugcacuugaauguagaaguucagaguaagagauuuaaccacaaaccuugaggaagauacagaguagcuuggugagucaggcaugucccaacccuggagcccuaacucaucugaccuagggaauacaggaccccuaaccuauggaaauagaucaucuaacaugaccaaggguaugagcucaaguucagagccuccacuggccugccacagccaaggcucaguucccccaccucagccacacuuaaggagcauuucuuggugaauuuuuuacugcaccaaagaugugcaaggcugaggcucacuuaucacuguugguuuugagaacagcucuguuuguuuacauuguugcuugcauacugcaaacuccacccccaccccaugagacaagacuuccuuuuuuucccucugugcauggccugcaggauuggggugguagaagaugacagggaccagagucuguuugcagcccuccucccuucuuccaccaggagaugcuuugaucuggggcuuccucagcaggguugucccaugccacaugccucuuguggcugauuaggcuaguguccccuuauaguuugugaccaaagacucagaaaucccucacuuaucccaggaagggaaucaugacuauaaagcaggggccaaggacacucagcacugugacuacauuuggcguuuguguuuuaagguccaggucuaaagaaaggagugugggguuuagaggcucuuauaccaccguuggaggcuggauaucugaucuuucauguguuugaccuaugcauauaaacuaagaacaaaaaucuuaaaaaaaaaaaaauuccgaaggcaucagagugaaaacccacuguguucaugaguaaucccuggagauacugucuauccccaccucuguauucuaagaggcagagagagauggaguugagagagcagaggagaggggacaggaguauuguucuucucuuccuccuuagagcaaccacagcaagggaagccaucacacguagauucaauguaacaugauaacuuaagcuuugauacauauacaagaaucugggguagacaaggacucaaaacuccuaucugauuucuaacagcguaaucuaugaaaauggccaaagccuccugagaccaccuguguuccacccacagcagucccaaauguacuuggcacuguggagcaaaaguagcucuuacuuaugagcuaccccaggcuaagugucugggcuuaacacaccccagccuuauaugaaaaccagugucugaaacacuuuggagauucugaauucuagagccgguccacaaaggagauccugguggucagccuuuggaucugagaagccagcugcccucacucaggaagcagcagguccuggcugcaggaaacaugcagggauguucugcuguguguuacuacugugaagcuguccugauuguuaauaggcagugugcacuccguauccauuuuuugaaaaaaaaaaaaaaaaaaaaaaagaagaaguacauugcauuuaggaauuacuucccuggagcaucgguuucacuuccggcuccccauuccgcaucgccuaaaugaagguaucauauugcucauuuugcuaacuuaccucaagcucaucaaagggacgacguaaggguaugugcguagacuuaguagaaaaugauuaggugaaagaaaaaaaugcucuguugacauucaagaacaaagaagcacaacccuucccauagaaauuccuaggauuggcugccaggggacagcauuugagagguauaauuagaauuagcugagugugugaaagagucuuuugaaugcgcuguguacgccauauccugcacacuguccugaggucaaagguuugauauuuuuguauaauuccuucuuaucuuguacacccacugugugauuuacgucaagguaaaugaacauccuguuuuaugucuuaaauaaaaaaaaaaagaugucucaaagaaaaaaaugugauuacuguuauuugaaauacagauuuucuccaaaau

SEQ ID NO: 7245 - RNA, 960 nt, Mus musculus
uaacugguccuggagcaaaacuuauuugacgcuugagacauauuuccuugguacagcaauugcuaaccauguaaaaggcucuaguuucacccacagaaucacacacagacacacaugucuuugacacaggaggaugcuguuuaacuuggcucccagauguacuuuagaugauuuuuuccauuuaagucuguggcauugugagaguccacauuaaacuauuuuaauuuuuccuuacaguaucucuagacuucaagucuuucuucacugccaauuguaaacauauucucauaacuccaugaucuauucaaauuuuagaaaguauuucaggauagauaaauuauauaguguggcuaccaacacacaguguuaugacaggaugaauuuuagacccuauccucaugaccauaaaucaaaauauucuguagucucauccuaagauuuuggaaaugguccaagcuaaauugcuuuuguugaagguaccuugucaagcuaaugugugugcucauagaaaaggaaaugaauccaauagcuauggauuaaggucuuuguaagggaaagccuccuagcagugccgcacauuguacacgagacugcaugcugcaucacuugaaugugaauugaacgaugaucccuaaaauuuaccauuaaucucuuugacauuccacaaaucauaagauuuugguugaucuugacguucuucagaacauuuugucuauuacucaauaaaaaguguuucauggggauuugcaagccaacuuuccuuaggagcucugugcuuauaugugacuccaucuuaucucagcagcagcaacagucuccaaagcaaaucuuuuucugaaagcagacuggcaaccuucgguucaccggaggcauuccuggaaugagaagucaugacagcagcaugacugagucacagccgccucuucaggcauaauaccuguccucugccuuucucuuucu

SEQ ID NO: 7246 - RNA, 474 nt, Mus musculus
agcuuccuuuuccucuucuggggacguugcucagaggcacucaggaugguccagcguuugacauacugcuguaggcuuuccuacaacacagccucuaacaaaacuaggcugucucgaaccccuggcaacaggauuguuuaccucuacaccaagaagguugggaaagcaccuaaauccgcauguggcgugugcccaggcagacuucgagggguucgugcugugcgacccaaaguccuuaugagauugucuaagacacagaagcaagucagcagggccuauggcagcuccaugugugccaaguguauccgugacaggaucaagggggcuuuccuuauugaggagcagaaaaucguugugaaaguguugaaggcacaagcacagagucagaaagcaaaauagauaugcacauuuuuuaaguaauaaaaaucaagacuugaucuaaaaaaagaaaagaaaagaaaagaaaagaaauua

SEQ ID NO: 7247 - RNA, 3718 nt, Mus musculus
cauuuguuuauccuuaacucauguuuaguuugacaagcucaucuugaugcuggcagggcaacaguauaaguagccuuuaaaucaaaggauuuaaaacaguguaacugugacuggauacauacaaaacccaaagaaguaacuuuaagaaguuuaaagaggauucaucuauucccuuugccaccacuauuuaaguugaaauaguuuucaugagaaaaauaagcuaccaggagguaaaaugaucugaaauacuuauguaauacucugaaauguuaacaggcaucugugcuauuuauuauucuaagaaagauaaguuaucucaguaacuuggaguagaaaaaguugucaaauauuuaaguucauuuuuggcccuucagauucucucuggaguacuucuggaaaaauuauuccaucacuguuagaugacaauggaaugcuucuauuaacuagcuucacgguauugaagaguggauugucugaggaccaauuguaaauugaauguaaaagaaacaaaggcugaagcaggaaaacuaucugaguuuauaaaguggacaccugggaaauucuguuaacuuuuucaauagaugggauuuucaguguaauaauuagauuuaaugauuccauaaacuuuccagauaaucuuaaauuuguuuuacguuaaaauauauuuccuucugacauccguuuuccccuagcuaguuaguccuucgggcucaaaccuaaaauuguuuacgcucuuuucuuccuuauuuugcuggcuauuaauaccuguuccucucacucuccuaaucuuucauuaauccucagggccucucccaccucgccuucaccagcugcaaggcuauggucuagguuucccuaccuuagccucguccauaccuccauuuuucauggugcuucuccaucuuucuuuuuaaacacaaaagacucacacugaugucucaggucaggccaaaccuuaugcagcucauuuuugccauuucuuagaacuacgcuuccccuggucaccauuugccuuccauugucuugaguuagcccagaaucugucucugaugcucccccccauccugcuuacucagcauguucaggcuuagaggaaauucugauuaucaguggggcagcucaaacccauguuuuuuuugugguugaucuccuuccuggauucugacuuuuagugcuggguacaacagggaaaguguuacaggugucauacaaugucuuuggaggagugugaagcuuagauuuuuaaagaaucacuuauaccuauuuuuaggaaacuaauuuuaauuaugacauuuaggauugcaaauaaaauauggaaaagcagguuguguuaagcccuucaagugugguacaggguacaccacacacauucucugguggguuuuuguuucuauugcccuuaaagucccauggccacuguguaugucacacauaaacccaauuuuuaccuuuucucuaguaagguaacaaauuggcucuaauuauacaggauuuuagugguuauauuucuugguaugggaaguugagauccggcauuugugcucgguccacuaauaucuuuccaucccccaaguuuuguacagcaccucagaauucauuucagaauuuaauauuaucagcagcaugucacaaaagguuuuaauauauuuugaucauccaaagcauacuucguauccaacugaucuguagaagaagauacccugucaugucuaccaguuugcuccugguccucaucuuuaagacacuuaauuccccccaccccaauuccuugcuacuaaacuuccccauaugaaaaugaaucuuucuaaucuuccgaaugggugaaaauaggaagacuugaucacguugggauuuuaaguuacacauauuuacacacuuacgacuuuagugccagcuuauuaccuaugaauuuauucuacucucucaucaagagaaagaccugaagcuaugugccccuucuuccuuuguucugaaccuagauaaugacacguucuauuaaucaaguuccccauuaacggugacccuccuauuguugaguccuggucccugacauuuguuguaugugccaugugcuaggcacucacucacugugaaacgugcuuagaaguguuucguugaauccucaguccaucucaugacauaaagacuugcuuucucuuuuucauccauacgcaauuccaaguuuagcgacguugagaaaauuguccaagcugccccgaugcacaugaucagaacugaaauccacauuuggccucagcugacuugaccuacguuguucaacugcucugaacugauaauuuauuacuuccuagaaaaugaggauauuaucaauuaucuuuugucuuuuagguagccagucauagcacaagauccauaaucuuacuguaguuggggagaccgcccugcaccccccacccccuuuacccauuccuguggccccacgauggugcuggggaaugaacaccaauuuaggacuuuuuuucuggcuugauuugucaguaguaagcaugaauauaacauuuaucauccacacacugaaaaugaaaggggauacuauauacagcuucacugagauguggagaguggccccuccggucucacauuuagcccauggcgaggagcuggcuucucuguggaugcucucacagugcugcagcaaacuggaaugauugauggcaaucagcuuucauggaaauaacugacuguagguaaggcagggaaaucaccaauuucaguaaaugucaggugagugccaccauggcgaagugccuauaauggcaucauuugcccagcuucaaguuuuauuuaaguaucuucggaugacaggguuugcuggcauucggaaagugggaugcacgggauguaagagagaagcuggcggagaacauuccgcuuuugcugcuguguggacgaacuggcugauuccuuggauuuguguaucuucugguucauugcuguaguagcugugagugagugugagugaguaugugugugugugagugugugugugugugagugugugugagugagugagugugagugagugugugugugagugagugugugagugaguguguguguguguguguguguguguguguguguccagaaagucaagaauggcagauuaugccuuuacuacaaaaguuaacugugugugaaagucacguacaaauaaaaugggcacaaguacuuuuaauuccacgaaugauuuauagucuguauuucuuacuccuuugcaccucagugggaaccuguuauggaaaccuguuuauagacuguuggauauauauauauauauauacuuguuuuaaggcauuuucaagaagaauuacuuauauaauuuucauuucagaaugauaucacaaauuauuuuucuaaaguuuauuuaagaaacaugaaaauauuagauuuauuacauauauaauuaaugauaaugcuauuuaauguuaaaaaaaaagaauagcugcuuauauuuucuaccuuuuaaaauagauauuuaagcauguuuaguuuuacuuaagucaaggaccauuaauuauaucuuuuaaaaguuguguuucuuuuacauguguguuuagguucuugucacugacuuucuauauuauguaaauggcacacaauuaucaauacaggagcacugugaaaauguccguguugcauacagauuuaauguacaauuaagcucaauaaaauauacucuguggguuaaaaguuu

SEQ ID NO: 7248 - RNA, 740 nt, Mus musculus
auagaacgcacacacaaaaggagccccgaggcauauaccgcauuccuucuccgucagucuccugcaggagccucugcgccccacuugcuagacacagccgaccccgccccccugcugcucucucucggguccccuucgccgagggaccggggaucugcgcuggcugcccgccuuuuccagcagccccuaggcgcugcagggcugguuggcucaccuggaccggcaggcgggacagauggcgaccccgggcugcgagcaaacgccacgccgagcuagcagacccgggguuggcccgcggcguugugccuccaacccggaagaacagccccaacuuugaggcggcggcggcgaccacgugacacagggcugccuagacccggacccgcgcccccuuucggcaccccuucucccccuccccgagccuccugccaaacccgcuuggcccgaucgccagucugcaaaggagaaaaagacuccaccagaugcacgcuuacagcgcagcagcugguccccuccggguggccgcugaagccccuuugucucugccagggccccaggcccgcagccccgcccccuugcucuugcucaaucggccucugucaaucaaacccgaugccaagcacugcaacucaaguuuuuaggaauucguaccucuucuuuccccccaggagacuaaguuacaaagugugauuuccucaccggucucccagcagagcaaauaaacggauacuauaacucca

SEQ ID NO: 7249 - RNA, 740 nt, Mus musculus
uggaguuauaguauccguuuauuugcucugcugggagaccggugaggaaaucacacuuuguaacuuagucuccuggggggaaagaagagguacgaauuccuaaaaacuugaguugcagugcuuggcaucggguuugauugacagaggccgauugagcaagagcaagggggcggggcugcgggccuggggcccuggcagagacaaaggggcuucagcggccacccggaggggaccagcugcugcgcuguaagcgugcaucugguggagucuuuuucuccuuugcagacuggcgaucgggccaagcggguuuggcaggaggcucggggagggggagaaggggugccgaaagggggcgcggguccgggucuaggcagcccugugucacguggucgccgccgccgccucaaaguuggggcuguucuuccggguuggaggcacaacgccgcgggccaaccccgggucugcuagcucggcguggcguuugcucgcagcccggggucgccaucugucccgccugccgguccaggugagccaaccagcccugcagcgccuaggggcugcuggaaaaggcgggcagccagcgcagauccccggucccucggcgaaggggacccgagagagagcagcaggggggcggggucggcugugucuagcaaguggggcgcagaggcuccugcaggagacugacggagaaggaaugcgguauaugccucggggcuccuuuugugugugcguucuau

SEQ ID NO: 7250 - RNA, 31726 nt, Mus musculus
cacuuuucuccggagggaccagcgaggaggucggaguggcccgguaagcgucgccccucgcccacgacggucccucagcccgacccccgagagcccagacccccgaacgcggccgucagcggagccgccugcggguccggacgccgcucguccaagcggcggggcgaagccggggcucgcccuccagccaucggcgaacgcgagcgggcgggagggcggccgugcccggggccuccgggccgcggggggccgcugugacccgccucggccccaccgcgccgcgggcgggcggggggagcgggacuuaagggagagcguccggcagccgaagggagccggggaggcgggcgcugugcugcggcgcgucggcggggcccggggcgcggaggaccgagcagggagcgccggccuccuccaugaggccugagugaggcgcggcggugacaggcggcccgcggcgccucccgcguguccuagccggaacugcggcggcggcggcggcggcggcggcggccccgguuggagagacaggagcaugucggacaguuucgaucgggcuccaggugcuggucggggccggagccggggccuguuccugggccgcggagggggcgggccugagggcggcggguucccgaacggagcggggccugcggagcggucgcagcaccagucgccgccgccgccgcagcccaaagccccgggcuuccugcagccgccgccgcugcgccagcccaggaccgccccgccgccaggggcccagagcgaggcccccgccggcuccgcgcggccuccccggccuggggcgcucccagguacggagcagcucgaggggccccggggcuccugggccagcuuuuccccgcgggccuucgcgcacgccgagccccggcgcgccgaauccgcccccugcuucuccgaaagcaucccccgaggggcccgcucggcacgggguagggacuagccaggaaccggguuuggaaggaggugguggcuggaauccuuugugcgcuccggcugggggaggggccggggcccggggcucgguucucggucuggcgucccgggaggaagucagaaucgccuaccucccccuagugaacccgggccccaggcgagcauccacuucuuaaccaacuccuuacgagagagagagagagagagagagagagggagagagagagagagagagagagagagagggagagagagagagagggagagagggagagagagagagagagagagagggagggagcgggggaaggggugggaaaagcccuggaagcuucguuuuuggaggcagguacgugcacucaugaaccaaagcaaggcuauuguucgguuuugcaagcucuuuguacgaucuuacguuguuuuguuuuguuuuuaacuccuaaaaucgaaguucucagacgguuucuaaaucuguaguaaguugcuauauacaaaggaaugaauacaucuagcacuguuuguuucuuucuuucuuccuuccuuccuuucuuucuuucuuucucucucucucucucucuuuuuucuuuugccuuuuucuuucucagaacaaacgaagccccagagagcuccaccuaguucacaggauaaaaucccacagcagaacucggagucagcaauggcuaagccccaggugguuguggcuccuguguuaaugucuaagcugucugcgaacgcccccgaauuuuacccaucagguuauucuucuaauuauacagugaguacuuuuuuuuuuaaaaccuccuacaagucuuguguuaaaacuauuagaauaaagugguuuuucuuuucacuagaguaugcuggcugcuuucaguacuacacacagaaauaucuuauucagcgaagucaugauucaagaauauaauuugcagauaugugugagauacuggaauguaagcuugugagucuaggaauucuccccgguucguuucacuguuguguuccuaguacuuagaaagaauauauaagauagcaaaccugguaugaaaagcccauugucaagcauauuuucaauuuauaaaacuaaaauccacuucugaaucuucuagauaaccuauacagugagcagccaggaaagguuccuuuaauuugauuuuagucacauugcaaaauauuucuccuguguguccuugaaguaaauagaugugcuguaaauaggaaguauccugaauauugaguguuuguccauuauuuuuaaaacaauguuuuuguugcggguuacauguaauaugcagaaauguuguaaacuuuuuuuuugguugauugggucuuacugucuuuauuuuguuguuguuguuguuguugcugucauucuguuuggauugaggcaggcaaggcaguuaguuguccugccucagcccuccaaaccuggaauuacagguauaacgucucuaugcuuaauauguaagcaauucuggcaaagcguuuacauaaguauaauaugcauaggcuuaaagaacuuuccacacuuuaaaucuuugccaauaaugcagcaaaucuuaauuaguccuaguuuucauauuagcaggaagcgcguaacacaugguugaaauguguaggaagaaauuuguugugcuuguugaacucaggugagucagugcauagagauuaacauuagaaaggagagggaauaauaguggugaauugaaaagaggauugguaauaauaccuuagcucgaagugucucucucucucucucucucucucucucucucucucucugauuuacuggauaacaccauaugaacaaggcucagcucaaaguuaccacucaagacaaguaugacagccaaauagaaaaguaucaacauccgauaagccucaugcaucccuagaacgaucacucaugcccaaggguaaccuaagcuuuguuuuguuucguuagauaguuuugaucuguauuccuaguuauccuugaacuugauauccuccuccuaccucagccucuccugugcuggccuguucccaggauuugcgugaguacuggcucaccauuuggacauacaaaguauuuuuucaaagcuuauauaagugaaguuuuuuagauuguuguucuaacucuaugucuaaauuuauaucauaacauaauaauuugagauaauuuauucacaucacuuaacugugucaagguuccauuugcuuaucaauugagagcuucuacuuuggggcuauugugcugucucugucuguauccugacugacauagccuuuauuucuucuugguauggaaaaguagaauugcaguagccaaccuuaauagaaucagccauugucucuaagaagaccuucccagucuacauuccucacugugucugauuugcuacuugcuguucuuucuagccagcacuuguuauuuuucuguuuagccaucccaguaguuauggucucuuaaaguuaaugacuacacaccucuugcaaucuguuuuugguucucuuuauguuugaucaguguggagacugcauuuuguagagauagaugcuccauucaucuuuuagcuuuggaaugagacagaggacaguaugaauguggcagggagaacaguugauguggagaagaaagccauugucaggaaaaggaaauaagaguggcuuggcauguugucaaaguuguacuuggcucagaaagggaaggaaccauuaaauagcuugaguaguugaauaaacucuuaugauuauuuacuuuuuagcaacucaaccagcuacccauguauuuuccuccuguugccguggacuuuuaucaugggagcaaaacaguuuuggguuuuuuuuguuuuuccuuuucaaaguccugaguaaaguucaaauuauaaguacauuuguuugugacuaugugcaggugagugcauuugucugagcaggccagauaggccuuggagcuggauguacaagaugguugugaauggccaguguggaugcuaggaaaggaguugggucuucugcaggaguggcacaugcuccuuuuuucccccuuuaaugacuuauuuuuaugugaauuaguuuuuggccugcauauauguuugugugaagguguuggauccucuggaacuggaauuauauaugacagcugugauccgccauguggauauuggaaauugaaccccaguuucuggaagaucagccaguacucuuaaccacugagcaaucccuccaauccuguguuacaugcucuuagccaccaagcuaucuucgcuaccccuccaccacuuccuuugaaucaguauuuuauuuuaagaguucuuugguauauuuauuagugcaguaaucucucuauuuaguguaccaaaacaaauuaugaacuagaaguuucuuuggcccugucugaccuuuuguuuuaaagauuguuuuaauuaguugccaacauuuaaauuggauauugaaaagccuauguuuccuaguuucuguccaaugauaagaaauagccauaguggacugggauucugaaagcaaaauugguugaagcauaaugggagcauaauuacaguuucuucccugcaugugacuucuuuguuguaauucuccugaauuucauggauaaguaagugcuugggcuugcuacucugccccaguacauuuucucaaccuuacuaauuuacacuaguauuuacuccuaguccagguuaaauguuuuucaguccauuuagaacagaacaagggaauucucauuuguccgagcucuucggauaaguuccuauaagggagucuuuucuguauaauagccauguuccaaagaaagcuagauucacacguucaaccuauaguucaauacuuaugcugggucaagcacuggucauaguguacaaagcagagaaauggucuuuauggacgcucuucucuagaaaucuuccuguuuccagaaaucccuugaauauguucuuuuauacauaauugguucagugagaugaccccacaguaaagguauuugcugccaaucuaaguucaguuccuggaacccacaugauggagagaaccaacucucacaaguuguccucugacuuucacgcauagaugcacccacaaaugugcacacgugcaugcacauaguaaaccuuuauggugguuuuugcugugccuuuuugguuccauuaaaacucugugcucuuaaucuuaagucuuuccucuaguucugcugcuagaauuuccucuccuuuauacuaucuuagcaaguuacuguguccaucucuuuguggugcuucuuagacaaauuaauaugacuaugaauauuuaaucauaacuuacuuaccaguaaaaagauucuauauaggaucucaucaagcacuuguuaagagaugaaaauguuaguguugaucaccauaccaucaccaucaaaaaagcuuuuuuuuuucccuaaaaguaucuuccuucaaguuacuguggccuuuuuuucucucucuuaaaaauuaucauugguacuauguaaugcucagugagugcaaaucucugcagcugaucccucuagguauguugguaauauaaugaugcuucucuguuuuugaaauauguagucaucuuaaccugccuucacuuuaggccccaacacaguauaauaaucuguucaguuuaaaagacugugcuaugcccuguaguauaugucaaaguuaccuuuuguagccuuuaauaaaaucucuuuuauaauuauauuagaaguacauucauucuuuuuuguuuguuuguuuugcuuuucgagacaggguuucucuguauagcccuggcuguccuggaacucacuuuguagaccaggcuggccucgaacucagaaaucugcuugccucugccucccgagugcugggauuaaaggugugcgccaccacacccgggcuagaaguacauucuuaauauuacuaguuuuguucugucuuuguguauaaucuccuuuacuuccaagacuuugcaaucaacauccuuuuuuuagaguuucgccuauagccugacacugaacgccccuuuccucacuucccugcccuuugaguucagaguugauauuucuccaucauccuucucagagcauagccucuaaugcuuuccacuuuacuaccuccuuugugaguccugccugcucccagauucggauacucacuuucucauguacaaauaacccuuagaucucauucuuuagaacuccaggcuuuuuagcuccauuuuuuucuuuuaacuucauaaggaucucacguuuaaauuaaaguauaaaacaauuaucuucucuagaucuuuuuuucugacaagguuugggcagaaacguaguuguguugacuccccaccccauccucccgugguuuaguucaguuaaccuaaguagucugaauuacuccacacacagugucagucucugcucaggucccuccccauugccugggauuagguucuccuaacagagcagugcagaguaacuaucuucaugacaguuagaguugugaauucguggucccucaucaucuccugccauagaauucuaagaaaaacuaagcuugaaaaauuauucuucaccuagaaguuagugucugcguguugaagacagaaggauccucugaaaaggugcuagggaagugcugcaggcuuugacucaagcaugcgagggacccuuuguugaggaucuagucccuccucugcucuguaugcaggcagcugugcuuuacuuaccagacuugaguucuauuuuagagaguuguucugacuuuauaugaagcugaaauaguggacacuguaaacuaugcuuuuguugcagugaaugacauuugauagaaaaauaaguugcuucagccaauguuuucagacuccuugucauuauguuaauaagauucuuuugagucuuuaaaacuagucauauacaccaaaacuuuauuaauucugaaaugcugacauagguaauacacauauuaguauguauguuuuuaugcuuaacugcuuuuacaacuuuucaauaaaguaggaguauuuauaauaugaacauguuuuuacuccagauguguuguuaaauuauuuagcuuugcagaaauguuaggucuguacaaauaaauccuuuucuucuucuucuuuucuuuuuuuuuuuaaaggauuauauauuuuauuuaacaaauuaucuugggacuguuuauggaaggauggauauguauauccugccauauauguaaguuauauguuagguauauauaaauucugucuuguuuuucugaguggcuauaugaaagcacauuauauaaauguaauuuaaccaauauuuugcuuauaaauuguuagauauguuucuugguaacaaacacacuuauguaaugucuaauuuguguucuaagauauagguaucuugggaauaguguagaauauaaaaguacaauuuuuaguuagcuuuauuaucauauacaacuuauucaaguugugugcagcuuuucuuuguauaaacuccccccugcguuuaauuagucuccuuagucugccccccaaaaccagccaugaucuaacuuaccagccaccauuccucccucaguccuuugcuuuagcuacugacuuucuuccucaaaaguaucaagccaagucccuuccucuuuggaaccaacacucugcaucugccucugcauaggguaccuuuccaccgauucuggcaaguuagaaggggauuuuguuuugcauguuuugucaguucagguguuaguuccuacuuuaauuguuuuaauaaucuguuuuauuuuauauguauggauguuuugugaacaaguaguauauguggaccacaugcaugccuggugccugcagaggucagaggaaggcauuggacccccaagaacaagaguuacacacaggugguuaugagcugccaugugggugcugggaacuaaacccacauccuccgagacagcaacaagugcucuuaaccacugaacuuuugucugccaacucccagauguucucucucaagacucugucuggccacacuuucuauacuuacuuccacaucugaauguuccuuuuaucaugggauuaugagaagagaacuuuaauuuugcuugcagauauuguaucguagaaguacuuugagcaccuauacaguuuguuacuuagcagguacuccguaugcgguuugauuugagauucagucuuccuguguagucuagacugaccuggaacuacugauccaaucagucuagucuggauuuacuggugugucugucugucugucugccugccucucucucucucucuuuuaauguauguggguacacugucgcugucuucugacacaucagaagagugcauuggaucccauuacagauguuugugagacaccuuggugugucucuugaaaggcuaggggguacagucuuaccagaaagaacaauuccgucacaggaaaguuugaccuugugugcuauuuuuuauacucacugacucuagaacuuauagucuuucauaaacugcuucucuauuuuacuuauuauuucuaauuugaguuuacuuggaaaaggauaaaucucaucaagcaauguaguacuugagcauaacagauaaacuuuagcaugcuuuggauaguauuccaugugaugagagcaagaaggauguuauucuagccuguuauaauuuugcauaauucuaucaagacuccuggcauuaauuacaagguuagcagcugccaaaaauugaauauuucagugggaaaaauaguauuuuaagacuacggauacuaucaagauugguuagaaauugcauaaagcagccagaaagucuccugccauguacguuaugauguaauuuuauacuuaaacauuucaacauguuucuccuucauugggaaucaacaaauagaugacauagcauacuaauuuugggagguauuuuuuucuuucgauauagauguugucuuaaacacauacaagguuauacagaaaagaauaguauaguaaauauuccaggguuggcaauucugguuucuauauguuuuguccuccuuuuuccaucauuuuuacacuugaucuuagccaaaaggccgagaagcgauuuuuccaucauuuuuaaugcaaauuuguaaguaggucuuauuucaucuguaacuagucuuucuuuuuauauugcuuauuauagcgaaguuacuuuaaauuuucucuguuauauuggaacgucugacaggauugaaaagacaauucuuggucuuaaugaaacaucuuuuuuaaaaaccacuuagguuaggaagggagaggaauagcugagugcacuuaaaguuucuguucuuuaaaguuaugggagaucccuaaacaaaacucauuguuagagacaaccucaacuugaagccacugcuugcuuguuuugccgguuauauggauuaaauuguuuuauucuguuuuuguuguuuuguuuuaauuuuugaacuguaggaauccuaugaggaugguugugaggauuacccgacucucucagaauacguucaggauuuucugaaucaucugacagaacagccugguaguuuugaaacagaaauugaacaguuugcagaaacccugaauggaugggucacaacagaugaugcuuugcaagaacuuguggaacuuaucuaccaacagguagguaggcucaagcuggggguggccugguaguuucccuggagcccaagaugugaauauucuuugaaagagacuaggucacugucaguuucauccauacucauuagugcuuuaugguuaauaggagcuuugaagucugccuauaauucgaauaguuaagagaucccaggcuagagccaggcuauaccaucaauuggcuuguauagccacagucuauggaagcuguacuuauggcuuagccaaugcucuguacacacaguuaguagugcagagagggcuuaggcucugacaaggaaaucuacacaagaaucacacaccagcauccacauacucccauuuuguagcaucugaaaguaaaauacacaaaacaguuguaggguuuuccccucuguguuuaaucguguagcauuauugaagaaggggagagaaaaauugagaauuuuugccucacaaaugaguucucuuugaaagccaaagugguguugaggauugaguucaguggccaaguacugaccaggcaaguacagagcccagaauuuaguccucagcacugagauaaauaaaaauaagucagacugcaaaauagucaaacauuaaguuccaaacguuuguucuugucuuggcuuguguauucauaugcuuuugagaaggucucaacuguauuuccggcuggccuggaacucacuaucuaucaccgacuggccucaaacuaauggaaauucugcuucugucuuccaggcuguaggauuugaccaugcccacucuuagguuucguaucuuaauuccuuaaagacuucacaguugauaugucuaugucauacaauauuuagcuucuaucaucacauaaugagcaguggcacaguaauaccguuauaaggguucacuguauuagacagugguaucuuuuuuuuuccccaaaaaacuuuauuuuuaaaauugucuucagugaaauuuuaaaaauuaaggaacuuucuuucuuacuauucccaaagaauucauguauagaagaccauacacaaagauaauacccaagucaucacuguaacuucuaagagguagugucagccuuaguaucaagaugaguaaggcugucuuaaucaguggcauauauagcuuaauucugccacagaaaaccaaagaagaaaaguuagauagccuggagagaaauaagucuuggggcuggaaagauggcucagcgguuaagagcacugacuguccuuccagaggucuugaguucaaaucccagcaaccacaugguagcucacaaccgucuguaaucagaucugaugcccucuucugguguguuugaugacagcuaaaguguauucauccauauauauauauauauauaagacaaaaucuuuaaaaaagaaauaagucuucuugacuaacaauucugauuggaucuccaaauuuuacauuugagaugaugucaaguuuugcauucccagaugcuaaaguuucuuagccaauaaugggaaaagcaaauuucuuuggauuucuauaaggagaaaucaguguuguugguguuuuuccugaaaugaaccaaaugugauagcaaaaaaaaaaaaacaaaacagaaaacccuagaaauaaaaaaguauaauuauaaagcacuugcuauguuucuaauaaugcuaagcauucuacaaauaaucuagcucuguggcugacagugucacucuucuguauacuuuauacccuguagcucaguggcugacagugucacucuucuguauacuuuauacauccugagcagagaugcuuacgugacuuggucuguuguaguaaauucaucuggaagaggcuagaggggcuucagcccaacuguuagacugggaucuaugaucgauuaccuuugugaccuuagucaggcuucuuaacaccccaguguguauuuuccuuucucccaugagguggugaacuauguugucugcuguucucuaaaaucugcaacugacgucaggucucuuaggugcuguuuucacuacgucacauucucuuccagauggaguauauucugguuaucuguuuuuuucauucucuuuuuaaguggcuucguuguuuugauuuucuuuuuauuccaaguguuuugagaugucauaccaggacuguuaaucacuuuugugugucagacugaagcucagggagguuuuaguaguggccaacgucaccaagcagaaaacuugggugucuuguggacuugcuaggucccaaagugugugcucuuacccugagaagcaacacugaucaauaguuugguuucucuuuuucaucuuucauaauuguuaccaaguaacuuucuacaaaucuguauuuucagcaaaaagggguuaaaaugaagacauuuucuaauuguuuucugguaaccucagguaaaugaggaaucggagaaguugccuuaaacauuuuucuuuguacugugguucuuaguauaaggauaggugggagaauuaauuuccuuaugccuaacaaaaaccucuuuuuuuaaauauacuauauaguuaauuuugguagccaaaaugguuuccuccauaaaauauugcuaaguguuugaauugaugauaauguacuuaugucauacaaaauuuuucuuuuuaaaaggccacgucuaucccaaauuucucuuacaugggagcucgccuguguaauuaccugucccaucaucugacaauuaguccacagaguggcaacuuccgccaauugcuacuucaaaggucagugugaacauaaauuacacauaauaaaauuugaccauugauacuuucuaaagaccuuaugauacagagaguuccaggggaacauaggcaaaccagacuaaucuccaaaauauuuaaaccuuacagucaaguaugucaguuuuuccuauaauagccuuugcuuuugguuuugaauuuaggaauguguuucccagaaucaucaaaaaugauugcugaugucuucuuaggcacauccguaguuuugguuugagaauuuaaguuagauaaaaaugaucaauuuguuuuuucuugauugauuugaacuacuacuugcaucacacugcauuauuaaacuugagcuuuaaaucuauacuuuucauuauguuccaucugucacuuguucuugucuuucuaauugcuauauaauagcuauuuuaagagcccuaaaauuuuaauuaucuggucuaaauaguucucgauucuugucaaauguucuuugcuguauaccuugcuacaguguaugauuagugcuugaaucacaaaacaguguugguauuuauuacauauuuaagaggugccauugauuaggaaguacaaggggaaaacuaauuuucuuaaagugagugugguagcucauaucugagccaggauugcuuuaaguucaaggcuagccugagauacagacuaaauugcacuccagccuaggcuacagagugagaucuuucucucucucucucucucucucuauauauauauauauauguauauauauauauauauguauauauauauauacauauauauauauauaaacugauuuuguuuuuuaaaacaaauucucaucauuuugagugguccuuagcaauaagauuauuuucauguuuaauaaguuuauuaucagggcuggagagauggcuuagugauuaggaacgcugacuacucucccagagguccugaauucaauucccagcaaucacgugguggcucacaaccaucuguuaugguuuucaaagccaucuucuggugugucugaagagagcaacaguguacucacaucaaauaaaucuuuuuuaaaaauguauuaucacuuguuccguaauucauuauauaucuaauggaaggcuagugugcaaaguccugaguucaguuucuacuggacaugccugcaugugugugcacauacauacaacauucaaaaauaauaacaauaauaguaauaauaaugguuauagaauauuucugaguaagaauucuaaagauagaacuggcuuacaugaaaacagaaaccucauagguccccaacccuaaacaaagaacugcagacaacuaaggaauucugagaguaggaaaaaagucaucuucccuauugucuuaggguuucuuuuacugugaugaaacaccaucgcuaaagcaacuugaggaagaaagaauuuauuuggcuuauguuuucacaucaguuucagcaucaaaggaagucaggacaggaacucaaaauagggcaggaaccuggaggcaggagcugaugaggauggggggaggugcucaucauggcuugcugagcaaguuuauuuauggaaugcagaagauaacucccucccucagggcuggcaccacccacagugggcugagcccugcauaucaaugacuaauuaagacaaugcccuucugcuggaucuuaugaaggcauuucuucaauugugguuccuuucugucagguaacucuagcauguuucaaguugacauaaaauuaucuauuacaccuagggaagagccauugguuaucuacuuaauaccaaguggucaguccaaauaccauaugcauaagaggcuagagaccauauauuugaagggggaaaugguucaugagaggagagagaaggggagaaauaaaugauguacuuauauuuaaauuuaaaaauauuuaaaaguuaaaucauugauaaaggugguacuucaaauacacuuauaaaagaugaauuguguuagcaguuaaguggauaguuauuuauagaaauagaaaaaguagagauggguucuuguccuauaccagauuaguacaucagacuaaaaugagacaacuagggaaaguaauaaguaaacaaaucuuggguugucaaagcuauuuuaagcaagacauuguagaccacaaacuuaaauuuagaaaauuaaauauaaauuacauuuggggaaagucagaauuuauauaaaguaaaauuagaaauuuuagccgggcgugguggugcacgccuuuaaucccagcacucgggaggcagaggcaggugaauuucugaguucgaggccagccuggucuacagaguguguuccaggacagccagggcuauacagagaaacccugucucgggggggaaagaagaagaagaaauuuuauacauagcagugagcucuuuuuaugcauuaguuaaggagcucucuaagaaugaguuuaaaaaaaaaaaaagccuaguggggcuggagggauggcucagcaguuaaaagcaucuggcugcucuuccugaggaccuggguuugauccccagcaccacauggcagcucacagccaucuguaacucuaguccuggccugcuuuucuuuucuucugugagcaacgugcaugcacaugguacacagacauguaggcaaacacccagacacauaaaaacagucaaguuuuaaagaaaaaaaaauucaaauagcucuggauaaauacaguuugggaaaaaaaugacaaaguuacauauacuuuuaaaaacuacuguaauuaaguacaaucugccguaucuggacagagaagguggaauagaagcaggguaugaugccagaaagaccaccuuauucaacuuaucuuugaguuuucuuuguucugaguuuucuuuccaauugugaucuccuacagugcuguaauacuaucaaagacacugauuugaaaaagugcugcuaauaugaaugggaaauagcacaaugcuacccuuaaaaguauaugucuuaguaguuugaaaaggacagagugaaguuacagugguauugcggggaaaucuggucuuuguucuuucaccuuugugaaauaagcacaaguucuuaucauugaaaauagcuucuagagacucagggucuuucaccugggaaaucauccauguauggcaguaaggauuuacuugggcacaucacugugucuuaauaucucauggucuuagaaauuuauaaaagaaaaaaaaucuaucaaauuuaacuacaaaauuguaacgggaaagaaaguagaaaaaaguuuagauaguugaauugucauuagcccuuugauuacuagcccuuccuauguguaucuacuggugagaaauuccuuuaauauauuugagaagauaacaacucuuacugcauuugacucaaaagacaguguuuauuaauuaggcuuuagcuugugauaauuagaauuguaaguuucuuguuauuucacacugaccaggaaauagaggguuucuuugucuuaaaaaagaugaggaggaaaguuguuuuuuuuuguugcuguuuuuaaaaaaaaaggaacuaucauaagcuggcuauuuggaaaacauucaguccagacuucuccuuuguccuuuguaaaaagagaacuaucaacaucaauuuuauaaaacaaaucacuucuacuggcauuucuuacuacuucaucuauuuaaaaagaaagaaaaaacccacuaaaaugaaauccucuaaacauccauuuuaguaauaguagccaacaucauaauuucccucuagacuccacgguagauggauugguguuaguucauaugcuuuggaacugugaguguaauaaacuccaagguuucuguucaucacuacgugaggcaaguggaccaaguuagggaaaaauggagcaagagaaaaucaguuauuugacaccuucgaucuccauuggaaauagagacaaauuaauugcuuuggacuugugguuucaacuggugagaguuugagguaauuaaauuuuaccugugguuugcaguuuuauuagaggucuuaauacuauuuaauuaguauuuuacccucaguauaaucugauaauguaaaaugggaaguauaagaguaauauauuuaguuggauaugguagugcaaaaucuaauuuccagauccugggaagguagaguaggaagauugucauuugagggcucuucuaaguaacauucuaaguucaaggccagccuggaccacuuagcaaaaaaccuaucuaaaaaaaaauuacaaauggcuggggagacagcuuauuguugccugccucauguacccaaggcucagauucggucuccagugucacagaaaaagaaaagagaagagaagagaagagaagaaaagaccuuaaggauuuuuuuuuuuuuuuuuuuuuuuuugagacaggguuucucuguauagcccuggcuguccuggaacucacucuguagaccaggcuggccucaaacucagaaaucagccugccucugccucccgaguguugggauuaaaggugugugccaccacacccgguuuaggauucuuuuuuuuuaacccuucaggugaacuagauauacacauacauucuuauuuaaaaaaaaaagaaagaaagaaagaaagaaaacauuuaaguucuuccuuaguaaaaaaccuauuagacauaauuuuuucuucauauuuuuaguacuagaauguucugaaccuugugaagucuuuauuauugcaaaaaucuaauaguuuuauugcauuuauuccuaucauuuucuuaaaacugcagccuuuggagagguuaggguugucauuguguugccuuuauugcuguggauaaacagacugacaugcaccgucuggucuuacuguugaagagacaaaacaaugagauaauaaaagaugucuucauuaggugcaggacggaguaugaagcuaaagaccaagcugcaaaaggggaugaagugacucgaaaacgauuucaugcauuuguucuguuucugggagaacuauaucuuaaccuggaggugagagcauuucuucuuauuaggacuuaaggcuugaauacauaaaaugcuuccaaagaagggauuuuguucauuuuaacuuugcaacaucaaaaauaaaaugaggaaaaaauugugcaaugaugccaggugauaacugccugcaauccuggcacuuaggggaaauguugaguuuuagauuagucuggguuauguagugaggcccugucaaaguuaaacaaaagugaagggagagaaauaggagagaaagcaaaucuuuucauaucuaauuauauuugaauggaacacugauaacauuuuucucuguucaugagcaggauguuacaaaauaacugaacuuuuaaaagcccuuauguucucaggaagcuaacaugucagcuagauuggcaucacccuuguagccuucuuccuacuguagccucccaagugcuagcuagacuuacaggccuggauaccacacacagcuuucagugcuggguuauucuaaccauaagaggauagauaacauuguaaaagucuuaaguguguuccuuuuucaguuuaauuuguuuguaagauaaguaagaacaccaauuuaaaugugccuuaauuaaauuaagucacguuaagggggcuggaaagauagguacuacucuuguggaagacucagagccaccaugugggugucugacagcugucugcaacucuaguuccagggaauuaaauacucuuuucaggccucuguggacaccacacccgauguccguacaugcauguaggcaaaaacaugcacagaaaauaaaucuuuguuuuuugaagucauguuaaaaugccacuuagagaugugccugaugugcuacuccugcuguaacuuaaugugccaggguagguugguacccaugguggguggggggaccaggaggacuuuccuucucagcggagaagggaagggugggacugggaggagaagagaagagagggagggugcaauugggaugugaaauaaguaaauuggaaaaaagagaaaagaauaccauuccaagcugggugguaguggugcacaauuccagcacucaggaggcagaggcagguggauuucuaugaguuccaaccuggucuacagagugaguuccaagacaccuagggguacacagaaaaccuugucucuaaaaaccaaaacaaaaaaaccacuuagcaucuccuguggaaaugauaagacugcucauucuaugaggaauaugaaagcaaagcacuaguccuacacauaaauuugucuagcaggugaaauugucuuauguaaaaaggggguauuuuaacuuguaugaaaagcaaaauagaauacuuuguuauuaaaauguggugccuuggggcuggaaaaauagcauagugguucagagcauuggcugcuuuucaguuggaccaggguuugauucccagcacccaauugguggcucacaaaugucuguuugaccaguuccguaagauccaacuccuccuuccuggcuuccuuaagcaggaggcacagaaauccauuuaggcaaaacacccaaacacauuuuaaaaaauaaauaaauaaaaacuuaaauuuuuuuugaaacgguagccuaaauuacagcauguuuagugaagcagcaguauugaaguggacuuauuuauguuuuaugugugaugaguaaaaauuaaauuuugccugugauuugcaguuuuauuagaggucuuaauuauguagagaacaauuguacuuaauuugaugaaguuaaauguauuccuguguuuuuuuuuauauauauuugacccaaaugcuuauuuuugcaaccuucaaggcuauuuuuauguguguauauuacauuuuaguauuguugcuuugucuguuuuuuucuccuaaagauuaaaggaacaaauggacaaguuacaagagcagauauucuucagguuggucuucgggaacugcugaaugcucuguuuucuaauccuauggaugacaacuuaauuugugcaguaaaauugcuaaagguugguuuuuguuuuuguuuuuucuuuuucauuuucuuuuuucuuuucuuuuuuuuuuuuuuuaacauuuauuguguagucagaagacagcuuuaggguuuguuucccuauuuuguagauucugagaauugaacucuguuuguaggacuuggcugcaaguuccuuuaccagcugagccaucuuaucagcuuauacucuuuaauuguaacuuuuacccacuugauguguaauuuaaagaaggaaagugggcuggggagauggcucagugguuaggagcacugacuguucuuccagauguccugaguucaauucccagcaaccacaugguggcucacaaccaucuguaaugaaaucugaugcccucuucuggugugucugaagacagcuacaguguacgcacauacauuaaaucaaucaaucaaucaaucaaucagaguuaggguuagguagaagaaggaaaguauguguagugcacaaauucaagauuaaguuuuuaaaguuacauaauuaucuuacauuuggcuuuaaaauaaguuagaaauaauauaguauaguguguuuauaaggauuuaauuuagaaggaaaaauggaaauccuucaccccagcucauuuguaaacucccuucccuuucucuguuuauguuccuuacaaaaauguucuuagucuauuucgguuuuuuuauuuuuggcucccagaugaaauaucuuaaucacuccagagagauuuagcucuguauugaguaacuucuuaguauucuguuguauuuaaauacauuguucauccauuauuuuaauaaaaaugugggcuguuucccauuuggcuacuauagcauugcuaguagucuuucauuaucucuuuacagauaaccuuuuuuuuuuuuaaagauuuauuuauuauuauacauaaguacauuguagcugucuucagacgcaccagaagaggacgucagaucucauuauggaugguugugagccaccaugugauugcugggauuuuaacucaggaccuucggaagagcagucggugcucuuaaccacugagccaucucuccagcucccuacagauacuuuuuaaauuuugaagugauucaaaggguugaugagcauagguauuuuauaucaacaguuaacaucaaaguuugaugaacuacacuauacucccucuaguaaugaaugaguacaccuuucuccauauuccaggggagaauaugauuaguuggguuugucaugaaugaauaauaauaauaauaaaacccucacuauaauuugaaguuaucuaaucaauagucaauuuaaccauucuuucauguguauaagcuauuugauuguuuuugugaauggccuggguuguuuuuuguuguuguugguggugguguuuuguuuuuuauuuguuuguuuguuuguuuuuugagacaggauuucucuguguaacccuggcuguccuggagcucacuuuguagaccaggcugaccuugaacucagauaucagccugccucugccuccugagugcugggauuaaaggcgugcgccaccacgcacagcugaauggccuguuuuuauccuuaauuuuuuuuuuuaaacauugcugggggggggagauauuacuauguagaucuggcuguccuggaauagcucuguagaugaggcuagccuucaaacucacaaagauccaucugccgccuccuccaaaguauugggauuaaagguguguaucaccacagucagcuguugauuuuggugggagaguauguauuucaauuuacaacuuuuaggucauacuccacuguuaauuauuuuuuuaaaaagggauagucaaaccuaaauggccagucuuauuggauaauaauuaugaugugaagcccuauacuuuuauuuucuaauuagucaaagaaaagcagagauagggaugguguagaggucucugauauagauaguaggcagagaauacuuggaaauaccaaaccauuuaauuuucuuuuuuuuuuuaaguuucagcuuuuccuaauauauuuuuaaaauuucuuuacuguauuccuguuuuuacugacaucugugcucuuaguugacaggaucaguuuuagaagauacuuggaaggaaaaggggaaaacugauauggaagaaauaauucagagaauugaaaauguuguccuagaugcaaacugcagcagguaggaaaagcaaguagaucuuggucuucuauuauuuucuuaaucuguauacuucaaagagaaauuaagguuuauagaucaauccaguauuuugucuaugguuucucuaguaaauucuguucaguuauacuuaaaacuaaaaacuuaagauuuucuuugugauaagauaugaugaauucauugagaaauaaaauuauuuagauuuuuuaaacauggacccaguguuuacucagugaacucugccauaaguaauauaagagaccaguguaacucaugaccauauaggcaguaaaguggaauggauuuuaaagauauuguuuuguuuggcuuuuuuucuggaagacagggucucacuguauaguucugucuuuccuuuaacuugcuaaguaggccagacuggccucaaacacacauagaucuaccugccucucccucccaagugcugagauugaaggagugugccacuagggcuggccagcuucaagcuuguuuuguuuuguuuuuccuuuuuuaaaguaaaaauaauacagugaauuaugucauugaaaaugucuagaaauuuaaagcauuggguaccuauguuaaauuaaauaaauugugcauuuuaagucacuggaaauguuauagaaccugauagcauuugcuguagaugcauauuaauuuuuuaaaaacuuuuuaucuguagagauguaaaacagaugcucuugaagcuuguugaacuucgaucaaguaacugggguaggguccaugcaacuucaacauacagagaagcuaccccugaaaaugacccuaauuacuucaugguaugcuaguguuuauauuuuaaguuucacuuaaugcuuuguuuuagucuacgucucuauagcggucauaaaacaccaugaacauggcaacuuaaaaagaaagcauuaauuggaccuauaguuccagaggguuagagucuaugauagagcaaagacacaggcaggaacagcugggagcucuuacuucaguucacauacagaagacagagcacacugggaaugauaguuugagagucuuuuggaaccucacauccugcccccagugacaccuccucuaacaagaccacaccucuuaauccuucccaaacaguuccaccaacuggcaaccaaguaugcaaccauaugagccuguggggacccuucuuguucaaacuaccacaugaugaauucuacuuuggaaacuguuugaauuauauaaagcuauucucauaauucagugcccauuaaauuuuuuauugucauaggagccagcauaucacauaaauaaagagucccuagugaaaaggagacuaaaucaagauucaaccauugucaagaaguagugauaaugcaugggcuugagucagcauuauaaccaaauuccuuuaucucagauguucuguaccgugcagcuucugacauuaccaaauguaaagcagcuacagaggacuacucaaccccaggcguguaaacucuuuaaaaauggcaggauaaaaaaaaaagaaaaagaaacaagaaaauagaacuaaacuaagucaacauuaagucacaguucagccagggagggaucaaacagaacaacagggccuaggacucaagagugugagaugacaaauggaaaucuaagaaccauaugcaugcccaguaaaguguauggguuguugggaaguuaggguguuacuucuuauauaauuugacugcaggugauugaccucaggccauauuacucuaauguauucugaaaggaguaccuauuuuuaucauuuugauuuauccuagaaugaaccaacauuuuauacaucugaugguguuccuuucacugcagcggacccagguauguugucucagucacuuucccauuuuucuuaagugauaaauuacauaagaucacucgucagugcaaaguauguuguuguuuuguuguuguuuugguuuuuugguggguuucauauguucuaaaauuguaggguuaaaauuuguccuauguugauuacuugagacuguuuuuaaguaauuacuuuguaguaucuuguuacuuucccagucaaagauuucauccuuccauuaaguccugccauuuuuauuuuguacuccucuuaguguuuguuuucaucuuaaaauuucagaugacuaggauagaaggcaaagaugauucuaguugacugaauagucaguagcuuacuuaauguuaguauuuauagauugcauuaguaucuacaauucagaguuaauuaaaauccaaaucucugcauaccuucuagaaaaggguuauuuauagaaaaaaaugcaguaguugugacaaguggaacuguaaucugagagcucugguuucguacaaacuacagccagcuauaacugggauuuuugugguuguuuccucuaaguaacaagcauugacugugucccaugcuucuagcaaaaaacgagucucuuuaggaugaggacguagaccuaaguuacagguaugagcaucuucagccucacugagacgaguggggcugcugaacagcuuuggucauuccagaagcaugaucauuccauuuaguuuuccaacccagucuuagaggacuuuuguuuuucauucuuggcaauacuuaucagacauaacuucugucaguccaauucuaugaaauugaauguaguuauuuucauggcuaauaauacuggauuucuccuggguguaagccuuuguuuuguuuuguuuugucuucauuugaaaacugccuguugacuggcuuuuuccccuauuucuguugggucauuuguauuccuaauuugugauuccuuauuacaaagucuagaaaaagcugaucguggucagguauggggcuuaucccuuugugugcuguguggcagucuuuccauuuuguauaugauguauuuucauauacaugcuuugaguuuuaucagucuuguuuuuacuggauuuuacuuaacuauguuuucauuuucuucugaaaaucauguugcuguuuuuucuauuuaaaccuuuaacucaccuaauuuuuacauggagauuauaguagguauuaaauaucuuuccacuguauugucucaccaucagguauuaacuuauuuuuucucucuucauuauauaaguugccuauaguauucugauacuauucauucuuguguauucuuuguuaguauauuugucuuucuucaccaguaguccauucuuaacuauucuuauguaaaucauguuguuucuaauaggacaaaucucuuaaagcuggcuaggacaguuugagcauggaggccaaaccaggaaguugagcacaggaguuugaaaccugccuaggcaacaguagaagacccuuuuguuuguuuguuuuguuuuguuuuguuuuuguuuuuccgagacaggguuucucuguagaccaggcuggccucgaauuuagaaaucuaccugccuugccucccaagugcugggauuaaagaugagcgccaccgcugcccagcuaggaagauccucuuuuacaaaacaauuuaaaaagcuuccuucuucgaguauuuuuuuggaguuaucuuccuucauuugauucuuuggugucuaucuugucaaaguuguucauaauagagauucacgauucacuuugguuuucucaaguuuuuauuauuauuaauuaucauuaccuggacuuuuucaaaguuucaaauccuuuuucucaucauucuauaggcagucguugcuuuucuuaaaccucuauucagaaauuacuucagaauuacacaacaguaacgaaggaggauugcacaaagacugguuuuucccagauauguguuggguacugacuuacucagcucaucuuuuuugccaucuccacaaauuuuguuuucguaaaccacuuggcuugcuaccuucuucaguaugaaugcauagugguuuaaccuuuuguuuucuugauuaaaaaccuguugucccuuugguuuuaggaucucuaccaaaaauaguuuuagaauugcuuuugccaagcacuacaacuuggaaaagguuggaugguuuuuuuguuuguuuguuuuuuguuguuguuguuguuugauugguuuuugucuugaggcuucuuucuuuuuuuuuuuuuuaagauuuauuuauuguauguaugugaguacacacuuuaguuguauagaugguugugagccuucaagugauuguugggaauugaacuuaggaccucugcuugcucuagccaaccccacuugcuccggccaaagauuuacuuauuaguguaaguucacuguagcugucuucaaaugcaccagaagaggguaucagaucucauuaugggugauugugagccaccaugugguugcugggauuugaacucaguaccuuuggaagagcagucggugcucuuacccacugaaccaucuuaccagccugagguuucuuucaaguagaaauucaaagucaauucuguuuuuacaaacucuggauaaaccguuucuccagagugccugacucauuccaaacccaaacauauaacaaaauuuuguuugccacugaggugcuuuucuguucuuuuugguuuuugucuguuuguugcuucucuagguccauucuuuuaagauaucaacccuuagauguuuaugaaugaugagagauagguguaugaguucugacuuccuguucuacacagacccagggcuuugaacacccuaugcauguuuaagugccagaccccuugguggcugaaaccagcacccucugugagccucuaagcugucauauaugugcaucaucuggaguuucuugcagccuccguugauaaaguaaaaagaauaucuuuuauaucuuaccacaagaacuuauagcaggacauuuuuaugcuuaaauuuucucuauucugacaaaauuggaauggcaccaaccccugauguugaguuagaguuuuauaaagacagucuuggaaaaaacuggcccuaacccaguuauauaauaaccuuucaaaacaagaaugaagauuagaagccgggccugguggcgcacgccuuuaaucccagcacucgggagacagaggcaggcagauuucugaguuugaggccagccuggucuacaaagugaguuccaggacagccagggcuauacagagaaacccugucucaaaaaaaaaaaaaaaaaaaaaaaaaaaaaaaaaaaagaaugaagauuagccuguguggugcaagccaguaauccuagcuacucuauagagucaggagguuuaaaagacaggccugggcaucuuaguaagauccuggcccaagauaaaaacuaagccaggaguaguggcacaugccuuaaucccagcaauuggaaggcaaagccugaagugucccugugagcuugaggcccauuuggucuacauaggaaguuucaggacagcuagagcuacauaguaacaaguuaaaaagagagagauugggaguuauccauucaguuguggauuauguuccauaagggagaccuuagguuuacucuuuaguaaccacuguaaaguguacuuaacauuuaaaagaauaguaugucaaaauauuuuaagguuugugagcaugcaacauaacaaaggcaagccaauuaagaauauagguuuuaugaaagcauuuauguaaguuuuacuauuaaagucauuaaguuuauggggguaaaaacugcucauuucauaagauuauauguucuuucuuuuucuguguuuucuuauagauuaccaagaaaaguaucaagaguuacuugaaagagaggacuuuuuuccagauuaugaagaaaauggaacagauuuaucaggggcuggugacccguaaguucacucucuuuuucuuuuuuuuuuuuugguuuuucgagacaggguuucucuguauagcucuggcuguccuggaacucacuuuguagaccaggcuggccuugaacucagaaaucugccugcuucugccuccggagugcuggggcuaaaggcgugcgccaccacgcccggcucauucucuuuuucauuacugauaauuugugcauguguguguguguuaauuuacaugugugcaugcauguggaagagaucggcuagugucagaugucucuuuuagucacuguccacauuauguuaaguuaggcucucuuguuaaacuaggagguaccugacuucacuuagguuggcugacugcaggaauaugccugucucuucuccccagaucugggguuacagucacugaguuacacucagcuuuuuacuugggugguggggagcuaaacucaggucuccaugcuucauagcagcugcucuacucugaacgauccuucucugccccuuauugcucacuuuuuaaaugaagguuuugugcccgaguuuugaauguaaacuaaacuagaagaaaaauuaugaaagaaauggcauuuggaggccagcacgaggcucaguuggcagaacugugugcuucagaagcccgaugaccuguguuugcugucuggaacucccaugucggguggauagaaaaugacuucacaguuguccucugacuuccacguaggcaccucugagugcugcgauuauacaauaguguaccacuaugcugcaauguuuuguaccauuuuaaacuccugguauuugggaacagggccaccuggauaacauaaucucaagaguagcuuucuguuacacaagucuggcuucagauaaugugggaaacugacccgucuuugugagaaauagccuugcagaaaucguagcaggaaaaggucuugauuuuaauuaggcauaaccacuggaaggauaaaacuuuuugaguggaaugauaaaagucauagguaaauucgaaauuauucuaauuaaaguaucuauuaauaagauguaaacuuauauaugucaagccuuuuguuaacuuuuaagugaacauaucuaaaauucuaacaaaauuuuguuuaggagagugcauuuaacaucuccagacauuuuuggauuugaaaagcagcaagguauaugaaucauuuuuuggcuucuuuuauagauauuuggaugauaucgaugaugagauggacccagaaauugaagaagcuuaugaaaaguuuuguuuggaaucagagcgcaagcgaaaacaguaaaguuaaauuugaggauaccaguuuuuuuuuuuuuuuuuuuuuuuuuuuuuuuuuaaaguuuagguauggggauuuagaagaacacaggaaagcaagaaacugugucagacuuauaccaaauuaaggauuuugaguuauguuacuaauguaugcaacuuuaauuuuguuuaacacuaccugccaaaauaaacuuuauucccuguaacuuaaaauguguauauauauauaauaguuuuauuauguacaguuaauucuacuguuuuggcugcaauaaaaucgauuuugaaauaaaugaaauguugaaagaaaauuuugcuagcugguuagaugcuuaucguucaacuucuuuuucuugagguuaaaaagucuuagccuggaaauacauaugacugcaaaaaauguagcauucuuuuuuagauaugacuauuagagcuuuuauuuuaguuuagcauuugauucucuauauauugaguuucaaguacuaaucacaaucaugaaaaucuuuagcaccaaagucuuggaguauauaaacaacuuauuuacuuacguagaugcuauuugauaccaagggcuuuuaaaaugccauuaaugugggguggguggggcuuagaacaccagcuaaggaaccaagauucuucauugaggauuuauuccaacucaagauuuguuuuuugugugcuuugcccgacuaacuucauucccgccauccuacaguauuacucugcguucuucauauggcuuacucauuuuuauuucauugcauggguugcaucgacuuuuuacuagacaguuuuacuaaguauuugucacucaaguuuucaucugcuuuauaauugcuauacugugaggaccacuuuucuaauacuuuuacuauaauguaccaccuuggcccuauuuaaguaauguuuuuaucuaaugucaaaucuuuuuccaacuaacuaaaaauaaacauauaaaaggguugcuuguaaauaugugcauguaaauaguuguguuaaaacucauuguuuuacauuugguacaucugugucugcuuauacacuuaguuuucccacuucugcuuguuuguuuguucagucuguauuaaaauuagaauuugaaaauaaaacuuaguuuguuucuucuaacuuuuuaaaaugguaucuuaaagaauuuuuuuuguuaagcuugccuacaugaaauaaauuaaagguuuaaaaauuagagaaguaacaauaccaaugaauaaaucaguaacauaaaugagccuacaaaauuaacaaauacaguaauuuuuagaauccauguuaaaaguacauguaugcuuuggcauuugucauagaauugcuuuuucugagugcuguaacuugaugacuaccagcacagccugcagucuuggaacaugcuaguuacagcacauuagauaagagagacagagcugcaucuauuuuagacaucuacuggucaguauauaaacauccaguauuugaccacucgccucauugucacuaauuacuguacucaaaaguggcuauccacagaaucuacauguguugguagucugguggcaguucaucugcuuagcaugcagaagaccuaaguuugauuccuagugcucaaguuaaaaaccaccuuaguaggaaaaccagugggcuagugguagugugagcagcuggaagcugucaucguuggagccauccucucucaauggcagugaggacccgagcuacaucuagaccugagcuguugacuagaacguuggcauuuuaccgauggugggcugcugcuuuuuucuuggaccucucagcauuuuggcuggacucagaguggacacaccaaaacaggaagaaacgucauuccgaagcugugcggcaguacugguuuucuugguuuuaaaugagccacuaggucuguguccguaggaggccacugaggaauguguacauaaggucuaaauuuguaacuguguauaaugaguugguccugugucacauugucuuguagaaugugugucuucaccaggcccaaacaugaauguguuguagaaauaguaauacagugcucuucaaugagcacuggcacuguggccaguaacugucagccuugagcuguaacaaaagaaauacugaucuuauucaagcaaucagguuaucaacuccgacucagucuuagcuagaaggcaaaaaccuacucuaucuuccuagacugguuuugucacagugauggagaauguagacuuugggaggaccagagaguucaucugcaagagguugcuagaauuuaaaaucagacagucuuuggguaauucuguaaguaucccauuaaaucuuaccugcaaggaggacagaugaguguagguuuuuuuguuuuuuuuuuuuguuuuuucccaauuagaaaaaguuuugucauuuaaugagaggaggauguuugauagauaaaaaauccuguugauggcugaaagcucauacaaaaguccauuuccuaucagguccugagggcagacgcacacagagcuagcugcaaaguuaacagaacauguauuuauccagucuuaagagcagcucuaaaaugccauagugugcgcaccuuguggaacuauugacuuguuaccagcagcucugcccaugcauugccguuguucaacuauuacugggucaaacucugcuucuucagaggcagcaucuuccccagaccuggcccccuucccuuaggacauccucagagacuuugaucaggaacccuuccucuugggaauuaacaggcuugagccugguggucuuugacuagauuuuagcagauggaaagaauguaagcuuguguaugccucggcccugcuguguugguuuagcaagacugaaccccgugaacgcagcagagccgcauccguuugccuuggguuugguucugguagaugugugccauuguaaguucagcaucccgaugccacuuuguacugcuggugaucauugugcucccuccguccaguuuuaauuggcucuugccuccuuuaaucuuuucauuaucucauuuguuuuagggaaaagcauuagcagucaaauguacacaauuguaucuucuuuaucuucucuccucuacaggaagcauccugaguagauuuuccugccuccucuuucaugaauucuguuacuuaagagugacugggguuucuuuuuguuguuuuucuaaucuggcuuuuuuucccccccacaagcuguucccaugccauuucuuaucaaauaaaaaauuaaaucuguuuuucuaag

SEQ ID NO: 7251 - RNA, 2860 nt, Mus musculus
gaaagaaagagaaagaaaggaaggaaggaaggaaggaaaagaaaagaaaaaagaaaggaaggaaggaagacuguuaucuguccaaggaugucuuuacuuaagaucauucuuuguaucaguauauuuucaagugauggcuaauugaagaguuagauccuguuuucccaaucccuuacugauagcuuugcuuaaagcucuugcacuaaacaaauauuccuaauaaagcuuuuuuguuaguuuguuuuuuaagaaaaaguugccuggagauuuuuaaauuuagaaucagcaaauuucuucgagucuggcuccauccauaaugaccuggccauacuaccucaggccuccuuccucccugaucaugcuucaaccccuuaaagagacaucaucuuucccuuggacugcuuggaguuguaacagagccuugaccuuugcuuguacuuagcaaguaccuauuuaaaacuccagauuuggagcucuggccauauggauaauguccuuguggagagaucugcccccccccccuugcucugagcucacccucauacugagggcaauaggcagcacaaagaggucugcuuuacuaccaagagugucuuguggacagucuauaaucuggaugcaauacuauuuuuaggcagggcaaagccaggaagauggugaagcacaucuuuaaucccagcacuagggagguagaggcagacagaucucugaguucgaggucagcugggucuacagagcgaguuccaagacagccagguuuacacagacccuguuucaaaaacaaacuaaacaaaacaaaacccaaaaaaacucaaaccucagauuuuaguggaaguauuuucucagacucuauucucucauagaucgcuguguuuuuuaguuuaggaacacucauaacuaauagaauauuuuguccccccagucauucuccaauccccauccugaccccagugaauugggcuaauccgcagcguauuuugcugacgucguacgcaugucuaauggcaauagauuaagaauuagaagacauuuucuggcaccucuuaaaacaaguggucuuugucuucgauuacuuuuaaagaauuuuaaagcuccgcuaacaccuauccugugacagugucgccugguaaaacuggucuauaacccuaauccccacggaaacucggcgcuuccgugccgacacugagcacccgauacguggagaccagaguccaacccggaaaaccggucuuuuccggaacugcucuuugcaauggaagaggcgggacuuccggcuucgcuuuuccggagaccgccccuuccucucggugcgggaggcuccaacugcugccucgcuuuguguuuuguuuguuuguguuuuguuuguuuguguuuuguuccucgcgucgccgaugcugccccagaggacuggaccgguguuucaaccgaaacacuucuuguauccguguuuuuccguagaugugauuauuuuucuuccucaagaaaugcuucucgguaguuaauacauuacggaaggaaccguggagaagcgcuacgcaaacagcacaguucgugccacuugagcaaaauagaggucggucggaggccgagguugcccucccuuccaggugcagaacaacuucgcagcccacagccgccggugaguguugcaaguuuggcgguggucuugcugaggguguuuucccgcccccuucucuuuccccggguuuguuuugaaaaaaaaaacgagccuucaacaugcagaggaggguuuucgguucguuaucccccagaccuaacguguugaauggugagagugcaaacgugaauaaaacgaugcaaagcaccaauuugcucuuaaaauaccagguagagcuaugcgugugugcacauacgucucuucgucuguaaucacgguguuugcuuauuggcguugcaaggauuuaaacaagugacguaaagcaguuacuguggucuuaccugugggaaguuaacccgugacggcaauauagagaugcacugaagacagacgaaaugggagaaagauaguuguaguaaauaagaguucagcuuccaacaaaaggagauaaagggccaaauucaagcgagauuuuaaaaagcaauagaaagcuaguuacaggcagaaagcaucgugaugacaguggugucaucaacgcauaucgugaacucaaggggaagaauuuaaauauuuauucuuucuguauuugaugaaaguuuauuuguccaacagcuuucuuugccuaguacuauuugaggucccagugauacauuuguaaauaagacaggagagaucuguuuugucugaguuucuauccuggugggagguacugauaaagucuaugaggacaaaagauauguuaggauagcaauuauggauggaguaguuuagcuuaggugauaaaguugggccuuggugcaagugguauuuguguugagaugugaguucugaugaagaguuugugauaugauaagcaaggagacgacaagcuagacagagagagcagggcaaaguuccugagaugagaaacaccuucuuucaagagcaaucucuacaaagccagugugauuaaaaugaucagaacaagggaauuaggaagugacauuuggagaaaguggugggcuagccuguguggccucugcaggcuguaguguaggacuauugaucuaauucugugugcaaauaacuaggauuaaugggcuccagcuaaagaauggauuuaggggaugcugcagaaaucugcuuuuggugggagugcuuuuguuauaguuuaaucagauucuguuucucuauggaacaaagacauagaagucuaugcugcuaccgguagccugaauugugcguaccuuauuugcauauuua
